United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 26

SEQ ID NO: 106146 - DNA, 468 bp, Glycine max
  Peptide Sequence Number=SeqID_222924
atggaaaccactgcagcaggagcaactagcaatagtttgtatggggattttgaaccttacagaagatggcatacagaggaaggacaacagactcttgaggagtctggcacagttgcttcttgcaatgctgttagtgttcgtgaaggaccctttcccgcacgtgcaagcctaggaactggaagggcttgctggtttctgcgagcctggcagagagtcaatggtggctgccgaagaaggagagcagagagcacaaccaagtgttcatctttgactcaccatgaagctcatcagggaaaggatattctacttgctttgttggaaaatcccattctagtatcagcctcaaactgtttgaaggctaactcagagaggaagttctcagtatctgatgtgtctagtccagagagatcaaaatgggtttatatattccagagagaatatgctaccattgaccccgcccttgttgat

SEQ ID NO: 106147 - DNA, 3105 bp, Glycine max
  Peptide Sequence Number=SeqID_222925
atggccgatcacggaaccagaaaaaccaccactgactgccttgaagaggcaattacccgtcttaacaatagccaggcctcacttacagaccgatacacagacctttccggcaaagttgatgccatcctcgaccaccttcgcctccacgactccggccggaacgccaccaacaccgcaaatcatcaaaatcatccacgaaactcagttaaaatagacatccctcgtttcgatggccgtgaccccttaggctggattttcaagcttacgcaactttttcaataccacaacacgcctgaagaagagcgagtcacagtcgcctccctgtatctcgacggaacagcactgagttggtatcagtggatgttcagcaatggactgatcacctcctgggaaagcttcctcgaagcccttgagtcgcgcttcgcaccaacgttttacgaggaccccaagggggcactattcaagttaacgcagaagggaacagttaatgactacctaacggaattcgaacgtcttgcaaaccgagtgaagcttcgagataaagcggtattggccccacgcaatccatttccacctaaaccctcgccgcccttcaatcccaatcccaccattaaagcaaaacctccatttgtgcaacgaactccggccgagatcgctttccgacgagaaagaggactatgttacaattgtgacgagaagtggagcactaatcatcgttgtaaaggacgcgtcatgctcctcattgctgatgaacaaacctccaccactgaagaaagcatactcgagctcgaacagacaccaccttctgccattgatgacaaacccgagccctcaccagattcgacttgttcacatatcagccttcatgcgttgtcaggattaccatccacagacacctttcggctctatggcaccatcaagaacacgcagttaaccattttgattgatagcagaagtacgcataacttccttcaaccgcgcatcgctcaattcctgaagctaccagtccaagcaactcggtccctccaagtcttagtgggcaacggttccaccttagattgtaaccaggtttgctcagagacattagtcaccgtccaaggccaccaattcctcgtatcattccacctcctgcaaatcaatggagctgatgcggtcctaggcatcgactggctgaagaagttgggcccgataacgacagactacacatctggtatcatgaactttacacaccagggtcaggaggtgtctttagcagcagacgctacatgtgggcctgaacccgtttccgcaacccaactgaaacagttccttcaaaccggctccacctcggccttttaccaactgagtgttcagcccgttacccgaaccgaaaccgccccggcccaacaccctcttccctccatccagcaccttcttctccgttataaccacctatttcagtccccatccagactacccccaccacgacaagtggttcaccgaattacattagccccttccacagccccgataaacgtgaggccttacaggtacccacacttccaaaagaatgaaattgagaaacaagtttctgagttgctttccgccggcctcattcgccccagtctcagtccctactcctcgccggtcctcctcgttaagaagaaagacggcacatggagactgtgtgtggactacagggcgctcaacacactcgatctccggcaaggatttcaccaaatcctgatgcacgaagaagatgtggagaaaacagcgtttcggacgcataatggccatttcgaatatctggttatgcccttcgagctcagcaatgccccatccacctttcaatcggccatgaacaacctgttgcaaccatttttacgcagatttgtaacagtgttcttcgatgacattctagtttatagcagctcgctgtcatctcaccttcaacatctggaaactatcttcgaaactctacagcatggtgagttctatctcaagcaatccaagtgctcgtttgcccaagagaccattgaatacctcgggcatgttgtttccggcaagggagttactccagaaccttcgaagatccaagctatggtgcaatggccaaacccgaggaccgccaaggaactccgagcatttttaggcctcaccggattctacagaaagtttataaaggggtacgccaccatcgcagctcccctcacgagcttactctgcaaggatgcattcacctggacctcagaatctcaggaggccttttcccagctcaaattcgccatgacaaacgcccccgtgttagccctacccaacttctccactcccttcgtgattgaaactgatgcatcagcaaccgctatcggagcagtcctcacacagagtggacatcctttggcatatttcagcaagagtctcaccccttgtttgacccaagcttcaacatacattcgtgaactccatgccattgtcgcagctgttagaaaatggcgacaatatctcttaggacgcccattcacgatcctcacggaccacaaaagcattcgcgagctcatgacgcaaataatacaaaccccggagcagcattattatctctccaaattattaggttatgattactccatacaatataaagctggatcttccaacgtggttgccgacgctctttctcgacccccctcatccaccggccagctcttaatcctctcagttccccagctggacttcctcaatgacattcgaaagtcattggagtccctcccggaatttcagcaactcatgcattcgatacagtccaacccagcaaaccaccctggctataccctctgcaacaatctcgtattgttccagggtcgaatatggttaaatagcaacaatccctgcattcccagtctactatcagagtaccacacaaccccgttaggtggccacctcggagttgcgaagacaacccatcgagtccaatccaatttcttctggaccaacctcaagcacgatgttcgtcgcttcatcaaggagtgctcagtgtgccaacaaaataagaactcctccaagcgcccgacaggccttctgcagccactgccattacctacggggatagatactctaaaggggtacacttag

SEQ ID NO: 106148 - DNA, 534 bp, Glycine max
  Peptide Sequence Number=SeqID_222926
atgacatggcaggacctcgaagagaagattaagaaatggattaaggcctccaacatcgctctcaagatcttcttccccagcgagcgccgtttctgtgaccgtgtcttcttcggattcgcctccgcctcagacttctccttcaaggagttttgtcgctggaaaggctgttccgaatcctcgacgtgtttgagacgctgcgtgacctatttctggagtttgaggctctgttttctgatcagtttagtgtgtcgctcaggaatgaagcgattacgatttggaagagtgcactatcaaagaagctcctggaataaggtattagggattctgaagttcgatagtaatgggtcaatgccccctattagcttggcaaagtcaacgaaggagaaactcaagtcgtttaacacggtttttgaggagatatgcagggaacagtcttcatggtttgtctttgatgagcagcttagggaagaaataagaatttcgcttgagaaaatcttgcttcctgcgtatggaaactttgttgcaaggttttag

SEQ ID NO: 106149 - DNA, 336 bp, Glycine max
  Peptide Sequence Number=SeqID_222927
atgttgacttgtggctggaccccaacaattaggtctcagctctcatgttttctctcacttgattgggctcaactttctcacaaaacagagtccaccttctgccgtgttgaagttgcccctccctcactttttctctcacatgtctcttctcctgtgttgaatttgtgtctctcccttggctgtgtcgaagtcacctcttctgtcacacttcacaccttcctctgccatttgcaacaggttaaagctccttcctctgtcacagcgacccattcagctcatccactcatatgccataaaacttctaattccatcgttccaatgtctgaagataattag

SEQ ID NO: 106150 - DNA, 2184 bp, Glycine max
  Peptide Sequence Number=SeqID_222928
atgtttgattctcaccctcacttgcttgatatgtcaccccacaagactactgcttgctctgagagtgatttgggaaaggcctgcagagatgatgagtacgagaccaaatctatcactgacgccatggacgctccttctggcgacgaccaagatcccaacccgcgacccaaaaagaagggttaccgccgccacacacagcgccaaatagaagaaatggaagccttcttcaagcagtttcctcacccggatgacaagcaaagaaaagagctgagccgtgagctggggttagagcctttgcaagtcaagttttggttccaaaacaagcgcacccagatgaagactcaacatgaacgaaatgagaatgctattttgaagacagaaaatgaaaagcttcgcgctgagaacaacaggtacaaggaggccctaagcaatgctacatgccccaactgcggaggctcagctgctcttggcgaaatgtccttcgacgagcaacacttgaggattgagaatgctcggttaagagaagagattgataggatttcaggaattgcggccaagtacgttggaaagccagtgacttcttcgtactccaacctttcatctctgaataacaaccacgtgcctgttggtaagtatggatcacagtcaggcacggtaggagaaatgtatggagggagtgacctttttaggtcactcccagctcctgctgatgctgacaaacccatgattgtggagcttgctgttgcagctatggaggaactcacaagactagctcaggctggagaccctttgtgggtccccagcaaccaccattctgagattctaaatgaagaggaatacttgaggactttccctaatagaggcttaggtcccaaacccttgggtttgagatctgaagcttcaagagaatcagtggtggtcatcatgaatcacattaaccttattgatatccttatggacgtgaaccaatggtcaactgtgttttgcggtattgtctcgagagcgttgacccttgaagtcctttcaactggagtagcaggaaactacaacggagccttgcaagtgatgtcatctgagttccaagtcccttcaccacttgttcctactcgtgagaactatttcgtaaggtactgtaagcagcaaccagatgggatatgggcagtggtggatgtttccttggataatctgcgacccaatacaatctcaagaagccgaagaaggccctctggttgtttaattcaagaattgccaaatggttactccaaggttacatggattgaacatgtagaagtggatgatagagcggtgcatagcatatatagacctctggttaactcgggcctggcatttggagctaaacgctgggtagctacattagacagacaatgcgaacgtcttgccagttcaatggccaacaacattccagcaggggacctatgtgtgataacgagtgctgagggaaggaaaagtatgatgaagctggcggagagaatggtaatgagctattgcactggtgttggtgcttctactgcacatgcttggacaacgctgtccgcaaccggatgtgatgacgtaagggtcatgacaagaaagagcaccgacgaacctggcaggccccccggtatagtgctcagtgctgccacttctttctggcttccggttcctccaaatagggtttttgattttctacgtgatgaaaactcaagaaatgagtgggacattctatccaacgggggtctagttcaagaattagcacatatagcaaatggtcgtgatcccggcaactgtgtctctttacttcgagtcaatagtgcaaattcaagccaaagcaatatgctgatacttcaagagagttgcacagattctactggctcatatgtagtttatgctcctgtggatattgttgctatgaatgttgtcttgagtggaggagatccagattatgttgccctgctcccctcgggctttgctattcttcctgatgggcctcctgcattaaatggtgggcccatgcatgaagttggatctggaggttctctactcacagttggattccagatcttagttgattcagctccaaccgcaaagttatctctgggttcagtggccactgttaacagtttaattaagtgcacagttgaaaggatcaaagttgcagtcatacgtgacaacaacaacacctga

SEQ ID NO: 106151 - DNA, 3828 bp, Glycine max
  Peptide Sequence Number=SeqID_222929
atggcggatcataccacccgcagaaccactaccgacagattagaagaagctatcacacgcttatccacttgccaatccacgctcacggacaaatacgcagagctttccgataaagtggattcaattcttgaccaccttcgtctgaaggagaccactcaaaacccaccgtcgtccaactcgcagttcacccagcgcaaccccgtcaagctcgatatcccaagatttgacggccgtgacctgctaggctggatattcaagatatctcagctgttcgagtatcaaaacacaccggaagaagagcgtataaccgtcgcctccttctacctcgacggcgccgccttgagctggtatcagtggatgtttcgtaatggttttatcacgtcatggtcggggttcttgcaagctttagaatccaggttcgctccgacattttacgatgatccgaaaggagctctattcaaacttacccagcgtggcaacgtcaacgagtatctgacggaattcgagcgcttagctaaccaggtaattggccttccaccccccttcttgctaagttgtttcatttcaggacttacaccgaagatacgacgggaggtactcgcgcttcagcccatttctctcccacaagcaattgcacttgccaaacttcaagaagataagcttcgagatcgacgtatgaccacacgccccaactttacatcaccatcctctaattcgcgtcccaacaaccccatacagtcatcatctcttccttcatcgtcgtcacagcaaaggaccaagccaccctttatccaaagaacacccgaagaaatggccttccgtagggagagaggcttatgctacaactgtgatgacaaatggaatccgggtcatcgctgcaaaggaggtattttgctgcttatagccgacaaccccgtgacggaggaagacactcgtgaagtaagcctcgactccataactactaatgaagaggacttaccagaccagtcacagcccacttcggacgacactcatccccacatcagccttcatgccttatcgggacttccttcatcagaaacctttcgtttatccagcatcatcaaacatgcgcgtatcacaatccttattgacagcggaagtactcataacttccttcagcctaggatagcgcaattcctccatttacctacccagaaaacaactccttttcaagtactcgtagggaatggttcagtgcttgattgcaatcagatttgccctaacacacagctatccatacaaggcaactccttcgacgtcacgtttcacttactcccgataagtggtgcagatgcggtcctgggtattgcatggttgaagcaatttgggcctattattactgactacacctccttcatcatgcgtttcaaccatttgggccaagcaatagagttacgtgctgatattgctattgggccagaacccgcgtctacaacccaggtaaaacgccttatccgaacaggctccacttcggccttgctccacttacgaatattacccacccaccaacccgaaccttccacaactcatcttcctcatcccatccccgccattaacacactgctcacccgataccagaaattattccagaccccaaatcatcttcccccaccacgagacgtagtccaccgtatcaacacccacccagccacagctccgatgaacgtacggccgtatcggtacccacacttccagaaaacggaaattgagaagcaagtgtctaacctcctttccgcaggactcatacgcccaagcacaagtccatattcatcacccgtactgcttgttaagaagaaggatggtacgtggagactctatgtggactttcgttcactaaacgtagtcacgatacgggaccgttttccgatacccaccattgacgagttactagacgaacttggccaagcttcatggttctctaagctggacttgcgccaaggcttccatcagatcctcatgcatgagcttgacaacgagaaaaccgcatttcatactcatcacgggcactacgagtacctcgtgatgccattcgggttgtgcaacgccccttcaacgttccaaggcgccatgaacagcgtgctcactcctttccttcgtcgatttgccaccgtcttcttcgatgacatactggtctatagtgattcactgccctctcacatctcacacctcgaaaccattttccagacattacttcaagggcaatattacttgaagcaggccaaatgcttattcgcgcaagaacaattggaatacttggggcacgtagtttccggcagaggggtcgaacctgagccttctaagagtctgagagaactcatgactcagattatacaaacaccggagcagcattactacctctccaagctactgggcttcgattataacatccagtataagacagtagctaccaacaaagttgctgatgcactctcacgaatcccacaaactacggcccagttaatgatattatccattccccatctcgacttcattgatgagcttcgacaaacacttcaacaaagcccagaattccaaagcctccttaccaaggtccgagatgagcccacagcataccccgattatcgacttcataacaacttgtttttcttccaaggccgtatttggttgaacagcgacaaccccttcattccttctatcttactcgaaaaccatgccacacccttaggtggttatttaggagtcgccaaaaccactcaccgcttggaatctagcttcttctggtcagggatccggcaagacaccaagcgcttcgttaaagaatgtaagatatgtcaacagataaaatccacaacgcgccgtccggcgggtctcctgcaacctctaccaattccggcaggcgtatgggaagacctttcgatggatttcatcacccacctcccatcctctcatgggttcaccgtaatccttgtcatcgtggatcgttattcgaagggggtacatctcggtgcattaccgacaggtttctccgcgtttaaagtcgcgtctctcttcctcgaactcgtctgcaaacaccacgggtttccccgcagcattgtttctgaccgagatccagtattcttgagttccttctggaaggagctcttccgtctctccggcacacggctgcgcatgagcacggcgtaccatctgcaaaccgatggccagaccgaggaaaccatgaagcaatacgcagacgctaagcgcgaagacgtctcctttacaccaggacaatgggtttacgttaaacttaaacccttccggcagcgctccgtcaccggcgcaaaccactcaaagttgcccaaacgattcttcggaccattccagatcacagctcgcatcggtgaagtagcctacaaactccagctcccggacgactctcgaatccatccggtcttccactgctccctgttacgacctcactatggtccaccaccatccaatacggcaccgtggcctctccaaatcgtgagccaacgtccagtcccacgaccactttgcatcttggactccaaatttgacacttcaacgacacccccgactcgactcgtcctaacacagtgggccggccaaccaccggaggatacaacatgggagccatggctggacctccaagaagcctaccacctcgaggacgaggtggtatctggaggagagggtattgatagcaacagagacccacaaggagaggatagcagcagcaacttacacgagcctagtcccgagtccaactcacagtcgaatagagacgaacctggaccagcaagacccacgaggataactcacaggcctacatacttaaacgactac

SEQ ID NO: 106152 - DNA, 1956 bp, Glycine max
  Peptide Sequence Number=SeqID_222930
atgcctagtccattgctatcattatcattagtgctgctattcttgatttcatgtggaaatattcatgaatgtgaagctcaagataccgaggctttgcctccagcagcagaaacttgtaacggggttttcatttcctatgactttctcactcgaagaaaagaattccctcgcgtgaagaatgccacggcacagtcttgggccttcaattccaccgcaacagttctcaacaccggcaaagacgtggttaaggcgtggaggctgttcataggttttcaacatgacgagattctaatctctgccagcggaggtaatctaatcgatggaactgacttccctgctctggtaggaaatggcactacctttgttggatcttctgtgccagatttggatagctccatcaacacagctcaagatttaacccaaatttcagccatgatccagcttattggcacccagtttggagtaaggcctcctactattcctatgcccaaaaccatcaagttggtaaatgatggttacaagtgccccctaccaactacccgtaagggttccatgtatgcgtgttgtaaaaaagaccctaaattcaaggctgtactacggaagacaaaattcttgccacggcaacaaggggatcttaccatatcctatgacgtgaatcaagtgtatgagaataattatatggtagaggtgaccatggagaacaatcaccttttgggacggctggatcattggaacttgacttgggagtggacaagaggggagtttatatacagtatgaaaggtgctttcacacgtgtgatagaatattcaggttgcatctatggagctgcaggacagtattacaaggacatggatttttctaaagtcgttaactgtcaaaagaatccaataatcagtgacttgcctccagagaaagctaatgacactgaaattggaaagatacctcactgttgcaaaaacggaactcttctacctatccttatggatccaagcaaatccaagtctgttttccaaatgcaagtgttcaaagttccacctgatctaaacaaaacagcaattttccctccagagaaatggaaaataacgggcattctcaacccggaatacagatgtggggcacctattagagtggatcctgcacaatctcaagatcccaggggacttgaagcaacggttattgccatttcaagttggcaaatagtctgcaatatcactaagccaaccaagaggagcactcgctgctgtgtttctttctctgcttattacaatgagtccatagtaccttgcaacacatgtgcctgtggttgtgatgaaaataacagaagatgtaatccgaattcaccagcaatgcttctccctccagaagctcttcttgtaccctttgagaataggacaaaaaagacagttgcttgggccaaactaaagcattttaaagtcccaacaaaattaccatgtgctgacaactgtggagttagcataaactggcatgtagtttcggacttcaaaggtgggtggagtgccagaatcactatgttcaattggcagcatacgaattttgagaattggttcactgcactgcaattcaagaagaagactgctcttggttacgaaaaagtttattcttttaatggaacattccttccgaagctcaatcatactattttcttgcaaggaacacaaggatcaaactttttgttagctttagacaatggaacaaacccaaaggtgcccggaaaagcacaatctgttctttcctttactaagaagtttgcaccaggcatgaaaattgcaaaaggagatgggttcccatcaagggtcttttttaatggtgaagagtgttctattcctacccgtttccctgtgggaaatggaaaccaacataatgcagattcattaaacctacacctactattagctttagtcctagcttttacaatgagtataatattgtattaa

SEQ ID NO: 106153 - DNA, 774 bp, Glycine max
  Peptide Sequence Number=SeqID_222931
atggccaaaccactatatctagaggaagattacaaaccaaaagattatacccctaaagccaaaagtctatccttctttgcctctattttttcccttttcatctacatatgtgtcttctataccttcaacctatctccctattctctcctcaacaacaacatcttttggtttttcatgtccaataccctcattctcatcattgctgctgactatggagcatcctcttcaaacaaacataaacaagatctctatgaagagtatgtgcaacatagtcaagcaagaaactgtgtctcgtcatcatacgtgcccaaatatgatcatgaacaatttgataaagaatgcatttatcccaaacaagagcaaggtagtgagctgatagagaaaaagaaagaaactatttctgatcaagatatcatcccagaacgtgtacttggaattgtgacagtactcaatcaacctaataaacctagtgagtgctccaatgagaaaaagccaacacttcacttgcaagtagatgatggcagtgaaaaatttgaggagatcaaagcagtgcctactagaatttaccggcgaagtaaatctgatagacccaatagagccaagcatgtggtgagtgaggagagggtgaacaaggtgcaaaggtcagagactaagaaggtagaagcaaatgttgttgaagaagaaaatgagttttctatgatgtcaaatgaggatcttaataggaggatagaggactttattcagaaatttagatctcaagcaactagaaattaa

SEQ ID NO: 106154 - DNA, 168 bp, Glycine max
  Peptide Sequence Number=SeqID_222932
atgaagaaacctagtcatcatgaaagcaaggatacacttcagcagcagatagtgtattcatttggtgaccactattatttcagaaaagaactcaggatattgaatctccttacaggaaatgagatattttgggctatgatagacatggatgagattatgcagttttaa

SEQ ID NO: 106155 - DNA, 483 bp, Glycine max
  Peptide Sequence Number=SeqID_222933
gtgttcctagttgatgccaaagggaatagctttgacagggaagggaagataattgggtttgatccagcgtatgatctagctgttctgaaggttgatgttgatggatatgaaataaagccagttgttcttggtcagtctaacgatttacgtgttggccagagttgctttgccattgggaatccttatggatacgagaatactctcacaacaggggtggtcagtggtttaggccgcgagataccttcaccaaatggaggggccattagaggagctattcaaactgatgcagcaattaatgcaggaaattcaggtggaccattgattgactcgtatggccatgttgttggagtaaacacagctaccttcactaagaaagggactggggtgtcatcaggtgtcaactttgcaattcccatcgacacagttgtcagaactgtaccatacctcattgtctacggaacaccttatagtaataggttttga

SEQ ID NO: 106156 - DNA, 303 bp, Glycine max
  Peptide Sequence Number=SeqID_222934
atggtagccacaaagtttcctgattttgaagtcagcttcacagatggtaaaacaatgaagcttcctatccgtgtttctgatcgtgcagttgattctgataaatcgtctgtccccaaggcatctttggtttgtctttcatttcgagcaagctcccaggaaatgatcaattcttggagtgtgccttttactgaagcatttagaaaatcaaatgatgttcatttatatcagcacatagctgtaatatccctccctaaatgtttagcttcctgctttggaatttctgaagaaaaagatgatgagtga

SEQ ID NO: 106157 - DNA, 489 bp, Glycine max
  Peptide Sequence Number=SeqID_222935
atggagctcaacatgtttagatctattgagaacaagattgaaataaaccttcaaccgctctattgcactgccaggagtaatccccctctatcttgtgcaaaaacctttagatcaaatgccacaaagggggttgccgccatcgatcaccacattgtggaggtgggttttttggtcgaggaggattgggagatactcgtggttggagttggggtcactcatcagattagacatgttatcgaaccgatcaaaagcggtgtgacccgtgcgacctggcggaaaacgccattgccactggcggcaaggctcaacccgccattgccagtggcggcaaagcaggagagaggggtgcttgccgccagaacgtctggcgggattggcagtgcagtgggactcgcccagggtgctggcgagacagccatgtcacgtgaaccaacttttcaggcttgtagggcttgtttctgctctccattgtttagggatgcagcatag

SEQ ID NO: 106158 - DNA, 666 bp, Glycine max
  Peptide Sequence Number=SeqID_222936
atggccaatgtttctctcccaagaaccataaaatgggatgaagtgactctccatgcaaaatgggtcatggacaaggccacaccgtcattccccagacccgctccaaccatagcacaaattaggcaagataactccggtaagagatacaaagataggctcaatctatctaggagaaggcatagaaatcacggttacttcaaagaaaccacaaagaaagggtcgagggctttattctctaccgatcccacgagttgggttttgaatattctgctccaattaaaggcttctactatgtgtggtggtctgataacaaatggtggcagctcgtggtggtcaccggtggtcgtgggtagaggaggaggaggttctatggtttgggtgagggttttgggaagaaaagaagtgaaaaatatgtgtttttacactattgtacgtatttataacctgcaagactcgcttagtgagctggtctcactaagcgaaatttcacttttgccgctaagtgagacattcacgctaagcaaaatttctctgctggctagaattgcgcttagtgagttggtgttgttaagtaaattacttcctttggaaagaattgcacttagttgcctggtgtcgctaagcgagttgttccaacgcagatcaatcaaacatcacataacctaa

SEQ ID NO: 106159 - DNA, 111 bp, Glycine max
  Peptide Sequence Number=SeqID_222937
atggatgcagaattcacagagagatgtctacctaggagtctacttgaatggggatttaatgatagtcaagtaagtaaatgcaaggttgtggctagatggattctagttaaa

SEQ ID NO: 106160 - DNA, 947 bp, Glycine max
  Peptide Sequence Number=SeqID_222938
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatctcctcccttttcccgatcaccatccatccccatcctcaatctatcttgcccaccctcctgcagaaggtgcttcttttctctggtttgctgagcctctgaggagggtttggaggcagccacgtcctgcagaggggacagtctcctttgagaaggctgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 106161 - DNA, 267 bp, Glycine max
  Peptide Sequence Number=SeqID_222939
atgactatgcaaaacatgcagtttcaacaagagactagagcctccattcagagcttaactaatcagatgggacagttggctacacagttaaatcaacaacagccccagaattctgatagatttaccttctcaatctgtccagaatcccaaaaatgtgaatcaaaagagaagcagcatatccctcttccattccctccaagagaaatttccaacaaaaaaatggaagaggcagagaaggagatcttggaaacatttaggaaagtagag

SEQ ID NO: 106162 - DNA, 504 bp, Glycine max
  Peptide Sequence Number=SeqID_222940
atggaaagtccccactctgtgaacagtccaagaagaaccctcagcctatcgaaaaagcagagggcaactgtatccttttttgaccccgatgacataacctctggctttggattgtctggcgatcatggccctaagccttctgaagtttatggttttgtaggttctattaccactgttgttgctacagttattttcttggtatgggcatatgctccagaatcatggctacaatctgttggcatctcttactatcctagcagatattgggctctagcagtaccaacttatgtgatggtgaccattgtattggtgctgggattctacattggccttaacttcatttcaacaccttcccctgcatctttaaacactgttttcgatgaattcagtagggatcctttaagtctcgagtgttctctagaagaagatgagaaacccatcgagcccatttcagatattggtattggcagaatcaatgatatcatgttcaataatgcaacctaa

SEQ ID NO: 106163 - DNA, 297 bp, Glycine max
  Peptide Sequence Number=SeqID_222941
atgtggatctcgataggtccgtccataacctattatccccgttgggtttccataccccatccctataccattcactcacagtaccgaatccagtttgagaagtcgtgcaatcgagtttatggtctcaatctagatgccctcttgaattgtttcatatcgggtttgaacccagatatttgccagaagattgctattttgaagcccaccaccctttccaatgctattgtgcttgacaagcttattgaggacaaagttaaggctactcatgctcgcacccctcattctaatctagtatag

SEQ ID NO: 106164 - DNA, 213 bp, Glycine max
  Peptide Sequence Number=SeqID_222942
atggctttggtgatgggtcccctccttgggaggattgcatcagccagggctatcactgagcaaggaaagcaaacactgtgttcattacgcaaatatgataacacagtgttacatgcattatccatggcattacaactacttgttgatgacatgggacaaccatctcttaaaaatatctattacaatggcaagtacacattcaaatggtcataa

SEQ ID NO: 106165 - DNA, 117 bp, Glycine max
  Peptide Sequence Number=SeqID_222943
atgactgtgaaaaagaggctaagtcatgaagcgctaaaagtgacagttgagcttagctcatcagttgggctaagcgtgcatccaccgctaagtgtagcttcagtgtgcttagcgtga

SEQ ID NO: 106166 - DNA, 156 bp, Glycine max
  Peptide Sequence Number=SeqID_222944
atgcattcagttgataaaaggccacctactggtctgtttaaagcaattgtggatgcagttgttaatcttgagaagcatagaagaaatgcgggtaaggattggattgctagttggttgcattttggagatgggcctccttcagttgctcctagttaa

SEQ ID NO: 106167 - DNA, 225 bp, Glycine max
  Peptide Sequence Number=SeqID_222945
atggaggagaaagcagggacaaagatggaagaagctatacataaaagagagaaaaagcaagtacacttgagaagcaagcatgaccatttggaaaattcaacaattcttgaaataacacagcaaaggttccgaatttcatctcatttaccctttttggttttttgttccattaatggaactccaggtgcacagatctgtgaggagggggtgaggctgaggctctga

SEQ ID NO: 106168 - DNA, 225 bp, Glycine max
  Peptide Sequence Number=SeqID_222946
atggaagaaattgatccaacattggcatcttcctctttggttttgtttgctcagatcatgatgcagaatgttttagtgtggatgagctattttgcaccaaatacttcaggctcagataaactttggtctgaaaaacttaatctccaccaaaacatatggactgtgtcaagtggtatgctaccaacaacacatctagctagctcacatgcacatgggagagcatga

SEQ ID NO: 106169 - DNA, 1599 bp, Glycine max
  Peptide Sequence Number=SeqID_222947
atggaggaggatgagattcaagcatgtaagttcccaagagttggaaatggtaggagtagtgaccaataccaagaggaggaagaagagggtggtgacctaagacttagaaaaggtgttggtgttggtggtggtggtggaggtggaggaagtgatgctagcacaaaccacttccaccaaagtagttggcaccattcttctagaatcataagggtgtctcgagcatctggtggcaaagacaggcacagcaaagtgatgacctcaaaagggttaagagacagaagggttaggctctctgtgaccacagctattcagttctatgaccttcaagatcgcttgggttacgaccaacctagcaaagctgttgagtggttaatcaaagctgcttcagaagctatctctgagcttccttctctcaacaaccctttccctgatacccctaagcaactaagtgataagaaaaggcctactagtggtggtggtcaacaacaacaacaaatacaacaaggccactttgatgatgctgatggagacacaagttacccccaaaaccaaagccagaacctttctctctccaagtctgcttgcagcagcacttccgagacaagcaagggctcaggcttgtccctctcaaggtctgagattcgtgtgaaccgtgttaaggcaagggagagggctagggagagagctgctaaagaaaaagagaaggagaaggagaaggagaaggagaaggagaaagagagtgaatctagcattgcacatcaccaccatcatcaccatgtgaacaacaacaaccacatgtctcacacagcttccttcactgagcttctcactggtgggattgggagcactgtaacagttaaccccaacaccaccaccaccaccaccacaacaacaacaagtcctaatgggtcatcagttcatcagatccatgatggtcatgatcatgagactaatctattcaacaagggaaggcaacaacaacaacagcatcattggtctcaaacagtgacacctatggactacttcagcacaggcctcttggtaggaccttcttcatcatctgcaagaactcaacaacaccaacaccaatcttcttcagcacatttccaactgggacatgcacatgcccttccaatctctccattcagtggagaaaaccactcagagcagctgcagcatttttccttcatgccagaccacctcaacaacataccagctcatcatgtggttacatcttcttctgcttctcatcaacccaacgggggtgacaacaactacaacctcaacttcagtatctctacatcgacgggccttgctggttacaacaatagggggacccttcagtccaattctccgtcttcctcgtttttgcctcatcacctccagaggtttcaacctttagacggatcgtccaacctacctttctttataggagctgctgctccttcttctgctcctccaaccatggacaacaacaacaataataacagcaacaaccatcaccaccttcagttctcacctgtctttgatggccgcttgcaactctgctatggcgatggaacaaggcattctgaccacaaggggaagggaaagaactaa

SEQ ID NO: 106170 - DNA, 474 bp, Glycine max
  Peptide Sequence Number=SeqID_222948
atgacttttgagccattggattggtattgtcgcccagttgcaaatggagtatggacaagatcagtggagaatgcctttggtgcttacactccttgtgcggttgactctctggtcatctccgtttctaatttgatacttctcggcctgtgcatttaccgcatatggttgattaagaaggatttcacagtcaagaggttccatttaaggtcaaacctttacaattatattctcggattgctagctttatattgtgtggcagaaccattatacagattgatattgggaatatctgttctaaatttagatgggcagactcaatttgctccatttgagatagtttcactgatcattgaggctcttgcttggtgctctatactaattttgattggaattgaaactaaagtctacatccgagaatttcgatggggatgctgtaatgttcaatctcatcatttctgtgaaggagttatatag

SEQ ID NO: 106171 - DNA, 408 bp, Glycine max
  Peptide Sequence Number=SeqID_222949
atggttatagtggaagaaggtgatgaagacagagagcatgatggagaatgggaatggagagggacagtgctaataatgggaacgttgtgcgtgcttcgagtacttgagagcggatttggcgttgttggaggctttgaacttggactctgcaatggtcttgaggtgcaacgcttcggattcttgttctgggtgtatgccgcttttgttgcctctctcgtggaagagaatggttgtgtaccgcaaagagatggagaggaagctcatggagttgaacgtagaggaggaagaagaaccttgtggagttcaatgctaaagaggaagaggaaggatatgaagccttccggcaaatttactgtaaaggggggatctgtttctggatggatgctgccagaagaactggcgacatag

SEQ ID NO: 106172 - DNA, 531 bp, Glycine max
  Peptide Sequence Number=SeqID_222950
atgtctcaccaacaatccctagtaatctattccaagtttctttgtagccttttgaggattcttgatccacctgttttctctgtgctatatttatacatcagtgaggtggttggccagaaatggatgtatagagaaagaatagagtgttttattgcagtatatggggatgttttgtttggaatactattgcttgtgtatgttcctactttggatccttatccaggttatacccccattgggagtgacatgattactgatgctgcatatgatgaactccctggaggagatatgatatgtcctgagaggaatgccaacatattgtcaaaaataatgttttcttggatgaatcccatcatgaaactaggatatcaaagaccactgacagagaaagatatatggaaattagatacatgggaacggacagagacactgatcaataagttccagaaatgctgggttgaggagtctcggaagccaaaaccttggcttttaagagcattaaatgcaagccttggaggaaggtatggataa

SEQ ID NO: 106173 - DNA, 564 bp, Glycine max
  Peptide Sequence Number=SeqID_222951
atgggtagcatgggaagtatgaatgtcaaacccaaaaggaaaaggagaaagagctgtgttttgtctgacataattgttcaatacatcgccgatatgaaaaattggaatttgctcccttatttggaaccgttattatggttgtgttgcatctgcaaactatttgcaaaccctcaatttagaacatttcttcatgtagtacgtgaagggcagggctgggaatctccaagagaaccttatgaagtgaaggcttggatttcagcaaagacagttactgggaaattgatcatgtcacatacagaaggagaaccatacttctttacatttggaaaatcagaggtacctaaaggccttgaaatggcgataggaacaatggttcgggaagagaaggctgttatatatgtcaccagtcagtatttaactgagtctcctctcatgcctgtaatagaaggttatgatgaagttcattttgaagtggagctggttcactttattcaggtgagggacatgcttggagatgggcgcctaataaaatgccgaattcatgatgggaaaggtggggattga

SEQ ID NO: 106174 - DNA, 334 bp, Glycine max
  Peptide Sequence Number=SeqID_222952
ccaaagtgaggcaaaatgggacctcatgctcgatgatgaggtgctgaagagtgttaagggctattatggtaccattgagaatgtgtcatacgaaaaggtttctattgagcaaccttctgagaccactgcttttgtgtcggatattgcaaatcggcatgattttttcatagttgggagacgtaatgggatcaaatcgccacagacagcagcacttgaaagttggacagagttttctgagttgggtgtgattggagatttgcttgcttcctctgataccaatactaatgcttcaattctagttgtgcagcaacaacaaatgcccaagtcgtcgtga

SEQ ID NO: 106175 - DNA, 297 bp, Glycine max
  Peptide Sequence Number=SeqID_222953
atggcgctaagcgtcagtttatttactgcttcagcgctggccgcaccgttgaatcccggcgaccgcaactatattcagaatcagcagcaacagcgactgcagcaagaccagcagcagcgagacgcgctttggaacgccgccgcgccgcaggccacagcatgcagcgggaaaggaaacgcgacgaaatacgcctcgatggccagcacccgtgatcgctggccatgtcgtttcccgaactcgactgttttgcagcgcgggctacatttcacctctcgcaaagccggatctggagtatag

SEQ ID NO: 106176 - DNA, 156 bp, Glycine max
  Peptide Sequence Number=SeqID_222954
atgactgaaaatgttagtcagtttgtcagattgattgtgaaggaatgcaatgacagtatcccgcgagcattcgctaagcgcaacactcagtggctaagcgcgaggaagaatccagaagaagacgagctgtcaggttcactgagtgcaccactctag

SEQ ID NO: 106177 - DNA, 459 bp, Glycine max
  Peptide Sequence Number=SeqID_222955
atggaggaatccaatcgggaaaataacaaagatcacatttcccagtcaagagggtccgcccttgacggtgaagaacacattggagaatggaggaatccaatcgggaaaataacaaagatcacatttcccagtgaagaggggtccgctcttgacggtgaagaacacattggagaatggaggaatccaatcgggaaaataacaaagatcacatttcccagtcaagaggggtccgttcttgacggtgaagaacacattggtgaatggaggaatccaatcgggaaaatcacaaagatcacatttccctgtcaagaggggtccgctcttgacggtgaagaacacgttggagaatggaaaaatccaatcgggaaaataacaaagatcacatttcccagtcaagagggtccacttttgacggtgaagaacacattggagaatggaggaatccaatcgggaaaataa

SEQ ID NO: 106178 - DNA, 372 bp, Glycine max
  Peptide Sequence Number=SeqID_222956
cccgctctcactagaaggatagctcggtggcaggtgttattatcagagtttgatattgtttatgtcactcagaaggtagttaaagggagcgctctggccgattacttggctcagcagcctatagatgactatcagcccatgcatccagaattccctgatgaggatatcatggccctgtttgatcaagagggtgaggttgaagacaaagataagtggactatgtcatttgatggcgcatctaatgtatggggacatggaattggagcagtgctggtctcgctagataaacaatattttcctttcacaactagattatgttttgattgcacaaataatgtggcaaagtatgaagcatacgcctcgggaatctga

SEQ ID NO: 106179 - DNA, 159 bp, Glycine max
  Peptide Sequence Number=SeqID_222957
atggctaagcgcatggacaattctagaagaaggatgagctgtatagaggcgctgagcgaaagccaactcgctaagcacaccgtcttcaccttcaggaagcttccttgctatggagagctaaaccctcagttggttcttcctatggggtacttgatgtaa

SEQ ID NO: 106180 - DNA, 570 bp, Glycine max
  Peptide Sequence Number=SeqID_222958
atgaagtcgggaaagttgcttgattttgttgttagccaaaagtggataaaggtggatccagacaaagtgaaagtgatcctacagatgccggagccacatacagagaagcaagtctatgaattcttgggaagattgaactacattagtaggcagtgtttgatgaatcctcatgtgctcgtgccaccagtacctggaaggcctttcattctgtacatgatagtgttagatgagtcaatggggtgtgtgctggggcaacacaatgagtcaggaagaaaagagtatgtcatctactacttgagactttttgtgcattggcatgggcaccatactgttgaagcaaagcttcatgatgaatcaagattgattcaaagatgttttgatgataacaaagatgatgacaaaggtgatgacaaaaagctcaaaggtcaatcaaagaatgagttcaagatgttcaagatagaatcaagaacacttcaagattcaagtggaatgttgatttcaagaatcaaggatcaagattcaaggatcaagattcaagactcaagattcaagaatcaagagaagacttaa

SEQ ID NO: 106181 - DNA, 579 bp, Glycine max
  Peptide Sequence Number=SeqID_222959
atgaatgcgctgtatcagctgaaaggcgaggtggaacagagggtttcggcaatgcccgcgccgccgcactatcagggccagccgctcaccgccttactgacgctggcggccgcgcacggcggcagtaaaggctccaccattccggaacgcttcgagctgctggttaatcgccgttatgcaccggaagagccttttgccgacgtgtggcaggagctgacgcagtgcgtggataaggcgatgcagggcagcgccgccagtgacgtcacgctacaactgattggccatctggcgccggtcgccgatcccaccggtccgcactggccgcgctggcaggcggcgctcagccagggcttcggcttcccgccagcagaattcaaagcctggggatccgccaccagctcggatatgggctgggtacagcaggccggcattcaggaaattctgctgggcgggcttgcccgtcccgataaccgcattcatgccgccgatgaatacaccacgatggcagatgttattgcactttcgcagtcgattctggcgtatctcgccaatgattttcagccaacccagggtaattaa

SEQ ID NO: 106182 - DNA, 885 bp, Glycine max
  Peptide Sequence Number=SeqID_222960
atggatcatgttcgagcattttcatctccccattttctttcttcttcaacaagtaacttcaatggacagcaagatatagaagaatgcggtttggaaggccttgccaccaatgttaagctattactgaagttaattcaagaccataatgggtctagcacaaaagaaaatgatgagcgcaagtttcatagggtaaatggaatgatgtttatcctagatgaggctaggaataggattcaaaagattcaatctaccacccagagaagagctgaacttaggaggtgtaacactgaccttaggcctaacattccagctccaaaggacagaaagcctccttctgatgtgcctatagatgagaaagagaggctaaagagggagcttaacgcgagcttggtggcgcgacaaagccttcaagcaatgtgttcgagtttgggaaaagagaaacaaattatggctgcggaactcgcaaggaaggctcaagaattgacagagatggaggatttcattggtgatctaaaggcacagaatgacatgttgatggagaagttgcatgaacagaaggagaagaagggtaatggtgtggagatggaatgcaacatagtgctacgagagcgtaacaaggcgctttcagagcaactccagaagtcaattgatggttatcggtctatgaagagaaggctcagagatattcaagaggagaacaggcaaattcgcgataccatggagcaaatggaggaggaagttgatgcaggaattgacaggaatataggtaggttcaaggaaagaaatatgagaacaaatgagatcaaagaagaaatttcagctttggagcatatgcttgattctctcaagatgaaagtctcaaaatatacacagaagaaaacttga

SEQ ID NO: 106183 - DNA, 936 bp, Glycine max
  Peptide Sequence Number=SeqID_222961
atgtcgtcgtcgaaggaggcagcagcagaagaacgaaactggctggaccttccgcgcgacgttctgtgcacgattttccagaagctgggcgccaccgagatcctgacgcgcgcgcagggcgtgtgctccgtgtggcgcgcgatctccaaggagcctctcctctggcgcaccatcgacatgcgcaatttgggcgacattggattggatttccatttattggccatgtgccaccgcgcaattgactacagctccggccacttgctccatatcaatgtcgagtatttcggcaccgatgatctcctccaccacatcacccattctacaagtaatctacgaagcctacgtcttgcatgttgctatcagatttcagatgaaggactgtgtgaaattgcagaaaagcttcctcagctggaggagcttgatatatcaatcagcaacttaaccaaggaccctctagaagctattggccagtgttgcccacacttaaaaacactgaaattcaatatggaaggttacagacgtccgcacattgagtgtgatgaggaggcttttgctattgcagaaaccatgcccgggttacaccatctccagctttttggaaacaaacttactaatgaaggcctgcttgctattcttgatggctgtcctctccttgaatctcttgacttacgacagtgtttcaatgttaacttggcaggaagtttggggaaaagatgtgcggaacagatcaaagaattacggcttccatgtgatcccactgatgactacccatttgaagctgaaattgattatggatctcttgatgaagattacccatctgggatttctgacatagatttcttgtctgatgatgattatgactattatgaattctcaggtgggagtgacttttctgaatatgatgatgatcatcctgattattacgaccacttttga

SEQ ID NO: 106184 - DNA, 189 bp, Glycine max
  Peptide Sequence Number=SeqID_222962
atgtggatcacacagggcttaatggtgcaacagcactgcattttctcagttagggggtggggtcgtcctctacgtgtattcaatatgggaaagtcagattctgaaagactcctccagctagctagccccatgtcttctggcgaggccacaccccatttttgtgcttggggtatgggatttgataattga

SEQ ID NO: 106185 - DNA, 4155 bp, Glycine max
  Peptide Sequence Number=SeqID_222963
atgtcttatgcttacaacgtgttcactgtgattcataaccccaacgtgttcacgtggaacaccattatcaggggctacgctgaaagcgataacccgagccctgcatttcttttctatcgccaaatggtagtttcttgcgttgaacctgatactcacacttacccttttcttttgaaggctatttcaaagtctttgaatgttagagagggggaggcaatacattcggttacgataagaaatgggtttgagtcgttggtgtttgttcagaacagtttgcttcatatatatgctgcttgtggcgacacggaaagtgcatacaaggtgtttgagttaatgaaggagagagatctcgtggcttggaattctatgattaatgggtttgctcttaatggaaggcccaatgaagctttgactctctttagggagatgagtgtggagggtgtggagccggatgggttcactgtggttagcttgctatctgctagtgctgagcttggagctctagagttaggacgtagggtccacgtgtacttgttgaaggtcgggttgagcaagaactcacatgttactaattcattgttggatctttatgcaaagtgtggggccatcagggaggctcaacgagtgttcagtgagatgagtgaaaggaatgcggtgtcttggacatcgttgattgttggcttggctgttaatgggtttggtgaggaagcacttgagcttttcaaagagatggagggacaaggactggtgcctagtgagatcacttttgttggtgtcttgtatgcgtgcagccattgtgggatgttggacgaagggtttgagtactttagaagaatgaaagaggaatgtggaatcatacctaggatagagcactatggttgcatggtggatttgttgagtagggcgggtttagtgaaacaagcgtatgagtatattcagaacatgccagtgcagccaaatgcagttatttggaggaccttgttaggggcatgtacaatacatggacatttgggtttgggagagatagctagatcccacctattgaacttggagcctaaacatagtggtgattatgtgcttctttcaaatctttatgcctccgaacgtcgttggtctgatgtacaagtgataaggaggtcaatgctgaaggatggtgttaagaaaacccctggctatagtctagttgagttgggcaaccgtgtttatgaatttactatgggtgatagatctcatcctcaaagtcaggatgtatatgcactactagagaagattacagaattgttgaagttagaaggttatgtgcctcatactgctaatgtacttgcagacatagaggaagaggagaaggaacaagctttgtcttatcatagtgaaaaagttgcaattgcttttatgctcttaaatacaccaccagggaccccaatcagggttatgaagaatttaagagtttgtgcagattgtcatatggctatcaaactcatagcaaagatttacgatagagagattgttatcagggatcgcagtaggttccatcattttagaggtggttcatgttcctatatcgcaatcgcaatcgcaatgggggatctagagagaatggccatagaactcaaatgccctatctgttggagtttgctcgattctgctgtgtcgcttacctgcaatcatcttttctgcaactcgtgcattttcaagtccatgaaatcagcctctgcttgtcctgtctgtaaaattcctttcactcgtcgagaggttcgccctgctcctcacatggacaacttggtcagcatatatataaacatggaagcttcttcaggagttaatacatttgtaacccagaatgcccctgttactaacttatcagatggagaaaaggaatgtgaaggtgatgctgactctggcaagatgaaagctggtggaactcatgaaggtcgtccgcaggagaagaaaacccggaagaaaaagaagtctaagaagacggttcaggccagcatggaaagttcaggttctgagtttgcaaagccttcttttccagcaaagaaaagggtacatgtgccgcaaaatcttctttcagaaactccaatgaagaatttgaaaattggagactctctcagtgaaattaacaaagagaaagagggaacggaaaaggaaaaagatggtgaaatgttaagtcaacaaactgatgaggatcaaattattgatggctcaacaccaaatcctccttcattcagtgatctcaaggactctgatgatgaagtccattctaatgttgatctaatggatgaggtgcaaaataaaagctctgttaatttatttgacagtgaaatgtttgaatggacacaaaggccttgctctcctgaattgttttcaagtccctctaaaatgcaggtcatggatacttatgaggatgatgaaaatcaagaggaattggtggcttcctcactagagctggaggcaaatctgccaagagttgatgctgacaacatggaatttgagaatcccaaagaaggaaatagaatggctgatgaagtacctccgagtgtatgttttcctcaaatcagaagttctgatgatctaaatggaataaagaagtctacaaaaagaaggaaggctagagataaaaataaacaagagcagattggagaaccaaaaaattcatttgatgaaatgtatgttgaggttactcaggaacaagcattggacaattcttctaatctggggaagggtagtagaagaggcaagagggtttgtttcaataccagtccaattccaacgcctataactgcttgtacagtccccaatacattaggagttcaaagcattggtgaaatgaagaaggctaagaatatagatattttgccatgtaaacaagaaaatgagaagcattatgctcaggaaatttctggaaaaagccagatgaaaatatctggaaaacaaaatatcaatcaaatgaatgagtttgctggttctgattcatccattttcagtctgcgaacagataataacgggaaggactctaataggaggcaatgcaaaagcaagtattccagaaaaactatatattgcagtaaagaattggaaactactaaaaggcaaaaactttcctcggcttgtatctctaagactaaaaacaatgaagaaattctacctattgaaagtattcatcaaggtcctgatgtcagggatttgaatgatacatcaaaagagaaacattgtcccttgatggatcaaacagtgttaaggaaatgtgagaatcttgtaaaaaattatcaatgtgttttctgtctctcatcagaagaatcagaggcttctggccctatggtgcattaccttgatggcaggcctgtaacatcagattatgaagggggatctaaagcgccgcacttggttgttatgagaaaagctgtcgcaggagctttcatgttccttgtgccaagtggacttctcaatgtcgatgggatacgcaaaactttgtcatgttatgccctctgcatgcttcctccatgttgccctgtgaaggttcaggatcccaaaaaaggagcaagaaatgcacagctagtgagggaaaagcccatggagagggaagttgtttccgaatttgaaagagtatcgaaagctacagttttgaaaaattgggactcgagtgtcacccatgttatagcatcaacggatgaaaatggggcatgcagaaggaccctcaaagtattgttgggtatactggagggaaagtggattctcaatattgagtggatcaaagcttgcatgaaggaaatgggtcctattgatgaggagtgttatgaaattaatgttgacatccatggaattcgagatggtcctcgtcttggacgactaagagtattgaacaaggggtatctgcaaaaccttgtggttgctgctggagggataattctgcacagaaaaccagtgtctggtgaccaagaatcaacttcaccagatatgcatacataccaaacccttataatttacagcctcgagcttcctgataaatgtaagccttcgaaaaaggatacaatttgcagccaaaggcgtcatgatgcagaggttctggcaagttctacaggttcaaatgtagcaagtaatacatgggttctgaattcaattgcagcctgcaaactgcaataccttgctcaatga

SEQ ID NO: 106186 - DNA, 531 bp, Glycine max
  Peptide Sequence Number=SeqID_222964
atgggtttgatggaggaagatcctaaaataaccggattcacagttatcaatggcgatctcctaattttggcaactgaaacaagagtctacagaaggaaatatgccaacacagatacgaatccaaagtttgctttacttcctactcagatagtcttcgtttctgtggaccaggggctacatgtttgccttgttaagcttgttgttgtcaaagaaattgattatcgatatgagcatacagatttcaactgtactttcttcaagttcctattgctgctgatgattctccaagtattagctggaagcctcctccgattggtgtgctttgggtttcaaaagaaaaaccactacacaacaaagttcaggtcatcgactttcaacagaagacaaccaaatagcctcttacatgtatcagataaatacaagttgcaaaaagtgaatgcgcttcacaaaggttccagatgtagaagaagatcatgcagtctccacctaccaatttcgttaaaacagcattactacattgagtatctttag

SEQ ID NO: 106187 - DNA, 525 bp, Glycine max
  Peptide Sequence Number=SeqID_222965
atgggactggtctcccgattacggaatgtgcgcatcacgcgcaagttggcggcgggcttcggcatcgtcctgctgctggtggcgctggccacagcgctcagcgtgcaacgattcaatcagattcacgacatctatcagaaaaccaatctgatttatgacatcaacattgaagtctttcaggccaaaatcaatcgtcttaaatatctatacggcgaggacaaagcgggcggcaccatgacggattacgtcacgcacgctcagcaactgacgcagcaggcccagcagctgccgtggacggcggacgccagagggttgctcaacgatgtcgccagccatcttgcccgtttccagcacagcatcaccgccatgacacaggcaacccaacagctcaacgagctgcgcagccagctggacgcgctgagccagcaggacatgacgtcgcgctataccgggctaatccggacccccgtcagcacacccgaagtcaccaaccagatttatcagctgctgtttgccatcagtaat

SEQ ID NO: 106188 - DNA, 327 bp, Glycine max
  Peptide Sequence Number=SeqID_222966
atgaaggacctgaataatggggaagtgaagaacccatcggcgcttgaagacggagagagcggcggagaaggcggaaacggtggcgaaaaggagagagagggtgaagcgggggcgggggtggggggaggcgataaaggagagggtggcggagaagaggaggtgggaagggaggaagaggagaaaggagagaaagggggatggcatttcgccaattcgtttggcgaaacagggatggatggcatttcgcccatccctttaacgaaaccagcaggtatttcatgtgaagattcaggcggaacagggatggcattgtaccacgtgaataag

SEQ ID NO: 106189 - DNA, 714 bp, Glycine max
  Peptide Sequence Number=SeqID_222967
atgaagaagaaaccgagcgcgagagagaattcgtcgtcgtcgtcgtccacggcggccagagaagaagagagcgaatgggaaatgaggcccggaggaatgctggtgcagaaaaggaccgcgaatacggatgctgctgtaacacggaatttgcgcctccgaatcgcctacggtgctctccgttacgagatctgcgtcagttccatcgccactttcggtaagacaagttctggatcaaaagtagctgtttcagtgcagcactatgaatcatcattgcagatgctacgtgcccactgtgaaaatgacttgacaggggaagtgaagaaggtgctttgtggggaaacggggttagaggtggatgaacagaaactggtgtacagaggcagagagcgagaaaatggagagtacttggacgtgtgcggagtgaaggacagatcaaaagtggtgttaatccaagacccttcaagcattgagcgacgcttcatccagatgcgtatcaactctaagatccaaacagcacatcgcgcaatcaacaatgtcgctgtccaacttgatcagctcgcggaccaggtctctgccattgaaaagtctatttccaacggagtcaaagtaccagaagttcaaatcacaacactaattgagatgcttatgagacaagcaatcaaattagaaagcatttctgcagaaggcggtgcctctgcacagaaaaatttgcag

SEQ ID NO: 106190 - DNA, 171 bp, Glycine max
  Peptide Sequence Number=SeqID_222968
atggaccgcccagcgcgcattagtggatttcggcttagcgcatgcttttcttgctcagcggatggactgaagtggctcagcacacgactgtcaccaagcccaaatccacttactcacgctaagtgcaagggtggcgctaagcacgacatcgcgatttcagagcctatttaa

SEQ ID NO: 106191 - DNA, 1128 bp, Glycine max
  Peptide Sequence Number=SeqID_222969
atggccaccatcctcagacgcttcttcaccatccgttccgtctccgcctattccctcaccccattcacgcgtccacagccctctctccccctcacgcgccccctcctcctccacgcgcgcccttcctcatcctccacctcaccctccagaaccccatcggagaaacaattcgagacatgggtccaggccctcaagccgggcttcaccccctccgacgtggcccaggccctccaggcccagtccgacccagacctcgccctcgacatcttccgctggaccgcgcagcagcgcaactacaagcacacccaccacacctacctcatagtcatcaaacacctcatcgccggccgccgctaccaccacgccgaaaccctaatcgaggaagtcatcgccggcgctatcgatgacgcctccatcccactctacaactccatcatccgcttttgctgcggccgcaaattccttttcaaccgcgccttcgacgtctacaagaaaatgctcaattccaacgactgtaaacctaacctggaaacctattcgcttttgttcaattcgcttctcagaaggttcaataagttgaatgtgtgttatgtgtatctgcacgcggttaggtctttgactaaacaaatgaaggcttccggtgttattcctgatactttcgtggtgaacatgataatcaaggcgtatgccaagtgcttggaggttgatgaggcgattcgggtttttcgtgaaatggggttgtatggctgtgagcctaatgcttatagttttggctacattgccaaggggttgtgtgagaaagggagggtggatcaggggttggggttttatagggagatgagagaaaagggttttgtgcctagtactagtacttttgtgatcattgtttgtagtctcgcaatggagcgaaggttggaggatgcgatcgagcttttgtttgatatgttggggcagtctaggtcccctgatcatctcacttacaagactgtcttggaagggctgtgtcgcgagggaagggtcgatgaagcgtttgagctgcttgatgaatgcaagaagagggatgtttccatgggtgagaagacgtacaagagtttgttgaatgacttgtatgttatatgccgcgagtag

SEQ ID NO: 106192 - DNA, 264 bp, Glycine max
  Peptide Sequence Number=SeqID_222970
atgcatcattttcaaactaataacagtagagttaatactgtaaggggtagtgttctagattctgcgcatgctataggcacagggcaagaaaatagactgattgatcagggacatcaactatctctaaaagggtttgctggagacacagccaaggctcatgcaaagacaagtatgatagcaggagagggagtgagcaacatcagaacagttgcagcattcaatgctcagaacaagatgttatcggtgttctgccacgagctccga

SEQ ID NO: 106193 - DNA, 168 bp, Glycine max
  Peptide Sequence Number=SeqID_222971
atgattcaagcactgccatgggaggcgcagtggttcaccatgtgggaagcagcatctgcagaaaatggtgatggggtgaagaatgcaatggtgaagggactcagatcttcgatggtgaaaacagaggagtcgaagcaagggaaatgtgataacctgcgggatagatga

SEQ ID NO: 106194 - DNA, 1548 bp, Glycine max
  Peptide Sequence Number=SeqID_222972
atgaagagattgaaaactgaacctcccagttcgaggaggtttaggttgtctcatttcttgtttggtgttggggtgttatacttggtttttatatcgtgtaatttttcacagtttacgaaagttgtgtcatcgttaagtggggatgagagttacgatggaattggattggataaggtagcaactattgaggatactgaagatgcagatttgagcaaaccctttgtaagttctgtttataaagatgcatttcattggaggttagtggatgatagggaccaagatgctcccttgaggccaaaggaggaaccaatgaaggaagaagatcatggcactgaatctgtgaagcagattttggatgcatatggtaggattacaggggaaatcttgcggcaaaggaaccggaccggtgatttgtcagtgctggagagaatggcagatgaggcttggacattggggttgaaggcttggaaagaattggagcaggttggtgacaagggggctggagaaagctctataattgaaggaaggaccaagtcttgtccttcttggatatcgatgaacagggcagatttgttaaagggggatggcttgatgtttattccttgtggtcttgctgctggttcttctatcactgtggtggggacaccccattatgctcataaggagtatgctcctgtgcttgcaaggtcaaggaaaggtgatggattggcattggtttcggtttcgcagtttgtggttgaattacaagggctaaaatcagtggaaggggaagatcctcctaagattcttcacttgaatcctaggttaagaggggattggagcaaacggccagttattgagcataataactgttatcgaatgcactggggaacagctcaaagatgtgatggtttgccatctgaggttgctgaagaaatgcttgttgatgggtttaggcgatgtgaaaaatggatgcggaatgacattgtagattcaaaagaatccaagacaacatcatggttcaagcggtttataggacgtaagcagaagccagaagtgacctggccatttccttttgctgagggtagaatgtttgtccttacattacgtgctggtgttgatggataccatattaatgttgggggtcgccatatgacttcatttccatatcggacaggttttacacttgaagatgctacaggattggtagttaaaggggatctcgatgttcattcagtttatgctacttctctccctacttcacatccaagtttctcacctcaaagggtactggaaatgtcggagacctggaaagccagtgctctacctaaacatgctgttaaactttttattggagttctttctgcttcaaatcactttgcagaacgtatggcagttcgaaaaacatggatgcaagcagctgcaatcaagtcttcagatgtagtagtgcgattctttgttgcattggaacaccccgtcaagatgagtgcttttggtttgtttattaggggagtcccctgttacgagatcactcttggattattctacatcataccaagaatgtcgtag

SEQ ID NO: 106195 - DNA, 1833 bp, Glycine max
  Peptide Sequence Number=SeqID_222973
atgaatatgcctagctgcattcccatgcatgtcaccccagttgatatagttgccggggtttgtacaacgggactaccaagtgatgttaccattgaagttggcgaaatctcttttctcctccacaagtttccattgctttctagaagtggcctactgaagaaactcattgcagaatcctcaaaagaggatggatcaagttgtgttttgcaacttcatgatgttcccggtggagccaaaactttcaaggatataaccaggttttgctatggtgtaaaattagaaatcacatcattaaatgtagtcagcctcagatgtgcagctgagtatctccaaatgactgaaaactatggtgaagggaatcttgttgcacagaccgaggcctttctcaatgaaattttcagcaattggccagattccataaaagcccttgaaacatgtgaggaagtgcagccctttgcagaagatctccatatagtttcaagatgcattgattccttggctatgaaggcttgttcagatccaaacttattccactggcctgtggctggaagcaattgcaagcaaaatcaagcagacaacagtgcattgtggaatggaatttcttctgagaaaccatctcaactccatgattggtggttttatgatgtgtctttgttaagcctctccctatataaacgactgattatagccattgaagtgaaaggaatgaaatctgaggttgttgctgcatctctcatatattatctcaggaggtttctccctttgatgaataggcaatcaagcttcactgatacaagccatgctaccattcctaatacttctgaagcagaccaaagggctctactggaggaaattgtggagttgcttcctagtaagaggggggtcacatcctcaaagcatctgcttaggctgctccgcacagccatgatattgagtgcaagttcgtcatgtaaagaaaatttggagaaaagggtaggagctcaactagaccaggctgcgctagtggatcttctcattccaaatatgggatactcggtggagacactatacgatatagactgcattcagaggattcttgatcattttatgtctatataccagcctgcatccgtagcagcttctccatgcataattgaacaaggggcattgatagctggagctgatgcattgacaccaatgacaatggtggcgaatttggttgatggatatcttgctgaggttgcttcagatactaatttgaacttgactaagtttcaagcacttgctgttgcaattccagattatgctaggccacttgacgatggtatataccatgcaatagatgtataccttaaggtacatccgtggctgacagattctgaacgggagcaactttgcagattgatgaactgccaaaagctgtcattggaagcaagcactcacgcagcacaaaatgaaagattacctctccgagtaattgttcaagtcctgttttttgaacagcttagactccgcacatcaatatctggatggttctttgtttctgacaatcttgaaaatggacaacaccacagtggaaattttggcctgaccaatagtgatacacgtcaaggggaaacggcagagggaaatgaaaacttgagggaacgtcttttggatctggagaaggaatgctcaagcattagaaatgagctgcagaagctgacaaagacaaagaaaagttggagtattttcccaaaaaggtttggctttagaaaaaagtcagactttagcaaccataaagagtcaaaaagcaatgatacaaagacatcatcctccaatacgaatggaaaaccagatcatgaaaatggttga

SEQ ID NO: 106196 - DNA, 1833 bp, Glycine max
  Peptide Sequence Number=SeqID_222974
atggctgaagctgctgagcctaataaagcattgcctgaggcagagaagaagaaggagcagacactacccttttacaagctcttctcatttgcagacaagtgtgattggatgctcatgatctctggcagcataggagctattattcatggctcatccatgccggttttcttcctcctctttggtgaaatggttaatggctttggcaaaaaccaaatgaacttgaagaaaatgacagaagaagtatcaaagtatgctctctatttcgtgtaccttggccttgtcgtttgcatatcatcctatgcagaaattgcatgctggatgtacactggggagaggcaagtgagcacactgagaaagaagtacttggaggcagtgcttaaacaagacgttggtttctttgacacggatgcaagaacaggagatattgttttcagtgtttccacagatactcttctagttcaagacgctataagcgagaaggtggggaacttcatacactatctatcaacgtttctggctggtctagtggttggttttgtttcagcatggaggcttgcacttctgagtgttgcagtgattcctgggattgcctttgctggtggattgtatgcttacacactcactggcctcacatcgaagagtcgagaatcttatgcgaatgctggcatcatcgccgagcaggcaattgctcaagttagaacagtttactcttatgttggtgagagcaaggcattgaattcttattccgatgcaatacaaaacacattgaagcttggatacaaggcagggatggccaaaggtttaggcctgggatgcacatatggaatagcttgcatgtcttgggcactagttttctggtatgctggagttttcatcagaaatggacaaacagatggtggcaaggcgttcaccgctattttctcggccattgttggtggcatgagtttgggacagtcattttcgaacttaggcgctttcagcaaaggcaaagctgctggatacaaattgatggaaatcatcaatcagaaaccaaccatagtggaagatccatcggaaggaaagtgcttagctgaggttaatggcaacattgaatttaaggatgtcactttcagctacccttcgaggccggatatgtttatctttcgcaatttctcaatctttttccctgctggtaaaactgttgcagttgttggtggtagtggatctggaaaaagcacagttgtttccttgatagaaaggttctacgatccaaatgaaggtcaggttctgctggataatgtggacattaagacactacaactaaaatggttacgtgatcaaattgggttggtgaatcaagaacctgcactctttgcaactaccattcttgagaatatactctatggaaaacctgatgcaacaatggctgaagtggaggctgctacttctgctgcaaatgctcatagctttattaccttacttcctaatggctataacactcaggtaggagaccgaggagttcaattatctgggggccaaaagcagagaattgctattgctagagctatgttgaaaaatccgaatatccttctattagatgaagctactagtgctcttgatgcagggtctgaaaacattgttcaagaggcactagacaggctcatggttggaagaacaaccgtggttgttgcacatcgtctatcaaccataaggaatgttgataccattgcagcgcacatgaagtactcattgccaaggcaggcacctatgcctcactcattcggttccaagaaatggttggaaatagggacttctccaacccatcaactcgccggacacggtcatctcgcttga

SEQ ID NO: 106197 - DNA, 1377 bp, Glycine max
  Peptide Sequence Number=SeqID_222975
atggcttccattcacgccaatctcgtccccaacttgtcctttaatcacttccagacaccaccatcatcgtaccttgttggtgctggtattgtgcaacgtggagttagtttgcgcaattgtagaaggaaggttccttgcataataaagtgtgaaaagaaagatgatgaagttgaacacattcagaatgtttcagttgagcgtccaccctattacagttacttggactccacctccggccagctcgagccggcctccggtgcccgagcgagtattccgggccaagagtattggcccgagggaactgctagtcgtgtgagggctgcaagggcacctgctccaactgctgaatcatcaacctctccatcttatggaaccaagcctggaagtaggaggaagaattacaagacaactgttcctgctgctgctgcttcgtctcaacccattgttgaatcaaatggcactggttctggaggttcttctgaggttttgattgaatccttggaagagtctcaggatgacgtgtctgactttgttgtttatcagtcggaacctgaggaggaagagttgagtgaatacgagttcgataagaaacttggacttcctcatccgtttattgatccaaaggttaataagccgatagaggggacactttcgaatgacgagctgtggtggaattggagacagccggagaaagaacaatggtccaggtggcagaggaggaaaccggatgttgaaacgacaagagttctaaaagccattcagatatacgtgaaagtcataaattttatttttgataaggttttcctgaatgctatggcagaaaccgggcaaataaagcttcacggtgaacacccaacattaacagaaactgccctttaccgagcaaggcgtgaaatttataaagaagaaagacttcaggccgagcaagagagactggaaagagatggtccaattgcatactattcagaatgggtgaaagcatggaaaagggacacatctcgcgaagctattcaaaagcattttgaagagaccggagaagatgaaactactcaactaattgaaatgttttgccaccaaactgaccgagagtatcgcataatgatggggactgatgttcgaatccaaagggatcctttagcaatgcgaatgagggaggatcagataaagcaaatatggggtggagatccagtttacccaactgtgaactatattcaagatccaaatgaagtgattgactacagggggccagattttcatgaaccaacaccaaatatggtgtcttatctgaaggagaaaggaaaacttatttcaagggaggaatttgacaagattatggccaaggaaaagactgaacaaattgagatgagttgcatttag

SEQ ID NO: 106198 - DNA, 558 bp, Glycine max
  Peptide Sequence Number=SeqID_222976
atgaagctggaaccggctaacgacaggctcgaggctccggcgttcaccgccgtcagaacccggcgatcgtgcgccgtcaaagcgccggcgactgcgacggaggtcgccattacacggaaaaagctcgctccgaacggcactagagatattagtggtggttgtaatgacaatgtgagtgacatgggtggtgatgatagcaatctcgatgatgtcagtggccatggtggtggtggtagcataaatggtggtgatagttactatgacattgatcatagttgtaatggtagtgacagaggtgacattgttggcagtggtggtggtggtgacaatgacaatgcagtggcaataacattaatgatggtggtggtggtgataacaattgaggatgagggtgggtggatggtggtggtgatgacagcagtaattgtggtggcaccaagtggtggtggtgatggttgtggtggcgataatgacggtgatggtggtagcaataccgatgacgatggtagtgttagtgatgatggtggtagtggtaacgatgttggtggtgacagttag

SEQ ID NO: 106199 - DNA, 525 bp, Glycine max
  Peptide Sequence Number=SeqID_222977
atggcggttggtatgtcaggccaaacttttgtgtcagatacgagagataacatgagggctctgaatcgctggggatactatccactgattctgataggatcatgggcttttggcactattaaccacattcatgatttttttgaacccaaccataagatcttttggctcacatttcttgatgttggaacagctgctcttatgtcatatgtattgtcttcccggaggacgagccctggtgcagcggtaaagttgtgccttggtgacctgttggtcatgggttcgaatccggaaacagcctctttgcatatgcaaggggttttagagtggtttgattccaatttaagccgcatgttgtatttgctcaatgattattctctgggtaacagaaaacaagagggcctctttaactcaattgcttatggtctcaattcttctgttcgtagagcaatttgtgaaagactggacaacttaatgcttactcagctacttcttgttttctacctattgccactacctcctccttaa

SEQ ID NO: 106200 - DNA, 1057 bp, Glycine max
  Peptide Sequence Number=SeqID_222978
cccaattgcattatattggccatctctcctgcaaaccaagatattgccacttcagatgcaataaaaattgcaagagaagttgatccttctggtgaaaggacatttggggtggttacaaaacttgatcttatggataaaggaactaatgctgttgaggttctcgaaggaaggcaatacaggttgaaacatccttgggttggaattgtcaatcgttcacaagctgatattaataaaaacgttgacatgattgtcgctcgcaagaaggaacgcgaatattttgagactagtcctgaatatggacatttggcacataaaatgggggcagaatatcttgccaaacttctatcagagcatttggagtatgttattaggatgaagatacctagtatcatttccttaataaataaagcaattgatgagcttaatgcagagttggaccgaattggcaggccaatagctgtggattcagggaatgtcgaaaaagttgttatggaagcggatggttatcagccacatctaattgctccagagcaaggatatagaagacttattgagggatctattggctatttcaaaggcccagctgaagcctctgtggatgctgtaaccctcttgactttattccttgatctgtttaaaatggattttttggaatcaacacatagagctgctatagcacctgctatggccgcaattcagcctgctatttggtccactatggccgctaccctaaacttctccactacggcatcccctgtacatctcattttaaaggagcttgtacggaagtcaattgcagcaactgaggaattgaagaggtttccaacccttcaggctgatatagctgctgctgcaaatgatgctttagaacgattccgagaagaaagtaggaggactgtgacccggatggttgatatggagtctggctatctaacagtggaattttttcggaagatgcatcttgaaccggaaaagaacgcagatcaaaagaaccccaatcggagtaatcctaatccacctgtagacagttacacagataatcacctcagtaaaattg

SEQ ID NO: 106201 - DNA, 780 bp, Glycine max
  Peptide Sequence Number=SeqID_222979
gttacatctcctactgtttcttctccatctgcttctattgagaattctgtttctgttgagaattctgcttcttctcaacctgtttctgttgataattttgtttctaatgataatttaccttctattggtggttctaatgccggttctgttgagcattcagattccaaccctgatcatgatatgcagcaagagtactcagctctcattaacaataatatatgggatctagtctctcttcctcctaacaaaaaggctattggatgcaaatgggttttcaggataaaggaaaattcagatggatctcttaacagatataaagctagactagtggccaaggtcaaagcacagcctgataactctcttgttctcattcagagcaagtacatcagagatcttcaaaagactaggatgacagaggctcaatcagttgtgggagccttacagtatactacaattactcgaccagaaataagctttgcagttaacaaggtcaacctattcctcttagaggtctttgtgatgctgactaggcctcagatgttgatgacagaagaatacagaagtttagcccaagtaacagcagagattttatggattcagattctcttgtctgaattagaaagagttctaacaaggcagctgattgttaatcacattcctggtcttgatcagtgggctgatgctttaacaaaatccttatctccaaccaggtttcagtttctaaaaggcaaactcaatgttattgattcttcttctaagtctcgaccaccttcagtttga

SEQ ID NO: 106202 - DNA, 711 bp, Glycine max
  Peptide Sequence Number=SeqID_222980
atgaatggtggtgattggagaattccctctttgccggatgccaaattccctgttgttactgtggctatcaaaaatattattattcctattgattctcaggtggatagtttagtctggaccccattggtcttgggggaattgtttttcaaagatgcttttatgcttgtcaatccttcgatgcgtgttctgccttcgacaaagattatttggaggagctctatccctccttctaaatcttttttattttggaggcctgtccgtggcaagatgccaacagatgaaaacctgtggaatagaggatgtgtggtggtctcggcttgtcctcactgctacagggactatgagacatcagatcatctcttcctttcatgcccttttgctatagagctaccgaaatggctaagcagtgtgattcattttggtaactcagatggtgcagctcgtggaacacctggtttagcagccagtggtggcttattccgtgattacatggaagtagacttctgcttcaatgctgaactgcatgctgtcatgttgatgattgagtttgctgaaagactccagggtcatacctggtgggatgaattgcctagcttttttaaagatgatttttacaggaatagggtgggtttacctttttacaaattctgttatattgtaaagctgttggacttggattgtatgctccttgtggactatttctactattaa

SEQ ID NO: 106203 - DNA, 375 bp, Glycine max
  Peptide Sequence Number=SeqID_222981
atgccagagagaggcagcgtgtgcggtggtagacaacaacgaggttggcagtgttggattcacaggagagaagcacttttgattggaggatcacactggcgagatggctgtgaggtagcagtggaagtgtgctcccagtatgcacattactgttcatggaaaaggagcactgcggcggaaactataacaaaaatcaaatcagctatccctcaccctctacaacattgctactgcatcaatgatactaaggatcaattgggggctttgttggatgaagaccctgcacttatggaaaagagagcacaactagctaaaaggcttgaattgtacaagcaagctatggatgatattaactctgtggcttggaataaataa

SEQ ID NO: 106204 - DNA, 1233 bp, Glycine max
  Peptide Sequence Number=SeqID_222982
atgagtactaaaaggaacacatggaagtctgtgatcttgatcctaagttgttacaaggttaagtgttccttggaggaatcagagaaacaggtcttaaaacaaggttctttccagaggctatgcctatctgatgtgagcaattcaagctccactcaggccattgaagatatttcaatttcattcgctggctcaaagctctatgcattcacacttgaggagctaagggaagcaacaaacagtttctcatggagtaacatgctaggtgaaggagggtttggacctgtttacaagggttttcttgatgacaaacttaggtctggtttgaaggctcagactatagctgtgaaaaggttggacttggatggcttgcaaggtcacagggagtggctggcagagattatatttcttggacaactaaggcatccgcatcttgtcaagttaattgggtactgttatgaggatgaacataggcttttgatgtatgaatacatgccaagaggcagcttggagaatcaactattcagaaaatactctgccgccatgccatggtcaactaggatgaaaattgcattaggagctgccaagggtctgaccttcctacacgaagcagataagcctgtaatatatcgcgatttcaaagcttcaaacattttactagactcagatttcacagctaaactctctgattttgggctagctaaggatggccctgaaggggaagacacacacgtaacaacacgcataatgggaacacaaggttatgctgctcctgagtacatcatgacaggtcaccttacaaccaagagtgatgtgtatagctatggagtggtgctgttggaattgcttacaggaagacgagtagtggataaatctcagtcaaatggaaggaagagcttggtggaatgggcaaggcctttgttgagagatcagaaaaaggtgtacagcatcatagatcgtagactagaagggcaatttcccatgaaaggagccatgaaagttgctatgttggcttttaaatgcttgagtcatcacccaaatgcaaggccctctatgagtgatgtggtgaaggtattggagccacttcaggactatgatgatgttttcattggaccatttgtgtacggcatggcttggtggtcttctgtcttcacaatcatggaaggggattcaagtagttctatgatcacatctgaactgaggccagaaatagagagatcagctgcagcaaaatga

SEQ ID NO: 106205 - DNA, 242 bp, Glycine max
  Peptide Sequence Number=SeqID_222983
agtctttagacgaagatgatagtcttgacggtatatctgatacacacgatgaagttgccgacatgattcaaccagtgtacaaggaattgaaaatccattttggaatgatgctttgcattataacaatatcaactagagtcatcctgatgaggaagacatttgtggtttggagatgccatcgagttttaatgttggacaagaattatatgttggcatggattttgatactaaagatgcggtaa

SEQ ID NO: 106206 - DNA, 513 bp, Glycine max
  Peptide Sequence Number=SeqID_222984
atggactcttcggagtgtaggccttgggggtcacatggtttgggtgctcctttaagcatgtgccgatctcacaaggttggagcattctcacaaaacaatgtgaccctgactggtctccctatgattttacttagtgagagtgacttgacatacccattgtgtggtgtgtcttgtcatgctgattgccattttgttcagctgaagtcgaccaaggaattggattgccatgctaaagatccccactttaggataaaatccaccactttgggtttggctcacttctttatagaagctatcttcgacatcatggaggatgtgggtgctttgttgaatcttgtcactattgatcattttgtctttgcctggttgaagatggatccaattgttgatttggacgctaaagccattcaatcaacaaattggggaagcatcttattggctagagatatgttctatggagtcaaacctacttctcgttataacaagatctctgtggaacactacaacccttaa

SEQ ID NO: 106207 - DNA, 156 bp, Glycine max
  Peptide Sequence Number=SeqID_222985
atggaggtagtatttaagaaaggtgaccacattgatcacattgtcaatgcaggggcgaagccaccaggggctaagggttcttggtcttttgggttattggaaaagatagaggtagaagatgatgactcatcattggagccatcaccatatttgtga

SEQ ID NO: 106208 - DNA, 675 bp, Glycine max
  Peptide Sequence Number=SeqID_222986
atgaagcttcgaaagaagaaagaagacaatgtcatttccgataaccgcttcaagctcctcaacgaaagggaggtttttgaagaaaaagcgtacctcgtaggcattgagtgcaagaatgatgttcaggatttcggcatcgaagagtctctgagcgaattgtcgcagatgggtggtggtagttccgggtcaggaaagggaggagaaaagggagtttcgcaggggtgggtgaatgagggaggtagcctaagggagactgataatcctgttagcaagtcgtacgaactccgtcaagtattcgttgatggaccccttctatgtgaacttgaacagtgcaccctttggatcatcatagaaggtaggagtgaagcaagattccaatttttggaggaatgttgcccaggaagtgatgaagtcattcctgaacgagattttaaagatccatcccatggcatcgtggccgtcaaaatggggtacctcaagcttgaggtgagggcgatggtggttgtggggcagtggggaaggaggtggtgtatggcagaggacgacatcgtcgaggcgatcagtggcggatttggaatgtgtgtggtgttctgtcatggtgcaacaggaacgatggtaggtcggactagtttgttacgtgattgccttgtattcgaggtcaaggctccctcctaa

SEQ ID NO: 106209 - DNA, 294 bp, Glycine max
  Peptide Sequence Number=SeqID_222987
atgcccctaaggatcaactccaaccttgagctcttgataccaatatattacgcaaaacagaacctacgaatacttgagatggtcgcaacaaacgagagagaaaatgagagtaaagagacaacaagaggagccagcaccacaggtgtgaggccttcaaagatgcacatttgctttgatctcaaagatggagaggatcacaatgtttttgttgacccttctactgaggaagagctgaaagatgaggaggaggctggagactatgattggattgggcacaagagtggtaacctttag

SEQ ID NO: 106210 - DNA, 3444 bp, Glycine max
  Peptide Sequence Number=SeqID_222988
atgagggcgttgttggttcatcaggggctggatgttgctcttaatgggaagaacctcccaacgcatttgtcggagaatgagaagaaggagttgcttgacaaggcgcacaatgctttgattctttccttgggtgacaaggttctaagggaaatatcaaaggagaaatctgttgcggcggtgtggctcaagctggaaagcctatatatgaccaaatctttggccaataggttgttcttgaagcagaggttgtacacgttcaagatgccatcaggtaaatccttggaggatcacttggatgaagatgaggatcaagcgttgttgctactcagttcattaccaagtgaatataatagcctatcagacacattcatatatggtagggactcgctgtcattggatgaggtgaaggctgccctattttcgaaggagttgaagaagaaattagagggaggtggctatcaggatgctgaaggattgtatacgaggggtataatgaagaagaaagatcccaagaacaagaatggatcaagatcaaagtctcgtgatggaaggaaaagaagcatctcaagaaagattgcccagacacaaggaaaaagaagcagggcaatcaaaagagtcagaatggagatgcggacgtggccgcagaaagaatgcaatggaggccaggttcttttgggtgacaataaagcctgcaaggtggttgggattggagttgtagagttgaggcttgcatacggcaccatcaggatgctgaaagaggtgaggcatgtgccttacttgaagagaaatttgatttctcttggtatgttggacaagcagggggacacatgcaaggctaaaggtggagtgctgaaggtcacgatggggtccttagtgatcctaaaagggagattggtgcatggcttgtatctcctagaaggaaacacaacatcgcccagcattgcgtcatccaatactgcatcatccagtgccgctactatgaccgcacagacgcactctcaggcaagcctaagggaacttagcaagcagaagttgcttggcaaggagagtttggacgcattggagttttgtgagcactgcatctacggcaaggccaagaggttgaagtttgctgttgcagaacaccattcgaaagggactttggactatatccatagcgatctatgggggcctgcatatgttttttcacacagtggagcaaggtacttcctatccatcattgatgatttttcgaggaaggtatgggttttcatccttaagagtaaggatgaggtctttgctaagttcaaagagtggaaactgttggttgaaactcaaaccagcaagaaagtcaagaagttgaggactgataatggtttggagttttgttctaatgaattcaatcagttctgtaaaaagaatgggactgaaaggcatagaacggtcaagggaacacctcaacagaatggacttgtagagaggatgaaccggatgattatggagagagtcatatgcttgctgtctgacagtaattgtttggggcatttctggggtgaggctgtgatgacaatatgttacctcaccaataggtgtccgtccactgccaccaacatggtgactcctaaaaagatgtggagtggtcatccacccaacctcaaaaatttgagagtgtttgggtgtgtggcatatgctcgcatcagacaaggcaagcttgaatcaagggcctacaagtgcatgtttctggggtacccacaaggagtgaaggggtacaggttatggtgcatggataaggggcatcctcgtgtcttgataagcagggatgttgtgttcaaggagtctgaaatgtatcacttgaaggaggattcaagtaaagggaaggcagtgtggatgcaggagagcgtccagttggaggtggagtctgttgcaggatcgtctagtacaagagggggtcgtccactacttgggtctacaggtgctgaagtggagcgtccagagcacgggtcgtctggtgccagagtcaagacgcaaggggaggaacaggaggctggcatcatgcgctcagacttgcaggactatctcttatcacgagatagggaaaggagggtcagcaacccattaaaccgggttgggtgtgctgacatggttgcattcgcgctcaatgttgctgagcacattgagggaagcgagccgaagagctatgtggacgctgtgaatagaaaacactccaaggagtggacgactgctatgcaagaagagatagactcgttgcacaagaatggcacttgggtgttagtagacaagccaaaggcgtccaagctggttagctacagatggttgtacaagctgaaggaggaaattccaagagtggaaaaggttaggaagggtatcaattacaatgagatattctcgcctgttgtgaaacactcatcaatcaagatggtgctagccttggtcatccagcaggacatggaattggatcagttagacgtaaagacaggttttctgcatggagaactggatgaggagatccacatgatgcaaccagaaggcttcatagaggagggcacgaatgacaaggtgtgtctgttgaagaagtccctctatggccttaagcaatctccaagacaatggtacaaacgttttgatacttttattgtggggattggtttcacaaggagtgagtatgacaactgcgtctactcaaaggttgcactggatggggctgtcacatatcttctactgtatgtagatgatatgttgattgcgttcatatgcaaggcaaacattgaggaagttaaagtgttgttggaaagggaatttgaaatgaagaatttgggtgttgcaagtaagattctggggatgcagatcacgagggacagggtccagggagtgttgtgtgtggatcagaggagctatgtagctaaggtgctgaagacgctcaacatggatcagtccaaggcagtgttgacacccatggcccagcatttcaaactttctcatcagcactcacctcagacgaaggaagaagcaacatacatggagaaggtgccgtatgcgaatgcagtgggtagcctcatgtatttgatgatttgcacaaggcccgacttggcatatgctgtgaatttagtcagtaggtacatgggaaaaccagggaagtatgagagctcaatggacgatgtggttggatttgttgattctgactatgttggatgcctcgacaccagacggtcacttactgggtatgtgtttaagttctgcggtaacactgcaatcaaggaggttgtgtgcatgaagggtatggcaacgaacttgcatactaaggtgaaggtgttaagggaggttattgcaaagggggaaatagttgtcgagaagatgcacactgaagacaatccaacagacgcattgatgaaggcactaccagggcctaagttcaaacattgtgtgcagatcatgaaggttgaagga

SEQ ID NO: 106211 - DNA, 421 bp, Glycine max
  Peptide Sequence Number=SeqID_222989
atggggaaccaataccaccaagcaacagatgggcttctgagccttttcacaaaggccaatcacgatctctctatggttcaccatcgtctcgaaaaggagtttcagcaggtttaccccgacaacgctaaccctatgaagctggtttctagaatcaagaaggttcaggaagatatatcaatcttgaaggggcagtgccatgagcttctggctgctaagcaggatttgattgataaggctcagagagttctggtggagaacagaaatttggtgcagcgtatgcagccgtccttgggcatctccccctctggtgaagatgatgctgcattcactaacttcaaacaggagttaggaaaatccagcattccagagtggcacttcctattgttgcatagctccatccaacctcctgcgcctgccttag

SEQ ID NO: 106212 - DNA, 366 bp, Glycine max
  Peptide Sequence Number=SeqID_222990
atgggcaacaatctaccaccggcaaatgaagtgatagatctttacagatcaaataacataaggagaatgagactatatgatcctaatgaagccgctttacaagcacttagaaattctggcattgaactcattcttggggtgcccaactcagaccttcaaggccttgccaccaacgttgacactgctcgtcaatgggtgcaaagaaatgtgttgaacttctggcctagtgtcaaaatcaagtacgtagcagttggcaatgaagtgaatccagttggaggatcctcttggcaagctcaatatgttttacctgccgtccaaaacgtgtaccaagctataagggctcaaggccttcatgatcaaatcaag

SEQ ID NO: 106213 - DNA, 573 bp, Glycine max
  Peptide Sequence Number=SeqID_222991
atgtctgatgaaatcagtcttattttgcaccacaatggtaaattcatacaaaatgcaaatggggcactagagtatgttggtggtgaattctgtgtttggaaggaagttgaaacaaatttggttaatgtctggacagcccaagaattgtgcaaagcttgccgcatttatgtgaagtttgtttcaatatattacttggtgtctggtattggtttgcaaaggttggagaatgatcgtgatgtgttgtctatatgccaaattgggcttgctgatccagaaaaaaaagtgcttgtatacttagaaaatgatgatccaaaggggggtcctgttaatgacattgggccagtgattaaagtacatggaatgcctataaattgcagtgcagaaaatgtgattgaggttgttgttgaagagtgtactcagaatggtattaaagatatggatgttgatggtgctaaaggtggttcagatgatgaaatgaagtacttggaactagtgtacaagatgcaaaaattgaagttgttgaaacaggagttgaaacagaacatgaagttgttggaattgaaactgaagtga

SEQ ID NO: 106214 - DNA, 138 bp, Glycine max
  Peptide Sequence Number=SeqID_222992
atgggggcaatatacagattagataggaatattttttttttaatcttgcaagtgcggaacagtttcttggtccacttgcacgttgatgagcgtgaatgtcgcgtcctcactctaaagggttggagaccctgggactag

SEQ ID NO: 106215 - DNA, 804 bp, Glycine max
  Peptide Sequence Number=SeqID_222993
atgggcgacaatctaccactggcaaatgaagttaccttcaaggccttgccacctagcactgctcaacaatgggtgcaaagtaacgtgttgaacttttggcctagtgtcaaaatcaagcacgtggtagttggcaacgaaattaatcctgttggaagctcttctgagtttgcccaatatgttctacctgcaatccaaaacatataccaagctataagagctcaaggccttcaagatctaatcaaggttacaacagctattgacatgaccctgttaggaaactcctaccccccatcacaaagctacttcaggactgatgtgagatcatacttagaccccataattgggtacttggtatatgcaaatgcacctttactagccaatgtgttgccttattttagttactccaataacccgattgacatatcactttcctatgctctttttaactcaacaaatgttgtggtttgggatggtcaatatgggtaccaaaatttgtttgatgctatgttggatgcggtgcatgttgcaattgataacacagggattggttatgtggaggttgttgtatccgagagtggatggccctcagatggagggtttgctgccacttatgacaacgcacatgtctacctggaaaatttgattcttcgtgctaaaagaggtagcccaagaagaccttcaaagcccacagaaacttatatattcgacatgcttgatgagaatcttaagagtcctgagatagagaaacattttggactcttctttcccaacaaaacaaagaagtatccatttggatttgtttag

SEQ ID NO: 106216 - DNA, 377 bp, Glycine max
  Peptide Sequence Number=SeqID_222994
agcgtgtagcctgtggtttccccagtccggcgcaggattatgtggaggatcgtctcgatcttaaccggctggcagtgagacaccccagtgcgacctattttatcaaggtgagtggagactccatgattggcgcagggattggcgacggcgatctgctggttgtcgaccgttcgttaactgccgggcatggggatatcgttgtggcctcggtcgccggagagtttacggtgaaggagttacagacccgtccggttctgcggctgctgccacataacgttcgctatcagccgattacctttcagtccgaagaggagctgcagatcttcggcgtcgtcacccacaccctcaaaacgcataaacatgttcgcgctggttga

SEQ ID NO: 106217 - DNA, 228 bp, Glycine max
  Peptide Sequence Number=SeqID_222995
atgggtgagccgtattttaaattcaaagagaagcgttttccgtcacgggtttacgtgtttagttcaaactatgcgctgtatgccgatctcagcagtcgggtgatgcagacgctgaccgatctcgccccggcaatagaaatctactccatcgatgaggcgttcgtgaacgtttcaggggtcagtaactgcctggcgctggaagcattcggtcaccagatgcgcacgcag

SEQ ID NO: 106218 - DNA, 789 bp, Glycine max
  Peptide Sequence Number=SeqID_222996
atgttgcgtccgctgcctgcctgcatcaccccgacgttcacccgggatgcgccttcgctgtgcgtggcgatgctgtgtaacgcgatggcggcctgcacggcggcgagcagggcattacgtccgtcctccggtttgccgccaggcgtgtgcggccacgccggtaaagttcacgtcgaatttggtggtcgccataaaattatcgctgccgcagatcaccgtcccggcaggcacgccggtgccaatatggatggcggtgaaatagtccacgtcatccagcgctccggcggccaccatggcacgcgcgccgcgcgtcccttcttctgcaggctggaagatcagcttgagggtgccgctgagctgcgcgtcattctgcttaagtacctgcgccagccccagaccaatcgtagtgtggccgtcgtgtgcgcaggcgtgcatcatcccgggattgcaggaggcaaacccgtcgcggaacgggcggtggctttgatcggttgggcccgggcggccggtattcagggtcgcgacaatcccggtaaacccgccctcaaacggcgccagccatttctacggcgcgccctgggcacgggcgcgggcaaattctcgcgccaggatggcctcatcgggcaggcccattcggctttcggcatccaccacgtcgcgccccatcgccagctcataacccagcgagtccagggtttctgcgaccttcgccgcggtacgaaactccacccagccggattcagcaaactggtgaaaatcgcgacgccatgcgctcagctgcggggttag

SEQ ID NO: 106219 - DNA, 312 bp, Glycine max
  Peptide Sequence Number=SeqID_222997
atgatgacaacaaaagattatgacaaaagtgatgaacaaaaagctcaagagaatcaaagaacatccatctcaagaaaatctagaacaagtcaaacatttcaagaatcaagaagaattcaagactcaagaagaaagcctacaaacaagaatcaagattcaagatctcaagaatcaagatcaagattcaagactcaagattcaagaatgaagaaaagactcaatcaagatgtaactcttcaaaaaggttttgactctttcaaatgggttttaagtttttctaaaagatataactcttctggatggctttcttga

SEQ ID NO: 106220 - DNA, 375 bp, Glycine max
  Peptide Sequence Number=SeqID_222998
atgtgtcatgtctggtctacgattgacacatggaaatccaaatgcactagagctgccctcaaaaaactcaatttggtagaagatagatctattccaagggtacaagctcatttctttcctaagaatatatgtgttagttggtcacttgcccttatgtgggaggttgtggaggcaaaaaatcgaaaagatgaattggattcggggccagcacctccagacaaggtaagagtggaagcttttgtaccagtattccgtatggtggtattaaaattagaacaaagggagctgtcataccctaatttcgtccggggacctttgcttgatgacatgcgaccattctttggtcctcgtgaggtgcttggcacccatcattag

SEQ ID NO: 106221 - DNA, 624 bp, Glycine max
  Peptide Sequence Number=SeqID_222999
atggagaaggcttttgcttggactgagggattgaatggaatcaatagtagtgattcttgcatgatcaaatctgataatagctatgaagcatggatacctcttttgttcaaagtgttgccatgttgggcaaattcatctgaggaaacacctgttttgtcacctttagtcccagtttcattattgggtagttcaaaaggtgaagaccagaagcaaaaagttgttactaagcaaagtccaaagaaggtcaacttggttgctgctctggttcgtggtatgcttgttaaagatgcattgatgcagttggaattgacaataaaacgagcagcaaaaactgtatatcaggagaactattcctgcttcttgatcggcaattctgagttacccaattccgaggagaactatgtcctgaaagaggaatgccgagcttcaattctgagttacccaattccaattcatgataaatggttcccaagccagactagacagttgacagcagtcttgctgggaaccaaactagacagcttggttatacaactatcaatacactatgactgctacccttgtctaaaaatgaaagcctctctaagggttgaggatgttgcaagagtctgggatccttgctga

SEQ ID NO: 106222 - DNA, 723 bp, Glycine max
  Peptide Sequence Number=SeqID_223000
atggaccctggacaccatgaagttcgttatgatcatgaagacaaccacagggtcttcttggttgatggggttgatgcccttgaagtccttgtccgtgaagttaatgttgatgtcccggatgacgtggtcgctcatgccgttgtggctgtggtctttgtctgcctcgatcttccactcttcttctatttgcttcctggttcttgtgctgctcctcttgatgtcctcctgtatttggttatgtctgaccctgaccttggaagtttcgtcttgggtagccggatgggtacatccaggttgaatacttcctcgagaatcgtgactgataaaggtggtcgaggtcatgcagtgagacttgctggtggcatactgcgcactaaattgttcaacgagggtgttgaagttgtctatggaccttggttcgcctatgtgaggaaggcatctagatgctcatttggatctgttgtcccgttgtacccctcgaggttgagtggtttccaccccaagggcatgccagcctccataatgcatgttgcctgtgtgtcggaggtgttgttccccttaggtgcgttcaagcaaggtgtgggcaaattgctcgtctccttagggatgtctaacatgagcctccagctgagtgtctgtgtctgtcataactaccagatgaggatgggagtctttgagaagggtctcgtgtttgaggctagatcgactgctaaccatggatga

SEQ ID NO: 106223 - DNA, 219 bp, Glycine max
  Peptide Sequence Number=SeqID_223001
atggcatatgggagacagaacctgcagatgaggtgtttccaggatgtccattccccacatggcgaaggaccaaagggagctcaaactgtgaagattgacaggaggagtgtgtggcacgtctgcaaagtcatggcatcgtctacatctcctggtaaagtcgagggtgtctaccttgagtgttggccagtagtagtcagctcacaccgctttggtggctaa

SEQ ID NO: 106224 - DNA, 1238 bp, Glycine max
  Peptide Sequence Number=SeqID_223002
aatcagaacggtgaaagctaccacttcgaatggggcgcagattcgctgctgctggcgcaggtcgggctggacggtgtggcaacaagctatgactacgatgccgccggacgcgcagttgcccgcactttcgccgccggtcacccgcaggccattacgcaccgcttcgccttcagcccggcagggcaactaatggcgcgcatcaccccggaaggccagacgcgctatgactataccgcggcgggccagctggcaagcgtggcgcagcatctgccactgggggaaaaccagtggagccgtgaagccgagcaggcgattactttcgcgtatgacaaagctggtcgcgtgatagcggagcagggcgatcagggcagcctggcgtggcagtatgacgcgctgggcaactgcactgcgctgacattgccggatggccgccagctgaaacagttgtattacggcagtggccatctgctgagcatcgcgctggataacctgccggtcagcgaatttacgcgcgatacgctgcaccgcgaactgagccgcagccagggcggactgaccacgcgcagcgattacgatcggctgggtcggctggtgcgtcgcgatgtgttcgacggtgaggcacagcgcccggcaccgcgccgctggtcacgccggcgtgatttcgactacggcaacaacctgatccgcgaacagcgcgacgacaatcctttcagccagacgctctggcactacgacagcgcgggccgtctgctggtgcaggaaggtgctcagcccggtaatgatacgtggcgctgggatggcgcgggcaatccactggaccgtagcgcggcagcagcggttacgcacaaccgtgttacgcagcttaacggcatccgctggcgctacgacgtacacggtcgcaccagtgaaaaggatgacggtcagacgcgctggcgctaccgctatgatgacgagcatcgcctgatcgaagtcgtcagcgaaccgcgcgatcgcaacaagcctcaggtgcaggtgagtttccgctacgatccgctcgggcgccgcatcagcaagcgcgtgcagcgtttgctgcacggcaagccggccggagcagcgaccctcacccgcttcgtctgggacggttttcgtctgctgcaggaaatacacgacgatgtgccactgacctacgtatacagcgacgcaaacagctatgaaccgctggcgcgtattgacggcaatgagggcgcggagattttctg

SEQ ID NO: 106225 - DNA, 534 bp, Glycine max
  Peptide Sequence Number=SeqID_223003
atgaccatgattacgccaagctcgaaattaaccctcactaaagggaacaaaagctgggtgagagcagaggaaacaaagaacaagagagttatgttggctttgaatgttgattgcagggcacgtttggagccacctattccaccaacatattttggaaactgtgttggagcgagacttgcaattgctgaaacaagagagatattgggggaagatggcctaattgtggttgtggatgcactgaatgatgccttggggagtctcaaggatggagcactgagtggagcagaaaattggtcaaggtggttgcttgaaagttttagtgatgatgtgagaataattggtgttgctgggtcacctaggtttgaggcttatagtaatgactttggttggggaagaccaaagaaagtggagatggcttctatagacagaactggggcactttgtttatcagatagcatcgaattcctgcagcccgggggatccactagttctagagcggccgccaccgcggtggagctccaattcgccctatag

SEQ ID NO: 106226 - DNA, 243 bp, Glycine max
  Peptide Sequence Number=SeqID_223004
atgcatgaacgaaaacgcaattcatggggctccgaagaaaaggcgaggatggagaattgcactagagggtccgcactaggcaatcatgaagcatggctccaaactctttggtggaggatgcatgaacgaaaacgcaattcatggggctccgaagaaaaggcgaggatggagaattgcactagagggtccgcactaggcaatcatgaagcagtggctccaaactctttggtggaggatgcatga

SEQ ID NO: 106227 - DNA, 459 bp, Glycine max
  Peptide Sequence Number=SeqID_223005
atggagaattgcactagagggtccgcactaggcaatcatgaagcatggctccaaactctttggtggaggatgcatgaacgaaaacgcaattcatggggctccgaagaaaaggcgaggatggagaattgcactagagggtccgcactaggaaatcatgaagcatggctccaaactctttggtggaggatgcatgaacgaaaacgcaattcatggggctccgaagaaaaggcgaggatggagaattgcactagagggtcctcactaggcaatcatgaagcatggttccaaactctttggtggaggatgcatgaacgaaaacgcaattcatggggctccgaagaaaaggcgaggatggagaattgcactagagggtcctcactaggcaatcatgaagcatggttccaaactcttggctggaggatgcatgaacgaaaacgcaattcatggggctctaaataa

SEQ ID NO: 106228 - DNA, 1278 bp, Glycine max
  Peptide Sequence Number=SeqID_223006
atggacagatggcaggagtctttcaatcgcttcaggcatatctttggtttgaatgcacaaggaaaatacacagacatgccagtttactatattccgggaaaccatgatattgggtatgaaagtcttcattctctaaagccagaggtatttcaacatgctatagctcaacttttgatgcccaaggttatccgacgctatgaggaaacatttgggattaggaactacagatttacagttggcaaagtggattttattgccgttgatgcacaaactctggatggacacccacaaaatcttctgacttctcaaacttgggattttgtgaagaatatctctgctgatgatgtggttcatccaagagtcttattgacacatattcctttatatcgacgtgatgatacgtactgtggtcctgatcgtagttccccaattatcaatcagaggatacgtcacagtctaaatggcaatactaatgatatatcgatgagtgagaacataggggaattgagagctgggactatagtgaggaagcttattttatctggtcatgatcatgatcagtgcactgtcagtcatcaatctaaatctgggcctgtaaacgagcacaccctaggtactataagttggcaacaaggaaacttgtatccttctttcatgctgttatcagttgataactcaactcatccaaatgcttccattcctaaagaggctttgttgactcatctatgttaccttcccatgcaaacacacatttacatatggtatattgtgctatttattctgacccttcttgctgccctattttggccaacaagtggcacgagtttctggcatcagtgttgcggcttatttggctattgtaaacaactaatagcttgcatcttttctagaagcgaaacgaaagaaaaggatgaggacgctaactatgaatatgagatgatgtgggatgcagaaggaacaatgcatcttgtaaagaaaaccttgaatgcatctactgtaaattcaaatgaccagagcttaggggaaaggggttacgttgtgatgcgagcagcggctagaaaaaatactgctcaggaaggagatctctctgtgaatgtggatatggcttcaggcattggtcttgatcctgtagcaaaaatgcctcccagaacgggcaaatcaaagacaaaaattatagtccagagattgatacgcacactgcgaatgcttactgtcatttcagcagtgaatgttcctctttacatgatgttgctattcaaggattggattgataaatag

SEQ ID NO: 106229 - DNA, 186 bp, Glycine max
  Peptide Sequence Number=SeqID_223007
atgtctcctccacctctaggacctcacaatcactcacaaactcatctcaagctctcaggacgacttcctcttcaagctccagtctctattcttcctcgcgctcagccgagaagtgttgcgctcagcggatggcttactaagccagaagattggcttagtgagagggtgaaaatcaacacttcataa

SEQ ID NO: 106230 - DNA, 481 bp, Glycine max
  Peptide Sequence Number=SeqID_223008
gtctaacattgtgatgctattcgcaggaggatcaaacggtggagtagtgaagaacaatgcatcaagcccaccagccattaatcacgtgcagccatattattatccagtgaggacaactgctgctctgccattccataatcacactcttcctttctatgggtatgcgcctacctacattgtgacggacgtaaactacaattacaatcagaaactgtgctatggtagcggtgggacctacatgaatgggcagcatgtgtacccgaggcaggctattgtgggtgccaacacactgatgccaatgtaccctctttatcagtatcatcatccaacggagaccataggtgtaccagctcacaacttttatccaacggcatcatgggccccaatgaccatcatgtccaagccatcgtctatcgttcctcatacaggtgcgtcacatggtaacatgtccgtttctttttactgtacagcagtaacataa

SEQ ID NO: 106231 - DNA, 627 bp, Glycine max
  Peptide Sequence Number=SeqID_223009
atgtctgaccttggtggcgagtgccactgcgtttcagcgctaggtcttgagtgtcattctgcccttgatcgcttttcagtgtgctctactagagcacttgaatgtggcctcttcccaacttcacccaaacagttgagtgatagtagtgacaagattggatgggtctccttgaacaatgttgagtttgattcaaacatcttccgccatttaaaggaccattttttcaagtctgaccctacccttgtagagagggtcaacaaagcaattttggagcagttggtgacctcgctggacacatggctcattctgtctctttcatcagcaagtgatcctctcgttgccttggatggtaaagtgcctaaccttgtccttaggccactcatgaagcaggttggacctacaagtgggactgtgccactgtttgctgctactccacccgttggagaagggggtcaacttgctggtgaggtttgccctattgttgttggggctgaggctgcagggttgatggctactacgggtcgcctttcgattgtgcaagatgtgcatccagctccaccgattgtcaaggctcctgctactgttgctactcctgcttcttcacctcctcccactattgttgtttag

SEQ ID NO: 106232 - DNA, 216 bp, Glycine max
  Peptide Sequence Number=SeqID_223010
atggattgggaggtcatctcgataggcggttcctcgtatgaggatacgtgccgaggtgcctccaatagtgagtcctactctacggagaggcctttcgctgttgtcgaggagcctttcccaatcactgtgatcctccccctttctgcttctgggggtgtaagaagaagtagtggcgacagagatgtgaggcgtctccctgtgttcgatgtagcctaa

SEQ ID NO: 106233 - DNA, 814 bp, Glycine max
  Peptide Sequence Number=SeqID_223011
atggctccggtggcttctccctctaatgtcttggctacagtgacgtcaccttcttcatcctctcgccctcgtgtctccctttatcacttatacacctttagtgatgctgactcattgtggggtgcaacttacaagctggagcagaagaccccggttggctttgtgtcagcattcgacaagaacctaattaggtcggctgggatgcagagtgctactgacttttccaaagtgttcctccaaaggacttttggaaatttggaggagaatggactacgacaccaagagactatgcagaaggtggcatccttggaggcagaggtcgccaggtggagggctactgctcgtactctttggcgagtgaagcaccctaaggacttggaggcggaaaagatggacttgggtggaaaaatggagaccatggcggctgagaagaatgggcttgccaaggctgctaaggaaagggaggccaacagggagcttgaagaagagttgcttctgtataagaagaaggccagtttctttgcgaaggaccttgacttgggtctcttcgatcccttcaaggatgtgaaggatgatgtcctgcttgatgaggaagacattgctgtggaggaggaggctgatgatgaaggacaacataggaagcaagactttgttgatgtagaggagtatataccaagggcagatgttgggttttgcaagaatatgtaccaagggcacaccttgggttttggagatgtaacttccaagggtagaccttgggtttttgggctcaccaagggtggaccttgggtttatcaagcctttgaccagggac

SEQ ID NO: 106234 - DNA, 183 bp, Glycine max
  Peptide Sequence Number=SeqID_223012
atgcttgcaatggaaccatcgcctactgttactgaggtggagatgagtgactcaacaggcgcatggacgatgatgattggtggcaaagaagaagttattgttgaaggagacaacgttagggagttgagggcagtggaacaacgactaatgctacagtttttttgtgcttgtgcttgcacctga

SEQ ID NO: 106235 - DNA, 345 bp, Glycine max
  Peptide Sequence Number=SeqID_223013
atgtattcagacaatggtggtaacaatgacgacagtaacactgacgacgatgatggtacatcctttgtggtacaagtaaagggtacatctacttgggttgttgtgactgagaacaagagagggtacatctcttgtggatcagttctagtggaggctacatccactagtttattcaaagagaacaagggaggaccacttgatccaacagatgataatgatagtggtggtagcaatgaaaatagtagtggtgaaaacaatggcaatggtggcaacagtgacagtgacgatgatagaaacagtaatgatggtggtagtgataatgatattaatggtaacgatgtgatg

SEQ ID NO: 106236 - DNA, 402 bp, Glycine max
  Peptide Sequence Number=SeqID_223014
atgttgggatttttcaaggagaagttggttaaagcacccaaagaggtgaacaatccagcttctttgaattcatgcagcaagcctaagccaagtcatgaaatcctgaaggatttcatgccctacaattcctccaatgctttctccatgtgctttgggaatgatgctttgttagcctattcccctttaaacaagcccttcattcatcatagtggtttggataacatatattgtgtcttcctgggtggcttgcacaaccttagcatggtcaataagcagtatggtctatcaaagggaacaaatgaggccatttttatcactaaagtgtatcgaactcttcacgacaggggtccacaccctgctgatcaggtcgtcgaggaacttgaaggtagtttcgatttgtga

SEQ ID NO: 106237 - DNA, 135 bp, Glycine max
  Peptide Sequence Number=SeqID_223015
atggtgttggatccaagactggtgctggtgctgttcatcggcacttgcattttggccatcaatggtgacacagatccaaatgacgttgtgtttgagctatcagctatgtgttgtgtatgctatgtagctggttga

SEQ ID NO: 106238 - DNA, 699 bp, Glycine max
  Peptide Sequence Number=SeqID_223016
atggcgagaatagctaaggaaaagacgaaggcgttggcagatcaaggtaaatgggcttcattcattgatgtcttggcactattggtatttggagttgtcctctttccaaatatggatgggctagtggacttagcggcgatcgatgccttccttacttgtcaccatagcaaggagagtccatctcgcacctctttcgtcatgaaaatagacccgtctatcccctacaaggtcatcgcttgtgtgccgagaaagggaaggaaaattgggagcaactcttcgctaggattctcgaatgtacccttgatgggaacaaggggttgtatcaattataatcttgtccttgccataagacaacttgactaccccatgagaggagcaccgttggaagaaagcatcacacctttcatcacatggggtttcagtgaccccaatgcgaggatacttcaaagagtccacaaagcatggagggcggtgcaaaaaaaagacaaggagcttagaggaagccgcaatgggatcaacgtgagctatcataagtggctgaaggctcagatgcaagagttggattggctcctaaaggtaaaggtttcaagtgaggaaggggctaaaatccctgaggagagtgaggaggtgcaagccttaaaggtggaacttgaaagagcacaagtggtcaaggaaaagttcaagacgacatccatcaag

SEQ ID NO: 106239 - DNA, 1269 bp, Glycine max
  Peptide Sequence Number=SeqID_223017
atgaattccatgcaaacttcatctgtaattgatttgaagacatttgatacatctgcgaccccaataagccttaaacctccaccttttgatcgtcacaaatcatttgatgaagacgagttttcaaacaagcccgttatagtcaataagcccactaaagtcaagaagaccgtaacagctcctacaaatgtaaaatcatattctatagctgacctgcagattgctactggatccttcagtgtggagcaacttcttggtgaggggtcttttggacgtgtataccgtgctcaatttgatgagggaaaggttcttgccgtgaagaagatagattcatctgtccttcccaatgatatgtctgatgattttgtagaactggtttcaaacatatcccaattgcatcatcccaatgtgaccgagcttgtaggttattgttcagagcatggacaacacctactagtctatgagtttcataaaaatggatcacttcatgacttccttcacctacctgatgagtatagtaaaccattgatatggaattctcgtgtgaagattgctttggggattgctcgtgctttagagtacctacatgaagtttgttcaccatctgttgttcataagaatataaagtcggccaacatattgcttgatacagattttaatcctcatctttccgacagtggattggcaagctatattccaaatgcaaaccagtttccttgcctctctcctaaaagcttaagctgttacttaaagcataggcaatgcacaagccaccctacatttgttggctgctggttaggagtgagaggcttgggtaattggcacgaggtattgaacaataatgctggatctggatatgaagctcccgaagttggcttgtctggtcattatactcttaagagtgatgtttatagctttggagttgtcatgttggaacttcttagtggacggaaaccatttgatagctcaaggccgaggtctgagcaggctttggttcgatgggcaacacctcaactccacgatatcgatgccctggctaaaatggttgatcctacattggaaggattataccctgtgaagtccctttctcgatttgcggatgttattgctctgtgtgttcagccggagccggaattccgaccacctatgtcagaagtggttcaagcgctggttcggttagtgcagcgtactaacatgagcaagaggacgtttggaactgatcaaggaggatccaacagagggggtgatgaccaagatacacaagacatgtaa

SEQ ID NO: 106240 - DNA, 1512 bp, Glycine max
  Peptide Sequence Number=SeqID_223018
atggcgattgaacacgaagacgatctcaaagacgagaagaaccctcgacctctcgacgaggatgacatcgccctcctcaagacctacggtttgggaccttactccacaagcataaaaaaggcggagaaggaaatcaaagatatggccaagaaagtgaatgacttatgtgtttatactggttgtcctaattgtatggactggatgctgttaacacttgtacacctccttaaatgtttgcttcctgttgttacaataggtataaaggagtctgatactggtttagctgcaccaagccagtgggatcttgtttctgataagcaaatgatgcaggaggagcagcctcttcaggtggcaaggtgcacaaagattataaacccaaattctgaagatgccaagtatgttatcaatgtgaagcagattgcaaagtttgttgttgggctaggagacaaggtttcccccactgacatagaggaagggatgcgtgttggggttgatagaaataaatatcagattcagattcctttgcctccaaaaattgatccaagtgtgaccatgatgactgttgaagagaagccagatgtaacatataatgatgttggcggttgtaaggagcagattgaaaagatgcgagaagttgttgaacttcccatgcttcatccagagaaatttgtcaagcttgggattgatcctccaaagggtgttctttgttatggccccccaggaactgggaaaacacttttagccagggctgtggctaataggactgatgcttgttttataagggttattggaagtgagctagttcagaaatatgttggtgagggggctaggatggttcgtgaactatttcagatggctcgttcaaagaaggcatgcattgtgttttttgatgaagttgatgcaattggaggtgcacgatttgatgatggcgttggtggtgacaatgaggttcagcgcaccatgcttgaaattgtgaatcagcttgatgggtttgatgctcggggaaacatcaaagttttgatggcaactaataggttggttgattttattgtgagagcatgtctctgcaatgcgagtctttccataatgatgatgcattccaaatgccctttcaaattcattttttctttgctgctaacctgggcttatggtcatgtctttttgtcaacaatttctaggcctgacactctagatccagcactactgcggcctgggcgattggaccgtaaagttgagtttggccttcctgacttagagagtaggacgcagatattcaagatacacacaagaaccatgaactgcgaaagggatattcgatttgaacttctggctcggctttgcccaaattccactggagctgatataaggagtgtatgcacagaagccggtatgtatgctatccgtgcccggaggaagactgtaacagagaaagacttccttgatgcagtaaataaagtcatcaaaggataccagaagttcagtgcaactcccaagtatatggtctacaactga

SEQ ID NO: 106241 - DNA, 255 bp, Glycine max
  Peptide Sequence Number=SeqID_223019
atggggcataataggaatgcttacccctacagcttaccccccaattatatgccacccaccatgcatgtgcctaatgagaatgttaatcatgtcattctcgttaccgttgaaggtcagcaaccccagcctataggaggcacccacgaagaacctcgggagtgtgctcaaggggacctcgacccatatcccactttcaccaccgagggaccaacatataatgctatgccccagcctaacaccgcgggagctccttaa

SEQ ID NO: 106242 - DNA, 321 bp, Glycine max
  Peptide Sequence Number=SeqID_223020
atgatgcatgcacctaactcaaccactcggatgcaatgtggtacgtacggtcagatcatggacaagtgtcttgtgaagttgcagaccaaatttcgagaagatccaacggttaacgaaggctggacaacatttttaccgaggcagcttcatccacgcgctaagccgagcttcccagagctaagcacatttcgtcgtggcatccatcgagctaagcgagccctgctcgctaagctcccgtacttagtgtattttttgaactgtatggtgctgctaagcgcagcttctaaagagcttagcgcaaaaccttgcggcagaccttag

SEQ ID NO: 106243 - DNA, 945 bp, Glycine max
  Peptide Sequence Number=SeqID_223021
atgagtgcaagtgacaacgcatggggtgaatctgacacaattgagatcacaggaaagatcatggtggtggccataatattcctcttcatggtggttgtctttgttcttgtgctccatctctatgcaaaatggttctggtggagcatggaggaaaacgccactccccagccccgccaccgccgccgccgccgccggaggtttgtcttcgcccccggtcaagactcggtgatctatgagactcaccaggttgggcttgacccttcagttctcaagtccttgccagtgttggttttccaacctgaggacttcaaagaaggtttggagtgtgcagtttgcctctctgagattgtccaaggtgaaaagttgaggcttttgcccaaatgcaatcatgggtttcatgtggattgcattgacatgtggttccattcacactccacttgtcctctttgtaggaaccctgttgcttttgaatcctctaaatgtgaagagagtaatgtctcagggaatagtgattcatcatcatcatcatatgaagagaactcaggtggtgtgagtggtttggaaccttcaaattttcccacaaatgtgttggtttgggggaaccagacacaagttagttccattggggtttcattggaagaaaaagaagaagaagaagaagaaggtacttctcagtcccagcaaccaccttgttctacaccacctacagcatcttcttctgctagtagcaatgttaatggaaggtgtcatggaatgttggtgattgatattccaagtgagtgcacttcctcctctttgtcaccttctgggagtaggtgtgctgaagaggaggtgaaatcaccaatggctgccacattgaggtcattcaagaggcttttgagcagggacaaaaagttgagtccttgcagtccaagttctgtagacgtggaacaagcacagagctag

SEQ ID NO: 106244 - DNA, 567 bp, Glycine max
  Peptide Sequence Number=SeqID_223022
atggctaaattcgatccggagatagtcatggagttttatgctaacgcctggcctacagaagaaggagtcagagacaagtgctcctgggtgagtgttcatgtcgcccatttgatctctgatgctatttaccaatttgcagggattatgcctccgagacacccagtggacccggagaagtccaacagggccctggggtttcctactctgattacaggcctctgtcagttctatggagtgtcgccaaaggaggaccagcagcagccagctgcagatgcgcctctaccgcctctagaggaggtaccatctctgaggtccatctccgatcacctgcggaggatagaactccagatgcacaacggagttaggaccccagtcctttcccttggcctaccaccgaacagttcggggccacggtggcctagcttggggacaagaccgattttgagacgcgagaaggacccatgggggcccctgggggtgaggaaggagctcaggaggataacgacatggctaacgtgttggacttcttcacttgatgaggcagagttgcacgatcgggaccgctga

SEQ ID NO: 106245 - DNA, 323 bp, Glycine max
  Peptide Sequence Number=SeqID_223023
cattgatcacgggtctctgccagttgttcggggttcccgtcacacctaggtggcgcaccgcagacccagacgcaccgccgccacctcatcaggctgatccagctaggtcatttgacacggagcgtctgcagagccagggtttcgctccttttccgtgccctactccagatcagtttagggcaaaggttgcatggcccagagattggcctgaggcccaggcaggggaggcgcctgcagaggctcccgacgatgcagatgaggcccgcatggacgaggagatgacagatttactcgatttcttgggagggagcggagccacatga

SEQ ID NO: 106246 - DNA, 321 bp, Glycine max
  Peptide Sequence Number=SeqID_223024
atgactgaagcacgtcaaaagggggtacggaaagggaggagcttgccacccaactcgcccaggcgagcaaggttgcttcctccagaagcaaccgccttctgggggaagaatctggaaggcccaactttcgaagaagttacgaaaaactcacggattacgcaacaacacctccttttggtttccgccacattacagaatttcacggatcgcgtaaccctgcttccttttgattccaggcgcatctcgggacttacatattgtgcaacaaagggtgccaagtatcttgaagcggccaatcaaaggttgcatgtcatcaagtaa

SEQ ID NO: 106247 - DNA, 396 bp, Glycine max
  Peptide Sequence Number=SeqID_223025
atgtcaatccttaccctcggaagcaaaagagaggaaaatttccaatcaaagaaaaagagaaggaaaatttccaatcaaagagaaagcaaaaaaaagagggaaggaaaatttccaatcaaaggaaaaaagaaaagaaaggaaattcccaatcaaagagtgggagaaagcaaaaagaaaagaaaggaaattcccaatcaaagagtgggagaaagcaaaaagaaaagaaagaaaattcccaaccaaagaatgggagaaagtaaaaaagggaaggaaagaaagttcttgatcaaagaaactagaagaaatgtgcagaaaggtcttttgaccagacaatatctgaacaatacagaattgtcaccaaatgaacaaaagaaagaaaaggaaaccatgacctaa

SEQ ID NO: 106248 - DNA, 264 bp, Glycine max
  Peptide Sequence Number=SeqID_223026
atggtgattatgggtgatggagaaagatcttggaatgttggaaatggttttggaagaaagaaagagaagaaaatgacatttttcctaagctacacgaaagcaaaggctgaaacgctcaagttggctaagattttgttaaaacataagcacttagacaatgaaggaaagctggagttgctgcacatgatgtccaacgttatgtcaaggaataagatcgggctgcacaatgcacaaggcaagataaaatgtctaatgaagaagtga

SEQ ID NO: 106249 - DNA, 339 bp, Glycine max
  Peptide Sequence Number=SeqID_223027
gatgcgcgaaaaaaggcacaagccatccagaaacaaaacaccacccctcacgtgttgtctcatgggggttatgaatatttagaaaacaagttgacggatgagaagagaaagaaaaaactggaggaagctgctcagtctggaagcactaataccgtgattgatcctccatctcctatcagacgacaggtgaagtggaagatgacccgcactaaggaaactgggcaaatgacgtctgaggcagcaaaggaaattgctgagaagattagccggtgtcacgatcaagaaatactttggatcggctccaaggacctcccacacatcttcctctatggctcctga

SEQ ID NO: 106250 - DNA, 732 bp, Glycine max
  Peptide Sequence Number=SeqID_223028
atggcggagaaatcatgcatcaagcgccttcagaaggaatatagagccctttgtaaagagccagtttctcatgttgtggctcgtccttctccaagtgatattcttgagtggcattatgtgttggagggaagtgaaggaacaccttttgcaggtggatattactatggaaaaatcaagtttcctcctgaatatccatataaacctcctggaatcagcatgactacacctaatggacggttcatgacacagaaaaagatctgtttgtctatgagtgactttcatccagaaagttggaatcccatgtggtctgtatcaagcatattaacagggcttctttcattcatgatggacaacagtccaaccactggcagtgtaaacaccaccactgctgagaagcagcgtctagcaaaatcttccctttctttcaactgtaagaatgctacattcaggaagatgttccctgagtatgttgagaagtacaaccagcaacagctttctgagcaggctgctccagagagggtctcatcggatacgtctcccgacaagagttcaaggccagttttggaaaagaaattagaatccaatggagaagacatgagaagagtagatgggttgaaggaaggaaatgaaatgatgaacatggaggctgcgttttactatgggctgaatttactcctttgtgtctatgttgccagcttcttggtggtgaatgttaagaagttacatgcttga

SEQ ID NO: 106251 - DNA, 1173 bp, Glycine max
  Peptide Sequence Number=SeqID_223029
atggaagaattgcgagctgaaagccagcagatttcggattcatctgggtcaattggacgctcaaaaggagcttcagtagtttcttctcaacagcaaatatctgttactgttgtaactgagtttgtgcgttggaatgaagaagcaatctcaagatgcaatctctttgcttcccagcctgctacacttgcaacccatgttaaagcagtgtttacttgcctgctagaccaagttagtcaatatatagcagatgggcttgaacgggcgagagacagcctgactgaagcagctaatttgagggaaagatttgtgctgggtacaagtgttacccgtagagtggctgctgcagctgcatctgctgcagaggcggcagcagctgctggtgaaagtagtttcagatcttttatgattgctgtacaacgttctggaagcagtgtagctattattcaacaatactttgctaattctatatctcggcttttgctccccgttgatggtgcacatgctgctgcttgtgaggaaatggctacagcaatgtcaagtgcagaggctgctgcttataaaggactacaacagtgcattgaaactgtcatggctgaggtggagcggttgctttcagctgaacaaaaggctacagattatcgatcacctgatgatggaatggctcctgaccaccgggcaaccagtgcctgcacaaggtggatgtcacttgaaattcgaactgaaactagtattagtactgatgatattgatattttctatgatttatatctctgtatagttgttgcttatctttctcgtgtgctggagtctgcatttactgctttagaaggccttaacaaacaagcattcctgactgagttgggaaatcgcttgcacaaggtgttactaaaccattggcagaagtatacgtttaatccaagtggagggttgcgactgaagcgtgacattactgaatatggagaatttctgcgtagtttcaatgctccttctgttgatgaaaagtttgaattgttgggcataatggccaatgtatttatagttgctcctgagagcctttcaactttgtttgagggcacacccagcatacggaaagatgcgcaaagatttattcaacttcgggatgactacaaggctgccaaacttgcgtccaaactaagttccttgtggtcttaa

SEQ ID NO: 106252 - DNA, 1029 bp, Glycine max
  Peptide Sequence Number=SeqID_223030
ttcgcgagcaatagtttggccattgtcacgaaagatcctaggattgctttcgaagttcgattcaccgattcaccaccggcggctgctagggtttccggagtggctcggcgcggcggagcggaggctgcttcaggtgaacagcagcgaaacgacgcccggacgctgtggtggcgagtgacggtagcggacagttcaggacgatcggaagggcgttacgttgagaacatcgatttggataagaatacgtggaatgtgtttatcttcggtgacggcaaggagaaaaccgtcgtcgttggtagccggaacttcatggacggcacgccgactttcgaaaccgccaccttcgctgtgaaaggcaagggattcattgccaaagacataggattcgtgaacaatgcaggtgcatctaagcaccaggctgtggcattgagatctggctcggatcgttctgtgttctttagatgctcatttgatggcttccaagataccctctatgcccattccaaccgccagttctaccgtgactgtgacattacaggcaccatagacttcatattcggcaatgcagctgctgtgttccaaaactgcaaaataatgcctagacagcctctaccaaaccagttcaacaccatcacagctcagggcaagaaggaccccaaccagaacaccggaatcataatccagaaatcaaaattcattccccttggaaacaatctcacagctcccacataccttggtaggccatggaaagatttctccaccactgtgatcatgcaatctgatattgggtcattcttgaagccagtggggtggattagttgggtctccaatgtggaacctgtaagtacaatcttctatgctgaataccagaatactgggcctggagctgacgtgtcccagagggtcaaatgggctggttataagcccactctcacggacgtggaggcagacaagttcactgtgcagtcctttatccaaggccctgagtggttgccaaatgctgctgtggagtttgattccaccttgtga

SEQ ID NO: 106253 - DNA, 1212 bp, Glycine max
  Peptide Sequence Number=SeqID_223031
atgtcctttgaagccatttcatttctcactcacttttttcttcttctcctttttgtgactcaggaagcactactcactgagagcaacatgagcttgtatgggaaaagcaaagacgacccttttgctgatgacttccctgacccactttgcaagctcaaccttaaagaaacctctgagtttgtcaagtcattgcctttgccaatgccaaatggcagagctgaaagcagaggccattctgtttcacaacagaggaggctactagattcaccctccacacctggaagaccagttttcaccttcagctctggccttccaagaaagagcttcccttccaaatgggatgatgcagagaaatggctcatgagcacttcttgccatgactcacctgctcacaacaacaacactacgaaggttttagtttcagactcctcaaaggtcacaaccagacaacaacaatctgatgatgatgttggcttcaagcagcaaatggaaggtttctcggagaaatcaagggtcacagaagaaagggtttcgtccaaagctgtcccaaacttcccttggtctcctttggaccaccaccataacacactcagcgctttccatggcgttaaagacattgtactaaaagataaattcacagacagcatagagccagttttgccaaatttgagatatttagaacctgctaaagaagggttcttgtttaggaaccaaggtgatggagcaatgcaagatgcttgcacagaagtggttcaacatagagacattgggactgagatgactccactgggaagttccacaacttcaagatgccacaccccagttaagatttcatcgcctcctcggcacaacactcctgcaagtaggtcagggccattggccttggctagcagtgcctgcactcttgatgttattcagcttgaggagtgccatttttccaagctgcaactaggaacgcagtatgatatagtccctttaaattggagctcaagtgaggaggaagaaaaggaaatatctaaaagcttgaggcacaatggtagccacaaagctgattcagactgcatagctgctgcatgggaagaagaggagaagaccaagtgttgtcttaggtatcagagagaagaagcaaaaatccaagcttgggtaaacctccaaaatgctaaagcagaggccaggtcaagaaagcttgaggtatttcattgccattcatag

SEQ ID NO: 106254 - DNA, 5400 bp, Glycine max
  Peptide Sequence Number=SeqID_223032
atggatgcagtggacaagactttttctgagcttgtcagcattgtcaaatcatggattccctggcgatctgagccagtaaatgtgtctagagatttttggatgcccgatcagagttgtagagtatgctacgagtgtgattcacagttcaccttatttaaccgtaaacaccactgtcgtctttgtgggcgaattttctgtaacaagtgtacaacaaactcggttcctgccccatttagcaaccaaaggaattcttgggatgagttggaaaagattcgcgtttgtaattattgttacaagcaatgggagcagggcatagttgcttttgataacagtattcctgtttccaatctggataatagtgcttccggatcaacttcaagcgtggctagcagtaaaaccagtgccactgcaaacagtagtaatattactctttgctccatgccatattcagttgggtcttatcaaccaatgcaacagggttctgttctgaacctgcataaatcacctgtgaaggggaaagaccccgatactgatagggaaggcttatcagcattaggagggaggagtgatcttgtagcagacctgggtgatccattaccgaagcaatacagattctcaataaacaggagtgatgatgatgaggatgagtatggtgtatatcggtcagattctgatatgagggattatcctcaagtgaataactactatgtacaagctgagcttcacgggataggcaacattgatggctcacagaaagtggatcttgatggagaaaacactaatgccaaactcccttcaaactacagttttgacacacaggatttggaaggagcccaagttattgccaaaaatgaagatgaaccttatatctgtgatgaaaatgaagccccttcctcgttgtatgtttcagaggatgttgatgctgaacctgttgattttgaaaataatggacttctctggctccctcctgaaccagaagatgaagaagatgaacaggaagctattctgtttgatgatgatgatgatcatgacgggaatgccaccggagagtggggctatctgcgcagttcaagcagttttggaagtggtgagtaccgacacagagataggtcaagcgaggagcacaagaatgtaatgaagaatgtagttgatgggcattttagggcattggtatctcagctgttacaggttgagaacttacctgtcgaagataatgacaaaaacagttggttggagattgtcacatctctgtcatgggaagctgctactttattgaaaccagatatgagcaaaggtggtgggatggacccagctggttatgtgaaagtcaaatgcatagcatgtgggagccgcattgaaagtgtggtggttaaaggagttgtttgtaagaaaaatgtggctcaccggagaatgacgtcaaaagtggataaacctcgcttgttgatccttggaggggctctagagtatcaacgtgttaccaacctcttatctagtgtagataccctattgcagcaggaaatggaccatctgaagatggcagtggcaaagatagcttcacaccaaccaaacatcttgttggtggagaaatcagtctcgcgatatgcgcaggaatatcttcttgcaaaggacatatctttggttctcaatgtcaagagaccacttttggagcgcgtagcacgttgcacaggcactcaaatagtgccttcaattgatcatctgtcatcacaaaagttgggttactgtgaaacatttcatgttgaaaagtttcttgaagacctaaatagtgctggtcagggtgctgacaaggatgaattgaagaaggtaaaacatgtggttcagtatggagtttttgcagcttaccatttggctttggagacatcttttcttgcagatgaaggagtctccctgccagaaattccattaaacagtctggcccttcctgataaatcatcatccattcagaggtctatttcaacagttcctggtttcggcattgctgacaatgaaaagcctcaagggctagaaccttacactgaaccacagagaaccaaaagtctcacagctgctgatctagcctcgtcaacctgcggtacagggccgtgtttgtctaatggtgcttctcaatctatggcacttggatcaagtctcaactattcaactgccttatactcctccattgttgcttcaggaaattcaattccagaatcgcaccataataagcttctttcatgcactagtagagacacaaatgaaatgaactccaaacaaactgtggtggaagaaacttctagagtggacaacacattagttgttggggatgatcctactgtagaggaccctggatcttcagagaaattatatcaaggcatgtcagctgacactccacaaaatggtgatagcaaaatctctaaaaatcagttaagtgggtcaggatctttatctccaaaagatgttcaaaaccatcccgagaaccttgaaatcacaaatgaagagccagttcccgaaaaagaagagtttcctccatctccctccgaccatcaaagcattttggtgtctttgtcctcccggtgcgtttggaagggaactgtatgtgagaggtctcatctctttcgcattaaatactatggcagctttgataaaccattgggtcgatttctgcgggaccatttatttgatcagagttatcgatgccattcttgtgaaatgccatcagaagcacatgtgcattgctatactcatcgacagggaacacttaccatatccgtcaagaaactaccagaaattatcctacctggtgaaagggatggaaagatttggatgtggcacaggtgcttgcggtgtccaagaatcaacggctttcctcctgctacacagagaataataatgtctgatgctgcttggggtttatcacttgggaagtttttggagctcagtttctcaaaccacgctgcagccagcagggtggccagctgtggtcattctttacacagagattgtcttcgtttttatggatttggaagaatggttgcttgttttcgatatgcatcaattgatgttcactcagtctaccttcccccccacacacttatatttgattatgggaatcaggattggatacaacaagaatcagatgaggtggtcaatcgggcagagcttttattctctgaggtcctcaatggtcttagtcaaattggagagcaaagatctaatgcactccaagtcagtaatggccataaatcacctgaattaagacgccaagttgctgaactagaggggatgttgcaaaaggagaaactagaatttgaggaaactcttcaaaagattttgaaccaagaaaagagaaatggccaacctgggattgatgttctggaaattaatcgattgtggaggcagttactttttcaatcatatatgtgggaccaccgtcttatttatgctgccaacctagtcaattccaactatgaatctggttcaagcagtccaatttcagaggataaggagaaacctactgatgaaaatcagatgagcattaactctattcatggtgatccaaagcttaacggtagccccagccatggaggaggaagtgtagtagttgatggcaaaatttcacatgatgcatcgcatcaagaaattgacatggtcaaaaataaaaatcttgagaaagatgacgaatctgatcttccaaacagcaaaagcataaatgatcaatccaaccttttagaacctgaattgggtgttggcagagctctctctgatggaccgtttcctgtcattcctagtttgtctgaaacacttgatgcaaaatggactggtgaaaaccactcaggatatggaattcaaaaggataacagttctgtaaatcctgatatacttatggcagatgctttgacgaccagtgcacaaaaagaaacatattatctaggggatcgtacagaagatcaaaatggttccaagagtttctattcttcttttaaaggtcatgataatatggaagactcttcaaactggttaggaatgcccttcttgaacttctatcgccaatttaacaggaacctttttgctagtacacagaagtttgataccctagttgactacaatcctgtttatgtgtcatctttccggaagcaagaactccagggtggggcaaggctgcttctaccaattggtgtcaatgacactgtaattccagtatatgatgatgaaccctcaagtattatagcttatgccttaatgtcaccagaatatcatttccaattaaatgatgaaggagaaaggccaagagaaggaaatgagttcacttcatcatatttttctgactcaggcaccttgcagtcattctcatctgttgacgaaacagcttttgattctcaaaaaagttttggatcgatagaggaaatgatattttccatgtctgggtctcgtaattcatcaatattggacccaatgttatatactaaggctatgcatgctagagtttcctttggagtagatggtccccttggcaaggtaaaatattctgtgacttgttactatgccaagcgatttgaagccttaagaagggtctgttgtccttcagagctagactatataaggtctctgagtcgctgtaagaaatggggagctcaaggtgggaagagtaatgtattctttgcaaaaactttggatgatcgatttatcatcaaacaagttaccaaaacagagcttgagtcattcattaaatttggtcctgaatacttcaagtacctttctgaatccataggcactggaagtccgacttgcctggcaaagattcttggcatataccaggttacatcaaagcatcttaaaggagggaaggaatcaaggatggatgttttggttatggagaatcttctgtttaggaggactgtgacacgactttatgatcttaaaggatcttccaggtctcggtataatgcagatagtaccgggaaaaacaaagttctactggaccagaacttaattgaagcaatgccaacttctcctattttcgtgggaaacaaagcgaaaagattgttagagagagctgtctggaatgacactggttttcttgcttcagttgctgtgatggactattctttactggttggagtggatgaagagaagcatgagttggttattggaatcattgatttcatgaggcagtatacctgggacaagcatcttgaaacatgggtaaaagcttcaggcatccttggaggaccaaagaacacatctcctacagttatatcacccaagcaatacaagaaaaggttcaggaaagcaatgaccacttactttctcatgcttcctgatcagtggtctccttctattattcctagtcattctcagtctgattttggtgaagacaacacacaacctaggactccagctgaatga

SEQ ID NO: 106255 - DNA, 1416 bp, Glycine max
  Peptide Sequence Number=SeqID_223033
atgctgattttttcccaagttgtgcaacccgacccacaacaactttgcacatctggaactccaaaaaacttgccaatccatgagtttacaagtaatcctgtcaatcctactctgatccccccaacttgcaatcctaagtgtgaagtgcatcagaaatggctagaaacttgtaaacatggaaacaaattgcagttggatgaccagacacgacttttcctataccagttagttggcacatggggtcaaattctctttccaaagccatggaaggagttcagactttggtacgacgagaacaaggcaaagggcaataagccatttcttgaggggatggtgaccaccggatggtataagaaaatgggagagaggatttggacaccttggttcataaagtttattcaatcccgtggttattttaatatctacacaaatcttctgcatgagagagcattaagtgtttctcacagagatgctggagttaactacgggaaaactgctggacctgattctaaattactagaggaaaaatctctagacttcaatatattggaagtgcaacctttgaggagtttaagatggtatgatttttgtttcagagaagtacatcctggaaaggttgccacgaacttggaagaacttggatcattgcttcactctctgcagaaacaggatagtgtcttcttagtaaatctttttggggtatcagatgctatatcaagaaacttactatgccactttgagaggctagatatcaggaattatatacttatgggccctccatctgactccttatttgatctggcaaggaggggacaccctgtaattaacgttgacaaatttataagtagtgttggattgtctaaattcacttcacaaggtttgagttttgagaccatcaagggtattctggcaaagacttatgcaattaagaagtgtattgagaataggtataacacgtgggttatggatgggagcatgcttctcacttcagacctcttcttgtctgagtctgaagattccaatggtgacttctttgttgcaaacaacttggaactcttttatgctaaaagctcatcttctagtcagaaaatctgggttgatggctttgtgtcaaaggttgtagccatggcggagtctttggcaggaaaagattcagcaacccatggtagcttaagtttcgtgtatgttgtaataaaattattggaacagaatggtgcgaggattagaagagttgatgagaattcttttgccacaaagattggctctggtagtgaaacttctcttcgggataagaagttggtatattggtcaagtgagatggagctgaattcaattcagaaatggctcgacgagttcaatttgtggagcatagacagtgatttgtcatgcaccgcggtggtctgccacaaatcctag

SEQ ID NO: 106256 - DNA, 618 bp, Glycine max
  Peptide Sequence Number=SeqID_223034
gctttggagtacgaagacttcaattccgccaagtctcgcttgctcgaacgcgccgaaaagttcggcgaaatctccttcaaggtaaatcactcacgaactctcgcacgtgcgtgcgtgcgtgctttcattcactcacatcatcacttcctaaactcagttgattcgcttttcgcttcgcaggctcgcaagatcattgcaatgctcagtcaagattttatattcgacggctgcacgattctcgttcacggattctcccgagtcgtgcttcagattctcaaactcgccgcgcagaataacaagctctttcgcgtcttctgcacagaggggagaccggatcgaacgggtttgaggttgtcaaatgagctggccaagcttgatgttccggtgaagcttgttatagactctgcggtggcgtataccatggatgaggttgacatggtgtttgttggggcggatggagttgttgaaagtggtggcataatcaacatgatggggacttaccaaatctcattggttgctaagagtatgagcaagcctgtttatgtggctgctgaaagctacaaggtaagcttgcaacccacagaaattagtgaatgtggtgtgaagttgttgctttag

SEQ ID NO: 106257 - DNA, 738 bp, Glycine max
  Peptide Sequence Number=SeqID_223035
atgagtggaattcaggttgtggctgcgggtgctaagttcaatttgagaagagggaatggttcttctcataatgttgtcaatagctatagcagtgatggagatctctgcagaattaacaagagtgggtgtttttcgtcagcggcagaggtggatagagacccttcttgtgtttcattcaccactttcaacattctggctccgatttacaaacggattgatccacagaaccaaggcctacgagaaagtgacttcagatcattctggttggacaggaataacaggattcttgattgcttgctttatgaatcatcttctattatgtgccttcaggagttttgggttggaaatgaagaacttgttaacatgtatgaggagaaacttggggatgctggctaccatctcttcaagcttcctcgaaccaacaatcgcggagatggcctgctgactgccatacgtaaagaatgtctaagagttatggattataaagagttgctttttaacgattgtggtgatcgtgtcgctcagttgttacatgttcagtcagttacccccttgttacaaaacccaaaaggctgtgttccccaagagtttctgattgtgaacacccacttgttatttcctcatgattcaagtctgtgcgtagtgagattgaatcaggtttaccaaatattgcaatatgtggaattgtatcagagagaaaacaggctcaaacccatgcctattatactctgtgggtga

SEQ ID NO: 106258 - DNA, 504 bp, Glycine max
  Peptide Sequence Number=SeqID_223036
atggcttcttttggagcaaatactgtaacaaagccaatcaaaaagaggaaaagaacgattgagatcaagaaagttgagcagataaacaggcgttacgtgaccttctctaaacgcaaattagggttattcaataaactcaccgagctctcagttctgtgtcaagtggaagccgctgtgatcatcacctcccaaaacgggaagctctatacgtgtggctaccccgacgccgatgccgtcgttcgccgctacctcagcggagggctatcccgagggctggacagtgaaagcaaaaagagacagcaagatgcaattgaaaccctaaggcctgaatacgaggccactcagaaccacttgaaagaagagcaaaagcgtttgcaagaaatcaaagagacgcgaaagagtagtttgtgctttccctcgtggtggatctccccaccgagggtatgggtttggaggatcttgaacagttcaagacttctttggaacgttttaagtttaacctag

SEQ ID NO: 106259 - DNA, 582 bp, Glycine max
  Peptide Sequence Number=SeqID_223037
atggtaggcaaagatttaggaagtacggatgaccccatgatgtgcaaattcaaaacaagcacgccttcccgccatatgacttgcctcccaaactatacaccacccaatgtggcgtacattcccgatgaggatgtcaataactccactcccatactcattaagagccaacaacctcaatctgatcatgcacatgtctctcgacccgtggaggagacacatggaatgccccaccacaatctagccgacttcgagccttgcctcggatatgccactgaagggcaagcagttggtggtatacccctgcaaaatactttggagggccctcagtgtcacccacaaccacaaccctcacattccacagcggttaaaaaccctcatgctatggcagaaatgggaaagaggaaaggctcagggccattgaaggagatgggggcatacgcgaaagatgaggaattgctgatacattccttccaagaaaatcttactggggtagctgttacctggtacactaccctggaaccttctcgagtccactcttggaaggacctaatggttgccttcgttagggcagtgtcagtataa

SEQ ID NO: 106260 - DNA, 354 bp, Glycine max
  Peptide Sequence Number=SeqID_223038
atgcggggaactggaaccagagaggtggcacacaaaccgaggcaggatttcagcattcaaaaggtcaaatttttcctccttgtggctgagtatgaagtcacatcaagagaaaaaacaaaattcagaagcttttcctccctcttccacgttgcttttcttcttcctccttccccaccattgttgtccattaaagctccaaaatccctctccatttctactccaaattgcaaagggaagccattttcggagtcttggagcactcctctacattgtgggacttcgaatttcagaaaactggtagagatgatggtgagagttaacttagggttaaatgtgaaaatggtagtgatgtga

SEQ ID NO: 106261 - DNA, 189 bp, Glycine max
  Peptide Sequence Number=SeqID_223039
actgtcaagaacgagattacatcatggcaattggcaaatgctaagcttgcagaggtcggtggcagactcaagaataatggaatgaagaaaaagcatgagacccatgcagctggtataatcgtgaaggaagatatcatcgtgctttctagaagatatgtaggtagtggaataagggaatatggttgttag

SEQ ID NO: 106262 - DNA, 345 bp, Glycine max
  Peptide Sequence Number=SeqID_223040
atggagaaagttttgcagaggctcttcatcttaagttcatctacacatacatgggatgctttccaccttgcacgtgcctcttttgaactttactgtgtccaaaacaatcaagtacttccttctgatagcgatgatgctaatagtgagatggggccacaccttcttggcgaccgtctcaaaatcaatgttgaccctccagagatcgatgaagaggatgatgatgaaagttccccaggcagtttgcctgccataaagatacatgaggatgaagtgaacttgagatttctcatctgtggtgcaccttcgactgttgtaagcttctttggaattctacttcctgtctaa

SEQ ID NO: 106263 - DNA, 400 bp, Glycine max
  Peptide Sequence Number=SeqID_223041
atgaattcctccatttatattcttgtctttgtccagctttggttgttcagcttaccatgcagagagagtgtgtgcatcccaagtgagcgtgagacacttttgaagattaagaataatctcatagatccttcaaataggctttggtcttggaatcataataataccaactgttgccactggtatggagtcctctgccacaacgtcacttcccatgttcttcagcttcacctcaacacttcagattctgctttctatcatgaccatgatggctatctctactcagacttcgatgaggaagcttatgagaaatcccagtttggtggagtgataagtccttgtttggctgatttaaagcatttgaattacttggacttgagcggcaatgaattccttggagaag

SEQ ID NO: 106264 - DNA, 864 bp, Glycine max
  Peptide Sequence Number=SeqID_223042
atggcttcttctggagcaaatactgcaacaaagccaatcaaaaaaaggaaaagaacgattgagatcaagaaagttgagcagataaacaggcgtcacgtgaccttctccaaacgcaaattagggttattcaataaactcacagagctctcaattctgtgccaagtggaagccgctgtgatcatcacctcccaaaacgggaagctctatacgtgtggctaccccgacgccgatgccgtcgttcgccgctacctcaacggagggctaccccggcggctggacagtgcatgcaaaaagagacagcaagatgcaattgaaaccctaaggcttgaatacgaggccactcagaaccacttgaaagaagagcaaaagcgtttgcaagaaatcaaagagacgcgaaagagtagtttgcgctttccctcgtggtggaatctccccaccgagggtatgggtttggaggatcttgaacagttcaagacttctttggaacgtttgaagtttaacctagttggggcgctgcaagagaagcagatgaattcggtcccatcaatgccacatgctgctatgcttccaccaatgtcatctactatggttccaccaatgccatctactgtggttccaccagtgccacatgctgctatggttccgccaatgtcatctactatggttccaccaatgccacatgctgctatggttccaccaatgatgccgccacagtttcaaagcatgccgctcttgagtgctcaacgtttaagtggaaatcaagttcaagatgattattggaggagtgctgctatagctagtactagttcgacgtttgcttcaaatggttttggaagtctgaaaagttatgggtatactacttaa

SEQ ID NO: 106265 - DNA, 414 bp, Glycine max
  Peptide Sequence Number=SeqID_223043
atgtgcgctcagcatgtgagagtttgtgctcagcggaacttgtgccacaggtcacagcgagaagagtgcaagtgtatttcggagctccttgagaatgaaacggaaacatcgttcgagctaaaggcagcaacgtgcaggcacagacacacgcgaacactgagaaaacgacgacggtggagttacgagcgcggaaggttggactccgacgtggctcagttccgaagtttcctccgccgaagaaaaacgccgtttcgcgaaactacggaggaattgcgacggtgcactgcatcgtttggatgcagagagttgccgatcaaggagaaacggcgcggcaatggcggtgtgcgagaacggaacaggaactgtgaaaaccctaacgcgatggatggattgggattggaagatgaagattga

SEQ ID NO: 106266 - DNA, 855 bp, Glycine max
  Peptide Sequence Number=SeqID_223044
atggattcttcatctagagcaaagactgtcaatgcagcaacaatgcaaaacaaaaagaggggaaagattgagatcaaagaagttgagcagagaaaccggcgttacgtgactttctccaaacgcaaactagggttattcaacaaactcaccgagctctctgttctctgccaagtagagaccgctgtgatcatcacctcccaaaacgggaagctctattcctgcggctaccccgaccccgacgccgtcgttcggcgctacctcaccggagggcctccgctgcggcgcaaccgtgcaatcaagagggagcagcaagagttcgttgagcagcaaaggctggaatacgaggctgttcagaatcagttgaaagaagagaaaaagcgtctgcaagaaatcaaagggacgcaaaataataatggtttctgctttgcggccccttggtggaatctccccaccgagggtatgggtttggaggatcttgaacagttcaagacttctttggaacgtttgaagtttaacctagttggggcgctgcaagagaagcagatgaattcggtcccatcaatgccacatgctgctatgcttccaccaatgccatctactgtggttccaccagtgccacatgctgctatggttccaccaatgtcatctactatggttccaccagtgccacatgctgctatggttccaccaatgatgccaccacagtttcaaaacatgtcgctcttgagggctcaacgtttaagtggaaatcaagttcaagatgattattggaggagtgctgctatagctagtactgcttcgacgtttgcttcaaatgtttttggaagcctgaaaaattatgggtatactacttaa

SEQ ID NO: 106267 - DNA, 429 bp, Glycine max
  Peptide Sequence Number=SeqID_223045
atggagggaacttcatgggcatttatgttctctattcctgaagataatctcctagttgatgatttctacttttcagccctttacgatgctgaagaaattcaggagaatatatcaatggtgaaatgccctcacaccaaatgcaagcaagttgtagagcctcaacactgtcgtttagttatcactaaggaagtgtttgagcgatgggaaaatgccccatgtgagaatttggttcttgcatcacaaaaattttattgcccttttaaggattgctcagctatgttggttgcatggcacgcaggaatagatggcagtgagtttcgcagcttgaagcaggatgagagagggagggaggatctaaagatgtggctatcaattttgttatgcctgatcctcttggagacagcaccatatgtgtttgactttcagtaa

SEQ ID NO: 106268 - DNA, 1002 bp, Glycine max
  Peptide Sequence Number=SeqID_223046
atggagggaacttcatcggcaccaacgactttgccctctactcctgaagataatcgtctcttggttgacgatttcttcttttcagccctttatgatgctgaagaagtatttccaatttcagatgagaaatatgcagaagagctacaactacaagaagtcctatattcctctacagtgtcaagtactggagttacaaaggaagttattcaaattgatgtagatgttgactgtgatacccctttgagaatcctcaagggcaaacagaaagagaccggtgaatcttcccaacaagtctattgtggtatttgtatggatgccaaatatggtgaagaaatgttcagaaaccaaaactgctcccactcattttgtgatgattgcattgggagatatgtggctacaaaggttcaggagaatatatcaatggtgaaatgccctcaccccaaatgcaaaggggttatagagcctcagtactgtcgctcatttatccctaaggaagtgtttgatcgatgggaaaatgccctatgtgagaatttggtgcttggatcacaaaaattttattgcccttttaaggattgttctgctgtgttgataaatgatgcagaggaaattgtgactgtttcggagtgtccacactgcaacagattgttttgtgcacagtgcaaggtttcgtggcatgcaggagtagattgtaaggagtttcagaatttgaaggagtacgagcgagagagggaagatttgatggtgatggaacttgccaagaataaaagttggaaaagatgtccaaaatgcatcttttatgtggaaagaatcgatggatatgtggcaatgaattttgctatgcctgtggatcctcttggagtggtggtctgcactatgaatgtagacctcgttaagaattgctggaagcaatttttgaatgaatctagctgcaaaagtttagttatactggtgagccttctggaagtgtgtcatttgaatgctcttagaggatgttcaaattaa

SEQ ID NO: 106269 - DNA, 372 bp, Glycine max
  Peptide Sequence Number=SeqID_223047
atggagaagatggagggtggttttcctcgacttgcctcattcgtgtgcaactgtgagcctttctcagaggaagaactccaagccatcgaagcctctctttccaaccctaacaacaaacgtccatatccattcaatgcgcgcgcttcttctttctcgcctcatacagggtggctctggagcttcatcattgtcgttcaattataccaaaggatgtgtttgatcgatgttgtgagaattcggtgcttgaaccacaatttttgttgcccttttaaggattgctcggctatgttgatacctgatgttgaggaagttgtgactgtttcgaaatgtccacattgtaaaagtgcaaggtttcatggcatgttgaaatag

SEQ ID NO: 106270 - DNA, 747 bp, Glycine max
  Peptide Sequence Number=SeqID_223048
atggatgccaaatatggtgaagaaatgttcagaaaccaaaactgctcccactcattttgtgatgattgcattgggagatatgtggctacaaaggttcaggagaatatatcaatggtgaaatgccctcaccccaaatgcaaaggggttatagagcctcagtactgtcgctcatttatccctaaggaagtctttgatcgatgggaagatgccctatgtgagaatttggtgcctggatcacaaaaattttattgcccttttaaggattgttctgctatgttgataaatgatgcagaggaaattgtgactgtttcggagtgtccacactgcaacagattgttttgtgcacagtgcaaggtttcgtggcatgcaggagtagaatgtaaggagtttcagaatttgaaggagtacgagcgagagagggaagatttgatggtgatggaacttgctaagaataaaaattggaaaagatgtccaaaatgcagcttttatgtggaaagaatcgatggatatgtgatcatgaattttgctatgcctgtggatcctcttggagtggtggtcagcactatgaatgtagacctcgttaagaattgctggaggcaagtgcgcaatgttattggtatatgcatgctagtgaacaacacatgtttagatcgatatacttcaagctgtgtagaagtcaatttcactataagaaaaatgatttatgcctacagaaaaaaactatcactggatgttaaaaatgcgtaa

SEQ ID NO: 106271 - DNA, 177 bp, Glycine max
  Peptide Sequence Number=SeqID_223049
atgggtgatgggtctactctatctgcatttaccttcacaatgtctaatgaatgtggtcctcgtttcacattaaaattgattagcctgcagcatggaacatttgacaccaagggtggggaatatgagtgggttcacaagccggaaatggacactagccgaaggaggttcttcctatga

SEQ ID NO: 106272 - DNA, 285 bp, Glycine max
  Peptide Sequence Number=SeqID_223050
atggaaaaatctgacaagaaaaccttcaaaggtaagaaaggaaagaaagcatatattacttgggaagatagtgacatggattcatcaagtgattcagaaaacgaagtcataaatctaagtctcatggccaaaaattatgaaagtgaagaagagaaaggtcatagtgcatcaacatgttattttaggaagaatggtagtagcattggaaaaattgtatgggttcctaaaggatctttagtcaaaactaacattcaaggacccaagaaaatttgggtacctaaataa

SEQ ID NO: 106273 - DNA, 441 bp, Glycine max
  Peptide Sequence Number=SeqID_223051
atgagcttagatgaggcatccgagtcaaacgttatggccgtccgaatatgcgtggtcattccatttcaacttttaatcgccatgatatattacgggcttcaatcggacatccgagtaaaaactttagcccgtcggaattcacccgagtcttccatgataaattttgagcgtcgcgataggttactttccttactcggagatccggaggaaaagttatggccgtttgtatttgtgatgggcttcattttaatcctaagagcatctcgatatattatgagtttcaatcacgaatccgagtcaaacgttatggctgtgcgaatttgcctgattgtttcaacaaacaaagccttgattcaagatttcttcaagatcaagccttgcctcacaatgaaaggtttcaagtcattcaaggcacatgtaatcgattaccaatacatgtaa

SEQ ID NO: 106274 - DNA, 270 bp, Glycine max
  Peptide Sequence Number=SeqID_223052
atggggctcgggataagatttgagggtggagtataccggaacaacgctaggcaatcaattcgtggggctccagactcgatggtggaggatgcaggaatgacaatcaattcatggggctccggactcgatggtggaggatgcatgaatgacaatcgattcatgggactcgggcggaatagcgctaggcaagcaattcgtggggctccagactcgatggtggaggatgcaggaataacaatcaattcatggggctccggggaaagatttgag

SEQ ID NO: 106275 - DNA, 129 bp, Glycine max
  Peptide Sequence Number=SeqID_223053
gtcatcaagcgcaccgcttcagctcattcgctaagcgagagaagtgcgctaagccataatccacttatgcgtgctaagcgatccagatttgcgctaagcgagcgagcacagaccaacccaactatttaa

SEQ ID NO: 106276 - DNA, 522 bp, Glycine max
  Peptide Sequence Number=SeqID_223054
atggataacaaatgcaaaacagtacaacttagtttaaaagcggatggggtctctgatatgtactgtgctagggcaaacaacaagaggtatgggagtgctactcttaaatgtgatgtggctgtgtctagtgaagctgtggtggcttcttgtgatgctgttttgagagattcaaatgctgagctttggggtattatgtatggcctccaaatggcagctgaggctaaaatggaacatttgcatgttgctgctgatagtctccaccccgtgatgcttgttgatgattgtattcaatctgaggatcagttccatgaacaaatctcgaaaatatggaagatgaagggaagtttgacaagctgcacctttggccatattggcagagatgataattgtttagcgaataaatttgcaaagtttggtttttctttaaacttagattgtatattttttcaagcagtcccttcttttgctagtactgtgacaaaggaagtgtttatgagtgattctatgttgaattcttcataa

SEQ ID NO: 106277 - DNA, 934 bp, Glycine max
  Peptide Sequence Number=SeqID_223055
atggtgttgggaattgtggaatatgactttaagttcattgagcctactccaactttgaactttgagaataaccattttcaagtagtgttcgatctactacatactaatcaatatttgattgattggtatgagatggctggggatatcaaggaggggagagcagggtgttctgttatttttctgctattgactttacttctttgtagcactgagggtttaaacactgaggggcaaatcctcctagaccttaagaaaggacttcacgataaatctaatgttctggaaaattggaggtttactgatgaaaccccgtgtggctgggtaggtgtaaactgcactcatgatgataataacaactttttggttgtgtctcttaatttgagttcattgaatctttctggaagtctaaatgctgctggcattgggggtctgaccaatctaacttatctcaatcttgcttacaataagctgactggaaatattcccaaggagattggtgagtgtttgaatttggaatatctttatttgaacaataatcagtttgaggggcctattcctgctgaattgggtaagctgtctgttttgaaaagtttgaatattttcaacaacaaactctctggtgtgcttccagatgagtttgggaacttgtcttcattggttgagttagtggcctttagcaactttcttgttggacccctgcccaaatccattggaaatcttaagaatcttgtaaatttcagagctggggcaaataacattaccggtaacttgccgaaggaaatcggtggatgtacgagcttaatacttcttggtcttgctcaaaatcagataggaggggagataccaagggagattgggatgcttgccaacttgaatgaactggttttatggggaaaccagttgtcaggacctattcctaaagagattgggaatt

SEQ ID NO: 106278 - DNA, 2154 bp, Glycine max
  Peptide Sequence Number=SeqID_223056
atgtatcagctgcaactttttgacaactccctaagtggtgttattcctcaaggactcggacttcgtagtcctctttgggtggttgatttttctgataacaaattgacaggaagaataccgcctcatctatgccgaaattcaagcttgatgttgttgaatctggcagctaatcagctctatggaaatataccaacagggatactaaactgtaaatcattggcacagttgttgttacttgaaaacaggcttactggcagcttcccttctgaattgtgtaagctggagaacttgactgccattgatttgaatgagaacaggttcagtggtacactcccttctgatatagggaactgcaacaaattgcaaaggtttcacattgcggacaattacttcacattggagttgcctaaggaaataggaaatctctctcaattggtgacctttaatgtttcatcaaatcttttcactggaagaatcccacgtgaaattttttcatgtcaaaggctacagcggcttgatctcagccagaataacttttctggttcctttccagatgaggttggaacacttcagcacttggagattctcaagctctcagacaataagctgtctggatatattcctgcagcattaggcaatctgtctcatttgaactggttgttgatggatggcaattatttctttggtgaaatacctccccatttgggttctcttgcaactttgcaaattgcaatggatctcagttacaataacctttctggaagaataccggttcagcttggcaatctcaacatgcttgaatttctctatctcaataacaaccatttggatggtgaaattcccagcacatttgaagagctttctagcttattggggtgcaatttctcattcaacaacctctctggtcctattccttccactaaaattttccaaagtatggctataagcagctttattggtggtaacaacggcctctgtggtgcacctctcggtgactgcagcgatccagcttctcactctgatactcgagggaaaagttttgattcttctcgcgctaaaatagtcatgatcattgcagcttctgttggaggtgtttcactcgttttcattttagttattttacattttatgaggcgtcctcgggagtcaactgattcctttgtaggcactgagcctccctcccctgattcagatatctatttccctccaaaggaaggtttcactttccatgatctagttgaagccacaaaaagatttcatgaaagctatgttattggtaagggagcatgtggaaccgtttataaggcagtgatgaaatctggtaagaccattgctgttaagaagttagcatctaacagggaagggaacaacattgagaatagtttcagggctgaaataactactctgggaagaataaggcatcggaatatagtgaaattgtatggcttttgctatcaacagggttccaatctcctgctttatgagtacatggaaagaggtagcttaggtgaactattacatggtaatgcaagtaatttggagtggccaattcggttcatgattgctcttggagctgctgagggtcttgcctacttgcatcatgactgcaaaccaaagattattcaccgcgatataaaatctaacaacattctgctggatgaaaattttgaggcccatgttggtgattttggtttggcaaaagtgattgacatgccccagtcaaagtctatgtctgcggtcgctggatcttatggctatattgcacctgaatatgcatatacaatgaaggtgacagagaagtgtgacacttatagctttggtgttgtgctattggaattgctaactggaagaacaccagttcagccactagagcaaggtggtgaccttgtcacatgggtgaggaaccatatccgggaccacaacaacacattgacaccagagatgctcgacagccgcgtagatcttgaagaccaaaccactgtgaatcacatgctcactgttttgaagcttgctttactgtgcacaagtgtgtctcctaccaagaggccatcgatgcgggaagttgtgttgatgcttatcgagtcaaacgagcgagaagggaacttaacacttactcaaacataccatgatcttccttccaaagatggcatgtga

SEQ ID NO: 106279 - DNA, 2349 bp, Glycine max
  Peptide Sequence Number=SeqID_223057
atggctcctccatatccctccctgctcattctcctatttttgttgacaagccaagttacttgttatggttcagagaaggaaaagagtaaaactttcataatccaagtccagcacgaagccaagccttccatattcccaacccacaaacactggtacgactcctccctctcttccatctccaccaccgcttctgttatccacacctaccacaccgttttccacggcttctccgcaaagctctcaccttccgaggcacagaagcttcaatctctcgcccacgtcatcactctcatacccgaacagcttcgctcgcctcacaccacccgctcccctgagtttctcggcttaaccaccgccgacagaaccgggttgctccacgagaccgatttcggctccgatctcgtcatcggagtcatcgacaccggaatctggccggagcgacagagcttcaacgaccgcggcctcggccccgttccctccaaatggaagggcaagtgcgtcgccggagaaaattttccggcaagttcgtgcaaccggaaactcatcggcgcgaggtggttctcaggcggatacgaagccacccacgggaagatgaacgagaccactgagttccgctcgccaagagactccgacggccacggcacgcacactgcgtcgatcgccgccgggaggtacgtctctcaggcgtccacgttggggtacgcgaagggcgtcgccgccggcatggcgccgaaggcgcggctcgcggtgtataaagtctgctggagcgacggctgctacgactccgacatcctcgctgccttcgacgccgccgtgtccgacggcgtcgacgtggcgtcgctcagcgtcggaggtgttgtggtgccttaccacctcgatgtcattgctattggcgccttcggcgccgcctccgccggcgtttttgtctctgcctccgctggcaacggcggtcccggcggactcacggtgaccaatgtggcgccgtgggtgaccaccgtcggtgccggaacgttagaccgagattttccggcgaatgtgaagcttggaaatggaaaaatagtacctggaattagtatttatggtggaccgggtctaactccgggtcgaatgtacccgattgtgtatgcaggtgttggacaatttggcggcggcggtggaagtggtggtgttgatggttattcatcgtcactttgtttagaaggttccttagatcctaagtttgtaaaaggaaaaattgttgtgtgtgatagaggcattaattcaagagctgctaaaggtgaggaagttaagaaaaatggaggggttggcatgattttggcaaatggtgtatttgatggtgaaggattagtagctgattgccatgtattacctgccacggcagttggcgccaccggcggcgatgagatacggagttacattgggaattcgcggactccggccaccgcgacaatcgtgttcaaggggacaaggctaggggttaggccagcacctgtggtggcatcattttcagcaagagggccaaaccctgagtccccagagattttgaagcctgatgttatagctccaggattgaacattcttgcagcttggcctgatcatgttggaccctctggggtaccctctgatgggcgtaggactgagtttaacatcctctctgggacttcaatggcttgtcctcatgtttctggtttggctgctttgttgaaagcagcacatcctgattggagtcctgctgccattaggtctgctttgatgaccactgcttacactgtggacaacaagggtgatcccatgttggatgagtccactgggaatgtttcatcagtgtttgattatggtgctggccatgttcatccagtgaaggccatgaaccctggattggtttatgatatctccacttctgattatgtgaatttcttgtgcaattcaaattacaccaccaacactatccatgtcattactaggaggaatgctgattgcagtggggctaaaagagcaggacattctgggaacctgaattacccttcattgtctgcagtgtttcagctatatggaaagaagagaatggctacacattttattaggactgtgaccaatgttggggaccctaattcagtgtacaaggtcaccattaagccgccgcgtggaacggtggtcacagtgaagccagacaccttgaatttcaggagggtgggacagaagttgaactttcttgttagggttcagattagggctgttaagctttctcctggaggttctagtgtgaagagtggctccatagtttggtctgatgggaagcacactgtcacaagtcccttggttgtgacaatgcagcagcctctggattag

SEQ ID NO: 106280 - DNA, 357 bp, Glycine max
  Peptide Sequence Number=SeqID_223058
atgcacgtgacacagttgacatgggagaatctgtcttgtggtggcagtgacaatgtaagccacaaagacttggtttcatggtctgacaaatgtgaaccacccaattctgatttttccatttcccagaagaatggatcactcttgggaagcacaaaagcttcttttcttagtgggaggaaactgaaggtgaacagttttacagcaccagttggagcacgatccagcactacagtgtgtgcagttgctgagcctgataggcctctgtggttcccaggcagcacccctcctccatggctagatggcagtttgccaggagattttggctttgatcccctaggtcttggaagtgatttatga

SEQ ID NO: 106281 - DNA, 210 bp, Glycine max
  Peptide Sequence Number=SeqID_223059
atgcaggagtatacttctagtgtcatttattccaaactcaagccagcaacaaaatgtggtaatcttctagagaaggttgaggagcatcatcacaagttggggaaaagaaaaagagagagggagagggagaaaagaaaatggggttggacagatggtcacatcaaagaggttacaagttacaagaaagtaggggaatccaaaacttcataa

SEQ ID NO: 106282 - DNA, 921 bp, Glycine max
  Peptide Sequence Number=SeqID_223060
atggctagtggtcgcaatttgaagaacgctgtgatagcgtttttggttcctcttccctccatcttcttctacctctcattcctcaaccactacgactcagcaaattccccattgttttggtcaactctatggtcatggtgctatcaccaccctcttctattagccaacgctctcttcttcctcaacgtcaatgtcctcttctgggccataggcctaatccaatccagccactggatgattgacccctattggactgtgatacctgtgatgcttgttcactactatgccactcacccgttggctcactatgattggtggaggtccaggatcgtgattttattgacttgggtgtggagtgctaggctcactcataactatttcaggagagagaggtggcagtggggtgccagggaagattggcgtttcactgagatgagtcaacagtatgggaagcaatggtggtgggtttcattctttgctgtctatgtctctcaacagaacaccttgaacctgcttgttgaattacttgttttctttgattgctgttccattgaattgagtgtttttcttttgctctatgagtttgtgagtagaaacaacaagctgaaggggcttgggaaaccagtggtttttgtccttgacagtggcttgtggtattactgccgacatccgaattactttggcgagcagctgtggtggtgggggctggttgtgtttgcatggaacctgggacatggatggacctttattggagctttggttaatactatgtgtttggcttatgtgactaggcttgtggaggaccgaatgttgaaacaaaaaagtagagcagaagcatttagggtgtatcagaagaaaacttctgtgtgggtaccttggttcaagtcctctccttcaggggttaaaaataagaatgcttga

SEQ ID NO: 106283 - DNA, 835 bp, Glycine max
  Peptide Sequence Number=SeqID_223061
ttcccagaagaatggatcactcttgggaagcacaaaagcttcttttcttagtgggaggaaactgaaggtgaacaactttacagcaccagttggagcacgatccagcactacagtttgcgcagttgctgagcctgataggcctctgtggttcccaggcagcacccctcctccatggctagatggcagtttgccaggagattttggctttgatcctctaggtcttggatctgatcctgagagcctgagatggaatgtccaagcagagcttgtgcactgcagatgggccatgttgggagctgctggcattttcatcccagaattcctcacaaagattggtatcctgaacaccccttcatggtacactgctggagagttggagtacttcacagacactaccacactcttcgtagttgagctctttttcattggttgggccgagggtagaaggtgggctgatatcatcaagccaggctgtgtcaacactgaccctatctttcccaacaacaagctcacaggaactgatgttgggtacccaggtgggctttggtttgatccacttggctggggaagtggttctcctgagaagatcaaggagttgagaacaaaggagatcaagaatgggaggttggccatgttggctgtgatgggggcatggttccagcacatttacactggcactggtcctattgacaacctctttgctcaccttgcagatcctggtcatgctactatttttgctatgcagttttataggctttcactcccaagtgagaagggttggaacaactctatgattgcaagccttggagaaacattgggaaacttgtttaactaa

SEQ ID NO: 106284 - DNA, 1269 bp, Glycine max
  Peptide Sequence Number=SeqID_223062
atgaagacttacttagtcttgttcctcaaacatctctccttcaaatggaagggtaaaattggaaaaatgaataaatgtccaatgaagacttgggttgggtggcaacaagtttgtctttcctacccggtctttgtcctcaaacttctatatctacttgccactttaaccccatcagggcacagctacaaaacaagcatacccaccaacaccacaaccgaaccagaacctaaggtggcagatatgcactatgcaaatggcaagaccacgcattgcttgaatgtgctcccttcccagaatttttcttgctctgacctcaacaccactatctttcttaacagaatgatcaaagcggagaaacccaatcttattgtcttcactggagataatatctttgcgtttgattcctcggattcagctaaatcattggatgctgcatttgctccagcaattgcatcaaacattccttgggtagctgttttgggcaaccatgaccaggaaggaaccctctctaggtcaggggtgatgaatcatatcgttgggatgaaaaacaccttatctaaattcaatcctccggaagtacatagcattgatggttttgggaactataacttggaggttggaggagttgaaggcactgattttgaaaataaatcagtgctcaacctgtactttcttgatagtggagattattcccaagtttctacaattcttggttatgattggatcaagccctcccagcaactttggttccaacgaacatctgcagaacttaggaaagcatacataagtaaaccagtacctcagaaacatgctgctcctggtcttgcatatttccacatccctctaccagaatatgctagtttggactcatcaaacatgacaggtgtgaaactggaaccggctggcaatggcattagctctccttctgtgaactctggcttcttcacaaccttgcttgcagcaggagatgtgaaggcagttttcactggccatgatcacctcaatgacttctgtggcaatctaatgaatatacaactttgttatgctgggggattcggataccatgcatatggaaaggcagggtggtctaggagagcaagagtggtggtggctagcttggagaaaacggagaaaggaagctggggagatgtcaagtcaattaaaacatggaaacgccttgatgatcaacatcttactggaattgatggtgaggtcctgtggagcaagagcactggtggattgtctataagatatgcctgttggacataa

SEQ ID NO: 106285 - DNA, 696 bp, Glycine max
  Peptide Sequence Number=SeqID_223063
atgtcggctcgattgatgaagaaggttctgaacgagcagcatcaccttccgcaacacgtgagcgaagaagaagaagaagaagagaacgattctgagcccatcactcgttcctccatcaaccccttcgacctcctcaacgacaacgattctgagcccgaagaccagggagatgagttgatgtccaccaatgaaatattgacaagttatgatgacaaagaggagtcagcttcattgaaacctactgctgaggtttccacatcaaatccaaaattgaagaaaaagaaaaagaagaagaacaaggatagtgctgttgcgaataaaatggatgataaagaattggacttgattctagaggatttatctctgaatgtcgacacttcagctgagcaacctgtttctaccaaagacaaaaataaatctgttaaacagcatgcagcctccgtattacaagtggatcctaaatacttgaatgccgaaaatgagcttagaagaatatttggatctaaggttgtaaaatcatttgagagtagcaatcaagtgggcagttctcggcagatgcgaggggtgagggggcgtgtacattataatcttaaaaagagtgttcttgtcactccatcagacaattggctccgctgtgatgattctttggtcatgcagtttttggagataaaaaatggatataactatttcaggtaa

SEQ ID NO: 106286 - DNA, 297 bp, Glycine max
  Peptide Sequence Number=SeqID_223064
atgaagagaatgagagggagagttgaagaggaagaggaaaaacaaagggaaggggagaatagaagtggaagaggctcaaaggagttgaagggggagttggaaaggaaggggaatggagaaatgagagtgaaagggagagagatgcatgagataagagagagagacattggagatgggaaggggaaagggtgcatggaggattatgtgttggaaagaagtattgaaaggaatcacattattttccaagatggagctgttgattttgagaaggaggttattcttcttgcaccaacataa

SEQ ID NO: 106287 - DNA, 195 bp, Glycine max
  Peptide Sequence Number=SeqID_223065
atggaagccatatcaaagtggattaaaggtcttgatatatgtggcaaagtgactctaaagattaaactttgggaaattgcataccctgatctaaattcgatgtgtgctcctcctgaaaagatcaaaactaaaggtatgagtgaagattcatggtctttgattcgcaaccatttgcaaaaagaacttggacaatga

SEQ ID NO: 106288 - DNA, 662 bp, Glycine max
  Peptide Sequence Number=SeqID_223066
ggtggacccttgggtacttgtacctatcacttttagaggactacacgtcctcgccatcagagggctgcacgccctcaccttcagaggactacacgtcctcgccttgagagggctacacgccctcaccttggaggacttcatgtcctcgccatcagagggctacacgccctcaccttgggtactagttaccctcaccgttgagaggactacacgtcctcgccttgagaggactacacgtcctcccatcagagggctgccgcgaggactacacgtcctcaccatcagagggttgcacgccctcacctctagaggactacatgtcctcgccttgagagggctacacgccctcaccttgggactacacgtcctcaccatcagagggctgcacgccctcacctctagaggactacatgtcctcaccttgagagggctgcacgccctcacctccagaggactacatgtcctcgccttgagagggctacacgccctcaccttggggctacacgtcctcaccttgggtactagttaccctcaccgtcagagggctacacgccctcaccttgaaaggactacacgtcctcgccagcagagagggctgcacgccctcacctctagaggactacatgtcctcgccttgagacaggctacacgccctcacattg

SEQ ID NO: 106289 - DNA, 138 bp, Glycine max
  Peptide Sequence Number=SeqID_223067
atgtcgtggtcggctttaagtggcattgcatcattgcttttaccaggaggtagaacaacccattatgttttttctattccattagtcatcaatgaatcctccaattgtaacatcaagcagggcaatgacaaagcataa

SEQ ID NO: 106290 - DNA, 246 bp, Glycine max
  Peptide Sequence Number=SeqID_223068
atgcctacatccagtccccaagcgacctacaatcctttagatttcttttgtttaagggaaagggaagaatcaaaagaattctcaaactgtgtctttttgaattctttgaaaagggagacacaaaagaattcaggcgaacaaggtttggaagccagaaaacttagaaagctttttggcaaaggaagaagaagaaagatgagaagcaaaggtttcaagatttctcaaaagctgttcaagaaattctaa

SEQ ID NO: 106291 - DNA, 616 bp, Glycine max
  Peptide Sequence Number=SeqID_223069
atgcgtctcgccgctctgtttgccggtgttgcgctggccctcgcgtcactccagccgctgctggcggccgataaagtcacgctgcgccttggcgatgtgaaaggcgatcgttttgccgccctgaaagcctcgggcgaactgaacaatctgccttacgatcttaagctcaccgcctttgactccggcgcaccggtgcaggaagcgctcaatgccggggcgctcgacgttggctttaccggcgatttgccgtttctgtttgtctatgcggcaggcgcgccggtgaaagccgtgggtgcctggcagaataacccggacagcatcgccctgctgacccgccccgacgccggcattcaccggctgcaggatttaaaaggtaagcagatcgcggtcaaccgcggcggctggggacactatctgctgcttggcctgctggagcgcgctggcctgacgccgcaggatgtcacgctgcgctttctcggaccggtggatggccgcgcggcgctgacgtccggtgcggtcgcggcctgggcgccgtgggagccctatatcgccacctcgaccgccatcgacggcacggtgcgcgtaccggacggcgggggtaaaggcattatgtccg

SEQ ID NO: 106292 - DNA, 357 bp, Glycine max
  Peptide Sequence Number=SeqID_223070
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggacgtacgtttgtctagcaaagctagcatttcattaccttactattgttgggttgaggccattcctcatgtacagccaattatattgcctccttgcattttgaacaacatacctgattcatacccccaaaagaaagaaaagggacatgctaggtgcacccagcaacattgctggtgcacccagcaattaggtgaatgggcaaaattgcccttgcgttaa

SEQ ID NO: 106293 - DNA, 388 bp, Glycine max
  Peptide Sequence Number=SeqID_223071
gtcgactctagaggatcccacattgaagaagcaaaagaggaagaatctagtgaagaaatatatccccaagaagaaggacaacctttaatggttaaggaggagtgtaaggaggtaagtgtctcctccaagaggtacttggcacccatcgtcaggcaatttgtgaagttccgtgacatgccggaactcaaaaggaagcatcgttgcacaattcgtgagaaggcggttgcttctggaggaagtcaccttgctcgcctaggcgagctgggtggcaagcatctcccccattttcctataaatagcgggagaaatgaagaggaatttcgttcagccctcctgccgttcttcgacgttcttcgttcgttcgtcatcgttctttggtcttcaacgg

SEQ ID NO: 106294 - DNA, 402 bp, Glycine max
  Peptide Sequence Number=SeqID_223072
atgcaaagacaatctaggtcatctgcctctttatttttcgaaggcttcaatgtctttcgaccaagactatcacagtcttcttttcctccaagactatcaagtctgtcggcctacagagacaatcaagagacaatcaaggtcatctacctctttttcaaagacttcaatgtctttcgaccaagactatcacagtcttctttgcctcagggactatcaagtccattggcttgcggagaccatcaaggcccctggctcacccaggccactagaaagcttagggttgaagtaaccagctcgcctgggcgagcaaggttacttctggaggaagcaaacaactcgtctaggcgagctgagcttgcctgggtgagctggtatgcaacctccacccctcattccctataa

SEQ ID NO: 106295 - DNA, 462 bp, Glycine max
  Peptide Sequence Number=SeqID_223073
atgagaggtgcatcttcaaaggaaatcatcacgcctttcatcacgcaaggtttcattgatgctaaagcgaagatactgcagaaaatccgtaaagcatggaatagagtggaaagaaaagataaggatcttaggggaagtagcaacagtgtcattggcggctatcacaagtggttgaagtctagaacgcaagggataacttggctcccaaagctaaaaagtctaagtgggaaagaggctgaaatttctgaggaaagtgaagaagtgcaagctttgaaagtagagctcgaagagtcaagagtggtgaatgagaagttgagggtggtagtcactagggtcaggaaaaaatgtgatgagctgaaagatatcaacatgaccacggtggaagcgttagagcgggaaataaaaaaaggcccgaaaggaagaatggagcaggaacaagttccaaggggctttgtggggtag

SEQ ID NO: 106296 - DNA, 246 bp, Glycine max
  Peptide Sequence Number=SeqID_223074
atggcaggtggcaatcttcccaccgaaaaatgtgtttggctatccggggtaaggcttgaagtcggccagcgtgtggtctcggggtacttcatatgtctcccccataggttgagcgacatgtgtatgcccagactaaggttgttggctctcaaggggtataggagaggagtggtcattgttctcatcgggcacatgtatagcattgggtggtgtatagttgagaggcaggtcatacggtgggaatag

SEQ ID NO: 106297 - DNA, 369 bp, Glycine max
  Peptide Sequence Number=SeqID_223075
atgcaattacaattagatgctcagtcaaaacagatgcaattgcaattggatgctcaatctacaaatttgattaaggaattagccatgttttcgtcatcaaatttagattgtgactgtaacctcagcttattctttgtgaccattttgggtcttgctcctttcttcatgaaaggccttgtgctagtttggttcaagtggcttcatactaccaatcaactcacgacttggccagagtttactcgcactattagaaaatacactttcaacatcggttatttagaacattctacatcggttctaaaaccgatgttgaaagtgccgatgttgaatgtatcaatgttaacattggttttggagaaccgatgttaa

SEQ ID NO: 106298 - DNA, 783 bp, Glycine max
  Peptide Sequence Number=SeqID_223076
atgggtggtgcagtgaccttgttggatatccctggtgggggaaataaagtggttatgtgggatgctaccttgtttggcctgtttaatgaagacttccccttgtacataaagcatgaagatctatctgaaatagcacatggtggtcaatgtctcaacatctctattacacaattgcatatgactaggacaagtatgcgagcggggaatgctgatgtgtatggatacctcgagccacagtctatccagagatttgaccaatcacaatttgaatcaaaaagttaccttaagaactggatgcaaaattcaaaacgagatgcgtacctaggagcttacctgaatggtgcacattggcaaatggtcgtcattttgcctaatgaaaatgttgtcatctggttttgttcgttgcataataggccagacaactacctcaaaggcataattaacagtgctttgaaaggacttgatgatactcaacaaagtaaatccaagcctactgctaggtggattgttgttaaagtgaatgagcatattacacaagtgcccaatgttgaagtggagacagaagctaacacagaggttgaggacacccgatttgagctaacaacagagtttgcagaggttatggatcatattcccctcacacaacaatctcaaccttttctgcgagacttgagtaccttccctgatgcaattcaaaaggatatgacaatccttgaaggattgctttctttggctgtgatgggaacctgttggaggagtaaatggattgcacgtgatagttag

SEQ ID NO: 106299 - DNA, 210 bp, Glycine max
  Peptide Sequence Number=SeqID_223077
atggccataatttgtctccgcatgtcatcgggctcgcctcctctggatgacaaaagggcacaaaatgaccataattttcctctgcgtgccatcggacacgactgtgtctggatggcgaaaagggtcagtatgacagagattgtggggcggctgacaaaagcgaggctcttactcctacgtatcctcaacgaggaactcagacctacgtag

SEQ ID NO: 106300 - DNA, 213 bp, Glycine max
  Peptide Sequence Number=SeqID_223078
atggtggttgtgggtgatggagaaagtgcttgggacgttataaatggctttggaagaaagaaaggagaagaaatggcgtttttcctaagctacccgaaagcaaaggctgaaaacgctcaagtgagaaagggtctaggacatggaagcgtcgcgcacactacagatattttctcgaagatcccaacggtcagatcatggacacgtgtcttgtga

SEQ ID NO: 106301 - DNA, 165 bp, Glycine max
  Peptide Sequence Number=SeqID_223079
atgttgatttctactactactctgtttttgccgcaagctgatttctactactactctgttttcaagcacaatcttcacagcaaaacacccaagactgaaacaggggaaacgcttaatggtaaaactgaaacagaacacacattaaacaaaacaccaggacactaa

SEQ ID NO: 106302 - DNA, 333 bp, Glycine max
  Peptide Sequence Number=SeqID_223080
atggcttcccgcaaaagaaaggcaccagcctcagcatctcaggcccactatgatagatcgagattcacatcccaagaggcctgggattgctattctgacattgtgattggcaagaagattcttcctgagaggaatgtaatgatatatcatacagaatttgatgaattcaagactaagttggaaagaaggaattggcacaaggagctgaccaattttctagatgggagcaacgatgtagctttagtgaaggagttttatgctaatttgtatgaccttgaagataaatctcctaagcaagtaagggttgtagaagcaaacttcattgcttcatga

SEQ ID NO: 106303 - DNA, 168 bp, Glycine max
  Peptide Sequence Number=SeqID_223081
atgggtgccaagcacctcccaaggaccaaagaaaggtcgcatgtcaccaagcaaaggatactaggctgcctcccagtggcgttttccgtttgtccagagctgggcaagggacgacgatctatcagtcgtgaccctagcctctactcgcgtccgtccctaagtacctga

SEQ ID NO: 106304 - DNA, 315 bp, Glycine max
  Peptide Sequence Number=SeqID_223082
atgtctcttgccactctctttgggaaacttcaagaatatgaaatggaacttatgaaactctatcaacatgaagagaatgacaaaaagaagaaagaaattacactcaaagcctcatcttcttctattcatgaggaaaatgacagagaagactcaaatgaaaagaacttagaagaagatgatgattttagtctctttctaaagagattcaataaattcatgaggaacaaaggaaatcaaaggagatcgaacttcaatccaaagaagaaaggagaagattcctccttagttccaaaatgctatgaatgcgatcaacct

SEQ ID NO: 106305 - DNA, 288 bp, Glycine max
  Peptide Sequence Number=SeqID_223083
atgatcacgagattaaatttaaagagcattgaaattcatgtatcagaattcagtcagaatctacgtgtgaatggttcgtatttccttgagattagtgcagcagataagcttcttccttctgatgttgaaatcctaagatcaacaggaccacaacggcttaaagggtgtctggtactggcttggcactcttatgtagcaactgtcacaatcaaaagagatgctcgatcaaattttcggatcaaagcgaatgcccgtgctaggcatctttgtctcagtcaccttaattag

SEQ ID NO: 106306 - DNA, 1395 bp, Glycine max
  Peptide Sequence Number=SeqID_223084
atgtatcagtgcaaggaaactacaaaagaaaatcctcaacaaatatatgatggtaacaacaatgaggatcacccttccttccttgaaagtaaatttgaaactaaccaacagataggaaccctggctgatgaagcgcctgctgataccccaaattccgtgagtagtccaacttgtgaagatcctcctccaccaccatcagaatggttagaggacacgcttatcgatctttacttatctggctacaagaacatagaagttagtgaagccgatgcagtgacagtgccatttgaaacagatgatagatataactcgttagcagctgatgcttacagcaaaacttacgaagtggaaggcgagtggatcctagaaccaggagatgaaaatggcttagctgataatagaagtactgtggatgaaggtataccttatagcaacacttatgaactggaagaaggtgaatggatcccagacatggaggacgaatatggcatagctgatagaagtaccatagatgaagccatctcattggatgaagagaaatggcgagctcaatatggtcaagttactgaatcagggaaagatctggtttcagaggttccaattgtggacttgtgggattgggaaatggttacgggatccaaaagagatggaaaagataagatggcaaggttggttggtagactggttaaaccatctgcaaagcaacatccatctatccctttcagtggagggaaattaagatctgctcccatctgtgaagcacatctcgatctgcagtattgggattttcagtaccgtgctagaggacaattgtacagattgcgaaatcctagcgcaaaatatgtggcttcattatcaacttatgattcttccaatccaacagaacattgggattttccccagttatcacctaatagaaaaatcaaacgtcactctaagtccagtgaaagctctgcttcagctttggatgaaacccctattgagaaggatttgtctgcattgccaagtcagctctctgcctctaagagttgcgggttagggaagttgagagaatataacgacatggagaacaattctaagcttaaaataaaacatcaatacagagatagggctgctgaaagaagaatattgcatggtggcttcggcatgggtccaggacagaagaatctgtcggacatttataatacaccatcttcacctgttgatgattgtccacaagaagctacggcagaggccttggagatgtcatttggagctggtagttatgctagaaaacttctaaaaagcatgggttggaaggagggggaagggcttggcagttctacgaagggcttggtagaacctattcaaccagttggaaacgttggtacttctggtttgggatggtctcgttga

SEQ ID NO: 106307 - DNA, 669 bp, Glycine max
  Peptide Sequence Number=SeqID_223085
atggcttcccctactcatttcgacgatgacttcgatttcggaggcggatttggcggaaggcattcaggtaataagaggtcgtctcccgattacgacgacgaggattatgacaacgatccttttgcaccgaagaaggctataacaaaagctgaagaagcttctggtgtaacaacaggaatgatcttgtcacttcgtgagagtctccagaactgtaaggatacacttgcaacatgccaacattcccttcaatcctccatttccatagctacctctagtctgttagaattgagggttgttgatgggaacccgagccatattggtctcaaccagtggccccaatacagagaagagaagcttattaagatcattgcattttctagaatgaacttgaggctgcaaaatcagagattcagagttggcattctacacttaaaaatcagccatccatacttgccgggatcactccaggccttgaaatcctctgaagagtctttaagagagcagcttgaaaaggcaaagaaaaaggaagctgcattcattgtaacatttgcaaaacgagaacaagagatagcagagttgaagtctgcggtgcgagatctgaaagtgcaactcaagccaccatcaatgcagaatcccactggttttccagcttcttttgaggcattgtag

SEQ ID NO: 106308 - DNA, 192 bp, Glycine max
  Peptide Sequence Number=SeqID_223086
atgacggaagaggatgacgaaggggccgaaagtgaaggatgcgagggaggccaggagttctgtgaggagggttatgtgtttggatttggtggattccatgaacaagtgaggattccggctcgtggtagttcctaccaagatttgaggtcgcaacatcattcccgatgctggactacaggatcttgtcgttag

SEQ ID NO: 106309 - DNA, 1795 bp, Glycine max
  Peptide Sequence Number=SeqID_223087
atgagactttcttcagctggttttagtcctccaccccaggaaggggaaaatcgagttctagattcagaactttggcatgcatgtgctggtccccttgtctctttaccagcagttggaagccgcgtggtatactttccacaaggtcacagtgaacaggtggctgtgtcgaccaacaaggaagtagatgctcatatcccaaactatccaagcttgcctcctcaactcatttgtcaacttcataatatgactatgcatgctgatgcggagactgatgaagtgtacgcgcaaatgaccttgcaacctctgaatcctgttttaactaaggccgtgtttgcagcaagagcaaaaggaggcatacctgccagcggagctgggcaccccaaggcagctgaaaaagtgtttcctccattggatttctctcaacaacctcctgctcaagaattaattgcaagggatttgcatggtaatgagtggaaattcaggcatatcttccggggccagcccaaaaggcatctacttacaaccggatggagtgtctttgtgagtgctaaaagactagttgctggtgattctgtgctgtttatctggcaaaaccaactactacttggcatccgccgtgctaatcgaccacaaactgtgatgccttcttcggtgttgtcaagtgatagtatgcacttggggcttcttgctgcagcagctcatgcagctgcaacaaatagtcgtttcaccatcttctataatccacgtgctagcccttcagaatttgtcataccattagcgaagtatgttaaagctgtgtatcatactcgagtttcagttggtatgcggttcaggatgctgtttgaaacagaggagtcaagtgtgcggagatacatgggtacaataactggcattagtgacctggatcctgtccggtggcaaaactcacattggcgctccgtcaaggttggctgggatgaatccactgctggagacaggcaacctagagtgtctctttgggaaattgagccattaactacatttcctatgtatccatctccattcccccttaggcttaaacggccatggcctccaggactgccttcattccatggcatgaaggatgacgattttggcccgaattcacctctgttgtggctccgagatcctgatagagggcttccgtctcttaattttcaggggattgggattaatccttggatgcagccaagatttgatcccaccatgttgaatatgcaaacagacatgtaccaagctgcggctgttcaggacatgaggagtttagatccttccaaacagcattctgcttccttacttccatttcagcaaccacagaacttcccaaacaggactgctgctttaatgcaggcccagatgttgcagcagtcacaacctcagcagatttttggaaatactcaagagaatcaacattccccacaatctcaggctcatcttcagcaacatctacaacatcaacactcgttcaatagtcagcatcatcatcaccaccagcaacaacaacagcgacagcaacatcaagtggtagataatcaacagatttctagtgcagtctctacaatgtctcagtttgtttcagctcctcaacctcaatcaccacctatgcaagttatctcttccatgtgccaacagcaaaacttttctgattcaaacgggaacactgtgactactattgtttctcccctgcacagtatcttgggttcttttccccaggatgaaacatctcacctcctgaaccttcctagaacaagctcttggattcctgttcaaaattcaa

SEQ ID NO: 106310 - DNA, 915 bp, Glycine max
  Peptide Sequence Number=SeqID_223088
atggccacttccaatggcttcgtcgacggcacttctccggaatccgcattgatctttctcggcagcggttgttcgagcatggttcccaacgtcatgtgcctccttcagccttctgaccctccctgccccgtctgcgtccagtcattgtctatccctcccgaacgaaaccctaattacaggtgcaatacgtctctcttaattgattactgcggcgacgccaacgctggtgatcgtaagtatatattgatcgacgtcggcaagaccttcagggagaccgtgcttaggtggttcgttgcccatcggattcccagagttgattctattattttaactcatgaacatgccgatgcagtccttggattggatgatgtacgtgctgtgcaggcttttagtccaacaaatgatattgatcccacacctatatacttgagtcagcattcaatggatagcatagcagagaagtttccttatttggttcagaaaaagcgtaaggaaggggcagaaatacgaagggtggctcaaattgactggaacattattgctgatgactgcaataaaccttttcttgcatcgggattaaaattcactcctttaccagttaattgccacaatctttgtcttcaatggttatgcatggagaggattacatctgtttgggctttctttttggtgagaaaaacagggtggcttatatatctgatgtttcccggtttcctgctagtacagagtatgtctgggtcacacaatgttcacctttgttttccacagactctagaaactgtgaagaggttgtgtcctaagcaaacactactaattggcatgactcatgagtttgatcaccataaagacaatgagtttttgatggagtggtccaaaaggttaaagcatgtgacaatgtataccgcatactgttga

SEQ ID NO: 106311 - DNA, 261 bp, Glycine max
  Peptide Sequence Number=SeqID_223089
atggctgttattgcttgtgtggtactttctatgcagcctaagcaaatccacgagattaaggatttccttctcactgccagaaggaaggatgcgaggtcagtgaagatcaagaggagcagagatgtggttaagttcaaggtcagatgctccaagtacctctacacactttgtgtgtttgacccagagaaagctgataaattgaagcaatctcttcctccagggtatacttttgattatatgtatgccaaatgccaatggtga

SEQ ID NO: 106312 - DNA, 828 bp, Glycine max
  Peptide Sequence Number=SeqID_223090
atggcatgttctgtgccttttaacaacaagaatttggatataagtttctttgttttcaagccaactattgtaatcatagatgaccttgttcatggactcaaacacttctccttaaccactgagagccttggttgtgttcaaagctctatatttaggagcatccatggaaatatgatcatatggtatggagcatggcagaggcggtcgagtaaggaaaaagaggagctgacctcaacccttagaaccctgttaggctatccactatccatactagacagaacatctaaaacggataccacagatattgtgccaatttttatagctgaaaaatcaatgttaagcaacatatcaagcatggctgtgttaattgaacacagtttccttgaagcatacggtggagaatcaagagatggctcttcaactgcaaaattctccactggggacataatatccttgaactcagcagtcaccactactaatgacctcaatgacctttgctacgcggtcctagccattttaaggtcacgctttgcaaaaatggaaggcataaccgctggcctttgcttcaagggacaaagcaaacccagagtggtgtgcattcatgtctggaagtctctccatttttgttactcttggattctcaactctgaccacagaaattggatgatgccatatcttgaacgcttctctatcaacatgaagtatgatattttccgagtagtctatgttaggggtgacaatgtggttgatcttaactgcatttctactcatcagatgttagaaaatgggaaagaaagtagtaggcaagggcaggttatgcagaactga

SEQ ID NO: 106313 - DNA, 2370 bp, Glycine max
  Peptide Sequence Number=SeqID_223091
atgccacttctcaggtttaatcactatctactgccaaaacttttagcctcccatttccatgctaacaacaatttctcctctattgctttgtcccttcattatgcaacaagttctgttttttctgcttcttattcaaccactaatctcagacatcaaactgagggtaaatacagcaactttgggaatttcaatgatgatttagggaaagtaggtcctggttttcaagaaagcttaagttttgctgcaagtgttagtgatggggcagaagaagaagaggggtctagtgatgatgatgagagtcttgagtttatcaattcctttcatggtagcaacgataaacagacacaaaatattgcaagcattgaaattgatgacagtgaatttagacaccctgtggtgagagaggtttgtaggttaatcacactcagctctgcttggaaccctaattttgaaggacgcttgaggcacttattgagaagcctcaaaccctcacttgtttgtgccgttttgcgctctcaggccgacgaacgtgttgctttgaactttttctattgggctgatcgtcaatggcgctacagtcatcacccccttgtctactatacattgttggatgtccttagcaagaccaaattgtgccaaggtgcaaggcgggttcttcggcttatgacacgccgcggaattgaattgtcacccgaagcttttggctgcgtgatggtgtcttatagccgtgcaggcaagctgaggaatgcgttgcgggttttgaccttgatgcagaaagctggggttgagcctaatttgtctatatgtaacaccactatctatgttttggtgaagggttgtaaactggaaaaggcgctgagattcttggaacgaatgcaggtgactggaatcaaaccggatattgtcacttacaacagcttgatcaagggttactgtgatttgaataggattgaagatgcgttggagcttattgcaggattgccatccaagggatgccctccagataaagttagttattatactgtgatgggtttcctctgtaaggagaaaaaaattgaacaagtgaagtgtttaatggagaaaatggttcaggatagtaacttaataccagatcaggttacatataatacgcttatccacatgctttcaaagcatggacatgcagatgatgctcttgctttcctaaaggaagcagaagacaagggtttccacattgacaaggttgggtatagtgcaatagttcactcattctgtcaaaaggggaggatggatgaggcaaagagtttagtgattgatatgtactcaagatcatgtaatcctgatgtagttacatatactgctattgttgatggattttgtcgcttggggaggatagatgaagcaaaaaagatgctgcagcagatgtacaaacatgggtgcaagccaaatacggtatcatatacagctttgttgaatggcctctgccacagtggaaaatcattagaggcaagagagatgataaatgtaagtgaggagcattggtggaccccaaatgccatcacttatggtgtcgtaatgcatgggttccgtagggagggaaaattgtctgaggcgtgtgatttgaccagggaaatggttgaaaagggctttttcccaactccagttgaaattaacctgctaatacagtctctctgtcaaaatcagaaagtagtagaagctaaaaaatatttagaggaatgtctgaataaggggtgtgccattaatgttgtaaacttcactactgtaattcatggtttttgtcagatcggtgacatggaagctgctctatctgtgctggaggacatgtacttaagcaacaaacatcctgatgctgtcacatatacggcattgtttgatgcattgggaaagaaaggtagattggatgaagcagctgagttgattgtaaagatgctcagcaaaggtttggatccaactcctgtaacattcaggtcagttatccaccgttattgtcaatggggtagagttgatgatatgttgaacttattggatagaatggtcaaaaggaagccatttagaaccatatacaatcatgttattgaaaagctttgtgattttgggaaccttgaggaggctgagaaactactggggaaggtattgagaacagcatcaaaacttgatgctaatacatgccatgttctgatggaaagctgtctgaaaaaaggggttgcactatcagcgtataaagtggcttgtcaaatgtttagacgtaatttaactcctgatttaaaattgtgcgagaaagtgaccaagaagctagttttagatggtaacttggtggaggctgataaacttatgttacgttttgttgagcgtggaatacaacaaaaatga

SEQ ID NO: 106314 - DNA, 756 bp, Glycine max
  Peptide Sequence Number=SeqID_223092
atgacggatcacttgaaatcagggctttacaaatggggtggtgatgcagaaagttatgagaaagagggtccctacattgagctggttacttctcccaataatcctgatggacacgtaagaagatctaaggtcaacagaagccagggatttttggtccatgaccttgcctattactggccacagtacactccaatatcagcacctgcagatcacgatcttacgcttttcactgtctcaaaaagcactggccatgcaggaatgcgcatagggtgggctcttgtgaaagaccaagaggtagcaaagaaaatgactaaattcatagagctcaatacaattggagtgtctaaggattcccaactcagggctgctaaggtcttaagggcagtttctgatagctgggaactaggaaactccaaagagagcgagtcattcttcaaattcagccacaaactcatggccaacaggtggaagcaattgagactagttgtggagagtagcgagttgttcagtttgcccaaattttctccagcattctgcaccttcttcaatcaggtcttggagcctcaaccagcttttgtatggttaaagtgtgaggggaacgtggaagactgcgaaagcttccttcgaggacacaacatcttaacgagaagtggaacacactttggggttagcccaaaatacgtaagaattagcatgttggatactgacgaaaattttaaccagtttctagatagactctctgccataatgtcgtga

SEQ ID NO: 106315 - DNA, 191 bp, Glycine max
  Peptide Sequence Number=SeqID_223093
attctggaatgctggcggagactgtagcacagcagctttttgaaagtagtcctgccgataatgtttacagtgttatgctttctaatatatatgctggtgatgggaggtgggatgatgtgaagaagttgagggataaaatgacaggaggtctgagaaaaatgcctggactaagctggattgaaggcagttag

SEQ ID NO: 106316 - DNA, 177 bp, Glycine max
  Peptide Sequence Number=SeqID_223094
atggtacctgttgatatgaggatagaacaccatttgacggtagatctccttattgatcacccagttcaggttgatgcagcaagatcgaaaaattctgtgaaggcaaagtggcatgattcgaaatgtgtttgccatccaactgtgttgcaattcatgggtgcagttgatatgttttga

SEQ ID NO: 106317 - DNA, 480 bp, Glycine max
  Peptide Sequence Number=SeqID_223095
atgaagcatagaactaatgaaatcaccatttcgtataccaaacgcaaagtatgtccaacagttattaaggaaaaagacatagatgttcgtttttatgatcgtataaaacttagctcggaacacatttgcgatgaactatttcaatggggtaatgtatgctttttcacgtttcaaaggaagcttccccaaagcaaaattcaaatgagcataatttttttattcctcaccggtcaccaacactgtatcaatagtgtactcgggatccattctctttcatatttcaaacagtatcaacagattgtatgtccagctgttaaaaatggcttacacgagattgaagatgagatttctacatcgaccacgattttgaggccccaaatttcacctgcctttcaagctcttataggaccaaaaacaatacaaaaaagacaagatattcaagcctgcagagtgtatctcaaggatgccattatgcaataa

SEQ ID NO: 106318 - DNA, 945 bp, Glycine max
  Peptide Sequence Number=SeqID_223096
atggcgttcgaagacaacacgcaccatctgtcggcatcggaaacacgacctgcaccaccccacatctctactaggcccatcgccggaatcaaagaccaacggataatctttttacccagtagtcaaagcaatcgcaactaccctttagttattgacgacagctcgcgggtgtttggcaaaaaccagcaagaagctatggctggacagcaagaaaccaaacatgggcaagggcagagtgtcgagtcttccacccttgtagcaggggcacaaatgtttcacaaaaagggtaataaggaaaagggggagaccagcggagcaacagagacccgtaagtcatcagcaagggtagcacgtgatgaggtagaggctaaagacagctttcgtccacgtgtcaatttcaaaaaccaagagggaagtgaagatataactgaagaagcaccaagggagcaggacctcgcagttactagtgggccaactaaaaggatgggccttttaaattacaccccaactgggaaagcatgtaatgtgggccttaatccaaaaaataacaaaataagagctgaaagcacttggcaggtgtattcaagacaaaggaggtgccaaaagaaatctcaaatgggtcattctttctccactacagtgacagaaatacatagaagcagcctaccacctcaactcccacagaacacagcacaacataggaccgcgtataatgctagccaggaccctatcattgcaacacctgtcaacagtggagatttagaagccaattctgattctgaaatccagcacattcaagaggcagctcatatatggagcacagctaaacaactgggggcttcaggaagagaggagcagaatatgatcattgaaaaaattaagcatatggaagaaagggacaagacagaagcggaaaggcggggagatagcagaaggaatcaatga

SEQ ID NO: 106319 - DNA, 495 bp, Glycine max
  Peptide Sequence Number=SeqID_223097
atggtccacgtcaatcctgcgaccgggaaggccgacggtccccacaagaagaaattaagaacatatttggggattgtcgctcatgataaggcaaaatttgatatcccggaagcttatgactgtaggacaaacaagaaagatgtgcgggaaaaggcacaggccatccagaagcaaaacaccgacccccatgtgttgtctcatgggggttatgaatatttagaacagaagctgatggctgagaagataaagaaaaaacttgaggaagctgctcagtctggaagcattgagggcgtcattgaccctccatctcccatcagacgacacgtgaagtggaagatgggacgacaccgagaaaattgggcagatgacgattctttggaggagcaggcgtcacagggttcatttgtcccctatggacgtcaggatctcctgactgctgccattgggcaaccagaacaccctggtcgtgtgcgtgctgagccagtgtcaccataa

SEQ ID NO: 106320 - DNA, 1178 bp, Glycine max
  Peptide Sequence Number=SeqID_223098
atgaccttggaggggattttcattgagcccacctcaaccactactgctcctgatctttctcttcacataagccccccaaccatctcttccttgaattccaattatgaaccccatgaaagtaatttcccttcaagaactactactgtgtctcaacaagcccacacagaactctctcttggaagaaatttcacttctgaaacaccaataccaacaccacacaacccttattatcaaagccaaaaccatttccatcatcttcaccaccaccaccacaacaacaacaacactagtactagtgttaatacaacaagtgttgttacaagtactaccagtactactcccttgaatcacataaactatggagtttcattgcttgatgtgtcatcatcagacaccttgaggccaatcaaggggattcctgtgtatcacaaccgttcattcccttttgtggcgaccatggaccatgctagagacaacttaaacaacaacaacaacaacaacaaggatcattaccatcaccacaagatgtgcttatataatcatcacaacatgccttcttatccctctctatcttcctccacagctactccttctccttcaccttactttgtggatcccatgtccctcttgaacaacggctccaccatggcggcgtgtagggctgccacggccacaaggtttaatgggttctccggcgatgctttcaaatctcatcatccattgcaccaatatggggtcggcccttcagaagcctcttctgggttcatgagatcaaggtttctgcagaagcttcccaacaagaggagcatgagagcccccagaatgaggtggacaagcaccctccatgcgagatttgttcatgcggttgaacttcttggtggccatgaaagagctactccaaaatcagttcttgagctcatggatgtgaaggatctaacactagctcatgtgaagagccatttgcagatgtatcgaactgttaagaccactgacaagcctgcggcatcttcaggccattcagatgggtctggagaggatgatttatctccgatggttagcaccgccgatcgtggtggtctccgacaatttcccaaccacagagggcggccggagtgggcggcacaacaagacatggactactcttccaccaccactactctatggagtaattcttcaag

SEQ ID NO: 106321 - DNA, 537 bp, Glycine max
  Peptide Sequence Number=SeqID_223099
atgggaggaagatgttctgaatgcctattttggttaataacagttagaatgaggattttgacagaagctttgtgggaaggtaaaatagaagctcacaatcagattgtgttaataaggtggctacatccaagaaaatcagtttcttcaagcaaggagagggcatatttcatttgtgagaggaaaatgccttcggtcaatcgtgctatttcaattcccaaaaacaaagctgttgtaaatttggtgaatcattgtcttgaaccgcgggagtgcgatctatgtggtcaagaagatcttctaggtgcagttggtgagttggatggagatggattttatgatttgaagcaggattttgtgatagggaatttggtggcggggaggaaaatcaagggatgggttggattcctttataccgtgtggctggtaactagaaagagccttggattggcaaagcaatctttgagtgtgactggctctgcaattactacttactctgctgcttggggcacccgcaaccttgcacacaaaaattcaatttag

SEQ ID NO: 106322 - DNA, 732 bp, Glycine max
  Peptide Sequence Number=SeqID_223100
atgaaaccaaactttgatcttgaagtggaggcatgtgcagaatatgaatctgaggttagcagccaggttgcttccaatgtatctattcaagaaacctctataggtccgtgtagtgatagcctcaccaacatttccaacatcacaaatccaatagggattcatcctaattctgatgctatttcacttgacttaagtctcaacttcaagaatagtgagccagggggaagagattcaataggattctcattctcaagcactagtgagagcagcaatgaacctgcctctcaaactacagcagcaaccattccacgagtcttctcttgcaattactgccagcgcaagtttttcagttctcaggctcttggtggacaccagaatgcacacaagagagaaaggacattagcaaaaagggccatgagaatggggtttttctctgaaaggtccttgggaataaaggcgcactcctcactgcaccatggtttcttaccaacaatgaggcctcctgagataaagagcaatgcaagatatgatcaagggtatcttggccacccgatattcttggaggatgacgagtcagatttgttgtggcctggtagttttcgtcaagttgccgaggcaggtgatagtcatcagaatttcatactgactggaagttctaatatgagttttactgaggtgaacccacctgtagacatagagaactcaacaccagatttgactttgaaactttga

SEQ ID NO: 106323 - DNA, 2886 bp, Glycine max
  Peptide Sequence Number=SeqID_223101
atgaaagctttagctttgttagccattattgtcttcaccctcttggtaagatctcaagaagaagaagattatgatgatgcttctgtaatgttggctctcaagaacagcctgaacccgccggggtggtccgacccggacccgtgcaagtgggcccgcgtgttatgctccgacgacaaacgggtcacccggatccaaatcgggcgcctcaacctccaaggcactctccccacaaccctccagaagctcacccacttagaacatttggagctccaatacaacaacatctcgggcccacttccctcccttaacggcttaaccagcctccgcgtcttcctggccagcaacaaccgcttctccgccgtccccgccgacttcttcgccggcatgtcgcagctccaggcggtggagattgacagcaacccgttcgagccgtgggagattcctcagagtctccgaaacgcttccgggcttcagaacttctccgccaactcggccaacgtcggaggcagcatcccggagttctttggctctgatgttttccccgggttgacccttttgcacttggctatgaacaaccttgagggaacgttgccgttgagcttctctgggtcgcagattcagtctctgtggttgaatggacagaagagtgttaacaagctaggtgggagtgttgaggttttgcagaacatgactttcttgaccgatgtttggttgcaatctaatgctttcactggacccttgcctgatttgtccgggttgaagagcttgcgagatttgagtttgagggataacaggtttactggtcctgttccggttgcttcatttgtgggtctcaagacgcttaaagttgtgaacttgactaataatttgtttcagggtccaatgccggtgtttggtgatggggttgtggtagataatgttaaggattccaatagtttttgcttgccgagtccgggtgattgtgatcctagggtggatgttcttctttctgttgtcggggttatggggtatcctccaaggtttgctgagagttggaagggaaatgatccctgtgcttattggattgggattacctgcagtaatgggtatataactgttgttaattttcagaaaatggaacttagtggcgtgatatcgcctgagtttgctaaacttaaatccttgcaaaggatagtgttagctgataacaatctcaccggttcgattccggaggagcttgctactttaccagcgcttactcaattgaatgttgccaataatcagctttatgggaaggtgccgagttttaggaaaaatgtagttgtgagtacaaatggcaacactgatatagggaaggataagagtagtttatcccctcagggtctggtgcctccaatggctcccaatgcgaagggagatagtggcggggtttctggaattggtggcaaaaagtcttcttctcatgtgggagtgattgtgttttccgtgattggggctgtgtttgtggtttcaatgattggtttcttggttttctgcttgtttaggatgaagcaaaagaagctgagcagggtccagagcccaaatgcgctagttattcatcctaggcattctggatcggataatgagagtgtgaagataacagttgccggttcaagtgtcagcgttggtgctgccagtgaaacgcgaaccgtgccaggcagtgaggctagtgatattcaaatggttgaagcaggaaatatggtcatttccatacaagttctgaagaatgtcactgacaatttcagtgagaagaatgttctgggacaaggaggttttggaacggtttatagaggtgaactccatgatggtacaagaattgcggtgaaaagaatggagtgtggggcaatagctgggaagggtgcggcagaattcaagtccgaaattgctgttttgactaaggttcgccaccggcatcttgtttcccttcttggttactgcttggatgggaatgagaagcttcttgtgtacgagtacatgcctcagggaacgttgagtaggcatctttttgactggccagaggaaggactagaaccactggagtggaatagaagattgacaattgccttagatgtggcaaggggtgttgagtacctccatggcttggcccatcaaagcttcatacatagggatttaaaaccttcaaacattctccttggagatgatatgagggcaaaggttgcagattttggtcttgtccgtcttgctccagaaggaaaagcctctatagaaacaagaattgcaggaacttttggatatttggcgccagagtatgcagttactggccgtgtgacaactaaagttgatgtgttcagctttggggtcatattgatggagctgataacaggaagaaaagcacttgatgaaacccaacccgaggatagcatgcaccttgtaacatggttccgcagaatgtccataaacaaggactcattccgcaaggccattgactccacaattgagctcaacgaggaaacgcttgctagtattcacacagtagcagagttagccggccactgcggtgcgagggagccatatcaaaggcctgacatgggtcatgctgtcaacgtgctttcttctcttgtggaactctggaaaccatctgatcagaattctgaagatatatatggaattgaccttgacatgtccctaccacaagcacttaagaagtggcaagcttacgaaggtagaagtcaaatggagtcatctgcttcctcttcgcttcttccaagcttggataacacacagacaagtatacctactcgcccttacggatttgctgattctttcacatcagcagatgttctccacacctcctccatgattaatttcacaccatctttagcacttgttgttaaggacttttgctga

SEQ ID NO: 106324 - DNA, 354 bp, Glycine max
  Peptide Sequence Number=SeqID_223102
atgtctttcgctctgatcgaagcctgcaagaagcgtaaacggttgccgaagtttttcaggttcaactcgttcggcgaccctggtgttgttccaattgcaccttcgggtccctttcgcgataacgttcgcgttttccttcaaaatgctggcgaactcgaaggttacactgtctccgggaaccccttatggtgcatccttctcatccacgacaactcaaacgctatggctcctctttacaccatcgaagaacacgtcgaccactcttcccaccccttctgcgatcactgccgctgcgtaggttcgtttccgatttcgccttgttgggttcggtttggtttggttgctgattcttga

SEQ ID NO: 106325 - DNA, 276 bp, Glycine max
  Peptide Sequence Number=SeqID_223103
atgcgccctttatcattcaggaacaacaagttgggtggtaaacgcgcagagacagattctgtgccctttatcattcaggaacaacaagctgagtgggtaaacacgcagagacagattctgcaccctttatcattcaggaacaacaagttgggtggtaaacgcgcagagacagattttgtgccctttatcattcaggaacaacaagctgagtgggtaaacgcgcagagacagattctgcgccctttatcattcaggaatagcaagctgagtgggtaa

SEQ ID NO: 106326 - DNA, 453 bp, Glycine max
  Peptide Sequence Number=SeqID_223104
atgacactagaggactactctaattccaccacaccacaatacttcaccagcatagcccgaccagatgggaatctattccacagactaccaagcgaagatccatacgcacatctggccacatacatcgagatctgcaacacagtaaagatagtgagagtacctgaagatgtcgtctgcctcaacttattttctttctctttggctggtgaagcaaaaagatggcttcactcattcaaggggaatagcctgcggacatgggacgaggtggtggagaagttcctaaagaaatacttcctggtgtccaagaccacaaaaggtaaggtggaaatctcatccttcctccaacaccctaatgaatcgttgagtaaagcacttgaccgcttccatggattactccgaaagactcccacacatgggtttagcgagccagttcagctcaacattaaaaaatga

SEQ ID NO: 106327 - DNA, 657 bp, Glycine max
  Peptide Sequence Number=SeqID_223105
atgacggtcaacaaaaagatgatccttctgttaagtatggtattgatgcaggaacttgggctgaatttgcaaaaagcccccaaatccctaactggtagaagaacaaatgcacatggaagctttgttctgcatggtcgtgatgacatattgaacactactattggtcggccaaagcatccaggtcgtgtacgtgtggcggggataggtgtgacaatcatccaatattttggacacgcatcatgtgactccaacacttcctctgcatcaatccatcaaaaaacattggctgaaatcatcggtaatctaaaggaaaagtggcggacaaaagtagaagatgaaaacaagaacctacaagaagcatggaggaagaaggtagaaaaggaaaacaaatgcagtttggagattattaaacaagagttgaaacaagcaataaaattagagttatcccaaattgcatcacaacactcacccccacttgaggcactggatatacaagtattagttgcacatatgagcaccaaggggagttgtgctgaagctgacacaaatccattagttagtgagccttctgatgtgcatatggatactatgagcttgtacgtagttggtgagcagcctactcaactagtggcattgggaaaattgtatgacaattag

SEQ ID NO: 106328 - DNA, 510 bp, Glycine max
  Peptide Sequence Number=SeqID_223106
atggcttactacaaagtcattgaagttatttgggagcttgattacagtgaatttagagtgcttgtgttcaagtgcttgtgggttaatggaaataccaaagtacgtcaagacaaaatgggatttactttggatgaccttcaaaaggttggttacaatgacgacccattcatcatggcatcacaagctagtcgggtgttttatgtccaagatccgtgcgactcaagagggtcagtgattctacaagggagaacaacttgtatcggtgaccgtattgatggttcaacacttgatgtcaacaagatgttgactttctctcaacaaatgcatttgataaatggggaagatgaggaggatgatcgcgagaaaaaacttcctattctccactataattggaatgatgtaccagaatctttaaagaacgtagtatgggatgacattttgggcaaacttgacatccttaaaggtgccaatgccaaaaagaagatgatgtcgacgatcgctactaaatag

SEQ ID NO: 106329 - DNA, 243 bp, Glycine max
  Peptide Sequence Number=SeqID_223107
atggggaaaggcaacattaagacaactatccccaagacaaaaaatgctaaagaatttatggacttagtggaagagcgctcccaaactactgataagtctcttgctcggacattaatgagtatattgatcagcatgaagtttgatggttcacgtactatgcatgagcatgttattgagatggcaaagattgcagcaaggcttaagaccttgagaatggttgtgaataagaacttttttgtataa

SEQ ID NO: 106330 - DNA, 351 bp, Glycine max
  Peptide Sequence Number=SeqID_223108
atggcaagcttggggggttccatgtttgtcttaacatttctctttgtctttgttggcttaatgtcttcttcatctgaagctgccataaagaaataccagtttgatattcaagtgacgaatgtgagtagactatgccatgcaaagcctattgtaacagtcaatgggaggttcctggggccaactgtatatgttagggaaggagagattttaagatgtagcaactcattagcatcatttcgttttctttggttttttcacaagaggaagtgtttgttgcttcgagagaaggtaagcggagccatggacgaattggaattgggttggccatggagtttggaatattggaaatga

SEQ ID NO: 106331 - DNA, 513 bp, Glycine max
  Peptide Sequence Number=SeqID_223109
atgacggaccattccatcagaaatccttccatttgcatatgtaaggtcttttgcggcgtcctcattagtaacttgtgtgatttgcagaaagtgctggaaaaggagactcaacttctcttggcccaaacagaattgaaaaacataaagaaacagctacaaagtgctgagaacacaaaatccaaaattcttttcgagcttgataaggccaaagtgacacttcaggaactgagaatgaagctcaacagtgctagggaatctaagcaatcagcaatagaagctgctgaagctatgaacaataaggccaaacaacttgaacaggcactatcccaaaaagctataggatatgaagcatggaaacaaaaactagagcatgaaagaaaggagtacacaacaacagtgaagaagaaagtagatgcttccaagcaacaactcaacaaaataaggcaatattttgacacacctttccaagcaagactagctgcattccaaaccctactagtagtaactaattaa

SEQ ID NO: 106332 - DNA, 234 bp, Glycine max
  Peptide Sequence Number=SeqID_223110
atggaagaaaagatgcatggagtacaggatctaaatcaaattgttgaggatcagaataacattctccaaacccaattcaatgaagcacatgaagatgatgcaaaagataaggagcttaaggttgctggtactgttgaagacgatgtaacatcagacaacaagcttgaggccactagctcaccatttgctaatgaacctaatgtcacccattcattggaaaatgatgctaagtga

SEQ ID NO: 106333 - DNA, 129 bp, Glycine max
  Peptide Sequence Number=SeqID_223111
atggataatgatggtgaatattggtgcaattacagtgcattcaagatcatggcacgaggcattctatcatgggaacgtgatcttaaaaaagcggaggaaatgggacatgatgcatgtataaaaagttga

SEQ ID NO: 106334 - DNA, 2214 bp, Glycine max
  Peptide Sequence Number=SeqID_223112
atggagtttgggtttttccgtggcctgcctgagaatctctttattctggacatcattggacaaatagcttttcttgtagatattgtcttgcaattttttgttgcttatagagatagtcagacctatcgtacggtctacaagagaacccctattgctctgcggtatctgaaatctaacttcatatttgatcttcttggatgtatgccctgggacatcatctacaaggcttgtggaagaaaagaggaagtgagataccttttgtggatcagactatatagggttcggaaagtcacagattttttccacaagttggagaaggacatacgtgtcaattacattattacccggattgtgaaactgatagtagttgaactctattgcacccatacagcagcctgcattttctactatttggctaccacactacctgaatcccaagaagggtacacatggataggaagtttaaaactaggtgactttagttattcacatttcagagaaattgatctttggaagcgctatacaacatctctgtacttcgctattgttacaatggctacagttggctatggagatatacatgcagtaaatatgagggagatggtattcataatggtgtatgtttcatttgatatgattcttggtgcctatttgattggtaacatgacagctttgatagtcaagggatcaaagactgaaaagtttagggacaagatgacagaccttatgaaatatatgaacagaaataggcttggaagggatatccgtgaacaaattaagggccatgtgcggttacagtatgagagtagctacactgaggcttctgtcattcaggatatccctatatctattcgagctaagatatcccaaacattatatttgccgtacattgaaaaggtttctctttttaagggatgctcttctgaattcatccgtcagattactttaacactgaaacatgaatattttcatgccattggtcctgctggtaaaccggaaatggttattaggctccatgaggagttctttcttccaggggaagttataatggaacaaggaaatgttgtggatcaactatattttgtctgccatggagtactggcatgggacaagctgagcgatgctgaattttcttacttatttgtattgtatcaccttaagaaagaggaagtaggcactgctgaagatgggactgaagaaactgtttcacttctgcagcctaacagttcattcggagaaatatctattctttgcaacattcctcaaccatatactgtccgtgtttgtgaactgagtagactcctgcgacttgataaacaatcatttacaaatatcctagacatatacttttatgatggaaggaaagtattaaacaaccttctagagggaaaagaatcttttcgagataagcagttggagtcagacatcacatttcatattggaaagcaagaagctgagcttgctttgaaggtcaataatgcagctttcaatggggatctgtatcagctaaaaggtttaattcgcgctggagctgatcccaacaagacagattatgatggaaggtcacctttgcatcttgcagcatctagaggatatgaagatatcacacttttccttattcaagaacgtgtagatgtcaatattaaagataacttcgggaacacacccttacttgaagcagttaagaatggacatgatcgggttgcttctttacttgttagagaaggggcctctatgaagattgaaaatgctgattatgattaccgaagtcctcttcacattgctgcagctgaaggtttatatttcatggcaaagttgctattagaaggaggagctagtgtttttaccaaagacagatggggaaatacgccgcttgatgaagctcggatgtgtggaaataagaacctgatcaagcttctggaagatgcaaaatctgctcaactgtcagaattcccatcccaagaatatacagacaaaatgcatccaaagaagtgcacagtgttcccttaccacccgtgggatccgaaagataatagaagacatggaattgtattatggattccacactccatacaagagctaatcaaatcagcggcagaacaaatagaattttctggcgatgcttgtattttatcagaagatgctggtaaagttactgatgtggacatgatcaaggatggtcagaagctgtatttagtccatgaaacacattag

SEQ ID NO: 106335 - DNA, 285 bp, Glycine max
  Peptide Sequence Number=SeqID_223113
atggaggttgagtcatccaagactaccattccaaagcccttggtcagaaggaagaaggcagatgaaacacaagaagctgcagccacttctgagaaatctcttgaggccacttctgagccttcagaaccagtggcagatacaacttcacctcaacaggcagcagaatcttccactcctgaggatcagactacaccagtcctttctctgaacacctctcctacagctatccctgtgctttacttaacagacgaggaggatgttcagacacaggatactcaggactaa

SEQ ID NO: 106336 - DNA, 385 bp, Glycine max
  Peptide Sequence Number=SeqID_223114
tcaaacccaagtagatgtaccctctacttgtaccacaaaggatgtaccctccaatgtgttaagacaaagatctcaggctgttacacctttgatactttgtgaatggggatacaaaagaattctcaggcgggagatgggagacacaaaagaattcaggcggttagtcccttgttcttttggaaaagagagaagagagacacaaaaagaattcagacagttagtccttggcgaattctttttggcaaagggagaagagaatgaaaagatgaataacacaagttttcaaggtttggaaaaccagaaaacttcagaaagcttttggtacaaagaagaagaagaagaacttcaaagagatttcaaggcttgtaaaggattgtttgaatga

SEQ ID NO: 106337 - DNA, 651 bp, Glycine max
  Peptide Sequence Number=SeqID_223115
cgtggtcagttctcgggcgacacgtcgcccagagatagatgtgtccgggatcgctgccaggcattcgcgcgtcacgtcatcgacaatgttgaggacgcggaatcgtctgccgcaggcgaactggtcgtggacgaaatccagcgaccagcgggcattggccttcgcttcaaccaggatcggtgcacgcgtgccaaccgcacgccgccgggctttgcgcttgcgaacggaaagaccttcctcgcgatagagccggtagatgcgattaacgccggacggctctccgtcccgccgaagcaggacgaacagtcgccggtatccgaaacgccgtcgctcattggcgaggtcgcgcagcttcgcccgcaattctacctccggcggtcggcaggaccgatatcgcaccatcttccgatctgcagatataatctggcaggcccgccgttccgaaagacccatgacggtcttcagatgcgtgacggcgtcgcgtttggcggcgggccctaccatttttttgcaagaagctcgcgaagtgcggctgcatccaacatctgttcggccagcagcttcttcagtctcgcgttctcgtcttcaagtgccttcagccgcttcgcctcggagacttccatgccgccgtatttggctttccaattataa

SEQ ID NO: 106338 - DNA, 677 bp, Glycine max
  Peptide Sequence Number=SeqID_223116
acgttgagggcaaaataacgcgactggaggcagaggagctgtggaagccgctgatcactcggttgcggaggccgattgaaagggtcattcgcgattccgaaacagacccatcgtcgctcagccagattgttctggtgggtggcgcatcgcgaatgccgctgctcaagaccatgacgacccgcctgttcgggcggtttccactgtcgcatcccaatcccgatcacgccattgccatcggaacggcagttcaatctgcgctccatgcacggcacgaagcgcttgacgagatcatcatgactgatgtgtgcccctatacgttgggtattgcgtcggttgagcaagcctacggcctaaacgagttgctgatgtcgcccattatcgaacagtccggcccattaaaggacggacgaatgaagaagcagagattcacggaagagcagattatcgcggtgctgaaggagcaggaggctggcgcgaaggtggccgacctctgccgcaagcacggaatttcagaagcaacgttttataattggaaagccaaatacggcggcatggaagtctccgaggcgaagcggctgaaggcacttgaagacgagaacgcgagactgaagaagctgctggccgaacagatgttggatgcagccgcacttcgcgagcttcttgcaaaaaaatggtag

SEQ ID NO: 106339 - DNA, 180 bp, Glycine max
  Peptide Sequence Number=SeqID_223117
atgactcgccttgatcgtacggtggagggtgtaactgatgaaacgtgccctagaatggaaatgcaaatctcacgcgcggaggggcgtgttggggaacgggagcgtgcgaagagggtggaagtggaggtgacgcgcgtagaagcgcgtggagaagtaggtgggagatggaaatggagttag

SEQ ID NO: 106340 - DNA, 1824 bp, Glycine max
  Peptide Sequence Number=SeqID_223118
atggggaaatcaccaggaaaatggatcaaaaccgtactatttgggaaaaagtcatccaaatcaaatatttcaaaaggaagagagaagattgtcaataaaaaagcagttgttgcttccaacgagttggaaaatggtttgtccttagatccaacccccaatgagattgctacaaaggaggaggaccttgaactggagaatgaagaatcagaaaatattttacctgagaatcaagaaagagacattaatggatctgttgatccggatgcaccacctgatccagagaaaatcaggcaggaggaagcagcaacaaaggcacaagctgctttcaggggttacttggcacgcagggcatttagggccctaaaaggcatcataaggttgcaagcacttattcgtgggcacttggttaggagacaagctgttgttacattatgctgcatgtatggaattgtaaagttacaagcacttgttcgtggaggaaggattagacagtctaatgttggatttgaaatccatgagaagtgcaatctatttaagcctctggatggaaaacttggtgagccagttggtatctccacaaaaatttcaaagctgtctgcaaatactttcatccgtaagcttgttgcttcatcaattacaataatggccctgcgcctgcaatatgttagtggagatccaaattcagtcttaagctggttggaacgctggtccgcatcttacttctggaaaccagttccccaacccaagaaaattcgagactctaaatctcatagaaagcatggtaatatttcaaatggagaagctcaaattaccaagtcaaaacgcactaccaggaagcttcctattgcaaattttgaaccagccctggtgcaaacaaatcctgaattcgagaaaccaaaacgtaatttcagaaaaataccacaccaagtgttggatccagagctagaaaatcctcaaagtgagcttgaaaaggttaaacgtagcttgagaaagattcataaccctgttgttgagaatgctgttcagccagaagttgaaattgagaccccaaaggagcatttggaaatagcaacagttattccaagtcacgctgtttcagaacaagcaatcattactcccgatgacaagatcgagcaagaagaaactttaaccatcttcaatgtgccagatgtcgaaatttctccaagaccatcagttaacatggaagtgtatgacattcctagcaattatcaagtgtctgtagaatcaaagcccttgtcagagactccaattaaagatagaaacacatctcacggaaaagttaaaaatgagctaggcaatctaccagagactattttcaaagatgaaaactccctattaacaaatggagatttgagctataatgatctgacaggtaatgaaaaccagaaacctacacgtaaagcctcaaatttgacgaagcaggagaatggagatgatggcttaaagaatagtccaaaattaccaagttatatggcagcaactgaatctgccaaggcaaagttgagggcacaagggtccccaaggtttggacaagatgaaactgagaaaaacaacactgctggttctgggagacattctctgccctcttcaactaacaagaagattagttcatattcacctaagacacagagatcagttccagcaggtggcaaggggggaaacaaaagtgacagaacagtaccatcttctaaggcagggaatgggaaacgctggttttcaggtattgaacacgaggaggctgaaaatcgtgtggggtcatctgtgatggaagttgttgaaatgataggaccattgtatgagctg

SEQ ID NO: 106341 - DNA, 2264 bp, Glycine max
  Peptide Sequence Number=SeqID_223119
aacaacattgtcctcaaggtgtaggagtcccggagctcgttccaatgttcccacgtggtgtcctcaggtgggagtccaaaccattgaaccagtgccaacttgggaccgcgatacaacttcagcaacgagacatggaagaccaggtggatcttgaaagaagtaggcaactggaggctgtaagccactggaccaatgagaatgagcacccaatcatcaatagagaattggacatcgcatcgatgaatgtctgcaaattgtttcatggaagcttggctttggcgagatgtcagatcagagtggaatctgagccactatgcgggactgttatagacaatagctctgaggtattgttcgagaatgcgattgaggacctccgcctggtcgtctgtttgcgagtgactacgagggaagtcgtgaagtttgcatacaatgtccatgaagagggtggctaccttgtgcgcagtgtaatgtgggggaatgacaccaaaatgaaccctttcgaaaatctatccaccaccaccaggatagtggtcaaaccgttcgacaacggtaggcctgaaataaaatgtagggataaacctcccagatcgaagatggtgtgggcaatggcgatgaagagttttagaaactcccatgtgaccaccaatgggtgtttgatgaaatttttccaacaaaagttaggtgaagggacagtttgccaggagcaaaatcttgtcattgaggaagatgagattatgaaaagcttggagttgttccatgaattcaaaattgggaagcgacagagaatacaactgactggagggaacccgggagagagcatcaacaatgatattggtggagccagacttgtattggattgtgtaatcatagcccatgagtttggcaaggtctttgagactctggtgatccgtaagaatcacaaaaggatgacccataaggtagtgtctcctcttgcgcactgtcgttgttatggtgtgaagaggattgctcccatggcaacgcttaaagcatcgaattccaaggtaaaaggaagtgaaaagtctggcgtagccaaaataggggtgccaatcatacattgtttcagagcttcaaaggtccgttgggcttccgaatgccatataaattggtccttccttagcaacaaggggttagccatgccattattgcctgaatcttgtctgcgtctggggccatgccgtcagtcgacacgatatgccccaggtttgacgttgactggggctgaattgggtacaagggtggtgacgacaaggggtatggatgacgaagctggggtgcagaagagccagttgtgtgtggagggtctgggtctgttcttggagcaactagaccccgaggacaatatcagcaccgtaaaggggaagctggaagaggtcaagggtgaattggtggccctgaacaacaatgtcaacttggggcatatagtgtcgcagggtcagaaatttagcaacgcgactttggatgaagttatgggtactttcgccatccatgagaatgctgacttggggaagaggtggtgtatcgtcagcacaagctggtggctccgtgttggggtggtcccagtccgagggtttatcgtcatcagcgatgaaaagatggaggcaaggcttgcagcggtgccttatgatccacttctcgtcacattggccgaaaatgaagcaactaaggaggaaagaaggggcaaggcccacgatcctgttcgcgagcaccctgagggtcatcataatatgaaagggcgaagtgtgattcatgctcttgaagcatggcaggccacgatggcccccctgatagtcgaagaactgacaaattttgaagatccagcccatgggatcctggccattgaagcgcggcacctcgagctttatggtgactgtaagggcggccaggcagtccgtgatggagttgagcctaacttccatggtggcatggttttggcgtgttacagcctcctcgaggcagtcaatagttgcctgacgagtattgtgttcaagcatggtgtgaagggtgcctctggcaggagaaattgtcaatcattggccagcatagagtataacagaacgataagagaatggcagctacacgaaatcactgaggtattggggcctcatgcatgttctcttgggcctggtattgtctgtgttgctagttggattactatcatttgcatcattggactaaacaaatggatgaaaacgtgcctcgttcatcaggggaggcttctcagatttgaagcaacgataatgtga

SEQ ID NO: 106342 - DNA, 2904 bp, Glycine max
  Peptide Sequence Number=SeqID_223120
atggcaaccactctcaccggcatctcgctggtggcgctgcaattcaaggccttgctgaagaaaaatctcttgctgtcatggcggaacaagagagccagcctcttacagttactctcccctctcatattcattttcctcatcttcgcaatcgacaaggccatcaaggcacagacctcgacctcctcctcctacaagagcgtcactgaccctcccatggaaccttctccccccatcactccctgcgaggacaagttcttcatcaaactcccctgctacgacttcgtctggagcggccacgccagccccacgttccagaccatcgtcgcccgcatcatgaacaacaaccccggccgccccatccctccctccaaggtgaagtcttttaaggaaaagagtgaagtggatgcgtggcttctcagcaaccctatgcggtgccctggagcgcttcatttttcggagaggaacgacaccgttataagctacggtcttcagaccaattccaccagtcttcagcggcgagggaagtacgaggatcccacggcttcgtttcagctccctcttcagcttgctgccgagagggaaattgccagataccttattggagatgcggatttcagttggaatgtgtttctgagggaattcgcgcacccttccatgaatcctttctctgctgtggcttcaattggtcctgcatttttcctcgcgatcgccatgtttaattttgttcttcagattagctctttggtgacggagaaagagcttaaacttcgccaggcaatgaatatgatggggctttacgactttgcttactggttttcctggctcatctgggaggcagttgtcacaatcctatcgtccctcctcatagttctctttggaatgatgttccagtttcgctttttcttggataacagttttgtggttctgttcgttctgttcttcctgtttgaacttaatatgactggcttggccttcatgatatctgctttcattcggaaatcatcttcggcaacaacagtggggttctctatatttattgtcggctttgtgactcagcttgtggtacaacaaggatttccttacacagatagcttctccaaaactatacgaaacgtgtggtcgttattccctcccaatctttttgctcaaggtataaaagtgctttcagatgcagttgcaacttctgaagacaaaggcattagctggagtaaacggggagaatgtgctcttaatgattcagactgtgtgataactattgatgacatttataaatggcttgcggctactttctttctctggtttgttctggccatttactttgacaatataatcccaaatgcatcaggtgtgaggaaatcaatattgtactttctaaatcccagttattggatgggaaaaggaggtcaaaaagtgaaagagggtggggtttgtagctgtataggttcagccccacgtcaagaacaaagtacaccagatgatgaggatgtccttgaagaagaaaacaaagtgaaacagcaactaacagaaggtcttcttgatgcaaatgttgctgttcagatacgtggccttgcaaagacatatcctggcacacgtagcattggttgctgctttaaatgtaaaagaacttcaccttacaatgcagttaagggtttgtgggtgaactttgcaaaggatcagttattttgtcttctaggacccaatggagctggaaaaactacagctattaattgcttgacaggggtaactccagtaactgatggagatgcgttgatttatgggcattcaatcagaagttctactggcatgtcaaacattcgaaagcttataggagtctgtccacagtttgatatcctatgggatgcactgtctggtcaggaacacctccaactctttgctactattaaaggcctgtccccagcttccataaaatcaattacccagacttcattagcagaggtaagactcacggatgcagccaaagtgagagctggaagttacagcggaggaatgaaacgccgtctcagtgttgcaattgcccttattggtgaccctaagttagtcattctggatgaaccgactactggtatggatccaataacaagaaggcatgtgtgggacataattgaaaatgcaaagagagggcgtgccattgttcttacaacgcactctatggaagaagctgacattctaagtgaccgtataggaatcatggcaaaaggaagtcttcgctgcattggcacctcaatcagattgaagtcccgctttggtactggttttattgctaatatcagcttcaatggaaacaatatcgaacatagtcctgccaatggagatgcaatatctacagaacgtcgtgaggcagtgaagaaattctttaagaatcatttagatgtagtgccaaaagaggagaaccataacttcctaacttttgtgattcctcatgacagagaggcgctcatgacgaatttcttttcagagctccaagatagagaagaagaatttggcatatctgatatccagcttggtctaacaacgctcgaagaagttttcttgaatattgctagacaagcagagctagaaagtgctgcagctgaagggagactagtgaccctgaccttaacatctggggaatctgtgcagattcctataggagctaggtttgtgggaattccaggaacagagtctgctgaaaaccctactgggtttatggtagaagtatactgggaacaagatgatactggtgccttatgcattgctggccactcacagaaggttcctattcctaatggcgttcaactatcttcttctccatctgtaagacaccgtagatatttaggccggtcaggaacagttcatggggttgtgattgatccaagtcaagttagttcagtagcttttcagtga

SEQ ID NO: 106343 - DNA, 319 bp, Glycine max
  Peptide Sequence Number=SeqID_223121
gaacccattattgctccaagaagttgttgcattgttggattctgaggaactgaagtttaagcttgtggaaagaggagcagcagaagatgatgaggatggattattattggaagttaggtcaagagtgatggtggggtgtgaaggtgaagatgagagtgctgcaggatgggacagatctgcggtggtcatggctgtggaaggccttgttccggagtgtgaggttgatgagccggataatagcatggatgcagctgctgaagtggtggaggccatggctgtggctgagagtggaagagggtggttgtggttgccttcgtag

SEQ ID NO: 106344 - DNA, 864 bp, Glycine max
  Peptide Sequence Number=SeqID_223122
atggagtttggttcagaaagatctggtcatgaagtcaaggatgagaagagaagtgaatctagtgttggagatgaagaagatcgtcgtgaacaagagattgttacgcaggagccacccctgtctactaccgaaagatccacagtggaggctgggccaaatgcttcttccctaaccaaaaaggaagaggctgttgatgaacttgaagttgccaaagccgaaatgggtgaagtgatggaagaaaaccaacgactaaagacgtgtttgaaccgaatactgaacgattaccgcgcactccaaatgcaattccacaacatagttgaacaagagacaaaagattcttctgatcagaaagtgaacaacaacaatgaccaatatcaaatagatgaatcaaacctagtttccctcagtcttggaagacttccaacaagaaacaataataaagtccctaataataaaccattgaaagaggaagcagaaaaagaagataaagaaggcttgtcccttggattagactgcaaatttgaaacatcaaaatctggaataagcacaactgaatatttgccaattcatcaaagccctaataatagtgttgaagaagtgccaaaggaagaagcagctggtgagagttggcaacctggcaagggaataaagacagctagagatgctacaggagaggatgaagtttctcaacaaaatccagcaaagaaagcaaggatgaacgatggatgtcaatggaggaaatatggacagaagatttcaaagggaaatccttgccctcgagcttactatcgttgcacggttgcaccatcatgcccagtaagaaagcagatgtgtagaagtagtataaagacggcatatgcataa

SEQ ID NO: 106345 - DNA, 2184 bp, Glycine max
  Peptide Sequence Number=SeqID_223123
accacaagcacaggatgtgtttcagctggagatgacaacatcatagtcaacccccaatttgatgatggcctgaaaaactggtctggaagaagctgcaagattatgttgcatgattccatgaatgatgggaaaattgttccaaagtccgggaaattcttcgcatctgcaacagaacgcacacaaagctggaatggaattcagcaagagatcactggacgcgtgcagcgcaagctggcctatgaggtcactgctttagttagaatatttggaaacaatgtctctaccgctgatgtacgggctactttgtgggtccaaacgccagatcttcgagagcagtatataggcattgcaaagttagcaacagataaagattggataacaatgcagggaaaattccttctgaatggttctccatcgaaagtggtcctttatttagagggtccccctccaggcactgacattcttctcaataatttggtcttaaagcatgcggctaatacacctccttcaaccccaccagatgtaaagaatgttgcttttggggttaatataattgagaacagcaatctggctgatagcacaaatggatggtttccccttggcaattgtactttaagtgttaaaactggttcaccacatataattccaccaatggcacgagattctcttggtcctcatgagctcctaagcgggcgctacatccttgtaactaatcgaatgcaaacatggatgggtcctgctcagaccatcactgataaagtgaaactctttgtgacttatcaagtgtctgcttgggtccggattggctcagcaggatcatcagggcctcagaatgtgaatgttgcccttggtgttgacaatcagtgggtcaatggaggacaaactcaggtttcggatgacatgtggcatgaaattggagggtcctttagaattgaaaagcagccatcaaaggttatggtttatgtgcaaggtcctgcttctggtgtggacttaatggttgctggacttcaaatttttcctgtggatagacacacaagatttagatatttaaagatccaaactgataagattcgtaaacgtgatgttatcctgaaattctctggactggactctggcagctatgctaacacctcggtaaaagttatacaaacacataatgatttcccaattggaacatgcatcagcagaacgaacattgacaacgaggactttgttaacttcattgtgaagcattttaactgggctgtgtttggaaatgagttgaagtggtattggacggagccacagcaaggcaatttcaattacaaggatgctgatgatatgttaagcttgtgtcagaagcacaagatacaaactcgcggccattgtatcttctgggaagtggacgaaaccgttcagcagtggatcaagtcactgaacaaaaacgatctgatgacggctgtccaaaaccgcctaaacggcctgctgactcgctacaagggcaagttcagtcactatgatgtcaacaacgaaatgctgcacggttcattttaccaagataggctaggcaaggatataagggcaaacatgttcaagactgcaagccaactagacccttctgccacactctttgtgaatgattatcatgttgaagatggatgcgacaccagatcatgtccagataagtacatccatcacattcttgatttgcaagagcaaggtgctccggttgggggaattggaattcaaggccacatagactgtccaatagggcctattgttagttcttccctggacaagttgggtattcttggcctacctatatggttcaccgagcttgacgtgtcttccgtcaacgaatacgttagagcagacgatctcgaagttatgctacgcgaagccatggctcatcctacggtggaaggcttaatgctgtggggattttgggagctgtttatgagtagggaccattcacatttggtcaatgcagaaggtgacatcaatgaggctgggaaaaggttcttagctctaaaacaagagtggctctctcacagccgtggccatgttgatgaacaaggccaatacaacttcagaggctttcatggaacatacaatgtgcaagttgtgacaccgtcaaagaaaatttcaaagacatttgtgcttgacaaaggtgactctccactagtggtatccattgatttataa

SEQ ID NO: 106346 - DNA, 396 bp, Glycine max
  Peptide Sequence Number=SeqID_223124
atggcggatttaggtggcggatttgcgaaaaaacgccaccgaatagcggtggcgtggcgggtttgggatggcggccgccatagccatggcggtcgtggcggttatggcggggtggcgaaaaatggcgggatttgcttggtttttgtctgcgctgtgattcaaaacagctctgcgtccctccctcaccccgccgcacccagccgctgccgcgacagacgacacccgcacagtccgcgcacccaaccgccgccgcccgcgacacccttacacgaagacgaaggccaacttcgcgcgagccccggcaacgcagcctcccgcgaccgcgacacctcttctttctgtctcgtgaagaagacgaagaagacgaagacgcagacgcgggtcagccagccttga

SEQ ID NO: 106347 - DNA, 651 bp, Glycine max
  Peptide Sequence Number=SeqID_223125
atgcaaaatcttcttgattggaatgaagcatgtgaagctacatatcagaggtattgggcattagtcatagggactcccaaggagaaggaaggcataattcatgctcctctttctaaggtgcttctaaatgatgggaagactgagaggataatactagctcaccattcaagtgtagaacctcgccaagaggctgtaactgagtatagggtgcttggtccacagataaatggatgctcgtgggttgagctgcgtccacttacttaccgaaagcatcagttgcgtgtccattgtgctgaagcacttggcacaccgatagtgggtgactataagtatggctggtttgtgcacagccgatggaaacaaatgccgcgagtggatatcgagccaaccaccggaaaaccatacaagttgcggaggccggaaggcctagatgttcagaagggaagtgttttatcaaaggttcctctattgcatcttcactgcagagaacttgtactccccaacattgttaagtttatgcatgttttgaacaatagttcagaagaactacgtacttcacttagagagcagcctgatgttcttcgctttgtggcaacaatgccttcacatatgagaattagttggaatcttatgtcatcgtatttagtctga

SEQ ID NO: 106348 - DNA, 369 bp, Glycine max
  Peptide Sequence Number=SeqID_223126
atggcaggaaacatttctggtccaagtgggagcaagggtgctaatattttacttaatcatgacttctctagtgggctgacctcttggcatctcaatagctgcactggctatgtaatttcatccaaatcaggtactcaaggaggaatcccaatggatttggatgctaattatgctgttatcaccgaccgaaaagaatgctggcaaggtcttgagcaagacatcaccaacaaaatttccattggttccacttacacggtttcggcttgtgtgggagtttccggggtttctcagggatctagtgatgttctagctactctgaaactagaacatcatgattcagctactcgttacttattcattggaaggtag

SEQ ID NO: 106349 - DNA, 819 bp, Glycine max
  Peptide Sequence Number=SeqID_223127
atgggaggggctagagctagtccatttgcaagttctttgccctatgggtttttggctggcccaaataggctatggctgagagggggtgggttggctcatttgacagctctagctatgaaatccttcatgcactactctagaattcaacccccaaggccggtttctgttgaaccagtaatcagtgtttctaacaatattgcccgcctggatgctcccaaagaaggtcctaaacccagacagctactatcattgccaccttttcctggtcaccccttgcccgacaagagctcaattagtggttctcgacagcgtgattatgttactgctgtcaattggattaagtattacttcaagggcacatggggttctgtcattgaatcccatttcagggagggtcttgtgcaaatggaggctgatgactcttccactcagaaagaagagcagatgaaacctatgcgaaagattagaccaaatgaagtgatgaaacgtggtgccagagttcatgtgcctgtgtcaatttgtgagactaggatttccaaaagatacgatgctattccaagtggaacactatatccaaatgccgacgaaattaagtatctgcagaggctggactcagctattattgtgctaaataaacctccaaaattgccggttaaggggagtttgccagttcataatagcatggatgctttggcagctgcggcactatcctatgattatgatgagggtcctaaactggagcagatttatttgcggcatagtccaatcactgtaaccaagacagtggagataccctacacttccaaaaaagagatataa

SEQ ID NO: 106350 - DNA, 882 bp, Glycine max
  Peptide Sequence Number=SeqID_223128
atgggaagagctccttgttgtgacaaagccaacgttaagagaggaccatggtctccagaagaagatgcaacactcaaaaattatgtagagactcatggcactggtggaaattggattgcattgcccaaaaaagctggccagacatcaaacatggaggctttactgaagaagaggacaacatcatttgcaccctctatgctcagatgggaagcaggcatatggtctgccatagcctctaaacttcctggtagaaccgacaatgatgtgaaaaactactggaacacgaaactgaagaagaagatcatggctagaaaagttaccctcaaaacattgactcacaatgacactcttccttcaacttcaactccatcatcactaaccaacaaccaaaatgtcaagactagtcaaaattcacctttcccttcacaaaatcaaaattccccaccctcagtgctgccagtcttagatgctaataatgcattattcatcactaataatgaaaaaagcattattagttttgaccaaactcatcatgggttgtatagtccacaagtcatggatgatgttgtgtcacaaattggtgcaagttcaaggattattaacaataataataataataatcctatgctgtcattgtctcaagaaggttcaagcagcatttcggattcctcttcaattgcaatgaacaacaacaatgtgtcacatccagaacaacagcatgctagtgatgaatctatggaaatgttgatggattttggctttggatttccctttgattttgccaatggtcctaactgccattatgagagagttggtgaatttgctacaagttcctatccagagtgggttgattttagctatgctgacattaagccacattga

SEQ ID NO: 106351 - DNA, 504 bp, Glycine max
  Peptide Sequence Number=SeqID_223129
atggtaaccaaagaataccagaatttgaagtaccaacaaccttatcagcaggctatgtactattgctctttgattttacaagatcaaacctggccttggatagaacagctagacatacttcctgctcttcaagttgaagatcttgctaaatttgtaccagcaatgctctccaggacctttttagagttttatatagcagggaacattgaaagccatgaagcacagtcaattgttaagcacatagaagatgttctctttaatttttcaaaacctctgtgcaagcctttattctcatctcaacatttggaaaatcgggttgttaaacttgaaagtggcatgaattacttctacccttcagaatgtcttaatcctgaagatgagaattctgctcttgtgcactatatacagatatgtgtggctccccagactggtatgcatcaatccatcaaaatatcattttggactggaaaagctaattgctacattatgcctgtttctacataa

SEQ ID NO: 106352 - DNA, 111 bp, Glycine max
  Peptide Sequence Number=SeqID_223130
cgcactcctaataagctgtaacgtaaaacgtgataaggaggcagcgggtagcggcaaaggcgtaaaagtaaaagcgattaaccatcattacgcgaagccgacaacggagca

SEQ ID NO: 106353 - DNA, 1089 bp, Glycine max
  Peptide Sequence Number=SeqID_223131
atggaagaacccgtcatggaacaacaaccctccgctgctgcttcctctgggaacaccaccagactcaggcttcagaagtatgcgctccgatctgtcaataaatcgaaggaagacaagtcagaaactcccaattgctccaatcctacttctgaaaccaagagggggagaagtgtaggtgcttcaagtgtaagtaaaagtgtgagtgttcttgatttttctggcaaggacaagtctggtagtgccaagccaccaagaaggctctcaattcctgccaaaacaccagccacttcaagacccaagctgggtggcaacattatcccaatcactgagactacaactgggaggaatgcttttggtcaaggcagaagcaaaacaccaatttctgacatttccaagacatctacccgaaccaagttaaatctcctaacttcggcttcgtattggttaaaccagatcaaactctctgaatccgccgccaagcactcaatttcgcttggtttcttcaaactagctttggaggcaggatgtgagcctctcgggccaatgcaagaagggctaaaatcatatgtggggagatatcagcttgatggccttgaagaaactgtgatagcattgtttgagagctataacatctcagaaagcatggagcagttgcaggtgtctgagacaatttcacatgtgccagaagagggtactcgctcttctgatgatgatgtgcatagctcttcttctaccgtggggactagaaaattgaaaccaaagtgcttaaacactgattctgctcaactcacaccttcaacagagtcaacaaagaaggagacaagtcaaaagagtaatcctggatccaggttgagagggaatctcagcacaaacactacaactccagggcctgctctagacaacaggaataataggttggttaaaaaatctgagaagccaagcaagcaagaaccaaataaggaaaagggcatgtctaacaattacatgattttttttctgctcacagttactgctagcactccaaagggagacaaagaaaatatggaaactccgaccactgaagagaacagtgtgacagaagtggtgtaa

SEQ ID NO: 106354 - DNA, 145 bp, Glycine max
  Peptide Sequence Number=SeqID_223132
atgaagaaaagtacgagctttgaggatgatgtcatcaatgatgctttagccttttttattcaagatcaaggagaagcattcaaatatgagtgtgcatggcatgaagtgaggaaccaggctaaatggcttgcaatgtacggtgaag

SEQ ID NO: 106355 - DNA, 419 bp, Glycine max
  Peptide Sequence Number=SeqID_223133
aagcattaggtgtggcaaagccttcagtagttagttaccttagccaggagatactagcagagcaaaaagctgatagagtgcatagaatacctgcgcagcctctggtcaagttcaacaatatggtggttatatcactgtctatgaaacttaaggaagagcactgctctattggtttttcgaggccactcacaaaccagaacaaaaacccgttctcttatggctcaatggagaatcacaaaccagaaggtcaggaagcagtggctggattaactcagcctaacaatgcaaagcctattgctgattccagtttttccaaggctaaaccagaagattctatggactctcaattcaaaccgccagaagcttcacaacttgtttttgtcttcactattttattcatgtttggttgctcaaattaa

SEQ ID NO: 106356 - DNA, 216 bp, Glycine max
  Peptide Sequence Number=SeqID_223134
atgggtgttttaaagaggttagaaggtcagaagttgagggaattgagagaagagagaaagaacaagaagaaagaagaggaaatgaagccgaggtgctaccgaattgcgaccgcaatcattccttatgtcattttctggttctgcattcttcgtgcgaccgtcggggtcccccttgttattatgtgcacattaatcttctccatctatcatcggtga

SEQ ID NO: 106357 - DNA, 432 bp, Glycine max
  Peptide Sequence Number=SeqID_223135
atgacggtagctacactttttggcaagctaagggagtatgagtttgagcttgggagactaaaggatgaagaagaagttgagaagatgaagaagggattaatcttaaagacaagcacttcacaccataaagctagtgataaagacctttcaaaaaattcagatagtgaaaatctaaattttcttcaaggtcatataaaagcaaattgtccaacctaccttaagaaacaacaaggaggtaataagaagcaaaagaagccatttaagaggagaaggacatatataggttggggtgatgatggtgcaagttcctctagtgattcaagtgaggaggaagaagcaaatctatgtctcatggctgatattgataaggatgagaccaaaagcaacataagtgaatatttgaatctaatacaaactatgacaatctactag

SEQ ID NO: 106358 - DNA, 378 bp, Glycine max
  Peptide Sequence Number=SeqID_223136
atgacgaaattaagggtgacaatcacgaaaacattgtatcaagcaagtgatgagcataaggaaagcatggggtgtttgaccctcgacaaattgtttgttatgtctggtggccttgcattgaggaagtggatgatggacagagatacactggggtatagtgggcggagaggcctcactttgccaatcctaatgggcttcgagactatgctttttgagttgggagacgaggggttggtgtacaatgtatctgttatagagaaccaaggtgaccattcatacatgttgtccaaggagatggaggagtaccaagaactactaaagcaattggaactgacgtctgaggaggagagtgacgattcttccgaggacacgtcttag

SEQ ID NO: 106359 - DNA, 471 bp, Glycine max
  Peptide Sequence Number=SeqID_223137
atgtgtcacacgtttccactatcactaaagtccattgtattgaaatggtttcagtctttgccaccaagatccatcgacttgtggcttgatttgagggagaaatttagacctgcctttgcaaccaacaaagaaaggctgaaaatgaagactgatatatacggtagggactcaaagagtcatcgagagaatacattcattgttcaacaaggaagcaagagctacagatacttgcgagatcgaggaggtaactatagaactcgatatgatcggtcaaactatgatgagcaaaaggagagaactagaagtgtcgatcgataccaaagaagagaaagctacagggaatgttctctaaggtacaagcataaaaatctagcaagggagacggaaaatcatgtgcaaacaatacatcagggcaactccaacacaagggataaattggaatcttccgagacaaggaataactctccttag

SEQ ID NO: 106360 - DNA, 291 bp, Glycine max
  Peptide Sequence Number=SeqID_223138
atgacaggtttatcattattgtctttgaccattggcagttggtattgtgttgttggaggtatactagaagttgtatctaatccttggaggtttatactagtaaagtggttttgtgacgtagatctagttagtcctattgggattgatcgggttcttatcgaaaaagaccttcttgttgatttgtattcggatcttgaggcttctattcttgatgaaaaagagtttctcctactaaagatgtcgtaccggatgtcacgacatcacgcttcagaacatgcagattatatttga

SEQ ID NO: 106361 - DNA, 195 bp, Glycine max
  Peptide Sequence Number=SeqID_223139
atgagcttggttcaaccctataatccagggaatggcaattttgatcaacaacatttcatagggatgaaagactcgggaatacgcatactatgcatggaggatgtaattatgaaattgagatgcccaaagaaacatcttttcttagttgacgatgcattagaggaaaatgcaaggatcacgcatgagcaaacatga

SEQ ID NO: 106362 - DNA, 252 bp, Glycine max
  Peptide Sequence Number=SeqID_223140
atgaggatcaagaggtcttttaaggttgtaatggggccatggacaaggcttgtagtgagcttcaaaacaaggaaagggaaacaaggctcaaaaaggctatcaaacgaattaattcaaggtaagtccatttggctagaagcttatgagaacaaaattgcctcaatcatttccaaatatgcatgtgaattaggaagcatcaacaagaatcaagccaaggctattgtgcaagcaatcaatgagctttcaaattga

SEQ ID NO: 106363 - DNA, 324 bp, Glycine max
  Peptide Sequence Number=SeqID_223141
atgactaaagcacgtcaaaaagggggtacggaaaagcgaagaacgaacgaagaacggttgaaaatcttcgtgaaatcactcacggaaacgtctcggaagcgttacagaagcgcctcggcttggattttcttcacggaaacaatttttctcactaattttaagaaaaagaaggagaagcttgccaccccagctcgcccaggcgagctaggttgcttcctccagaacttcccgccttctggagaacttcctggaaggcccaagtgggcctggttgctatttgcaccccctgtttacgaaatacacccccttgcctatttttgttga

SEQ ID NO: 106364 - DNA, 142 bp, Glycine max
  Peptide Sequence Number=SeqID_223142
atccagattgacaagcttctcgatggccaaggtcactaaggagacgatggcggaaacccacaacacaacagcctcggaaccaccaacgccggtggtggagaatgacgccgtccgttctggcctccgcaaagaacggcgatag

SEQ ID NO: 106365 - DNA, 1254 bp, Glycine max
  Peptide Sequence Number=SeqID_223143
atggctacatctgttaataagattggacactggaagcgaaaagagttgtgtagaattggtcatgatgtgcttgctgctgatccaaatgcacattctgttctgttttgtgaaaaggatgtttcagatgctcagtggaggaatttgcgaggaaatatacctgttcttactcttgtctttgcaattttcactctgctggccaatttcatgagggccttcaatttaagagtgaagggaatgtccattgtctggcttttattttctttggcctacttatcatatcttcatggagcatgcattgtatttatcctgtcaatagctactggtaattttcttcttgttaagttatcatgcaacagtgggcatttttggacaattaccggggcagctttaggtggcacatatgtttcaactttgatgtttgtgacagttgttttgcgcatgataagctttggattcgattttcactggagtaatcaaaattctcattttgatcaggagaagcattatcagcattgtcatatttgtaaatccggaaaatcttgctatcaagttttacaggagagaagtctacataatgacaactttggatatatcacatacctttgttatttggtatatgcaccactttatattgcgggtccaatactgaacttcaatgcctttgcctcacagatagatgttcctcaaaacactaattcagttagaaatgtgacactcaatggtttccgctgggtattaaacttcatgtggctaaaatttttactgatctggcgctttttccgtttctggtcactgataaacggaattgaggctccagagaatatgccaaaatgtattaataattgtcacaacttggaaggcttttggaaaaactggcatgcttccttcaacaagtggcttgtgaggtatatatacattcctcttgggggatctaagaaaaagctactaaatgtgtgggttgttttcacatttgttgcaatctggcatgatttagagtggaaacttctttcatgggcatggttgacgtgtttattcttcatccctgagttggttttaaaatcagcagcaaaagcatttcaggctcagagttcttttggagaatgcatatttcgtgaactcagtgctgttgctggtgcagtgacaattacttgtctcatggggtcagtttatgatgcaacaagtaatcctgttgaaccaattgatccagtgcgaggccttttatacaacaagtttgatgttcaattttacacataa

SEQ ID NO: 106366 - DNA, 315 bp, Glycine max
  Peptide Sequence Number=SeqID_223144
atggagtattacaaaatccaggtagtggccatagtgtctttgatgcttgtgcttccaaacacacaagggtggggagaagatggccatgccataattagtaggattgctcaggtcaccaattactttcattctctctatgaagtgttgtgttgtgcttccaaattcatcgattcagcggtggatgctgtgaaaaacctgcttccagaatatgcacagaacgacttagggaatgtgtgctcatgggctgatcgtgtcaggttttatttgcactggtctggtccattgcactttgctgatacacctggcaacctttga

SEQ ID NO: 106367 - DNA, 726 bp, Glycine max
  Peptide Sequence Number=SeqID_223145
atgggtaaacatgacattgaggcagggttaccccatgcacaaggcgacgcgctctatccatatatgatagagtcacctcagctacgttggggattcatacgcaaagtttatgccattatttctttgcagctgcttttcacagctgcattcgcatccttcttcatcttcttcacacccgcaaggaatttcgctaggtacaatcaatatcgcatctgggtattctttggagccgccattttctctatcatacttttgtttgtgttgagcaaattttacaagaaacacccggtgaatctctttcttcttggtctctataccctctgcatgtccgttacagttggattcgcttgttcttttgtcgatgcaaagatcgtcctagaggctgcgtttcttacaggtgtggtgactgccagcttgacgatctacacattttgggccgttaaaagaggcagtgatttcagtttcctaggcccattcctctttgcttccattatggtcatgttattattcgcactcattcaagtgttttaccctctaggaccaatcgggcgtatgatgattgcttgcattggtgcaatagtaatgtgtggtttcatcgtatatgacactgatgacctaatcaaaagatacacctacgacgactacatttgggctgctatttccatctatggcgatgttatcagcctcttcatctatctgcttacaattttgaatgaacttttttaa

SEQ ID NO: 106368 - DNA, 213 bp, Glycine max
  Peptide Sequence Number=SeqID_223146
atggaggaagaggaagatgtccatcatttgttctatgcgtgtcaggtgaccgctagcatttggcgtcaggttattgcgtgggtgggagttaatttggtcatgccacagacttttggacaattgtttaaacaatttggagggttattgcctgggagaaaatcaaggagggtgaagcatatattatggcatgctacctgctgcttttggggatga

SEQ ID NO: 106369 - DNA, 1425 bp, Glycine max
  Peptide Sequence Number=SeqID_223147
atggcttgtggcacttccaggtatgatgatacaaatcctgaagcagaaaagaaagagtatattgatcacattgaagaaattgttcagtggatgggttggaaaccattcaagattacttacacaagtgattacttccaagaattgtacgaattagcagtggagctcataaaaaagggtcatgcttatgttgatcatcagacacctgatgagataaaggagcatagggagaagaaattgaacagtccttggagagacaggccaatttcagagtcattgaagctctttgaggatatgaaaaatggcagtatagaagaaggaaaagccacacttagaatgaagcaagacatgcagagtgataactacaatatagaatatcacacattctgtaagttgtctttcactcaatttcctccaggtgttgatacaattttcttgctgctgtgtacacttgaatttgagacacgtcgtgcatcatactattggttgttgcatgcgttaagcatttaccaaccttatgtatgggagtattcaaggttgaatgtctctaacacagttatgtcaaagcgtaagctaaatcgtctagttacagagaagtgggttgatgggtgggatgatcctcgtttgatgacactagctggtttgcggcgtagaggcatgactccaactgcaatcaatgcttttgtacgaggaattggaataactagaagtgatggcactttgatttctgtggaacgccttgaatatcatgttagggaagaattgaacaaaacagcttctcgtgcaatggttgtcctacatccactcaaggttgttattactaatcttgaagccaactcagtaattgaggttgatgcaaagaaatggcctgatgctcaagctgatgatgcttctgctttctacaagatttcattttccaatgttgtatatattgaacattcggacttccggatgcaagattcaaaagattattatggccttgctcctgggaaatctgtgatactcagatatgcatttcctataaagtgcactgaagttattctagctgatgataatgagactattcttgagattcgagcagagtatgatccttcaaagaagaccaagcctaagggggttctccattgggttgctcaaccttctcctggagttgatccattaaaggtggaagtcagattgtttgagaggctgttcctattagagaatcccgctgaacttgacaactggcttggcgatttaaacccaaattccaaagtgataattcccaatgcatatggtgtgtcttccatacagaatgcaaaagttggggacaatttccaatttgaaagattaggctattttgtggtcgaccaggactcgacatcagaaaaacttgtttttaataggactgtcaccttaaaggacagctatagcaaaggtggaaaatag

SEQ ID NO: 106370 - DNA, 306 bp, Glycine max
  Peptide Sequence Number=SeqID_223148
atgactctaagacaacatgaatcaaatgatttacacttagatttttgtgttttcttttctaatcaatattttatagaggaagcaaaagaacatcacctagatgaagatgctctgataccacatgatgtagctccatgtaaagcttgtatgatgcaagctccattggagcttgtaggcctaggatcttcttcatcaatggattcctttgcttcttggaagataaatggcagcggaatggagaagaaagagagagaggagacatcacttcaaggagaagatgagtctagaagaagctcaccaccatag

SEQ ID NO: 106371 - DNA, 715 bp, Glycine max
  Peptide Sequence Number=SeqID_223149
atggcagatgatattgtatttaatcataggagacaaggcatccaactaacagacaaagaaaaaatgcatctttgtttgacggaaattgaaaacctcctgcaagccaacaggaaaatcctacgagattttccttcaatgtcatacccactaggatatgccgccaacccgcaccaaaataatctcatctacaatgaactggcttacgacagggacatattggccaccgaatttgacaaatgctaccagtcgctaacagatgagcaggcttctatttttaataagattatgcatgtggttgcaactcaatcaggtggagtttattttctgtatggatatggtggcacaggcaagacatttgtgtggaaaactttatcatctgctatactctctactggcggcattgttttaacagtggcttcaagtgggattgcctcaatactattgtctggcggtagaacaacacattctaagtttgctattcttgtccctgcaacacaaaattctacacgcaatatccatcaagggagtgatttggctgaattgttgcatatcacaaaactcatcatatgggatgaagctccaatgtgtcatagatacagtattgaggcccttgacaaaagtttacaggacatcatgcacaacggcaatccttttggaggaaaggtcattgttttcggtggtgatttccatcaaatactacctgttgtgccaagag

SEQ ID NO: 106372 - DNA, 222 bp, Glycine max
  Peptide Sequence Number=SeqID_223150
atgagtcgtcgcggtaactgtcacgacaacgcggttgcggaaagctttttccagctactgaaacgcgaacggattaagaaaaagatctacggaacacgggaagaagcccgcataagcgtcggcatggctcgagcgatcagatgccaccaactgaatacgaaaacaaatattatcaacggctcgaaagtgtctagattatccgtggcgattcaacattactaa

SEQ ID NO: 106373 - DNA, 335 bp, Glycine max
  Peptide Sequence Number=SeqID_223151
atgaaacccaactccaaaatcgaaagtggaggacacatgaacgaaaacccagttcctggaactccgaaaaaaagtggagaatggaggattgccttgagggtccgatcaagcttaaccataccgtccacctccagggggggcccggtaccagcttttgttccctttaatgaggtcgggaaacctgtcatgccagctgcattaatgaatcggccaacgcgcggggagaggcggtttgcgtattgggcgctagcggagtgtatactggcttactatgttggcactgatgagggtgtcagtgaagtgcttcatgtggcaagagaaaaaaagctgcaccg

SEQ ID NO: 106374 - DNA, 366 bp, Glycine max
  Peptide Sequence Number=SeqID_223152
atggggtgtgcattttttttattggatgcttctgtgattgagttcactgagagatctggtttggagtggaagagggtgaagatctatgaacaacttctattggtatatttgttgatctgcacaattcagacttcaagtgcagccactgatcccactgatgttgctgcaattaatagcttatacattgcactgggatcccctgttttgcctgggtgggttgctagtggaggagatccatgtggagaaggttggcaaggcattctgtgtaatggatcattcatacaaaaaatagttctaaatggtgcaaatttgggaggagaactgggagataaactgtcaacttttgtttcaatctcagtaatgtaa

SEQ ID NO: 106375 - DNA, 270 bp, Glycine max
  Peptide Sequence Number=SeqID_223153
atggcaaagggcgcagaattcgtctatgcgcgtttaccactcgactcgctgctcctgaatgataaagggcacaaaatttgtctctgcgcgtttatcacccaatttgcgaaatctgaatggcaaagggcgcagaattcgtctatgtgcgtttatcactcatcgagcgtgcgaataaccgcatctcatcgggcccgccgcctctggatgaaaaaaggcacagaagacgacgttagtctctacgtgctatcatgctttgagtcttatagatag

SEQ ID NO: 106376 - DNA, 225 bp, Glycine max
  Peptide Sequence Number=SeqID_223154
atgagggtagtttatgttgtgagcttgcacttcaagacgtgcaatgctggtgttcattttccatggaaacaacttctggtaaataggtcggagattcccttgatgatgcttcaatctccaagtccagaggaactaaatttcctgcgggagatctatgcatataaaacactaacagaaatagcggttatccagttcaagatgaaaacaaatatgaatcgaaagtaa

SEQ ID NO: 106377 - DNA, 888 bp, Glycine max
  Peptide Sequence Number=SeqID_223155
atggctatgggacccgagagatcgaagcctcttcacaatttcatgttgccttgtttgaagtgggggagtcagcgccacctccgctgcaccaaacacccctccgactcctccactgaagatcgccgatctccagcgccgcgcgaattcgactcgccgccgctcactaatgccgacacccgaacgcgcctcacgcggccgcgattcctcttcggcgacgaggggatcgacgccgtcagggaaaagctcatgcttgatctcaagaccgaggccgataagatgaaggacgcgattctcggcaaggaggtctcggaatacaacaatgatgatgtcgagatgaacgacgcgccgccgcaaccggaggaagaggcgccgccgccggttagtggagtgaggacgtggaatctgcggactcggcgggctccggcggccggaggcaaaggagtgaggattgacgagaggaggggcggtggagggtcgccgttgaggatgaagtcgccgaaattgagagggtcgccggagaaggaggaacggcgggcggtgaagttttctctgatgctggcgaagaaggagattgaggaggattttatgaggatggtgggccaccggcctccccgcaggcccaagaagaggcccagaaatgtgcagaagcaattggatacccttttccctggccagtggttgtcggaggtttgtgccgattcctacaaggttcccgatgatgctgagactcgcaagatcacatatgctttaggttactactttgcttttgatgctactattatttctgggtttatccattgcagtcgaggtggtaactgttctgaactagggttcggcccaaccgcagcctgcaaagccagaatgcaggcccatccaacatccaaatga

SEQ ID NO: 106378 - DNA, 285 bp, Glycine max
  Peptide Sequence Number=SeqID_223156
ggtggtggttgccgcccagctcacccaggcgagctcagctcgcgcttccaccagaagacaccgccttctgttggaagatcctggaaggcccaaattacgcaatcatcccttctttggcttccggaatgttacgaattgcgcattaacacgtcctttcaactcccgatatgtcgcggaacttcacggattgcctaacgatgggtgtcaagtacctcgaagcggtcaagcaggggttgcaccccaacaaacagatgatccccggacgaaattagggtatgacaactg

SEQ ID NO: 106379 - DNA, 417 bp, Glycine max
  Peptide Sequence Number=SeqID_223157
atgttgctgggtgcacctagcatgtcccttgtggtaataccgaagggcagtaggcctaaaacccacgatggaggtggaagaaaagaagaacacaattggaatggaagcaacaagcgactagggaagtatatgtataccctcaaaattcgagtaagcttggaggagaggaggataagacctcattttcaacttgatggatgcccaagaggttattggaagtggaaaaaagaggggggaagcaaaaggaatatgggatacaaatggggatgtcatatatataggggtaaggtggggaacatggtgagaaaattagttagtatggaagagagggataacaggggcattgagggagttaaaagataccatcaaggaagggatgatgagatgttgtttatgaagatgctctctcttatataa

SEQ ID NO: 106380 - DNA, 153 bp, Glycine max
  Peptide Sequence Number=SeqID_223158
atgatgatttgggaacaacgtgcaaaattaatcatggctacagctaggtgggtactcaagcatccagtttatggcattgtgatactaaggacgacgttcctaaaggaaaactctacaaggttccagaattccaacaaacattatcgacaataa

SEQ ID NO: 106381 - DNA, 1773 bp, Glycine max
  Peptide Sequence Number=SeqID_223159
atggcttcccaacacgaaaacgggtcgattatcgatccgaatccttttggggtggagacagtaatggcttcccagcacgaaaacgggtcggaaattgacccgaaccctactgtggtggagacagcaatggcttgccttcacgaaaaagggtcggaaattgaccctaaccctactggggtggaggcacatgaagcggaggctgaaaagtttggaactttgggttgtgctgttcctattgaggaaggcttggagaagatcactttggtgggtccttctctttcagttgaggagaaccttgttaaggatgatagtgaaattgaaattgaaagtgagagtgagagtgaaaattcagagtctgagagctcttcttctgattctggtagcggaagtagtagtaacagcagcagcggtagtagtagttgtagtgatagcgaggacgacgatgacgataaagacgatgatgtggaagttgaagaaggtgagataagtgattctgatgaagagaaaatggttagttggagcattgttgatgaggatggtgatgaagatggtgatgtgggaggaggagggggaccgatcaggtcaaagaatgagcttcagaatctgcctcctgttcctccccgtagatgcgattttggaaccacaccatcaaacggtgcccagttggaattgttatgtcggaatataatagaaagggtactgattagtgttggaattctcattggacagactcttggtgctcaagtcatcgtggaaggagtggagaagcatgaccctcttaatgagggttctattctttggttgactgaaagccaaaaaccactaggtttaattgatgaaatttttggaccagtcaagaacccttattatgttgtgagatacaattctgaaagtgaagtccccacggggatcaatgagggaaccttgatctcctttgttccagaatttgctgatcacgtgattaataacaaggatctctataggaaagggtacgatgcatctggcgcagatgatgaagagttgtctgatgaaatggagttttcagatgatgagaaagaggctgaatacaagagaatgcaaaaacagacaaagaggggtgcaaacgatcaaaatcatggcaagaaaaaaaacaacagaaagaaattttcaccgaaagatgttgctgcaccttctgcaccagctgcaccttctgtgccaatgcttcatcatggaaattgtcctcctttttcaagcattgcacaaggtcatttgggtggaactaccccacttccacccttaaacgcagctccaaactttgctacgaatggagtctggacaactggaacaacatttccacatcagcaacagtctcccatgcttcctaatggatttcctacaaatggcatgccatggtacccacaaaatcctcaaatttctcctcagtttcctatgccaggaattccatttcaacagcaattacatcccaatcagggatctcttcccacaactatgctacctgggatgcagctcaatatgtttgctcaatcccaatatgcagcaggacttgctggtcaaaatcaaatcgcatttgggatgggttcacccttcccacagagtcagccacctatatttgctgcacagcagggttttccatccactgaattgtgttcagaaagaaacctgaattttcattctaatggcgccccctctcaatttcatccgcgtccaaatgctaatcgtgggagaaaaacatttcatggtgcaggtaggaaagggtggcgtccacccaagtga

SEQ ID NO: 106382 - DNA, 462 bp, Glycine max
  Peptide Sequence Number=SeqID_223160
atgtatatgctttgtcaagttgtatttgttccatacaagttgactccttctgcatttgagaaacactctggaagagagactgccaggaaatggaagaataatgtctgggtaattgttaatggtgagaaggttccattgtgtaaaacagtgctgctcaaatactacaatcaggtgtcaaaagctgcaaatggctcccatagatcccaaaatggccgggcttgtcaccgtgatgagtttgttcgctgcactagttgcaataaagagcgtaggtttcgtctgaggactaaagaggaatgccgcattcaccatgatgctttggcagatgcaaattggaaatgttctgatcttccatatgacaactaccaatgtttcaatttggcccgaagcgggaataatacaggaactccaaagtggaagagggacgaaaatatactgaagctggcatttgataagttcatataa

SEQ ID NO: 106383 - DNA, 237 bp, Glycine max
  Peptide Sequence Number=SeqID_223161
atgtcttattccgcttctactcaaactaattatggttgtaccctctgttatgttgtggacagaggcattttggctgcgattgatgtgttgggagacaatgcattggttgggatattctacttcattggatttgggccttttctgtctcgacaagtatatatgtacttccgtggcagtggcaaggctgcagttttaaagcgtgaggctgcgagagggacaatgatggcagctctataa

SEQ ID NO: 106384 - DNA, 300 bp, Glycine max
  Peptide Sequence Number=SeqID_223162
atgcaacagggagaaccatacattcccatagttgggttccttgaccccaactacagtatcaaagtggtaaaccaaaataaactcctttcagatattgtcagcgctccgacaactcctctctgtgtcgctcagagacttttctcgttcacgttcgtcagtccaaatgcaaagtggattctgaggattccacttcgattaagatattcttctgcgtgtggtggtccagcagcaagcaatggtggctcgtggtggccaccggtagtcgtgggtggtggaggaggagtttctaaagtggtttag

SEQ ID NO: 106385 - DNA, 579 bp, Glycine max
  Peptide Sequence Number=SeqID_223163
atggctcgatgtcttccgttattatcagcagagaaattatgggtagcagagaagtcagaaggcaattgtctcagtgcagcctattgtttatttaataacactggaagtgttccctcctcaaactcaaggctctcaccccttccaccagagccttatgatcgtggggcaactattgacatccccctaaataatgcaaaggacgcaaaagcaaaggagaaggaacttcaagctaaagaggctgaattgaaaagaagggaacaggaactaaaacgaagggaagatgctatagcacgagctggaatagttatagaggagaaaaattggccaccttttttccccatcattcatcatgacattgcaaaggaaataccagtacatcttcaaaggatccagtacattgcatttacaacatggttgggtttggttctgtgtcttttgtggaatattgtggcagttactactgcttggatcaaaggagaaggtccaaccatctggtttcttgctattatctattttatttctggtgctccaggatcctatgtgttgtggtatcgccctctttatcgtgctatgaggtag

SEQ ID NO: 106386 - DNA, 135 bp, Glycine max
  Peptide Sequence Number=SeqID_223164
atgaagactaaccgcgaagggattaacctcgaccggttcttcgtcgaagggattgggatcgtagcgactcatggaatcggagagaaagcgttggaatctacggcttcctctctttcttattctgtttgtttctga

SEQ ID NO: 106387 - DNA, 645 bp, Glycine max
  Peptide Sequence Number=SeqID_223165
atggttagaacacgaggtttaggtcgtgctttagctagggttataggcagaggtagacaggatgagcatgatgcagttgatgttacctggaggcgtaggcctactgcatcagtccgtaggcaacgggtacatattgcagttgatgaaggtgtttctcaggtgactgaggatgtacctcatatggcgaaggatgttcctcagatgactgaggatgtccctcatatggctgacgatgttcctcagatgagtgaagatgcgcctcagatgaccgcggatgtagatgcgactgttgcagaggacttaggtcgtaatggtgctaagggatcacatgctgatgagggattccctggtggtccacgtgacccatcagtgctgacttcatttgcggagcatgttgcagatgccatttggactgggcaggagcgtcctgagctgaagttggtgtcgcacgggaggaaggtggcattaattgggaggccagtgcctaagattgaagctggttgccgccacaagattaagtccattgatcgggtgttaagttgtaaccggcgatcctggacttatattcgcatttgtggagaggaggcacagagagaccagcaccttccaccttctagtaggagagttgatgatcacactagatga

SEQ ID NO: 106388 - DNA, 606 bp, Glycine max
  Peptide Sequence Number=SeqID_223166
atgtattttggagttagtgatctaagcagcaacaacattggaggaaatattccatccagtttgccagttaccttgagaaacttttttcttgcagccaaccagttcactggaagtattccggcatctttatccactttgactggactgacagacatagatttatctcaaaataatttgagtgggaaattgcctccttctatggataacttgttggctctgaccaccctgaatgttgagaacaaccagtttgctggcccaatacctccaaagttgctaagcatccctgccttcagacaagctggaaacccatttaatgttagtggtagtactacaactcctgcttcttctcctcgctccccagcaatagcaccaccaggaactccggtttctgggacaccaccatcttcaggccgtgtacctactaaacaggctgatggaccaactgcagcaaatgaatcacatactgggaaatccaaaaaatccacaaaaagggtggatttattctctttattccaaggtgtagcagaagagaacgggatgacagaagatccaagcgacatcaaattggtgcatatggaggtgaaagacaaagtgctagggatttag

SEQ ID NO: 106389 - DNA, 1053 bp, Glycine max
  Peptide Sequence Number=SeqID_223167
atggcggtggtacttaaagacatgtgtttcttcaacaacaaggacattctggttataaagcctcagaagaaatcaccactgttgttaaggatgtcggtgttgatcttctcaatggtgtgtggtgttttcatttgttccgtgtgtctaaagcagataagcactcatgcaaggactatgcttatggagttgcaaattgagaagccttctcggagtagtagtagtagattgaacctaaaaaatgatgttcctttgttacattaccccaagcctgtgtctttcaacaggagtgagtgtgctggtaaccctgtgcggttctttgccattttgtcgaatcagagatctggcagtgggtggtttgagacccttttgaatagccatattaatgtgagctccaatggggagattttttcagttagagaaagaagagtaaatgtttctaccattgtacagactttggacaaagtttacaacctggactggctcagcagtgcttccaagaatgaatgctcagctgcaattggatttaagtggatgcttaatcaggggctaatggagcaccctaaggaaatagcagattacttcaacagtagaagtgtttctgtcatatttcttttccgaagaaacttattacggagaatggtatcaatgcttgccaactcttatgatcgttatgctaagctattgagtggaactcataagtctcatgttcattctacagaagaggctgatactctttcaaagtacaagcctaccattaattctacatcattgctggctgatttgaaggatatagaaatgagaactgcaaaggtgttggaatacttcaacaccactcggcatatgatcctgtactatgaggatcttatgcgaaattgtactaagctaaaagatgtgcaagagtttttaggattgccacagatggaattaacaagccgtcaggttaagatacacagaggaccattgtcagatcacattaaaaattgggatgatgtgaacaggacactaacaggaactgtttatgagagtttcctccacgccgattattcatcttaa

SEQ ID NO: 106390 - DNA, 168 bp, Glycine max
  Peptide Sequence Number=SeqID_223168
atggacaacaatccattggagcttcttgacattgataacttagacctgccatcctttattcgtccgactaatcagtcatcctccaattcaacaagacttattcctagtccaattggggtcttacaagctgccatgatgaatcgacaatctaggattggtaaatgctga

SEQ ID NO: 106391 - DNA, 333 bp, Glycine max
  Peptide Sequence Number=SeqID_223169
atggaacttccggagacccaccagtaccagttcctccctctctttcatctcctcgatcatccacattattttcctccgatgatcagcgtcagagaaacatttgattgttaccaagtgtttcaaaactctgctttggttgatttcatgtctctcaaacttccctactttcccgaattagttaaagttttctataataatttgaaaattcaggatgatgttctttattctaaggtgcataatattcccattgttgttgatcaatccttggtttattcattgactaaactgcccagtcaaggtgttccttttgagggcaatcttgtagatgactga

SEQ ID NO: 106392 - DNA, 240 bp, Glycine max
  Peptide Sequence Number=SeqID_223170
atggcattaggggtcatggcagctcgcccagacaagttgttgcttcatcctgaagcgagccagaggctagcctgggtgagccagggttcagaaaaaagcctagaatggcccttttgccctcccctttgggtatttttcatattcttgatcaaaacatcgaatgatcatctatttcgcactataactggccttcaacgccataagttaactagcaaggatcaaaagatcaccaaaggatag

SEQ ID NO: 106393 - DNA, 876 bp, Glycine max
  Peptide Sequence Number=SeqID_223171
atgacgtcaaaattggcaattgcagctgacaaggacaatgtcagggacactgatcgaaaaaaggcacaggccatacagaaacaaaacactacccctcacgtgttgccttgtgggggttatgaatatctagaaaacaagttgatggaggagaagaaaaagaaacaactggaggaagctgctcaatctggaagcactggcaccatgattgatcctccatctcttatcaaccgacacgtgaagtggaagatggcccgcaccaagaaaactgggcaaatgatgtctgaggtagcaaaggaaattgctcacaagattgattcattggaggagcaagcctcacagggttcctttcaatactttggaccggctccaaggacctcccgcacgtcttcgtccatggctcctgaagacctggagcagctgaagcaaaaaatcagggaccaactagaggagtcgatcacagaaaaagtgactcaacaactaatgttttccttcagccaaatacaatcccaatttcaatcacagatgcaatcacagggaatcgcattgcctcctgagcataagattggtccttcagctgctcatgtcaacacaaaggagagttatattgatccctcagggaacgatccagatatgggtgactcagacaaatggagtcgtgggaccggcgaaactacagataggccggatcatgatgtcgatgatctccaatatctattgacattgaccatcccacatctttttcttaagccgttccaggttatgtgggatgctatcgtgtttagggtgtttaataaaaacttccccttgtacataaagcatgaagatctatctgaaatagcacacggtggtcaatgtctcaacatctctattatatag

SEQ ID NO: 106394 - DNA, 861 bp, Glycine max
  Peptide Sequence Number=SeqID_223172
atgttgctcaagcagatcggtcaacggcgtgagatcgtgaatacagggctcgccgccggtaatcacgacgtgacgggcggtccatccctgacggccaatgatcgccagcagatcgtcgctggtcgccgggccccacttatcgctctctttggcgcaaccaaccgggcatccctgcaaacgaataaaaatggcaggcacgccggtaaagtaaccctcgccttgcaaggtctggaacatctcgttaatcgggtactgcatagtcatctctgttcaggtggtaaaaagatgtatctgcgcgcggataaagatgtaacaaagaatgtctttgatgatcgcgttaccggatttctgggtggagcggtattagagaatatcctcaataatgaaaatgggattaatctactgctcctggtgcgagccaataacgatgaagcggctctggcccgggtgaaggaaaacctgcgtaaattcaatattgcagaggagaagctggccgcattaaccccccggcagatcctgctcggcgatttgtcatcaccggagacgttcctgagcgacccgcgcctggagcaggtcactcacgtgatcaacagcgctgccgtcgcctcatttggtaataatccactcatctggaaagtgaacgtcgaaggaacgttcaaatttgcccaacggatgtcccgcgtagctggactacaacgttttctccacgtcggcaccgcgatgtcttgtaccccggagccagattcactggtcgcagaaagcgctgaattccgcgagcacgccgagcatctggtggagtatacccattccaaatcgacgattgagcgcctgatgcagtgcaatgtccgacgttaccgttag

SEQ ID NO: 106395 - DNA, 267 bp, Glycine max
  Peptide Sequence Number=SeqID_223173
atggatgattccacttctcttctaactgaagtactcacaaagctccacgatcttcgagcatttgtgggtgagcgttttgatgcgatggatacttgctttgataggatggatactcgtatcactaggcttaaagatgatatgagctttatcaggcgttgcttcgatccccaggtgttttttggctttttgatgttgccaaaaggggagagaacaagggtagaatttatcatgaacttaggcataaattccaatcttaagggggagtaa

SEQ ID NO: 106396 - DNA, 207 bp, Glycine max
  Peptide Sequence Number=SeqID_223174
atgcagaattcacaaagagatgtgtacctaggagcctacttgaacagtgcacattggcaaatggttgtcattttgcctgaggacaatgttgtcatctggttatgttccttgcacaattggcccaataactacttgaaaggaattattaacagggattcagtgacagtcaaggaagtaaatccatggatgttgctagatggatcgtag

SEQ ID NO: 106397 - DNA, 228 bp, Glycine max
  Peptide Sequence Number=SeqID_223175
atgaagaaggacacttaccagttggagaagattcctctcttcttcaaaaggattttggacaggttcgatggtcttcaaacctatgttggtgaaaggtttgatgctttggaattacaagtggccatgcgattcaatgtgatggactctaggatcaccaaggttgaaggagatgtcacttacatccgcacatgctttgatctaccaccactgccaccaccatcatcttag

SEQ ID NO: 106398 - DNA, 657 bp, Glycine max
  Peptide Sequence Number=SeqID_223176
atggagtccacgccggtgaattgggaagccctcgacgctctgctcatcgatttcgccaaatcggaaaacctaatcgaagactcctccgcgccgtcgtcgtcgccgtccccgtccccgtccccgtcgtcgtcttcgtatcactcccgcctcgtcatccgccagatcagacgcgccgtcgagaccggcgccattgacgccgccgtcgctctcctccgcctccacgccccctccatcctcaccgaccacaagattctcttccgcttgcacaaacagaaatttattgagcttctgcggaaggggacagcggaggatcgagactctgctatcgagtgtctgaggacggctctcgctccttgcgcgctcgatgcttatccggttggttttgtatttaaggaagcgtatgaggaattcaagcatgttctgctcgcgtttatatatgacaaggatgataagaattctccggtggcgaatgagagtctctgcctaggaaacacaacaattgaatcagattgcatggaaaaacatggtttgcttttcatccctgtgttccatgctaagcaggtcttagaatcctgggaggcaacaatgacacggttattggcttgcaatgttagagtggatttgcaggtcaaatttgaatttagaatgagaaaatga

SEQ ID NO: 106399 - DNA, 261 bp, Glycine max
  Peptide Sequence Number=SeqID_223177
atgggagttaaaaaggcagggcaaaagagatgtccaagtaacggaagaagcggtgtaagcatggtgggcacgactggtctcattgtgaacaaccttcgtgttggtgcaaatatgagatcaaagaaatggaggaagcaacaaaagaggaatcacacaagagaggttcaagcgggagaattgatttgggttttttggaatgttatggcgggttcagtggacctccttgtgaaccacctccatgcaggtgcaaagatgagttag

SEQ ID NO: 106400 - DNA, 1866 bp, Glycine max
  Peptide Sequence Number=SeqID_223178
atgggtgagtggtcagaacacaggaggcttgacttagccggatttatgtcctctatgttaagggctcatttaaatgcctatgacccaattttttcaatggctctgagatatttaataagcatacacagggtatattgtttacgtcaaggtattacatcacccatctctgatctgactgaaagattgctccttgaagagcgtgaccctcctgcaacaccacaagacattttatatgaagtaccaccttttgatgagattttttcttaccctgctctctctctttttcttaccttgttctgtcttgtctcctctcttatttcatttcctttacccaattttgcacttgatccacacttccgcctgccacataatcaggttgacatacaggctcttgcacatgctgtagagcttacaagacaaggggcaattgatagcttgagattcactaagggtgatgtgttcctggcatttcagccgatactaactaccgtgggtctaacttctgctccgccgatggctgtgcacttgcatctagcgggtcagagaaaagaaatgacccgattcacaaccctaatggacctaaccctgaacgacagtaatgagttatgccggatgaggttggatgctccccttctcgatcagcttgttagagagtattgtgtttacagaggcattgttgactctgcatctgggaagcaacctattccagaaactgtgaaattcaacccacaagaccctgggtattgctcatcaagggattgttctcttgagctagactgtaatgccagcaagcattctgatggtgaaacttctgttaccaatgctcagatggatggttcccctgaaaataacactgatgtgacaagcatgagacgaattgattttgaagtacgatatgcttctgaactcgcaagcattcatgaagactgtagtaccagtggatcacagcaacatgaagatgcaagtgttttgcagcgaagcagattgcctgggaatggagaaaggagcaagcgcaagcggtggagaggacgatatgatgacaatagttacatgcccaatgcttctttggaagagaacagcaagcaagagcatagcattagtactattgtttcaactatatcaaaggagaaacagggctctgaaaagctttctgtacatgatattagtaatgtggaagatagatatgagattctgttgggaatgaaggaattagctagcaaaggaatggctgctgaagcggttgaggaggttgaattcctcaagttggtcagctctggcgattataatactgctttaaaggttgcttgcacccatttgggtcctttagctgcttgtgatcctgctttattaaagccgttgaaggaaactcttttggctttactacgacctaatgaagatgctcttggaaatgcattacctctacatgctctagctgcttctctccaggttgcagttggtcgaaggcttggtgttgaagaacctcagctcatgaaaataatgcgagccactctttatactcataatgagtggtttaaacttcaaatgtgcaaagatcgttttgaaggtcttttgaggcttgattccttgaaagaagccaacactcccttccttgcaccagtctctacatccaagtcgtatgctgatagctgcacaaatggatcttctcaggctacagtatcttcaggcaccaggatgtcagaagatggtagcagtccaactcaagcatcttcaagggatgtcatctgtgacgaaggtgcaatacttaaagtaatggagtttttggctttgcctagggctgatgccatacatctgcttgcacaatacaacggaaatgcagagacagtcattcagcagatatttccctag

SEQ ID NO: 106401 - DNA, 195 bp, Glycine max
  Peptide Sequence Number=SeqID_223179
atgatggagttcaacacagctacagtcattgccgcaagtaccgcaactgaggtggacctaacttacccatctggcctcaaccaagtaaatcgcccagcctcggatatgatgaatggcagcggaatggagaagaaagagagagaggagatgccacttcaaggagaagatgagtctagaagaagctcaccaccatag

SEQ ID NO: 106402 - DNA, 570 bp, Glycine max
  Peptide Sequence Number=SeqID_223180
atggagaaaggttatacgcaacttgaaaataagaattctttgccacaaaatgaaaaggagactttgttgaagatgaggaaggatcaacaagcacttaccttcatctatcaaggtttagatgaaggcatctttgagatggtgttcaatgtctccacctccaaagaagcttgggagattttgctaacatcccttgaagatgttgacaaggtgaaaaaggtgtgcctacaaactcttggtggaaagtttaaatccttggatatgaagcaatttgagtcaattttggattttggcaatagggtgataatgattgtgaagcaaatgaagcgttatcaggagaatatggaagaagctcatgttgtagagaaggtccttcgttctttaatcgcaaaatttgattttgtgatttgtgtaattgaaaagtcaaaggacattgaatcaatgactgtggaccgattattaggttcacttcaagcatatgaagaaaggttcaaaagaagaaatgatgagcctttggagaaagttcttaaagccaaagcttctttgaaagtaaaaggaagagacaacacatga

SEQ ID NO: 106403 - DNA, 369 bp, Glycine max
  Peptide Sequence Number=SeqID_223181
atggttgcaacacgcaaaatactccaatacttttttggtcgtgaggtgcgaaggttgcttgtaggcatagtagtatctaaaagttttatgtcattcaatcggcaaatttccccatttggggtacttttaaaaagtattttctcatatggggttgttttaaaagatatttcggcagggggcacttttgcacgtaaagtgcatgcatggcccaagcaaatcgccagtgggactggcaagttcgctgttggtgaaggactcgccattgtgaatggcgatatgcacatgcaaggtgaagaactcgccactgggaatggtgacatacacagcaaggggaatcgccagtttgactggctagttcccaccacgtag

SEQ ID NO: 106404 - DNA, 210 bp, Glycine max
  Peptide Sequence Number=SeqID_223182
atgaagcaaaacgttgcttacctcgacaatgctgacgcgcggagggagaacaccaccctcaaatttcctgggctactcaacaccaacggtggcgtggtcacagaacgaaacaccgacgaagaagatgacgacaacactctcggggggaacaaatgcgatgcggatgatgacgacgatgggtcaatcttttttgagaccagcctagactaa

SEQ ID NO: 106405 - DNA, 123 bp, Glycine max
  Peptide Sequence Number=SeqID_223183
gaagtttgctatgggattgttgagaggttggagtgtcatctgagcctaggggtggtcatgtcaggctcatcgacacatgaggtgatcgaagaatgcctcaggatggataggagtgtcacataa

SEQ ID NO: 106406 - DNA, 885 bp, Glycine max
  Peptide Sequence Number=SeqID_223184
atggtggcgagagattgcaaaggttttcgtttcctcgttaggagttgggaaatagcaatgggggatggtaactatgatagaactttgagggagttctgtattccggattacatattagtgccgggatctgaggtgagaagtgtttcacatgtacctgcttgccctgtgattgttttcataaacaccaaaagtggtggccagcttggaggggagcttcttgtttcctatagtacacttcttaacagaaaccaggtttttgagttggggaaaaatgctccggataaggttctgcagaagctttatgctacattggaaacactcaagcacaatggagataattttgcagctgaaattcagaataggttgagaataattgttgcaggtggagatggtactgccagctggcttctaggagttgtatctgaccttaaattacctcaaccgccaccaattgctactgtgccattggggacgggaaataatcttccctttgcgtttggatggggaaagaaaaatccaaccacggatctccaatcagtggagacattcctaaatcatgtaaaagcggcaaaggaaatgaaaatagacagttggcatattataatgagaatgaaggctccaaaagaaggttcatgtgaccctattgcaccccttgagctgcctcatgctatgcatacatttaatcgtgtctcttcaacagataaactaaacttgaaaggttaccacacttaccgtgggggattttggaactactttagcatgggaatggatgctcaagtatcttatgcatttcattctgagaggaaattacatccagaaaagtttaaaaatcagttatacaatcagtctagtttgaatctcctggatattcttcattcaagataa

SEQ ID NO: 106407 - DNA, 402 bp, Glycine max
  Peptide Sequence Number=SeqID_223185
agggacctgactcttccctatgtggacgatggcctatttgaggtagttggttttagagatgcttggcatggtcttgttttgcttgcaccaaagggacacggaactcgtttggcacagggtgcagctgactgcacattcatgagaattgatggagagccatggaaacaacccctcccaaaagatgatgacgcagttgtagttgagatatcacaccatgatcaagttagcatgcttgcaaccccattgtgccgttctaaaagtatttatgatccctcctcaccttccgatgaccgcgaagaagatgatagcagtgaagaagaaccatcagaagattgggaagaacggcgcaaatttggcgcagctgagacattcaaatatcctgatggaattgatatagctcaa

SEQ ID NO: 106408 - DNA, 444 bp, Glycine max
  Peptide Sequence Number=SeqID_223186
ggagaccagtcagggtcacagtgttttgcgagaattttccaaccatatgagatcaacataggcttaaaggagcactcaaaccgtgtgacccccaaggcctacactccgaagagtccgtcagggcctctccctcctgattcagttattcctccgactgttccgatagaattcccaaacgccaaagagacggagaagagattgaaacctccacttgtactgtcttcatgcgattcctttttctcccaccacgaatattatctcaaaaatcccaatggtggaactaaaaataaaaggctacaacgcgaagggttttcctctaagctcagacataatatcaaaattcccaacggtgataatgctcttaattgggtttcgaacgtggtgttcaaatttcacaatgatctaacggtgaatgagcccgagatcgtcatttttctaagacag

SEQ ID NO: 106409 - DNA, 795 bp, Glycine max
  Peptide Sequence Number=SeqID_223187
atggggtatgactatgaagtttgctacaagaaaggaaaagaaaacactgttgcaaatgctttatctagagtgcagggttatgaattaatggtgattgcagtttccagcatttccagtgagctaatggctgaaattcaaggtagccggaagatgcgtccacatctattcgagcttatacctcaactgcagcaagggttgaagcctaaatctccatatatatggattgagggacaactaactagaaagggtagaattgtgggaatggagaatcaagtgaggaggtttgtacagcaatgtgacatttgccaaagattcaaatatgataatgttgcaacccctggtttagtgcagcctataccaattccaagtcaagcttggtcccaggcgtatttgaagctgcaaccttatcgtcaaaactctctagctgacaggcagtccaggaaattatcagcaagatattttggtccatatcagataattgacaaaataggagtagcggcctataaattgaagcttctacctggggcgcagatacaccttgtcttccatgtgtcacagttgaagaaaaaggtgggtgttggtgatcatcttggtactcagttacctattccttgggtctctacttctcttcaaccattagctattttagataggaaaatggtcaagagaggaaatcgtgttgtaactatggtgttgattttcaaccttgaggacaaggttgtttttgaaggggattctgttatttctgttattcaatttgttatttctgttattaagttgtttgaaggttgctaa

SEQ ID NO: 106410 - DNA, 525 bp, Glycine max
  Peptide Sequence Number=SeqID_223188
atgttaggaagatatcaaagaaatccaggaattgaacattggaaaactgcaaagaaagttctaagatacttacaaggaatgaaagatcacatgcttacatataggaggtttggtcatcttgaggtgtttgagtattcagactcaaactttgctggatacatggatacgagaaaatccactcttggctatgtatttcttttagccggaggagcaatatcatggaaaataatatttttctctaagatcaacaagtactctaagggtgctaagcatatggaattgaaataccaatggtggttgtgtggtgacaatggcgatagaaaagatggtggtggtggtagtattgatgccaacggtgttggtggtagtattgatgccaactgtgttggtggcagcaaaggtggtattagtggtagcaacgatagtagtgacaatagtgacaatgatagcggtgatgacaacaacattgatgttggtggtgcagaaataattgttggagatgcaggaaacaacactcctagctag

SEQ ID NO: 106411 - DNA, 411 bp, Glycine max
  Peptide Sequence Number=SeqID_223189
atgccggccttgatcacctctctgcggaacctgcccaggagcttctcctcggactcgtcctcggccaccaccacctgcacgttgtacggcgaccggaagaagagcgtgttggagtacgccatggatgggcatataacagaggacaactcagaagaagaagcgcaagagggtgaaggaggagggttgtattgggcaattaggggcttggtggggttgaactgcggtggagagggtggtggtggtggttttgtgcgtaagaagaaagagaggaagttgttgatggtggatgaggcagccatgggtgagagtgatgaggatgatcacggaaacaatgtttatcagttatcagtgatacacatcactgttggatggaagggaattgatattggcgtctatccaattggtaattga

SEQ ID NO: 106412 - DNA, 150 bp, Glycine max
  Peptide Sequence Number=SeqID_223190
atgggttcaaatccagaaaatagtctttctccttgcacagggcggcccatgtcaaaaactgtaggacagaagaagcaggatgtctcagcaaccaaaagagaagacgatgaggataactgggatctacctgaaggagacactctgtattaa

SEQ ID NO: 106413 - DNA, 198 bp, Glycine max
  Peptide Sequence Number=SeqID_223191
atggtgaatgagtccgggatcatcgttttacagagacagatggatgcactagaaaaaaatttccagagccaaatcctagacattcaacaagccatagctgcaaaggaagataagtttgtgaaattacagcaggcaatgcaagaaaaagtaaaagagtcctgcggagaatcttctgagaaagaggacaagtacatctaa

SEQ ID NO: 106414 - DNA, 222 bp, Glycine max
  Peptide Sequence Number=SeqID_223192
atgttgttcgaaattcaattactcacactttcaacgttgggatttgcgagaaaatattcatggagggagaaaaacgaattgcgtgaggacagtacaagtggaggtttcaatctcttctccgtctctgacgtttgggaattctatcggtgcagtcggaggaataactggaggaatcccaggaaacagctagagatgctgctatcgctggctgaagacacgtga

SEQ ID NO: 106415 - DNA, 339 bp, Glycine max
  Peptide Sequence Number=SeqID_223193
atggtggaggagaatgttggggaatgcttgtgcaatggcttgaagcaaattgagggtagtggctgtgtggctttgtgtaaaggagaaaaacaaaagaaggtaaagcttgattatatgaagctttcaacatcagggttggggcagcagggacatgaaggaggggagaagaagtgtctgaattctgagctatggcatgcatgcacgggccccttggtgtccctaccaactgcagggactcatgtggtttacttccctcaaggtcataatgagcaggttgctgccacaactaacagagaaattgatggacacattcccaattaccctagcttgccaccctag

SEQ ID NO: 106416 - DNA, 1338 bp, Glycine max
  Peptide Sequence Number=SeqID_223194
atggcttcttctaatagacactggccaagcatgttcaagtccaagccctgcagccctcaccaccaatggcagcatgacatcaacgcctccctcatctccactagctgccacagaagcccttactcttcaggaggtggtggttgtgaagagagaagtccagagccaaagccaaggtggaaccctaaacctgagcaaatcagaatactggaggctatattcaactctggaatggtgaatcctccgagggatgagataaggaagataagggcacagttgcaagagtatggccaagtgggtgatgccaatgtcttctattggttccagaatcgcaagtcaaggagcaaacacaaacttcgccatctccaaaactcatcatcaaagaacatgaaccaccatcaccacatgaatgttgatcaacaaaatcatacaattcccactaattcttctctccctcaaaccactactactgcaccctcttcctcgtcatcttcatcgtctgagaaatcttccccaaaagaacttataatacctaccaccaaggtgttctccattggattctccgatgcggtgcctaattctccaacagcttctgtaaaccagacccggattaatgacatcatgcttccaccaccaccaccagttgaggctttcttcttcccagtgcaacaacaacatgatgtgcatcatggagtaacatcatcatcacaagggttttgcttctctgagctgtccaatgttgttcatgctcaacagaacaacgttggcccttgcactagcctcttgcttagtgagatcgtaggtcatggtgctgcttctgctggtgcctcaaagaaagacaagtctcagatgaaaataatgcaccagccctcactgcttaatttctgtgtcactactccaacaacagcaacaacatcaactcctactactaccaccactgttgttgtacctcccatcactactacctctactactgtttcatcccccctcatgcctcagcttcaaggtattggagatccaggtggtgcggcgagatcaacggtgttcattaacgatgtggcattcgaggtagctgtgggacccttcaacgtgcgtgaagcttttggagatgatgttgtgctcatccatgccagcagtggtcaacctgtgctaacaaaccaatggggtctcactcttcattcactccagcatggcgcatatataggaagtggaaagctaaagaatgatgatgatgatgatgaatgcgaggttctctgtcttgttttttttttccttctttttctcatctatatctacgtgtgtttactattagggtaccggttattagataggggtttgtag

SEQ ID NO: 106417 - DNA, 3213 bp, Glycine max
  Peptide Sequence Number=SeqID_223195
atggaaggcaaggcacttgcatggttccagtggatgactggaaatggccaatttactttgtggccggttttccttcaggccctacaaacaagattcgcaccatcacagtacgaagatccaacaagagcattattcaagcttacgcagaaaggttcagaggcacaataccttttagattttgaagacctcgccaatcgcatcgttggcctgccaccagccttcctcctgagttgttttgtctctggtttgacgtcggagatccgtcgggaagtacaagcacaccaaccattgatgttggtccaggccgccagtctagcgtgcttgcaagaagaaaagctgcttgatgtccatcacccaccgtggtcgcgagtccttctggtgacgatagttccgccatacactccatcaccctctccacgcaccgtgacccttccaccaccgttacctccacctggtcgtccggcaccacccccgttgaagtgcctttccctgaaagaaatcgcatcccgccgggagggcgacctctacttcaactacgacgagaaatttcatagaggccaccattgtgcctctagggtttttcttctgatcgcagaagaggacgagaaccctgaccctcatatagtgttgaatgacccgccccccgacccgccaggccaagtggactcccttgacctgtgcccgacccaaataagttttcattctttggcgggtcagctcgcaccaaaaacactacgtatgttgggctcgcttttcggccaccaggtcatggtgctggtggatagcggaagcacccacaatttcatccaacaagagctggtgacccacctgaatcttccatgtcgcatgacctcagttcccttatgggtcatggtgggaaacggtcaacaccttcaatgcacaagcttgtgcgaagaaatcgtcatcgatgtccagtcttcaaagttcactgttgacctccacattcttcccatcttcgacgccaatgtggtgttaggcatccaatggcttaaatccttaggaccagtcctaacgaactataacatgttgtgcatgcaatttatccatgatgaccgtgtggtagaactcaagggcgatacggatgacactctgaacatcatcatcccgtcacaattccgacgtctagcgcgatcccaagcaccgggcctgtactgtcacatatcccttctttcggaagccacgaccatcccacaggaccttcacccagccatccaatcaattctaactaagttcgagcatttatttcaacaacctaattgcttaccgccggagcatgacaccgatcatcacatccatcttcttcctcagatagctccgattaatgtgtggccgtatcattactcgcactttcagaagtgcgaaatcgaagctcaggtggacctcatgcttcagaaaggtctcatacaaccaagcacaagccctttttcttccctggtgttgttggtgaagaaaaacgatgggtcatggcaattctgtgtggactaccgcaccctgaataccattaccattcgagattgttttcccattccaacaatagatgagcttcttgatgaacttggcggtgccagatgcttttctaagcttgacctacttcaaggttatcaccagatacgaatgcactccgaggacatgtccaaaacaacattttgcacccacaatgggcattacaagttcagagtgatgccttttgggttgtgtaatgccccgtcatcgttccaagcaacgatgaacaacatctttcgaccatacctccaccatttcatcattgtgttctttgatgacatcttaatctatagcacgtgctttgacgatcacttgcaccaccttgaattgaccttccaggtggagtaccttggccacttggtctcacatagaggggtagagccagtagcatctaagtacgcagcttcttggggttggccggattttatcgccgttttattcgcggctacgcctcgatcacagctcccctggttcacgtcaccaccttggcgaaatttacttggtctccgcaagctcagattgcttttgaccagctcaagcaagctttatcccaggcaccgttctctcccaaaggaaccaccccataactttcttcagaaagccatttcctcccaaactgctccacgcctcagcgtatgtccgcgaactattcgccattacagcagcgataaagaagtggtggcagtacgtgcttggttgtcgcttcaccataatcacagaccatcgaagcctcaaggaactgttgacgtaggtgatacgggcgctagagcaacacatggctgcatttggttaccaaaagacttggtgctgattcctacattgttactagagtaccatacaacccccaccgacggtcacatgggagctgtgaaaacgacagcccgcctgatggaaaattttgagtgtaccccatcgaccctaggaagacttgtccctggatttcatcaccggtttgccgccatatcgtggcaacactgtaatcctggtggtagtggacagggaagcttcacggctcgcctcacagcttggtctctaactgcgaccccctgttcgaatggggcaggttcctcctctgggtggagtggtcacacaacacctcctggaatgcggtcactggcactaccccattcgaaattacattctggtgcaaaccctttaactttcccgaatatattgcaggttcatcgactttgggtgctgtttgacgaaatgttgaccaacatggaagaaacgtttcaggcaatacgcaagaaacttctcagggcacaggaacgtatgaagctaactgcaaatgccaaaaggagagaggtgtcttatcaacctggggaatgggtgatgctcaagttaagacctcgccgacaagtttcgcttaaaggatcactagcagtcaggggcaagctggctaaaaggttctatgggccatttcaagttctcaagcgcataagacctgtagcctaccgcttgaagtttccagaagaagctcaaatccaccctatgtttcattgctccttgttgaaagctttcaaagggtctccagaccacattcagaaagtagacttacctatgcaattcgttcaacaccaaccagtcattactcccttagccttaattgattatcgccggtcatcggaaaacgcaccctgggaggtgttagtgcaatgggatggactgtcacctgatgagacttaa

SEQ ID NO: 106418 - DNA, 1026 bp, Glycine max
  Peptide Sequence Number=SeqID_223196
atgaatttggcgggaaatgacaacttgattaagaaagagaacattgttgacgtgtgtcgtgcgctgaagcgggaactcaagaacacacaaaaagaagaagaaaggaaatgcaaggaggaggagaaggccaaaagggtgctggttgatattgtaaaattagcacaaaaaagaggcctaaaaggtttgagtgatccatcaaagagatcccatgaggtattggctgcatttctaaagacattttcaaaggaggaagagttgaagttttttgataacatcatgcgacatcatttaaatcaatacatgttggagcgactgaaagataaatctcatgattcccctgagcaagggtggatagttataaacttcaaaaacaaacccaaggtgattaagtcaactgaaatggttgttgttgactgcgaaatggttctctgtgaagatgaaactgaagcggtagttaaagtctgtgtgctagaagaacttgtaaaaccaaacaaagaaattgcagactacagaacaaagataactggtgtctcttctcaagatctagaggcagtgacttgctccatggctgatatacagtttatcagcaattgttgtctagatgatgcaaaagcagctatggaccttgttcttgcaaagatcaaacatggagttgataaggaatttccaattgcattagttcaagagcatgtttcaaaaagtgagctggcaaagcttcttcttcacaagataccaaacactgtaaacattgaaacattgcataaaattcttcctggagatttcaaaattgaactgaagctaggtagtgtgtcctatgagtatctcaatgttatgagaagaggtttgttgccttccaggaaaggtcaaggagcaagttattctgcctttgcaatttttaaaagtccacaagaggcagatgaggcctacgaaaatgtccaaggaagccaattaaagttgtatatcacctatgaagcaccgacaccggacacgacacagacacggacacgtggacacctgaaatgttga

SEQ ID NO: 106419 - DNA, 1350 bp, Glycine max
  Peptide Sequence Number=SeqID_223197
atgaatacctttacacaactcagacccttgataaaacatagccttgtcccgtgttctgtatttgagacattatatgtcaatctgtctgtgtcgtatctattgtccgtgttagagtttgtgcttataggagaaccaaaaggatcaaagtcatcatcacatgtaggggttatagttggtgcagtagttgctgttgtggtctttgttgtactggcattctttgcagggaggtatgcccttcgccagaaaacaagagcaagaagatcttcagagttgaacccttttgcaaattgggaacagaatacgaatagtggcactgctcctcagttgaaaggagcgcgatggttttcttttgatgacctaaggaaatacagcaccaacttctcagaaaccaatactattggatctggaggctatggaaaggtttatcaaggaactcttccctctggggagttggtcgccatcaaacgggctgcaaaagagtctatgcagggtgccgttgagtttaaaaccgagatcgaacttctatcaagggtccatcataagaatctcgttggtcttgttggtttctgttttgagaagggtgaacaaatgctggtgtatgagcacattccaaatggcactttgatggatagtctctcgggaaagtctggaatctggatggattggataaggaggcttaaagtagcattaggtgcagccaggggtctggcctatcttcatgaacttgctgacccacctatcatacacagggacatcaagtcaagcaatatcctacttgatcatcacctcaatgcaaaagttgcagattttggtctctctaaacttcttgttgatagtgaaaggggccatgtcactactcaagtgaaagggacaatgggatacttggatcctgaatattacatgacccagcagttgactgaaaagagtgatgtatatagctatggagtgctaatgctggaactagcaacagcaagaaggccaatagagcaaggaaagtatattgtaagagaggtactgagggtaatggacacatcaaaagatttatacaaccttcattccattctagatccaaccataatgaaagcaacaagaccaaaaggtttagagaagtttgtgatgttggcaatgaggtgtgtcaaagaatatgcagcagagaggcctacaatggctgaggttgtaaaagagatcgagagcataattgagctagttggattgaaccccaattctgaatcagctacaacatcagaaacttacgaggaagcaaatgcaggaaatgctcaacatccttacagggaagaagattttagctatagtggaatttttccatcaacaagggtagaaccccaatag

SEQ ID NO: 106420 - DNA, 657 bp, Glycine max
  Peptide Sequence Number=SeqID_223198
atggcgatcgcgccaacaatgattaatatcagacgcaaatcctgcatcattatattctctgttgttccaataccttgccaccacggcaaactttatcctctaactgtatttgcccagctacacaactgccccacgcttttttgctgttttttcgcgcaaagtgcgcctgtcaccgataaaaagccagggctggaaactggtgcgtctgccaggtatccgccgctacgtcatcatcccgctgctggtaaacattgtgctgctgggcggtgcgtttatctggctgtttcagcgcctcggccagtggattccacagctgatgtcgcacgtgccggactggctgcagtggctgagctatctgctgtggccgctgtcggtgatttcgattgtgctggtattcagctatttcttctccaccatcgccaactggattgccgcgccgttttgcggcctgctggcggagcagctggaagggcgtctgaccggaaaacccctgccggacagtggctggctcggcatgatgaaagacatcccgcgcatcatgaagcgcgagttacagaagctcggctactatttgccgcgcgcactgggcctgctgctgctctattttatccccggctttggccagaccgtggcgccggtgttgtggtttctgtttag

SEQ ID NO: 106421 - DNA, 328 bp, Glycine max
  Peptide Sequence Number=SeqID_223199
atgttccgtgatcgcccactgaaacgtatgaagtctcgcgacgatgaaacatcggaagacgatgactttgatgacgatgttgaaggcgtacgtgaagttcgcgtacaccgggttaatcacgccccgaacggcgcatatggggagcaagaatcacctcgtcaggcgccgcaacaccagtatcagcctccttatgagcgtcaggtgcagcagcctgtgcgtcaggacgagccggttcatcatgcgccgtcgtacgcgccgcgcccgcagcagcctgttgctccgctgcctgcgtgcccagtcgccgcatcatgttgcccctgctcagccg

SEQ ID NO: 106422 - DNA, 174 bp, Glycine max
  Peptide Sequence Number=SeqID_223200
gcagcggagcaacaggctgctgcgggcgcggcgcgtacgacggcgcatgatgaaccggctcgtcctgacgcacaggctgctgcacctgacgctcataaggaggctgatactggtgttgcggcgcctgacgaggtgattcttgctccccatatgcgccgttcggggcgtgattaa

SEQ ID NO: 106423 - DNA, 480 bp, Glycine max
  Peptide Sequence Number=SeqID_223201
atgttccagcaagaagttaccattaccgcacctaacggcctccatacccgtcctgcagctcagttcgtgaaagaagcgaaggctttccagtctgaaatcactgttacttctaacggcaaatctgccagcgcgaaaagcctgttcaaactgcagactctgggtctgactcagggtacggttgttacgctttctgcagaaggcattttagcatcaccgggtatcgctttcggcaaagcactgctgctgaaggaagacgagatcgtcatcagccgtaaaaagattactgacgaccaggttgagcaggaagttcagcgcttcctcgacggtcgcagcaaagcagccgggcagcttgaagccatccgtgtgaaagccggtgaaaccttcggtgaagagaaagcggcgatctttgaaggtcacatcatgctgctcgaagacgaagagcttgagcaggaaatcatcgacctgattaaaaaagatcac

SEQ ID NO: 106424 - DNA, 1095 bp, Glycine max
  Peptide Sequence Number=SeqID_223202
atggaccaacaacataaagtgattcctctgctgctgcttcttttccaagttctgcttgtagcatctcagacagatagtcaagattattctggcctaaattctcttacggaatcctggagtaacaagccacaaaattgggtgggtccagatccttgtggcagtggatgggatggaattcgttgcagcaattcaaaaattacccaattgagactaccaggcttgaatttggcaggacaactgtcttcggcaattcagtctttatccgaactagatactttggatctttcttacaacacaggcttgacaggaacaattccacaagaaattgggaacttgaaaaagctaaaatccctatcattggttggttgtggtttctctggtcctattccggattcaatagggtctttaaagcagctgacatttctagcacttaattctaataggttcagtggaactataccacgctctcttggcaatctatcaaatattgattggcttgatcttgctgaaaaccagcttgaagggactattcctgtctctgatgaccaaggaagaccaggccttgaccttctccttaaggcacaacactttcatatggggagcaataagctcactggtacaataccagaagaactctttaactccagtatgcatctaaaacacctgcttttcgaccacaatcaactagagggtggtattcctgtctcccttagtactgtgagcacattggaagtagtgcgctttgataagaatgcattaactgggggagtgcctgcaaacttaagcaaactcggaaatctaagtgagatctatttatctcacaataacctgaatggatttctgcccgattttactggaatgaatagtctcacctatgtggacctgagtgacaatgatttgaatgcttctaatattccttcatgggttacaactctgccaggactgacaacggtgatacttgggcagaacctgctcggtggcacattaaatcttagtggctacagcaacagtctgcaactcattaatttggaggataatgaaataacagaacttgatccacaaaacaacctaccaaattttgagctaagatggtag

SEQ ID NO: 106425 - DNA, 225 bp, Glycine max
  Peptide Sequence Number=SeqID_223203
atgggtcaaaacacaaaaacatcaagagcactcaaggttcccaaacgtcagagagaagaagggattgaagcctccattttatactgtcttcatgcgattctagtgccgccgcaagaggttctagtgccgccggtcacggagttacagtgccacaagaggttgcaaatcagagtgccaaagcgttcaagtgagagtgatgagagtgagaggtttcaaagttattga

SEQ ID NO: 106426 - DNA, 228 bp, Glycine max
  Peptide Sequence Number=SeqID_223204
atgatccgggctttgtgcgggttttcccataaccttgccaaggatcgcagctatgaggtggtggccaccgaagtcttaagccaagaaccgttacggtgcgttatctcatgcgaagaagatttgttgtgcattaagagattaggagaagattacaatgatggctctctcggtgattggactaaaatgcttccaggattctcaatttttgttgatccaagagaagtttga

SEQ ID NO: 106427 - DNA, 2229 bp, Glycine max
  Peptide Sequence Number=SeqID_223205
cgcgtggcgctggcgcgtgcgctggcagttgagccgcagattctgctgctggacgaaccctttggcgcgctggatgcccaggaagaagcgatggaagtggcggatagcgtggtggtaatgagtcagggcaatattgagcaggtgggcgcaccggatgacgtgtggcgcgaacccgcgacccgcttcgtgctggagttccttggcgaagtgaaccgctttgacggcgaagtgcacggctcgcagttccatgtgggcgcgcatcgctggccgctgggttatacgccagcgcatcagggcgacgtggagctgttcctgcgtccgtgggaagtggacgtgtcacgccagagtagcctggagacaccgttgccggtgcaggtgctggaaatcagtccgcgtggccacttctggcagctggtggttcagcccgtcggctggcagagcgagccaatctcggtggtattcgccggtgaacagacggcgccgatccgtggcgaacggctgtttgttggtctgcaacaggcacgtatctaccagggcaccacgccgctgcgcccgcgcctgacgccggataacggcagcgaaatctggctcaagctggaaggcaacaatccggcaggttcggtgaaagatcgcgcggcctggtcgatgatccaccacgctgagttgcggggtgaaatccagcccggcgacaccctgatcgaggccaccagcggcaataccggcattgcgctggcgatgattgccgcgctgaaaggctaccggttacgcctgctgatgccggagaacatgagccaggagcgtcaggatgcgatgcgcgcctacggggctgagctggttttggtgacacgcgagcagggcatggagggcgcacgcgatctggcgcaggccatggcgcagcgcggtgaaggcaaagtgctggatcagtttaataatcccgacaacccgctcggccattatctcaccaccggtccggagatctggcagcaaagccacggtcgtatgacacattttgtctccagcatgggcaccaccggcaccatcagcggcgtcgggcgctatctgaaagagtttgctccggcggtgaaagtgattggtttgcagccgcaggagggcagcagtattcccggtattcgtcgctggccggcggcctatctgccggggatttttcgtccggaactggtggatgaagtgatagatatggcgcagcaggaggcagaagagaccatgcgcgcgctggcgcagcgcgaaggcattttctgcggcgtcagttcaggtggggctgtggctggcgcattgcgcatcgcgacggcgcagccgggcagtgtggttgtcgccattgtctgcgatcgcggcgatcgctatctctccaccggcgatcgcgtaaaaccggctgctttcccgcggcactcaggacaaaatagcggcaattttgtacgagagaaaaagatgaaaatcctgcttgttgatgacgatgttgaacttggcaccatgctgagccagtacctgattgccgaaggttttgaaacccagctggtgctgaccggcagcgccgggattgaaggggcgttatccggacactacaccgcgatgattctcgacatcatgctgccggatatgagcggtattgatgtgctgcgtcaggtgcggcagaacagccgcctgccggtgattatgctgacggcgaagggcgacaatatcgatcgcgttatcggcctggagatgggcgcggacgactacgtgcccaaaccctgctatccgcgcgagctggtggcgcgtctgcgcgcggtgctgcgtcgctttgaagatcaggcaccggtgccggataagaaagaggtcctgcgctggggcgatctcagcctgaacccggctacgcgtatcacggagtggcagggcaaagcttttgatctcaccgcgtcggagttcaatctgctggatctgctgctgcgcgcaccggaccgcgtggtgtccaaagatgagctgtcggaaaaggggctgggccgtccgcgtgaagcttacgatcgcagcgtggatgtgcacatcagcaacatccgccagaagctggctgcgctaaccgcagacagcgtgaatattgaaaccgtgcgcagcattgatcctgctgggcttctggattgtgtttgtgattatcagccagctgctgtggctgggctttaccttgtcaggaaaccgtcacgagccgccggagattgtggcggtgcgtcggatcgttaa

SEQ ID NO: 106428 - DNA, 220 bp, Glycine max
  Peptide Sequence Number=SeqID_223206
atgggctcaaaaatctaccctaaagttaatgagaaccctaaggccttctttatcagctctagcccaatcctcttggagccttttgctcatggctctgatcctagaggtgaaggagacatcctcacctcttgtattgttgcaatctttcatcttgttcttctctttgttgttaagaaggcttcttggtatggaaagctaaatcctctgttggatcttccct

SEQ ID NO: 106429 - DNA, 823 bp, Glycine max
  Peptide Sequence Number=SeqID_223207
atgcccaaatcttgtgaatttgggatgattggccctcttgatgagtcgatctcttgcttactcataaggttggacccttgggtactagtacgtatcgccatcagaggattgcacgtcgtcgcctttaaagggctatatgccctcgcctccagaggactacatgttctctccttcagaggactacacgtccttgccttcaaagggctacacgccctcaccctcagaggactacacttcctcaccttcagaggactacacgtcctcgcctccagaggactacacatcctcgccttcaaagggtcatgtaccttcgccttcggaggactacacatcctcgcctccagaggactacatgtcctcgccttcagaggactacacgtcctcgttttcagagggccacacgccctcgccttcagaggactacacgtcctcgccttcaaagggtcatgtaccttcgccttcagaggactacacgtcctcgccttcaaagggtcatgtaccctcaccttcagaggactacacgtccttgccttcagagggcctcacgccctcacctttagaggactacacgtccttaccttcagaggactacgcgtcctcgcctttaaagagtcatataccttcggcttcagaggactacatgtcccccttttcaaagggctacactccctcgcccttagagggcaacacgccctcacctttagaggactacacgtcctcgccatcataggaatacactccctcgccttcaaaaggcaacacgtcctgaacttcagagggctgcacgcccccgcctttagagggctacgcgtcctcactttca

SEQ ID NO: 106430 - DNA, 174 bp, Glycine max
  Peptide Sequence Number=SeqID_223208
atgggaagaggagagaagaggaatagacgcgtgaggagagaagaggagcagctagtgagtggagagaggaatagacgtcgtggaaagaagaggaacagacgtgtgggtaaatatgatgtcgtaaaaaagggtttttccagtagtgcacgtgccaatgtttgtggaggacactga

SEQ ID NO: 106431 - DNA, 189 bp, Glycine max
  Peptide Sequence Number=SeqID_223209
atggagacaggggaacaagggacgggcgacgagggagggtccgacgccgagggaggggtcggcgccgacctcccgcggcggtttatggagtgtttcgggaagaggaagaggcattacattggggagaggaaaaaggcattggaaatcactgtagcgattgaggagatcaagaaagaggtcagcatttaa

SEQ ID NO: 106432 - DNA, 324 bp, Glycine max
  Peptide Sequence Number=SeqID_223210
atgagggagccatcaccggtgggattcgaaggcaacgacgttgttccgccgcaagctctcctccagagactgaaagactacgatcaagaacacgctttcgccctctgtttagatctttcaagaattgaccggattattcaatgttcgctgcgatctcaaggactgccggtggtggccattgagcctgtgccggagagcagtgtgtcgacggtggtggagagaagtcaagaggatcgagagagatggtggaaaatgggattgaaggccatttttgatggcaaattagctgtgttgcttttatctggtggccaggccaacctgtga

SEQ ID NO: 106433 - DNA, 303 bp, Glycine max
  Peptide Sequence Number=SeqID_223211
atggaggttctgtacaggaagctctatgacaagtacaccagactaaagtctaacaaactttctgatttggatcacctcaacgaagaacaagaactcaaattcagaaacttctcgtccgctgcggaagagttgatagagcacttgatgaccgaaaaggaagagcttcttggacaagttcatcacttgagaagcgagctcgcttcccttagggctgccaaagacaaccaggttgttgattatcagaggcttttgatggaggaaacccgcaaaagtgagtctatccatcgattttctgggtattaa

SEQ ID NO: 106434 - DNA, 477 bp, Glycine max
  Peptide Sequence Number=SeqID_223212
atggattggattgtggatgtgggactgatacatcaggcagacacacaaaggtgtgttgctggaacctctaaccgtcctcgaacttttagacagaaagaagctgagcatgaagaggagcctgaggaagtatctggggatgaatctggagaagaatcagaagaggaaacttctaagaaaaaaggaacacaaggagttattgagattgaaaatcctaacttggtaaagccaaagagcttgaaagctagagatgttgatgttggaaaaacaacagaactttcaaggcgtgaaagagaggagatagagaaacagagagcccatgagcgctatatgaggctgcaagagcaaggaaaaacagaacaagcaaagaaggatttagaacgtttagctcttatacgtcagcaaagggaagatgctgctaaaaagcgagaagaagagaaagctgcgaaagagcagaagaaggctgaggcgcgcaagtga

SEQ ID NO: 106435 - DNA, 1578 bp, Glycine max
  Peptide Sequence Number=SeqID_223213
atggaaattcgctccttccgccaggaagattttgaagaagtcattacgctctgggagcgttgcgatctgttacggccgtggaacgatccggaactcgacatcgaacgcaaaatgaaccatgacccggagctgtttctggtggctgaggtaggcggcgaggtcgtgggcacgctgatgggcggctacgatggccatcgcggctccgcctactatctggcggtgcaccctgattatcagggccggggatttgccaatgcgctgatgaaccggctggagaaaaagctgattgcgcgcggctgcccgaaaatccatctgatggtgcgcgaagagaacgatcaggtggtggctttctacgagaagctggattacgagccggtcgactcactgctgctgggcaaacgcctgattgaagaccgcacgccagtcggcacaaaagaaaggagtttgcatgaaagttgttcgtcccgccctgctggtcagcgccctggtgctggccggttgcgccagttccgttcgctcaccgtcaccgagcagggcgtcgccgggctgaacagcaacacggcaatgtcggagtccgccattagcgccgcgctgaacaatgattatcagctgcgtcagggcatgcgcacgcagaacgggcaggtagtggatttctggcaggcgctggatgacggtaaggttaagctggtgattaatggccagcgtagcgtcgagcgcattgaagtgctcgatagcgatgcgcgcagcgccgacggcagtaaaatcggtgatgcgttcagcgataaattcagcaaagcgtttgataattgcaaaatggttgccgggctggatgtgcgcgatgttgagtgccgcgcgccgggtagtcagcatatcgcctatatctacagcggcgagtggcacggtccgaccgggctgatgccgtcagatgatacgttaaaaagctggaaaatcagtaagatcagcattgtcatgtctcagtttcagagcgggatcctgctggagcaccgccgttttgccatttggctggaagcccgcgccaccggcgacctcgctgcgctgcgtcagggttgccacgcctttctgcaacagctggctgcgctgcagcagcaattcccggacgccggtctcggtgcggtcatcgcctttggtgatgcgctgtggcgcgatctgcagggcaccgactcagctcccgaactcaaagctttcacgccgctcggcaaaggtgccgcaccggcgacgcaacgcgatctgttgatccatattcagtcgctgcgtcacgacgtgaacttttcgctggcgcaggcggcgctgacggcgtttgccggcgcggtcgccattgaagaagagacgcacggtttccgctgggtcgaggatcgcgatctttccggttttgttgatggcaccgaaaacccgcagggcgaggcgcgccagcaggtggcgatcattgctgacggcccggatgccggcggcagctatgtgtttacccagcgctgggagcacaacctgccgcagttcaaccggctggcgattgataagcaggaagcgattattggccgcaccaaacaggacaatgaatag

SEQ ID NO: 106436 - DNA, 1383 bp, Glycine max
  Peptide Sequence Number=SeqID_223214
atgacacatggtgtatgttgtgacgaggaaattgtgaacatgtttgaggtgcttttcttacctgctaggaaagttaaagaaaaagccgctaagctcaggaattctttccctaaagatctattttccggctctgggtctaagaatgtacttgctatgacctttaggcaagtagttttgcagcagatttggagctttgacctaactgtctttcaaccgggagaggaacggaagatggttgatcttgaaacaccgagagaggttcctgcatcttttgctcttagctcagctgatgaatatcttatctcagtgcttgcagaagcgatttgcatctctgcacttcaaagcacccaaatacaatttcttgagaaagtcaaaggtggtaatagaggtggtttctttcgctggtttcgaaagcctgaaagtgtgcaatcaaaagattctgcagttatcttatccaaattatttgaagatgagatagttgaaaatgctaggagtctattggataactataatttaatgaaggatggcttcaagcctgtgaaaattaagtcagggcatcattggtggaagtcatcatgttatgaaaagttagagaaaattggtggttctgatttcagtgcttgggcaagtgagtatgtacctgcatatcggttagagattgacaccaagatattgggagattccaaaattggaggctggaagaagtctgcagagaataggtgggaagttcttttgacccactctcaaatggttcagttggctgaaacactagatatatactatgtggatccttattccctacctaataaacaattatcctgcggtgtggctgccaagtttgcaaatgtgtccaataaaaaggggaattcttttccaaaatttttgtcacttgcccttgcaagtggtatatttcttgtagcaattagtgctctgggtcaattttgtttgccttggttatgcaaggaaaggaaacactcagtagaacatagatctctaccatcatctgaagtcgatgttgcaatcaatgacttttttgatacacaaaagttggaagagtattgtgtgttagctattgccaaggcaaagggcacttttggctggtcaggtgaaattaaggtggaggatggtattggtgtatggattggagaattgccggcttacttgagaggtgaaggtgtcgatactctttctacttcagagaatatagatgcagatgcaaaagtgtccatacaagacattgctagttaccaggtggttttctctagcgagggaaagatagttggtttccaacctttgagtcgtgtggctgtcaatcattggtctgttaatcctttagcaagggagctatatggagggaaaaagctttctccaagtaggatctaa

SEQ ID NO: 106437 - DNA, 1365 bp, Glycine max
  Peptide Sequence Number=SeqID_223215
atgaagaaaatttccaagagcagctgcaagtcagcatcacacaggctctttaaggacaaggcaaggaaccatgttgatgacctgcaggagagccgtactatcgatgctgcacttctcgaggagcaagtccatcagatgcttcgcgagtggaaggccgagcttaacgagacatctcctgcttcctctttgcagcaaggtggtagtcttggttcattctcaaccgatgtctataggctattgcagctctgcgaggaggaagatgatgccactagtccattagttgcacctaagtctgaacctaatgatcagattatgcaggctggggctaaggtgatagtccaagagggccaacatcaacaggaattccgattacttaaagaatgcaaacactccactgtaggagttcccaacatagcagcaaataacttggatggaactgctttagagtatcaccaatttgatatcaaggacttggatcacagcttctatgccggtacaggtttttgtgaggaaggtggtgttcctcacatatctagctatcttccaagtgtgtgccctcctccttctgctttcttaggcccaaaatgcgcgctttgggactgtccaagacctgttcaaggcttggactggtgtcaagactattgcagtagctttcacgccactctagctttaaacgaaggaccaccaggcatgaccccagttctaagacctgggggaattggactcaaggataatttactttttgctgctcttggtgctaaggcacaaggaaaagttgttggaatcccagaatgtgagggagcagcaactgcaaaatctccatggaatgcacctgagctctttgatacttgtgttcttgagggtgagactattagggagtggcttttctttgataagcctagaagggcatttgagagtggaaacagaaagcagaggtcactgccggattacagcgggcgagggtggcacgagtctagaaagcaagtgatgaacgagtttggagggctgaagagatcctattacatggatcctcaacctttgaacctttttgagtggcacctttacgagtatgaaatcagcaagtgcgatgcgcgcgccttataccggttggaactaaagctcgtcgacgggaagaagagctccaaggcaaagatagtagtaacaagtgattcagttgctggtctgcagaagcacattggaagcctctctgctaaaggtagaaccaagcttggcataggaggtggtgtttattcagcttctaacagagttgctctacaactaaatgcaccttatcaatacggcttaacttcttcaccatatgatgactatgttgttgacaacacaagagactattatgtgacatga

SEQ ID NO: 106438 - DNA, 574 bp, Glycine max
  Peptide Sequence Number=SeqID_223216
aaagatcatacctgaaaggaatgtgcaattgtcgttcaatgactttgaggaatttcaaaggcagttaaataggaggaactggcataagaagattgcaaatttggtagagggaagcatagatgtggcacttgtaaaggagttttatgcaaatttttatgatcctgaagacaagtcaccaaaacaggttaaagttagggggcattggattccatttgactcagctaccctcaactcttttttggaaacacttgtggctatagaggaaggagaaagtcttccggcatatgcaagatttgttttgctaaggccaaatcagcaagagttagcagcctgtttgtgtatcctaggcaagggatttgaattgaattcagacggactacctttgaagattttaagaaaaaacttgactactcttgctcaaacttggagtgtcttttctttttctaacttggctcccacctctcatacttctgacatcaatttagatagggacaagttagtatatgcactcatacagaagatggatatgaatcttggatctttcatttctagtcagattacacttatggcctag

SEQ ID NO: 106439 - DNA, 249 bp, Glycine max
  Peptide Sequence Number=SeqID_223217
atgatgcccaaccaaatttcgaactgcgagagcctcaacggtactctgaacagacaacctcaggcacctggaactatcgagaacactaacaatctcaccagtgcttcctccatcgtcggaaacggggagaatgtgagcgccgcgggtggtgaaattcttgagctcctcgacgacgccattgaaggcagtcccactggaaaagacgagcaaagagggctgagggtgagggtgaggagggttaaggtttga

SEQ ID NO: 106440 - DNA, 666 bp, Glycine max
  Peptide Sequence Number=SeqID_223218
atggatgctggattatgttcagtctgtggtgaagaaagttttgggacaggttctgaccgtattcgtgagaaagatggaatctgggaagttttggcctggctatctatacttgcatataaaaataaagataaacttgaagacaagcttgtcactgttgaagacataattcgccagcattggactacttatgggcgccattattatactcaatatgactatgaaaacgtggatgcaggtgcagcaaaggaactgatggcatatttggtcaagctgcagtcctcactttcagaaccagaaacgaaaagggcactgctaaacaaaagttctgaggataaaatacaaaagtatggtaggtccaaagctggatctcgtgtggttccatatcaagaagatgagagccaagactcagttcctgtcagtatcgtctctaaagatctccaaaggaatgacaaagagagtgaagatctccaaaggaatgacaaagagagtgaagatttatggctgatccgtgatcagttacatcaaattgagaaccagcagtcaagtctacttgatcttctgcagcatgaaggtgcttctcaagcctttgaagatgctcaaaagaagatgaaaagcatatcagaaacagtgataatttgcagcatgaaggtgcttctcaattcttga

SEQ ID NO: 106441 - DNA, 360 bp, Glycine max
  Peptide Sequence Number=SeqID_223219
atgttggacctgcaagacgtgtttcagagattctcttttgacaacatctacagattctccttcgggttggaccctgactgtctaacaagacaatcggggttcacgcccgtgtttgtaaaaaacttcgacctgacattgaagcttttcgcagaaagggcgacaacaggatcgccctttgtctggaaactgaagaggttgttaaacctcggaagcaggaaacagctcaagaaagcagtcagagtgattaacgtgttggttagagaagttatacagcaaagatgcaaaaagggtttctccaaaaacaaagacttgttgtcaaggttcatgaacacgattcacgatgatgacacatatttatga

SEQ ID NO: 106442 - DNA, 281 bp, Glycine max
  Peptide Sequence Number=SeqID_223220
atggagttggcgagttggacacgtggcagcagctggtggaactcgccagtggagatggcgagacacggtccacgtggcgggttcgtcggggttagtggtggttccgtcgaggatctaattgcgtgcggtggtgatgggtggtggctcaaatttgggtcgtgtgaggttgatgagtttgtgggtttggtgtgcgtaaggttcgtcggtgttagtggttgtttcactgcagatctagtcgcgtgcggtggtgatggattgtggctcgggttggatctcgaagg

SEQ ID NO: 106443 - DNA, 244 bp, Glycine max
  Peptide Sequence Number=SeqID_223221
atggaggaggaagttccgctggaaacggagaaaccagtgagaggttccatggtcgaagattgtggaggttctgttgaggttagagacgtgagggaaaaggaagatcgagaagcagcaacaaacgaagatgaagataaaatttacattcgtatggaatctgaagtaaaccctagatcgtggttcgagcacgggaggagacggaaagtgaaactgagggaagcgatggatttgatcatgagaaatg

SEQ ID NO: 106444 - DNA, 153 bp, Glycine max
  Peptide Sequence Number=SeqID_223222
atggaaggtctctggtcggtgttcggggagtatgaattagcttcctatggaatcggaagggaaaatatggttaagtctctctgttacggatatacgacagctctgtttgctgctcctttccttggcgtgctctcggatttgattatagcgtga

SEQ ID NO: 106445 - DNA, 234 bp, Glycine max
  Peptide Sequence Number=SeqID_223223
atggctcgcatgcttgtgtcaatgaagaatctgctgaaattttttatcttcgcagccatggttattgttcaattctcacatggtgtgagcttcaaagacagatgtcatgaattttgtcataatattccaaaggcaaactgtgatgcctactgcaaggacaaccactatcagaaaggggaatgcatcccaccttatccagctggagatagcttatgttgttgctctggtgattaa

SEQ ID NO: 106446 - DNA, 594 bp, Glycine max
  Peptide Sequence Number=SeqID_223224
atgtggaaaggagttgataaaaggatatggctgttggcatgggcacaaacttgccttcacttctctattggaattttttggatcctctgggcacctactgtggtggctgatggccgagaagtgcatctgggattgatatatccatgctttctgggctctagaatgctaggaagcactgcatttccgtgtctcactagtgggccatcatcgcttagaactgaggactgccttgtttttgcatacattatactggctcttctcctgtctattgtggcctatgactatcaggaagttggggttctggtgatactattttgcttgtttcatgcttgtgtcgggtttgttttgccatcacttgctagattgaggaccatgtatgttcccaatgaattgcgtggtgggatgatgggtttctctcttgcccctgcaaatgcagctattctgctttctgtggtgcagggtggctattatcggaatgtaggaaatgcagcattgatggcatttggtgtgtgtggtttattgctagcagctggttgcatgcatgccctgaagcaatgggggaagcaaccttataacaattggcataaacagtga

SEQ ID NO: 106447 - DNA, 396 bp, Glycine max
  Peptide Sequence Number=SeqID_223225
atgaagcatagaacattgatggtgaagcatatgcattggtatgaagtgagtgagaaagtttcagtttgtgaatgtagatgcactagagcacgcttaccaccaagcaaattttggctatttgagcctcgttgtggcttccatgacatagggggttggtacgttgaaacatatggcaaagataagaatggtcgtacaatgccatcacaaaggttctgggatggcttggactatagtgagcaagctgacagaagacttcatccagcaatgtatctgtttgctcttgcatatcggacacttgatcttgaatatgccaaagcaagcaagaaatcatttaggaatgttgttggagcacaaatgttccgaattcttcattggtgcaagaaacttgttcaatag

SEQ ID NO: 106448 - DNA, 456 bp, Glycine max
  Peptide Sequence Number=SeqID_223226
atgacactgattagatctaacatagatgacgataatgaggcaacagtgactcattttccaagtggactaaaccatgatattagagatgttgtggagctgcaagagtatgtggagttagaaaatctgttgcacaaggcagtgcagttgtgctctttcatagttgttagtggaagctacactaatgtggccagttccagattagtgtccaaattaaacttggagactaagccacatcctaggccatacaaacttcaatggcttagtgaagatggagagatgacggtgagtcaacaagttgaggggtgcctctcagttggaagatataatgatagggttttgtgtgatgtggttccattggaggcaagccatatcctcttaggaaggccatggcagtatgacaccaaagctatacatgatgggttcacaaataaaatttctttcaggcacaatgaatag

SEQ ID NO: 106449 - DNA, 1038 bp, Glycine max
  Peptide Sequence Number=SeqID_223227
atgcatttggttcggataatctcagtcctaagggggttaagcgcatcagatggacggtgcataagaagcccacgtggacaagaagcttctccacataacttagaggcaggacaaaatgtctactgttcactaattccaagtgcaagacaagccagaccaggcaacagttatggctcattgatcatccataatcacaaagcttcaaaattttctcaccggatttccatcaaggctaaggccataaaagatgagatggatggagaaacaagcggatcttcaggacgtagctgggatcctgggttggaaattgaagtcccttttgagcagaggccggtgaatgagtactcatctctaaaggatggaatcttgtattcgtggggtgaactgggtccggggtcgttcttccttcgccttggaagtctctggctggcagtatttacagttcttggaggaccaattgcagctgcaagctttaatccttctaaagagcctctaagatttatactagctgctggaacgggaactctcttcattgtgtctttgattgtcttgaggatttatctgggttggagttatgtcggtgacagacttctatcagcggtcatcccttatgaagaaagcggatggtacgatggacagatgtgggtcaagccacccgagatcctagctcgtgatagattgttgggctcttacaaggttaaaccagtcgttaaactgctgaagcaaactctagttgggacaggagcattgcttgttacaggagtaatgctatttatctttgctacaccagtggagaatttttttcgaactacctttaccaaagaagaaattaaatcaactgttcaagctcccaaggttaacacaaagctcctaagaaaagaggagttgcttaaattgccagtggaggtgataactgatgatgatctagcagcagctgctgctgaggctgctgatggaagacctgtctattgtagggataggtattatcgagcattagcaggagggcagtactgcaaatgggaagatctgctcaaataa

SEQ ID NO: 106450 - DNA, 792 bp, Glycine max
  Peptide Sequence Number=SeqID_223228
atgaacaagctcgacttgccttccgttttccttatttgcatcttcttcttcctcgctggattctctgcttccagtctcttctctcactctcaggtttcccttctcaatactcctaatcacaaacatgaatatgacctgaggctgagaccgagaccgagaccgagagcgaggttacttgaaaaatcgacgcaggagaagacggagtatcatttgttgaaagccggagactccggcgacgattacgttacattgattccttttcaggttttgagttggtatcctcgcgctctgtattttcctaattttgcgagtgcagaacaatgtgaaagcataattgaaatggcaagaggaggactcaagtcatcaacattggcattacgcaagggagaaacggaggagagtacaaagggaatcagaacaagctctggtgtttttatgagtgcttctgaggatgaaacggggattttagatgccattgaggagaaaattgcgaaagcaacaaaaattccaaggactcatggagaggtagcttcttttttgctgtatttaactgatgttccagaaggtggggagaccatgtttccgtatgagaatggattcaacagggacggtaatgtcgaggactgtattggtttaagagtaagaccacgcaagggggatgcgcttctattttattcattattacctaatggtactattgatcagacatcagcccacggaagctgccccgtcataaaaggagagaagtgggtggcaacaaagtggataaggaatcaagtgcaggacgattag

SEQ ID NO: 106451 - DNA, 2193 bp, Glycine max
  Peptide Sequence Number=SeqID_223229
atggccaaatccaaaatgccagcaagcttcaaccaccattcagtttggtataaatcgattatgaaatcaatatctaactcaacagagatgctctacacctatgacaacacaatccatggattgtcaacaagattaacactggaagaagcccgattattgaagagtcaaactgggattctaaaggtactaccagagaaaatatataagccactcacaactcgaacaccaaaattcctcgggttagataaaatcgctgatatgttccctaaatcaaatgaagcaagtgacatcgttatcggactcctcgacactggtgtttggcccgaaagcaagagcttcgaagatactggactgggacccatccctagtagttggaaaggcaaatgtgaatcaggtgacaatttcactaccttaaattgcaataagaaattgataggagccagattcttcttaaaaggttacgaggcttcaatgggtccccttaatgcaaccaaccaattcagatcaccacgagacgctgatggccacggcacccacaccgcaagcacagccgcagggtctgcagtgaaaggcgccagcctattcggctatgcttctgggacagcacgtgggatggcctcacgtgccagagtcgctgtttacaaggtttgttggggagatacttgtgctgtttcggatatattggctgcaatggacgcagccatctccgacaacgtcaatgtcatttctgcatcactcggaggcggagcaatcgattacgatgaagaaaatcttgctattggagcctttgcagcaatggagaaagggattgtagtttcctgtgctgcaggaaacacgggtcctgatagctcttctctccaaaatatagcaccttggatgatcaccgtgggagctggcacactagatcgtgattttccggtaaatgttaacctcgggaatggacaaaactattctggagtatcaatttatgatggtaaattttcacgccatactttagtgccactcatatatgctgggaatgccagtgcaaaaataggtgcggagttgtgtgagacagatagcttggatccaaaaaaggttaagggaaaaattgtgttgtgtgatcgtggaaatagttctagggtagagaaaggacttgtggtgaaatctgccggcggtgtgggcatggtgttagcaaattcggaatccgacggagaggaattggtggcagatgcccatcttttaccaacaactgcagtgggtttcaaggctgggaaactcatcaagttgtacttacaagatgctcgaaaaccaacatctaggcttatgtttgagggaacaaaggttggaattgagccgtcgccagttgttgcagcatttagctctcggggcccaaacccaataacaccagaggtattgaagcctgatttcattgctccaggtgtcaacatcttagccgcatttacgaagcttgtgggtcccactaaccttgaccaagatgataggcgcgtggacttcaacataatttcaggtacatccatggcatgccctcacgcaagcggtatagcagctttgatcaagtcatttcatccagattggagcccagctgcaattcggtctgcgcttatgaccacagcttatacaacttacaacaacggtaaaaaattgctagacagtgccacaaatggcccgtcaacgccgtttgaggtcggtgctggacatgtgaaccctgttgctgcgcttaatccaggtcttgtctatgatttagcagtggatgattatctcaacttcctttgtgcactaaactacacacctgataggattgaggttgtggcgaggagaaagttcaggtgcaatgcacacaagcactacagtgtaaccgacttaaattacccttcatttggtgtggtgtttaaaccaaaagtgggagggtccggtgcaacgatagttaaacacaaacgaactcttactaatgtaggggacgcaggaacatacaaagtatcagttacagttgatatttcatctgtcaagatcgcagttgagccaaatgtgttgagcttcaacaaaaatgagaaaaaatcatacacaatcacgtttacggtttcaggtccaccaccgccaagtaattttggttttggacgtttagaatggtcaaatggaaagaatgttgtcggaagtcctatctcaattacctgggaatcgggacgtgcatga

SEQ ID NO: 106452 - DNA, 1005 bp, Glycine max
  Peptide Sequence Number=SeqID_223230
atggcgacaaattgtactcagtgggaaaaaatgctacacttgaaagaagaagaggagggaaaggaggaagaagaagaagaaatagaagcattgtcactttgcgatcttcctgtcaatctgatcggccacgaagaccaatcaaaagcaaaaccagattctcaaatcaatgaaacccaagaagaggatttcgatttccgcttatggagtggccccttttccacagaaccagaaatgtgtgctgcagatgaagttttcttccaaggccaaattctcccattgcatctctcacttaagcgatgtgaatccttggaccacgtttccgtgagagaattttgtagcaatagcagtagcagcagcattagaagccagaattcatctagtagcagctcctccaccacaaccactacaaccccaataatttccgaaacaagaattcaaaatcaaaatcaaaatcatttcctcacgcatccaagtccccaacgtcagttgaaggtaaccgttccaagacaaacaagcttcggcaatcacggtagaaaatcatcagcatgggactttttgcgtctgggtgtggtgcctgcaccagagatagcattgcaagatctcaaggttcgtagtaccaatggtgttaataaaaaccacacagctcgcagcaatagcatgggcagcaacaatagcaacgccaatgctaatggcaccgtgaaaacgagttacagcggtaagacaaaaaatcacgttttcaaaaaaattggtggcttttggagtggttgcaaatattctgttgaaacagtgcaacaatcggacatggtcatgattaagggtggtactaaaagcgccaacacgacagaaagcgcaacgcacgccgcgaaagaaaaagtgctcgaaaggaagaggcagaaacacagacaaaagcagggaaagaggaccatgtcgcgtcgtcgaacgtttgaatggataaaggagctttcgcatgtaagctatcccgatgaagaggctttgttatcttaa

SEQ ID NO: 106453 - DNA, 390 bp, Glycine max
  Peptide Sequence Number=SeqID_223231
atgtgttcagatatctattccaatcttgctactttttcatcaagattcttggatatgtcaaagcaggttcatgatgaagtcatattggaaggaccaacggaatcggctgaggttgcgaagtccatagttattgagtgcatgtccaaaccctttaacggcaagaatattcttaaagttgacctctctgttgatgccaacgatgaagagaagaaatccgtgtttacccgaatggaagaggaagttgagaagctgaagggttctgcctcaaggcacgggaagatttacttgaaagctgccaagaattacttggaaaaaaaaacaaatgaaacttatgctgaattcttatgtcttctgcagaaattcatccataacaggatttatgttaaatag

SEQ ID NO: 106454 - DNA, 192 bp, Glycine max
  Peptide Sequence Number=SeqID_223232
atggagtggaatgggagcacaagacgttatgttccccgagcagattcttctttgagcttcctttacaactacaactacaccccatatccagttaatttattacttatccgtttgaagaagcacttaacttctggcatgcaatttagtaactcctatacgtttgtggactactttcagagtccatttttgtga

SEQ ID NO: 106455 - DNA, 238 bp, Glycine max
  Peptide Sequence Number=SeqID_223233
atggaagaagggaagagagagaggaagcagcaaagaaaaggaaggacaaggcgtgaaaaagggaaggcatatgtcagttggccccctaggcagccttcaacggggaccatatttgatcatagacctatgaatcctctctctcagttttgccttttccattgtgtgccacaatcacccaaaactgatggtttcttctactttttctctctctcacttgtggtcacatttgcaaaatggg

SEQ ID NO: 106456 - DNA, 252 bp, Glycine max
  Peptide Sequence Number=SeqID_223234
atgaagttgaagactatgctgagagagcaagcttctagaacccaacaagtgtcaacaggatacacagaaatctctggggaagaaacagtggaaagcacgtcagaggcactgcgttgctccaaacggggaacactgcaccatcagcagcagcagaataatattggagagggaaactgttccttcactttggaagattacaacacagtgccagtactaccctattggcctggggtcccttattatcatccctaa

SEQ ID NO: 106457 - DNA, 177 bp, Glycine max
  Peptide Sequence Number=SeqID_223235
atgaagaatgatggaaaaccttcacgaaatcgcccacggaaacgtctcagaagcattacggaagcgcctcggcttggattttcttcacggaaacaatttttctcactaatttcaagggaaaagagggaggtggttgccgcccagctcgcacaggcgagctgggttgctttgatcgag

SEQ ID NO: 106458 - DNA, 1251 bp, Glycine max
  Peptide Sequence Number=SeqID_223236
atgggggacaagcaccagcagcaccaggaagacagcagcgatttcacctccgaggacgaaggcaccgaagattaccgccgcggcggctaccacgccgtccgaatcggcgacaccttcaacgccggtcgctacgtcgttcagagtaaactcggttggggccatttctccactgtctggctcgcttgggacaccaaacattctagatacgtggctttgaaagttcagaagagtgctcagcactacaccgaggcggccatggatgagataaaaattttgcagcagattgcggagggagatcctgatgataagaaatgtgtggtgaagcttttggaccatttcaagcattctggtcccaatgggcagcatgtttgcatggtgtttgagtaccttggggacaatcttttgactcttattaagtactcagattatcgagggttgcctattgccatggttaaggagatttgctttcatattctggttggattggattacttgcacaagcagctttctatcatacatactgacttgaagcccgaaaacatcctgctcttgtcgacaattgatccgtctaaggatcctaggaagtctggtgcacagcttattcttccggatagtaaagataagatggcactggagtcagcaggggtgaaagatatgaagacgttgaatggggatttgattaagaatcataaaaaaaagattaagagaaaagctaagcaagcagcccatggatgtgttgaaaaggaagcttctgaaggagttgagggtaatgctgaaacctctggggctgtggagttgtctcccaatgcgagttctgcaagagaacaggcttctagttcggcaggaactagtcggttatccgatgctgatgcaacaaagttgaaagagcagggtaacaaaagaggaagccgctctatgagacagaagctgctggcattggttgatctcaagtgcaagttagtggactttggtaatgcctgctggacatataaacagtttactaatgatattcagacaagacagtatcggtgcccggaggtgatccttgggtcaaaatattctacgtctgcagatctttggtcttttgcttgcatttgttttgagcttgcaactggagatgtgttatttgatcctcacagtggtgagaactttgatagggatgaggaacaatgtggcactatccaagtaaatgaaaggactatatatatggactttttgaagttcaaactcatgaaggtctttgaatcctaa

SEQ ID NO: 106459 - DNA, 1425 bp, Glycine max
  Peptide Sequence Number=SeqID_223237
atgaaccaccgtccactgttgcttttgttcttcgccatgccaatgttgtcttcaagaggcttcatcgcttatgtcctatctgctttctcttgtgctgttctgtctgcgctttttatcaccaaccacatccatgatgatgataacaaggcagttactttgttagcctctcgtgtgtctgaaactcttaaagtttggcccgacttggagccaagttggagacttttgttggcaacggttattgggtttcttggttcagcatgtggaaccgttggtggggttggagggggaggcattttcgttcccatgctcaatctgattcttggctttgatactaagtctgctgctgctctttctaaatgtatgataatgggggcatcaacatcatcggtttggtataatgtgagagtgccacatccaacaaaagaggtgcccatattagactatgatctggctcttctgtttcagcctatgctcatgcttggaatcactgtcggtgttgctctcagtgttgtcttcccctactggcttatcactgttctcatcatcattctcttcatagggacttcttcaaggtctttcttcaaaggaatcgagatgtggagggaagagaccattttcaagagagaaaagaccatgcagcgagcgactttggttgattctcaggttagaatcgacacaaaatatgaaccgttgattcctaaagaaaagaaatcaactatggaaattttatgtctcaaccttaggtggaaaaggattctggtactgatagtggtgtgggttggtttcctactagttcaagtcatcaaggcaagttccctcacccctttcttctctctgtcactcacaagactattcggttgtgataatcttccaattgcacttttggtgtttggctatgaagcagtgaagttgtacaaggagcataaaaggaggatgaacacagggaactcagaatgcatctgtgaggcttctatagaatggactgctattaaccttgcattttgtgcattgtgtggcattgtagggggaattgttggaggcctacttggttctggaggtgggtttgttttaggacctcttcttctagagattggtgtcattcctcaggttgctagtgctacagcaacatttgtgatgatgttttcatcatctttgtcagtggttgaattctaccttctcaagaggttccccattccttatgcattatacctcacctcagtgtctgttttggctgggttctggggacagttctttgtaagaagattgattacatgtcttgggagggcatcaatcattgtattcatcctctcaggtgtcatttttgctagcgccctcaccatgggtgtcgttggcattgagaacagcattcaaatgataaacaaccatgagttcatgggattcttaggcttctgttccagtcagtga

SEQ ID NO: 106460 - DNA, 678 bp, Glycine max
  Peptide Sequence Number=SeqID_223238
atggttttgcaagccatcttcaacggcaccttcttctcgacgacgacttcttcttcaacaactctcttcattggcagttctgcaagcactcttgttgccgtcgattctcgtcatcatcggttcccatcattgttgttttcagccactcttgcaagcactcttattgccgtcaattctcgtcatcatcagttctacaagttttcaatcagtatgcgaacaacgaacctcggcttcgagcttggtgatgtaagcaataagtgcaaacttatctttgtgcttaatcgattcctcatcgaagccagcgtcacagaggcgcttccagatctgttcgtcagagagagggtttctcaaaaccctagaacccggtgtaatggacaagaagagattcttggaacagaaccacacgcattgtgcaaattagggtttcggttttggaagtgtgatttggatgatgctgcttctgtcggggagattctgattccagtgaaaggaagaaaaggagagagagattttggcgaagtaggcattggaagggtcgtcgaggagagcggtggcgaagaggtggcgagtggcggagataagggttggggaggagcggaaggtgggtttggaggagatgaatttgttactgaaaagagggaaaagacggagcgtgaggttgaaggggtacagtcgtga

SEQ ID NO: 106461 - DNA, 137 bp, Glycine max
  Peptide Sequence Number=SeqID_223239
atgaaggatcatgtgaaacacatcgaatcgcttgggtggagaatgaacctcaaagtgtcttctaatttgtcctactcttctctgcattcttatatgctgccttggggaaatactcatcaaaatgtccttcaagatgg

SEQ ID NO: 106462 - DNA, 1311 bp, Glycine max
  Peptide Sequence Number=SeqID_223240
atggcgtccaagaaacaagaggagcgagctgaggcagctgcgaaagttgctgccaaagaactcgaacaagtcaacagagaaagaagagaccgtgatttcggtgttgttgctgaacaacaacaacaacatcatcaggaagatcaacaaaaacgtggtgtaatcgggtccatgtttaaggcggtgcaagacacctacgagaacgccaaggaagctgtcgttggcaagaaagaagctactaataacgcgtacagtaatacagaggttattcacgatgttaacattcagcccgatgacgtgtcggcaacgggggaagtaagggacatatcagccacaaagactcatgatatctacgattctgccacggacaacaacaacaacaaaaccggttccaaggtcggagagtacgcagattacgcttctcagaaggccaaggaaacaaaagatgcaacgatggaaaaagctggagagtacacagattatgcttcgcagaaagcgaaggaagcgaagaagacgaccatggagaagggtggagaatacaaggattactctgcggagaaagctaaggagagaaaagatgctactgtgaataagatgggagagtataaggactatgctgcggagaaagccaaagaggggaaagatgctactgtgaataaaatgggagagtataaggactatgctgcggagaaaacgaaagaggggaaagatgccactgtgaataagatgggagagtataaggattacactgcggagaaggcgaaagaggggaaagatacgacgttggggaagcttggggagctgaaggacacggcttcggatgcggcgaagagggccgtgggttacttgagcggcaagaaagaggaaactaaagagatggcttcggagaccgccgaggcgacggcgaataaggcaggggagatgaaggaggcaacaaagaaaaagacggcggagaccgcggaggcggcgaagaataaggcgggggagatcaaggacagagccgcggagacggcggaggccgcgaaaaacaagaccgcggagaccgcggaagtgacgaagaataaggctttggagatgaaggatgcagcgaaggacaggaccgctgagacaacggatgcggcgaagcagaaaactgcacaggcaaaggagaacaccaaggtctcaactttgcatcttttaaaggataatttgtttatttttccttcgagattagttgaaattacttttattctctttaaaatggtgcatgtatctgtggaatgtagtggatttcgtcctcgtctgcttaaaggactaaaaagttatcatttttaa

SEQ ID NO: 106463 - DNA, 932 bp, Glycine max
  Peptide Sequence Number=SeqID_223241
atgaaagaaactgaagttttcaatgtctccaaacccgagttcaatttagctcctgtgaataaaccagatgaatctcacccaagactgaagcagaaaagaaagttcagtttcttagatagaaccgaagttgttctagcacaagctcgagctgcaatcagagaagccagaaacaggaatcgaacactagattcagattatgttccaacaggtccaatgtattggaatgctaaggcatttcacaggagctacttagaaatggagaaacagttcaaagtatttgtgtacgaagaaggggagactccagttttccacaatggaccttgcaaaagcatatactccatggagggtaacttcatacatgctattgaaatgaatgaccattttcgaactaaagatcccaagaaagcacatgtgtttttccttccttttagtgtagtaatgatggttcgatttgtgtatgaaagagactcacgtgactttggccctattaaaaaaacagtcatagactatgtcaatctcattgctacaagatacccttattggaatagaagccttggagctgatcacttcatgcttgcatgccatgactgggggccagaagcatcattctccttaccttacctgcacaagaactctattcgagtactttgcaatgccaacacctctgaaggattcaagcctgcaaaggatgtttcatttcctgaaatcaatctccaaaccggttcaataaatggtttcgttggtgggccatctgcatctaaacgttcaattttggctttcttcgctgggggagttcatggccccattaggccaattcttcttgagcattgggaaaacaaggatgaagatattcaagttcacaagtacctcccaaagggtgtttcttactatggcatgttgaggaagagcaagttttgcctctgccctagtgg

SEQ ID NO: 106464 - DNA, 414 bp, Glycine max
  Peptide Sequence Number=SeqID_223242
atggaggcatgtagagagatagagaaaaaagttttaaagacaagagaagtggtgtgcatacacgacattggccccaactgccttggcaagctccaccaacatcaccttgagcttcccgatgcgcacaacgacattggactggcgtgcctagaagttacagcggaggttgaagacggagtcgatgaggaaggcaacatgataggggttgatcttgtcgaagcagtagacggggaggacaacgagggcttctttgttggcggcggtgaggccatcgttgtcgaggagaccaaggtcgttgcagaaccagactattgcagcatggcggagggcaacagtgttggaggggtcgcgggggcggtggggctcgagggaaagaaggggtgtggagggggttggcagagacggtggatttga

SEQ ID NO: 106465 - DNA, 273 bp, Glycine max
  Peptide Sequence Number=SeqID_223243
atgggggatttagatgccttcttccctgcagccacatgggaatgtgcaccattagttgaagaagtatggagggaccttgcaatacaagaaaccttcaaaagaaaagatgagcttcactttcttccagatgttgttgagtacttaagtcgggatttgttggaaaggaatattgtagcacacattaatcatgtcatgtggattggagtagatgaatataaaatggattggagtagtttaccaaatgggaggtgtatgaataagcttatcaagtag

SEQ ID NO: 106466 - DNA, 255 bp, Glycine max
  Peptide Sequence Number=SeqID_223244
atggttatgtcgtgttggaagcaaattgttgatggtgatgaaggagatgagagtgggagagttgatggtcttttacggtacaaggatttggggaaccacctttatggggaattctcaatggttgtggttcaggacaatagttcattagaggaccgaggtgaacttgagtctagacccttgagttctaatcacttgggtcctcaagggacttttataggtgtttatgatggccatgatggaagtgaggcttcatag

SEQ ID NO: 106467 - DNA, 1365 bp, Glycine max
  Peptide Sequence Number=SeqID_223245
atggcctcaatgacaacaatggaagttgaggacagtggagacgtgataggaaacacagagcgctggaagaagaagcatgaagctgctacgacatcatacgaccatgagaatgaaactgaagttttcaatgtctccaaacccgggttcaatttagctcctgcaaatgaatctgatgaatctcacccaagacagaagcggaaaagaaaattcagtttcttagataaaactgaagctgttctagcacaagctcgagctgcaatcagagaagctgaaaattggaatcaaacacaagattcagattatgttccagtaggtccaatgtattggaatcctaaggaatttcacaggagctacttagaaatggagaaacaattcaaagtatttgtctatgaagagggggaacttccagttttccatgaaggaccatgcgccagcatatactccacggaggggagcttcatccatgctattgaaatgaatgagcattttagaacaagagatcccaagaaagcacatgtgtttttccttccttttagcgtagtaatgatggttcgatacgtgtacataagggactcacacgattttggccccataaaaagaacagtcagggactatatcaatgtcattgctgcaagatacccttattggaatcgaagccttggagctgatcacttcatgctctcttgccatgattgggggccagaggcttcaaaattctcaccttacttgcgtaagaactctattcgtgtactttgcaatgccaacacctctgaaggattcgaccctagaaaggatgtttcatttccagaaattaatctccaacgtggtccaatagatggtttacttggtgggccatctgcatctcaacgttcaattttggcattctttgctggaggcattcatggccccattaggccaattcttcttgagcattgggaaaaaaaggatgaagatattcaagttcaccagtacctcccaaagggtgtttcttactatggcatgttgaggaagagcaagttttgcctctgccctagtgggtatgaggtggcaagccctagagtggtggaggcaatttacacagggtgtgttcctgtgctcatttcggatcactatgtccctcctttcagtgatgttttgaattggaagatgttctcagttgaggtttctatgaaagaaattcccaacttgaaggacattttgatgaatatttctccaaggaagtacataagaatgcaaaaaagagtgagacaaattcggagacactttgaggtacattctccacccaagcgatatgatgtgtttcatatgatacttcattctgtgtggcttaggagacttaatttcagagtccttgatgatcaatga

SEQ ID NO: 106468 - DNA, 603 bp, Glycine max
  Peptide Sequence Number=SeqID_223246
atggaaaatggagatgccattgggcttggagctgcactttgtgatgcacagttcattggcactggaacaagcaaaagcatatcccacaagttcatttctgacacaccccaaagaactttcacaaatgtaagaagcttccctgaggggaaaaagaattgctacacgctacgacatccagaaggcagaaatactatttacttgataagagcttcgttcatgtatgggaactattatgacttgaataagctgccacaatttgatctctatattggggttaatttatgggacactgtgatgtttgacaatgccactcatgtggtaatcaaggagattctacatgtgccatccttggatgaattatatgtttgtttattaaacactgataaaggaactccttttatatcagcactggaggtgaggcactttgatcattccagttacagaacaaactctaaactcttatccctctataaacgttttgacattggctcaacaaccaatgaaatagtgaggtatgacaaagatgattacgatcgaatgtggtatccgtataacttcctgattctacaccactcaatacttccttcaccgtcgactccttga

SEQ ID NO: 106469 - DNA, 135 bp, Glycine max
  Peptide Sequence Number=SeqID_223247
atggaggaagtcattgttgttgttgttgtgtattatgatggtgatgtggtatctacttttaaggagacaaaatgttcgcttactgctataaggaaagtcattatggatgccattggaggtggaagaaacttatga

SEQ ID NO: 106470 - DNA, 1157 bp, Glycine max
  Peptide Sequence Number=SeqID_223248
atgaagcaacatcccaagtctcagctgttcaaactggatatcaaaccaaacgagttcaatagcattgagttttccgccaggaactaccaaaaccgcttttctcggcgcgatatcgatagccatgacctttatctcaaatatcactatgcgccgtgttcagagctggtggatttaaacctcaccgtcagcaccagtaaaggcaatcagaaatacgacggcggatcgctgttcaccttctttaacaccaacgcggaaaaccgctccgatgcgctggatatcaataacaccagccgattcagcctgctggataccgatgtagccttcagctatggcggcaaactgatgcgcaaccaataccgtaagcatgtagaatcggctatagagaattcgcagacggcgcaggaagcaatagaaaataataccttcgcgccatccggcgagcagcgaatcggcagtttatataccggcctgcagcttaaccgggatatctatcagctcgatctcaacctgaactacaccagcaacaagctgaccggctataagcctgaatgcgattatcgcgtggagtgcttcccgcaaggggccgcgagcatcaatttgaaagagcaagggttcaatccttcggtaatgctatcggcgcaggtgacgccgtggttgcagccattcgtcagctacagcaagtcgatgcgtgcgccgaacattcaagaagtgttctattccaactcgggtggcgcatcgatgaacccgttcctcaaaggtgaacgagcggaaacctggcaggccggcttcaacgccaacgggcacgatctgctggttaaggaagactctttacgcctcaaggtcgtgggctataccagtaaagtgcgcaattacatcttcagtgaatcttacatggtgtgccgcaatggacggaaatgcagctatcgcgaaaatctggaaaacgattgggccgatgcgagcgaagattactcggacaatatgtatatctacgtcaactctctgacgccggtgcgtatgcatggtgttgaggttgaagccaactatgatgccggacgagccttcgcgcgcgtctctttcagcaagcagcacaccgagcagccgacctccatcgccagcacttatttcggcgccggggatatcaatgaactgccggacat

SEQ ID NO: 106471 - DNA, 190 bp, Glycine max
  Peptide Sequence Number=SeqID_223249
tcaattcagcgatatctatcaggaagagcattttatcaactacttgactcctgatattcggatagtgagggagcttccaaaggagctacaatctttggacttggaggcaattagtagtgttacacgtgagaagctagcctcgagaaactattatgcgagcctcgagaaagtattctgcatatgcggttaa

SEQ ID NO: 106472 - DNA, 315 bp, Glycine max
  Peptide Sequence Number=SeqID_223250
atggagtttcagccacaaaggtggctaaaggatggggtatttcaacctatgaatccattcgagtacccaatttttcaagtcgggttgagggtgtgtgtggggaaggaaatggatctaaaggagatgaaaagtgtggtggttttgttgctgaggaagttccacatcgagttggtgtcatcgttgtcttgtgggattaaccctcatttctcttcgaggcttactaccacatttagttctggccttcacgtgatggttcatgaaagagaaattataacaaccactgaatcacaaaagagatctaatttaattggttaa

SEQ ID NO: 106473 - DNA, 234 bp, Glycine max
  Peptide Sequence Number=SeqID_223251
atgattgtcaccacattcaccgacataactgttgtcatagtcaaaactaccaccaccattgccacagtcatggtagcaacaacggtaacagttgatgatggtggtgacaacgacgacgaagaaggtcatagcgatagagttgatggtggcaacaattatggtggtggttgcggcggtagtcatggtggtgacaacaacaatcatgatagtgatgagttaattgagatattttag

SEQ ID NO: 106474 - DNA, 1023 bp, Glycine max
  Peptide Sequence Number=SeqID_223252
atgatgtttgcatttacatcaccaggggctaagcttgatagatctattagcaaatggtgcaggaccaccaaccatatggatacaaggaaccaaaagaacatcgatgctaaaattgtgtctaagttatcagccatgctagatgaatacaatgtacatggaaagttctttagaatggcgaaggaaagtctaaaaagtgaacatgttcatgatctaaaactgaagctaatttctaacagaaataaagatggtagaatatataacataccatctgtatctaaagttgctaccctaattgttggggatgttgatacaggttccaagagaaatattattatggagatgcatagtggaaaacttcaacgaattgatgaattgcatacttgctatttaagttttcaataccctcttttgtttccttacgatgaagatggttacagacacgatgttcttcaccgatcaacacatacttctaaaaaaaggattcaacttacaatcaaggagtggctatgttttagaatccaaactagagcaaatgaggcacaaactctacttcggtctaggagactttttcaacggttcctgagcaaatacccaactgctaaagatatagaccgaatcattttagctgaaattccaagtgaacaagatgaacctaagttatacaatttagtgaaagctcacatgattcatggtccctgtggttcatccaacaaatcatcaccatgcatgaaaggtggaaagtgttctaggtattatcctaagaagttccaaaattcaaccattgttgatcaagatggttatccgatttacaggcgaagagacaatggtcatactattttgaaaaatagtgtaatagttgacaatcgtattgttgtcccttacaatcccatgttattattaaagtttcaagcacatattaacatggaatggtgtaaccagagtacatcaattaagtacttattcaagtacatcaacaagggttatgataggattacagcagccatcgttccaactgagcactaa

SEQ ID NO: 106475 - DNA, 1005 bp, Glycine max
  Peptide Sequence Number=SeqID_223253
atggtacccctggcaacagaggaattaggtttagcctttgagtctgttaaacttgtttacaatggtttgctttatgcatggcaatttgtttgtagtaatccatttcgtcctttgaggagcctcaatcctatgccaagaatcatatatagtctggattggctgtcaaacccaagctgcatcattatgtcctttgaggatggaacaatgagaaccattagcttggtgaaggctgcaaatgaccttcctgtcactggagaaatatacagtgggaaaaagcaacctgggttgcacggttctgcatattcatcttttgccatttggagcgttcaagtttcacgtttaacaggcatggttgcttattgtggtgtagatggtgctgtcattcgttttcagctcactactaaatcagtggagactgatcattcacgcaatcgatcccgacgcttcctctgtgggtcagtaactgaggaggattcaactctcattatcaacactcctttgtcagatgctcctttccagtggaagaagccacctgaaaagggtcggtgtgctgagtctttccgagacctattagccaagtcaaatccattcagaagtgctagtaatcaaatggcagaaacttcaaatcctgattctcagactttagccattggtgctggtgaggatgttggtttggaatctgggtccgaggaagctttatgttctgtgaagcagcccaaaagaccaaaactaaatagtggcagaaagaaaaaaccagaaggcctagctctggtttgtggagatgatgatgcgccaccaattactcccgaggctgataatgaaaagtcagattttgggaatatacctgaaaccttccctcccaaagtagccgcattgcacagagtgagatggaacatgaacaaaggtagtgaaagatggttgtgctttggaggagcttgtggacttgtacgttgtcaggagattgtttactctaatattgataagagatgggccttgaagaaatga

SEQ ID NO: 106476 - DNA, 319 bp, Glycine max
  Peptide Sequence Number=SeqID_223254
atgggagagctaccagtggatagagcctatgctccagaagaccatcacaacaacttgcttgctactgcaattggagactggcaattagctagagaatccaaaatacatagctatggaaagagcttcaacggattcgttgcacgacttttgccatatgaagcagagaaattactagaggaggacaatgtgttatctgtttttccaaatacacagaacaaattacacacgacaaggtcttgggattttctaggattgcccctaaaacttaacagacactctaatgtggagagtgatatcatcgtgggtgtgttagacacag

SEQ ID NO: 106477 - DNA, 1350 bp, Glycine max
  Peptide Sequence Number=SeqID_223255
atgaagagagggattctcacttcttgttccgctggtaacaatggcccttccaccatgactgtggagaatgtcgctccttggattttgactgttgctgcttccaacactgatcggcaattcaccaccgccgttcacctcgccgacggcaagaaagctcggggaatgtccattaatacctttacccctgagaaaaaaatgtacccattgattagtggagcccttgcttccaaagttagcagagacggctatggcaatgccagtgcatgtgatcatgggagtctaagccaggagaaggtaatggggaagatagtgtattgccttggcacgggcaacatggactatataatcaaagaactaaaaggagcaggcaccatcgttggtgtttcagacccaaatgactactccaccattcctgttattcctggggtctatattgatgccaacactgacggcaaagcaatcgatctctacatcaattccaccaagaatgctcaagctgttatacagaagaccacaagtacaagaggccctgctccatatgttgcttccttctcatctagaggtcctcaatccatcacagtcaacatcctaaagccagatttgagtgctcctggagtggacattctagctggatattccaaattagcaacactaacaggggaccctgcagacaaccgtcgaaacgtttttaatatattgtcaggaacatctatggcatgcccccatgctgcttctgctgctgcatatgtcaaatccttccatcctgattggagtcctgctgcaatcaaatctgctctcatgaccactgccattcccatgagaatcaaagatgccacagcagaactaggatcagggtcaggacagatcaacccggtgagtgcattggatcctggcttactttacaacagtagcatggactcctacattgcattcctatgcaaagaaggctacaacagcagcagcattggaatactaattggcaccaagggactcaactgctccaccatttcccctccacaaggcactgatggaatcaactacccttccatgcatacacagattatcccttccaatgccagcatttccgcgatcttttatcggagtgtgaccaacgtaggatccggaaactcgacttacaaggccaaagtcagagcacctaagggcctttccattgaggtcatcccagacacattgaattttggtggggtgaaccaagagttgtccttcaaggtggtgctgaaggggcctccaatgcctaaggagacaaagatattttcagcatctcttgaatggaatgactctaaacacaatgtaagaagccccattgttgtctataaaccgaccttttga

SEQ ID NO: 106478 - DNA, 1192 bp, Glycine max
  Peptide Sequence Number=SeqID_223256
gtggcaagtgattgatttcgcgaggctaaaccacagcaccatttcgttcttcaatttgcctgagagtgctgcgtcacggtggagtagggtcaaactcaacgcttccaaggtgggaaagggtttgtacttggacgccaaagcacaaaaattggcttttcaacattggattgaagctattgatccacgccaccgctatggacataacttgcattattactatgaagaatggtgcaaaaccgattctggccagccattcttttactggttggatttgggaaatggaaaaaatattgatcttgaacaatgccccagatccaagctccgaaagcaatgcataaagtatctaggacctcaagagagagaacactatgaattcattgtctgtgaggggaagattatccacaagcaatctggagatttacttcacacaaaagaagattctaaggatgccaagtggatatttgttatgagcacctctaagaaactctatgctggcaagaaaaagaagggattattccatcattcatctttcttggctggtggagctaccttggctgctggaaggctggaggtcgagcatggcgttcttaagtccatctctgcttatagtggacactaccggccaacggatgacgcactcaactccttcgtatcatatctcaaggaaaacggtgtcaacattgatgaagttgaggtacgcaatccaaaggatgataccgatacttacgaggacagcaaggttagtgaaatagccacagcacctgaagattctagcaatggtaagatatccaagcctgtagtttctgaggaagccgagaacactgcatcctcaatcaaggaagaccctcaacctggatctgttggcagttacaaaaggactctctcaggtgggcttcagagtccaagagctgatgtgccgaagaaagcgatattgcaaagaatcaattccaagaaggctacaaaatcctaccaattggggcaccaactttcgcatagatggtcaaccggggcaggacctagaattggttgtgttgctgactaccctgtggagcttagactacaagccttggaaatgcttaacctttctccaaaagttcctccttctccttcctcatacaggtttgtgggtggtcttgtgtcgcctatggccaatggcactagaattgacagtgatgagaattctgttcattga

SEQ ID NO: 106479 - DNA, 168 bp, Glycine max
  Peptide Sequence Number=SeqID_223257
atggagaaatggaaaaacatagaaatgtcctttggggtatggttaaaggtgtctcccatcaaggcgaatgtagtggttggggttaggcatgaggtcacatgctatggtctcagtatattcgtagaaggggacgattcttcctttggaggtcttttattctccgtgtag

SEQ ID NO: 106480 - DNA, 1080 bp, Glycine max
  Peptide Sequence Number=SeqID_223258
atgaagttcttgctctctctctctctcttaaatctggtggggatttgtgaggcactccttctggtttgtgattgggagctagctgaagctcgaaaaaaggatgcaattgatcgagctagggtgcgtggtgaagaacctcccgcagatctgcttgcagaagaaaggggtctgcattacagtgttgagccagatgtgaagaatcttttgcaggggaaaacacatgcagaattggaagcttatcaggtgcatacagagtcagagatgcgtactggtacagcaaaagtggttgagtactgggaggcagttttaaaacacctccacatatataaggccaaggcttgtttaaaggaaattcatgccaagatgttatgcaagcacttgcaacgccctgaacaaccattggaggatgaagatgaattggaagatgctcaagttagaaactctgaggacgatactgagcactatgctaaagatgaatcattttcaccagaacccattaaaggagaagttcaagaagccaaagatcaggctggctcattttcaccggaactgtttcatggtgatgaaaatgaggaagctattgaccctgaagaggatcgagctctactggagcagaaacgcatggctgtaaaggaagagcagcaaagacaaattcaggaagcaatggcatcaaagcctgctccatctgaagataattttgagatgaaggccatgaaagctatgggagctatggaagatggggacgcagtgtttggctctggtgctgaagtgaatctagattcagaggtttattggtggcatgacaaatacagagccaggaagccgaagtatttcaaccgtgttcacactggatatgaatggaataaatacaatcagactcactacgatcatgacaatccacctccaaaggttgtacaagggtataaatttaacatcttctacccagatcttgtagacaagacaaaagctccaacttacactattgagaaggatggcagcaatggtgagacttgcatcataagatttcatgcagggccaccatacgaagacattgttggaatcagtctagaaacaggttaa

SEQ ID NO: 106481 - DNA, 120 bp, Glycine max
  Peptide Sequence Number=SeqID_223259
ggcttgacagtaaaggaaatggaagaacttcatgatgacatcaaaatgcatctggaccttgacagggacacacccacccatgtagaatattgggaggtatcatctttatccattgtttag

SEQ ID NO: 106482 - DNA, 459 bp, Glycine max
  Peptide Sequence Number=SeqID_223260
atggttcatataggtggttaccatgccactgctcacattcttccacaactaagaggagccaaaattcctgaaagtgattatacaaccttgcccaatggtttgaagtactatgatttgaaggttgggaatggagctgaagctaaaatgggatcccgtgttgcaattcattatgtcgccaaatggaagggtatcacctttatgactagtagacaaggaatgggcgttggaggaggaacgccctatggatttgatgtaggccaatctgagagaggaacagtccttaaagggttggatttaggagtacaaggcatgcgagtaggaggccagcggctgttaattgttcctcctgaacttgcctatggaagcaaaggagtccaagaaatccctcccaattcaacaatagaggtgaattattctgatctctttgttaagatttgttccagtttagagttcaattag

SEQ ID NO: 106483 - DNA, 930 bp, Glycine max
  Peptide Sequence Number=SeqID_223261
atgtcctgtttccaatcaccggacgttgattggcaccgtcgtcttcatttcgcagccatcttctgcgccacaggtagcaagagtaggaaagagagaaggcgaagaagatccggtgattcttcacggtccgatgatgatgcggaaagccgtgatttgtcctctcaggagagacgccggagagacggtcacctcggccaccgtcgattgtggcggggacggagcaggcaggactcagatagttcctctgatgagagtagtgataggggtggcaagaggaagaggtcctccaggcacgtcactgaagaggaaatagcacagtacttggccaaaaaggctcagaggaaggcattgaaagatgctaagaaactgaagactcgtaccgtgtcagggtattcgaatgactcaaatccatttggtgactccaatcttaacgagaagtttgtttggcggaagaagattgagcttgatgtcgttcaaggtgtgcctattgatgcattttcagttaaagctgaaaaaaagagacagaaagaaaggatggcagaaattgaaaaagtgaaaaaaagaagagaagaaagggcacttgagaaagcacgacatgaagaagaaatggaaaattttatgttaccactcaacactcatgtttctgggtggtgtctgtttgtggtggctaactggctatatgttaatatgacatgcccaatttctcccatccctgcactgttagctagagaacgtgcacgagctgagttccacgactggcaaaaaagagaagaggagtttcattttgatcaaagcaaggttagatctgagattagattgcgtgaagggcgtgctaggccgattgatatcctaaccaagcacctcaatggatctgatgatttggatatagaaataaatgaaccatacatggtgttcaaggttaatatttag

SEQ ID NO: 106484 - DNA, 197 bp, Glycine max
  Peptide Sequence Number=SeqID_223262
agcgagttcatcgtcacgcggtctctgcagacgcgaacggaagcgatgctcccgaactccacgaaagccgcgaagaggtggtgttcctggacgtctgggtggaggtctccgacagagaggggaagaagaagaaagggaaaagagtgcgagtgactgagtgtgaggaccttgcatgcacgcagacgaaggtggattga

SEQ ID NO: 106485 - DNA, 411 bp, Glycine max
  Peptide Sequence Number=SeqID_223263
atggcttctgttcactcttctttccttctaccatataatctcctttccctcacaaccccatcaagctcttccactcaaattctctttaccgcgagaccctccgcgacccacctgcgaccccttcttctcaccacacgacgccgttccgggagacgaccctttgccgcggtggcggaacaggccgccaccgcgaccgaggcggccgcgaggaggctctacgttggcaacattccccgcactgtcaccaatgacgagcttgccaagattgttcaggagcatggcgctgttgagaaagctgaggaatggggtgttttactaagggatttggataaagcttatagaatctttcaaaattgttattattgtttggaatttgaggatatgatgtgctttactaagggatttgcataa

SEQ ID NO: 106486 - DNA, 306 bp, Glycine max
  Peptide Sequence Number=SeqID_223264
atgaacccagatttcaaccaaccacgaggcgggtgctcgcgggaggtcagcatacaccccgcgcagcaacattgttacatgtttgcgttggggaaacgatgttcacctacggaaaccttgttacgacttctccttcctctaaatgataaggttcagtggacttctcacaacgtcgcgggcagcgaacccgctcacgtcgccgcaatccgaacacttcaccggaccattcaatcggtaggagcgacgggcggtgtgtacaaagggcagggacgtagtcaacgcgagctgatgactcgcgcttactag

SEQ ID NO: 106487 - DNA, 414 bp, Glycine max
  Peptide Sequence Number=SeqID_223265
atgggtggtggtgcatggccgttcttagttggtggagcgatttgtctggttaattccgttaacgaacgagacctcagcctgctaaatagctatgtggaggtctgtgatgcccttagatgttctgggccgcacgcgcgctacactgatgtattcaacgagtctatagccttggccgacaggatcattgcaattgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgagcgggttcgctgcccgcgacgttgtgagaagtccactgaaccttatcatttagaggaaggagaagtcgtaacaaggtttccgtag

SEQ ID NO: 106488 - DNA, 177 bp, Glycine max
  Peptide Sequence Number=SeqID_223266
atggttggccgaacattaagcacaatctctgcatgtctcattgccgtggagaaatcatcagatatatctccattattttttattggcttgttacaggctttggtaccatacacgtttttggatgtttatattaatggagtgaaccagctgtctgaccttgaaatagacaagatttga

SEQ ID NO: 106489 - DNA, 1155 bp, Glycine max
  Peptide Sequence Number=SeqID_223267
atggctcatttgattgggaccataactatgttagtatatggggtccaaaacccttatcatctcttccagaaattgctgtccttgatagatcccaatttgcttgttgcagagacaccagaatgtgatcagggtgaattcttgctccaaaaagagtttctcagaaagtacaggaatatgtgcacttttccatcaagggcatctgagactatgacccatgaatttcccgttaagttcatgaacatcttggatcctctaagaaatgacaacaacctaggccgtagtgtaaacatagctaacttacatcgagtaagatttgctctttcctacggtgctagaaggcttaagcagatcctcacacttccaggagaaaacttgggtgcagcactagagaagtttttttttagcactttggacaggaatgggaaaggagaaagggcggatgttgttgttccgatttctccattttatagaagttattttcatttaatttttccaaaagctaagaattataattcctactgggatatgcacacaaagccatccaggccaaggagatttgcttcttcaaagtacaatgcattgcccaaatcaccttcgaaaaagcaacaagcagaagaggttcattctttgacagacataaatgctaattcagattcaaggctgtttgagttctcaagtgaagattctccccttcttctatgcaattgcaaggttatactgccaacgcaagcccaagagtctactccattagcaaagtttcattctgagacagacatggatgttacttcgcagttgcttgagttctcaaatgaagatttcccccttcttccaaaggtttattatgagacacacatggagggtaattcgaggtcgtttgagctctcaaagaaagatttcccccttcttcaaagcactgacaagactgccctgtcagagtctgctgctaagttaactaagcaagccaagagtttcccatcctctaaagagtctaaactgaaaaatattgagtttggaactttcaagaaatcacaatcattgatagaaccaagtttatcaacaaagggtgagagagaagattctggtgttccattatctcaagaaactgtgttggtggttccaaaggtggcagcggagaggaaagatgaatctccctag

SEQ ID NO: 106490 - DNA, 357 bp, Glycine max
  Peptide Sequence Number=SeqID_223268
atgaaatttaaatcaagcggcaccccttcaaaggcccaagcactcctcgacctcagaggccacttctcaacccccacactgtcgccaactactctgaagttatcttgtacatcgtcggctacccctccaacaccatcttcatcccctctgtctaagggaggcatttgggattttggaaccctaacggaggttgttaggttgatgggtgaaaggatgaagggaaagggtgggtcatcatcgtcgtcgtcgtcatctcctatgatggttaagtgcaaatgtgaagtacccgttattatgttcatgtcgcgtagtgtgaaccatccaaggagaaggttttggagatgcccacactggaat

SEQ ID NO: 106491 - DNA, 300 bp, Glycine max
  Peptide Sequence Number=SeqID_223269
gaatccagttcttgcatattttttcaatgggttaatgatattgaggctcgcaataatttttacgtagaagggagtgagttgatccagtatgttcataaaaatgaagagctaaagctaaaacttgcttcattaatggaggaagctaaagcaaatgcaaaagaaatagtagaattgagggaaaaaattgttgcacatgaagaaaaatatcgcacatcctcggctaaagttgtgcacttgaagagtaaaattggaaggaaaaagaaaaatgttgttgttgaaaggaatagggtgaagctgtaa

SEQ ID NO: 106492 - DNA, 204 bp, Glycine max
  Peptide Sequence Number=SeqID_223270
atggagaattggcgaacagcactacgcgataacttcgcggggttccagactcgaaggtcgaggacacatgaacaacgcttgccaataaattcatggggctccgaaaaaagtggagaatggagaattggcgaacagcgctacgcaataacttcgcggggttccagactcgaagatggagaacacatgaacagcgctaggcaataa

SEQ ID NO: 106493 - DNA, 843 bp, Glycine max
  Peptide Sequence Number=SeqID_223271
atgccggaattgcgcgagcgcgtcgccaatgagcgcgccaaaccgctgagcatggaagagatcgcccgcctcgggctggggctgcgcaccgcgctgcagcaggacgatcgcaacatcaacgactggatgatgctggggcgcgtcggcatggcgttgaacaacgccaccaccgccacgcaggcgtttgcccatgcttatcaattggatccgaatagtctggaagtgcggctcggctatgccgaggtcttgacgcgctccaacgatccggaggataacaagcaggcgacgcagctgctgcggcgcatgatcgcggaaaaccacggcgatccgcgggtgctgagcctgttggcgttcaatgccttcgaacagggcgatttcaagcaggcgatcggtgcctggcaggtgatgctgcaactgctgccggccaacgatccgcgcgcggaagtgataaagcgcagcattgcacaagcaaaagcccaggcaggcggagaaaatgttaaactgaatgtgaccgtttcgctgtcaccgcaggcggcgaaagccttgccggcgcaggggacgctggtcatttcggtcactgacggcgttagcccggtgccggtggcggtaaaacaattgccgctgagccgttttccgctgtctttctcactggatgacggcaacgccatgatgcccgagcgtctgctctcggcgcagcatcaggtgcaggtgcgtgtgcgcctctcacaggacggattggccacgccgcagccgggggattggttcggcgaaagctcgctgcagacattcagcggtaaagagcaggttagcgttcagataaacaagcaggtcactgaaaaataa

SEQ ID NO: 106494 - DNA, 516 bp, Glycine max
  Peptide Sequence Number=SeqID_223272
atgtcccatactaatggattcgggtccacaacgatgggttcaaatgtaagatcggttcaggatcatgggatccttttctatcagataggaagggctgtttcacaaaatgtacttctaagtaattgctccatagatcctatatctatctatatgaagaagaaatcatgtgacgggggggattcttatttgtacaaatggtacttcgaacttggaacgagtatgaagaaattaacgatacttctttaccttttgagttgttctgccggatcggtcgctcaagacctttggtctctacccggacctgatgaaaaaaatgggatcacatcttatggactcgttgagaataattctgatctagttcatggcctattagaagtagaaggcgctctggtgggatcctcacgtacagaaaaagattgcagtcagtttgataaggatcggagtgacattgcttcttcggtccgaaccaaggaatcccttaaatatgattcaaaatggatcttattctatcgttga

SEQ ID NO: 106495 - DNA, 315 bp, Glycine max
  Peptide Sequence Number=SeqID_223273
atggaaccaaaaaaaagagctagaatagaggacatgccttcgtcatccactccagctcctccatcagtaactataggacaggatgtccaaagctcactaactttagttcctatgctacaaagcttattccgaggacagtttattatcatgcacaacctgcaagagttggctcacaataggccaatcttatctatggagcattttcttgagcaagtagcctggcctaaagctcaacttccattgttgagacccaacgaggctgctctgcctgagtccacacctgtgcaggtcaatccagagccagctaacccataa

SEQ ID NO: 106496 - DNA, 465 bp, Glycine max
  Peptide Sequence Number=SeqID_223274
atggccagacagcttgcaagatgtatcacacttttacagtgttggatctacgagcactttccctctgttggttgtgttgttgctgctgatgattatgatgagaggaaaccacgtgcctatcgttggaagtctaggaaggcattactagtatcaatgtatcataagcggttggctagattgacgtctgatgttacatatcaaatgggttccatctattgtcatacatcggccaaagagggttgtatgatagtttgggtatgtgcagaccattcctccgcccctgctgctccttctctcagtatagaagacattgatgatagatggattcagttttccgaatacattgcaccggttggtcagatatgtgtagcgcctggccagtgttcaccggactacatagattggttctacttgatattccatccctttatgagttcggcacagcctgtggatcctcttagatag

SEQ ID NO: 106497 - DNA, 177 bp, Glycine max
  Peptide Sequence Number=SeqID_223275
gtagcagctttggaagctgctacttccacaggtggggttatagcagagttagatatacagaccttgacagagaatttgatgagaacattgattgcattggatgaaatttatggtgagggtgaactgaaattgcagagaagaaagcaggtacgtgaggaagctgttggatttgcatag

SEQ ID NO: 106498 - DNA, 282 bp, Glycine max
  Peptide Sequence Number=SeqID_223276
atgaaggctcaagtggagaaggatgaaggcccagagacttatcaaggtaatccttgtggcgtctaccttgacttatcttccttcactggaagtggcgtctacccggacttatcttccttcaccggaagtggcgtctaccctgacttatcttccttcaccggaagtggcgtcatccaaaaactctacagcctgtatcaagcgatccgccccgtaaggttcacatcaaagggattgaatagaaaactcaatagccgacatcggtcgcgaagtagccccgactga

SEQ ID NO: 106499 - DNA, 1247 bp, Glycine max
  Peptide Sequence Number=SeqID_223277
atgcttggagttgtacgagaacaggcgcggatcgggctcggggaagctggtgccgcacgaggggcaggcgcgcttgaccgagaagtgctgctgctgcaattcgctgttcagcgcctcgtgcagcttgtccaccggccacaccaccgacatcacgccctggccgttttccagcgcgctcttgaccgcggcgcgcaggtcggcctcgttggccgggtcgaccaccacgtcggccacgggcagttcgatggtgtgttccttgtagcggtccaggcgcggccacggcgccaccgggatgaatttgccgtcgacccgcaggtgcgtgtggcccttggagccagcccacttggccaggtcggtgtagtagcccttgcgcgcggtgaccagcggcgccagcaggccgatgtgctcgcccttgcgctcgcgcagcaggcgcgccacgatctggtcggtgttctgcggttcgaccgcgacgttgcagtccgggcagtattgcgtgcccagtttcacgtacagcagccgcaggaagtggtggatctcggtcatcgtggccacggtcgacttgcgtccgccgcggctggtgcgctgttcgatggccacggtcggcgggatgccgaagatggcgtccacgtcgggcttgccggccggctgcacgatggcgcgggcgtaggcgttgagcgattcgagatagcggcgctggccttcgttgaagaggatgtcgaaggccagggtcgacttgcccgagccggacacgccggtgatcaccgtgaacttgtcgcgcgggatctcgacgctgacgttcttcaggttgtgctcgcgcgcattgcggatctcgatcgccatgttgtcctggcggcgcttgcgcatgatggattgcagcggcgtgccttcgccggcgccgtaggcggcatccggttcggcgatgcgggccgtcaggccggcctgttcgacttcctgcgcgtcgatgtcgctggtcacgaccacgtcggccggcaggatgctgacctcgtagtcgcgcagcgccgcgccggtgtgcgaggcgggggtggccatcaggtcctgcggcgtgccgacgccgatcaccaggccgccggcgtcgccgccttccggccccaggtcgatcagccagtcggccgcgcggatgacgtccaggttgtgctcgatgaccagcagcgtgtggcccgcggccagcagcttgcggaaggcgcgcatcaggcgcgccacatcgtcgaagtgcaggccggtggtgg

SEQ ID NO: 106500 - DNA, 809 bp, Glycine max
  Peptide Sequence Number=SeqID_223278
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagtgttttcccagtcacgacgttgaattcgatcgatcatgatcgtggcggcgagaatggtggcgatggtcgcggccatgcggaactgcccgatggcgccataggcaacatcggaatcaacaacaaagccaagataccagtcgaccgaaggcaggccggcaacgggaatgaaactatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 106501 - DNA, 624 bp, Glycine max
  Peptide Sequence Number=SeqID_223279
atgacgacacttgctcagacatggagtgtcctttcttactacgatcttgcgcccacttctcacacttctgatgttaatcttgacagggcccgcttgatctacggtttggtgagccgcatggacatggatgtgggcagctttatatcacagcagatcagccagattgcccagtccagtacctcgaggctcgggttcccggcgttgattacagcgctgtgtgacattcagggggtggtttctgacaccctgatctttgagtcactcagccctgcgatcaacctagcctatgtgaagaagaactgctggaaccccgccgacccatcgatcactttccctgggcctcgccgcacacgcaccagagcttcagcatcagcttccgaggcccctcttcctacccagtctccgtctcagccatcccagcgaccgcgacatccacctgcttccacctcagcatccatggacatgcatgggcagatgctgagatggatcccccgctcaccactccagaggcctatcgtcagcgagtcgcctggccaggagaccagccctccactgacaggggggaagagccttctggagccgctgaggatcctgcagtcgatgaggacctcattgctgacttag

SEQ ID NO: 106502 - DNA, 405 bp, Glycine max
  Peptide Sequence Number=SeqID_223280
atggaaggtaacttgaaattgtcaaagctcgatggtggcaataaggaagatcatacttcgttcgaaattgttgtaggaaacttgaggaacgttaataagcaagtcattgttacactttctacttgtgaagttgagtacgtagttgcaacttcttgcatatgtctaagacggttgaaggagtttaacatggaccaagagaaaagtataaagattcatattgataacaaatctgctcaagttcttgctaagaatatgatgttttatgaacaaagcaagcacataggcacaatatatcatttcattagagaatgtgttgcacgaaaagaagtagagttagttcatgtgagaacacaagatcaagttgcagatatttcacgaaactcctcaaatttgaaaattttataa

SEQ ID NO: 106503 - DNA, 462 bp, Glycine max
  Peptide Sequence Number=SeqID_223281
atgccaatctcccctgcagatgtatcggttggtttgtgccgtcatgacataggtaaggatcgcgcccacaagatgcccagtgggcctgaagaagtccaacaggaccttggggtttccagctctggttacgggcctctgtcagtcctacagggtgcccgttcccccagtgaggaatcgcacccacaaagacacccagtggacccggagaagtccaacagggccctagggtttccagctctggttacgggcctctgtagtcctacagggtgcccgttccccccggcaaggtcacgtcatcatagttctacggagtacctgtcacctccagcaagggcatcaggccccctactaatcgagctttcatcaagaagtactacactcccaggcaggcgcaaggcgaaacaccacaacagcctggggatggtcggtagcgggcaacagacgcactgccaccacctctag

SEQ ID NO: 106504 - DNA, 384 bp, Glycine max
  Peptide Sequence Number=SeqID_223282
atgatgaatgggttagcaacaactgacatactgatgtggattgtttggtcatatttgtctatgccattttattctggtgggatgatcaatgataaagatggttctcagtcccaatctagccagagtaatgtggattgttactgcttaactgttggaacagttgacgaaatcattattgatgctccatggagttgtgacagttgtcctaactgtacaacgacatttgatccatcaaaaggtggctcagcttgccgttcttgccataccagtgtggtcgatacagttccacggttagccatgatcattttttgtactgattatttatttacacgctttgctgttttagcaaatttccctgaaatttctatggatgtcaaggtataa

SEQ ID NO: 106505 - DNA, 438 bp, Glycine max
  Peptide Sequence Number=SeqID_223283
atggtccacgtcgatcctacgactagtaaggccgacggtccccaaaagaagaaattacaaacatatttagggattgtcgctcatgataaggtggaatttgaaatccctgaaacttctgacaataggacaaagaagaaagttcttcagactatgggcgacaaggacggtgtggataacactgtctatgaaaaatacagcattagcaaggagaaatgggctcagttttgtcagacccaccgagatccctcgtgggaggatgtgcggaaaaaagtacaagccatccagaagcaaaacaccgctccccacgtgttgtgtcgtgggggttatgattatttagaacaaaagctgatggctgagaagacaaagaaaaaactagaggaagctgctcagtccggaagcactgagggcgtcattaatcctccatctcccataagatga

SEQ ID NO: 106506 - DNA, 282 bp, Glycine max
  Peptide Sequence Number=SeqID_223284
cttgggaggattgatggggacccggtgttgagagaaacgaggatatgggctacgtgggagtacgtgagctcagttggaggtgggcaacaggggatgagtggtacctggagatatgtcgcgggggtcaggagaccttggggacgtcaggcgagctcctggcagtcaacagataaaaggaaaacaagaccacaaagcaaggaggcttgtggtagctggccagctggggctaagatggtctctggtaatcgattaccaggggatgtaatcgattaccaggcttga

SEQ ID NO: 106507 - DNA, 291 bp, Glycine max
  Peptide Sequence Number=SeqID_223285
atgagggttgaggatttcgttctctaccaaatcctcaaggtgggtttcaaagattccactccaattaaagtgttcctctccatgcgatggtctagaggcaagcaatggcggctcgtgccgatcactggtggccgtgggtggtggaggaggagagttagggatttggttgttttgggaagagagagagagagaaaaacatgttttctctcgctgatgaacgtatttataatctacatctcgctaagcgaaattcaacttttgttgctgagcgtgaaatttcacactaagtga

SEQ ID NO: 106508 - DNA, 330 bp, Glycine max
  Peptide Sequence Number=SeqID_223286
atggctgatagtttgaatgaaaccactaaaagagtcataaaaaatggctcaaatggaaagaaaattgaagcaattattgctgctgtaaataaaattgaaatgactactgtgaccgaaaatgaagaaggaatggctactaaggagttcaaggattgctttgggtgggattatggtggaatgcttggactcaacaaagattttatggagcatagactacctattcaagaagagaggaaacatgttaaacaagaaccaagaagattttctcctaatgtcatggaagccatcaaagaagaaattgaaaggctactgaatgccaaattcatttaa

SEQ ID NO: 106509 - DNA, 429 bp, Glycine max
  Peptide Sequence Number=SeqID_223287
atgaataatatcaacatcagcaacaacgatagagataccagtggtggtcatggtggtaatggaaatagtggtgatggcagtggtggtagaggtgacattggtggtggtagcgatgttgatggtggtggcagtgacgatgtggtggtggtggcagtaatggacatggtattaatattggtggtggcaacaacgataatggtgatggtggtgggtggtaacgatgttgttgttggcaacaaatggtggcaatgtggtggtgtttgtgacaatgttggtggtggttgtggtggcagtgataatgacaaaggtggtattattggtagtagtggtgacaataatggtgtcaatggcattgatggtggtggtggtagtgatagcaatggtggtaatgatggttgtaacacccatgaatatagactttcaaaataa

SEQ ID NO: 106510 - DNA, 402 bp, Glycine max
  Peptide Sequence Number=SeqID_223288
atgggggtggatttaggaaattttgagtctaaaactgagttccttgcatttggaaacattgagaagcatatatggatatttgaggttgagagcttcatgaggatcaacatgtattttgaggaaggaacgaacgaacaagatagcgagattgtatctaactcctcatctgagcatgttgaggtcatttcccctgctctgatgtctcctcgattggtgtttcctaagtctcaggcacctcctgggttagacttagtggatcttgtgtcggaggatgagggagaggagttagaggagaacacatctttcgagaaggatccgtcgatggatgaagaggtccctaccatcgagcctgagcttatggagcaggattcttcacaggattcctttgaggagccgtactga

SEQ ID NO: 106511 - DNA, 504 bp, Glycine max
  Peptide Sequence Number=SeqID_223289
atggaggatagacagattgagctggaggctctagagaaagccatacaagaaggattaggtttgttaataataattagaagaaaaaaaaagtgtaggaatttaccaaagatatatgctcacgccttgctcctatcttctaatacagaagcctatgataagatgcaaggtgaacttgtaaaagccagggcaagcctaaccaaaatcttgacatcaaaggatgccaaagtaactgttttattggaatttaaggagtatgctactgaagttgttcacacgtcagagtgggttgggttatgggattgtaaagatgggcttaattttctcaaaaatgagtatgctaccattgttcaactattcaattgttcaatcgttcgctctttcaggttgacaagaatgatgacatttatgaagcaccccttgtattacagactgtgtgatggcagaactcgagaagttaggccaaaaatatcgtgtagctctaaggtagatgttatgtcttcttga

SEQ ID NO: 106512 - DNA, 464 bp, Glycine max
  Peptide Sequence Number=SeqID_223290
atggcttcttcatatgttttattcatgctttctctcagctgcttagcctcaacaacaattgctttgggtgggaatttcaacactgattttaacattctctttggagatagtcgagctaacatacaagatggaggctcaagcatgtcccttgcaatggacaaatcttctggctcgggcatagcaaccaagaacgagtacttgtttggacgatttgacatgcaaatcaaacttatacctggaaattctgcaggcactgtcactacattttatctaagctctcaagggccaaaccatgatgagattgatttggagttcttgggcaacttatccggtgatccatacattctctcaaccaattattatgccaatggtactggtggtcgtgagatgcagttctatctttggtttgatcctacacaggacttccacacctattccattgattggaacactcagcgcataat

SEQ ID NO: 106513 - DNA, 153 bp, Glycine max
  Peptide Sequence Number=SeqID_223291
atggttagcaagaatgataggtcacaaggaataacaccaaactccagtcctcacaagaaaatcacccaaaaacattcccccaaatttaggataatttgggggatagatttgtctggatccatgagtactctcctacaacctaagaaagggtag

SEQ ID NO: 106514 - DNA, 645 bp, Glycine max
  Peptide Sequence Number=SeqID_223292
atgagggttttggcagttctgtcaagatttatcaaagccaacaaagctcaggaatgtctaaatcagatgctgcaaattgatgggagtagctctggaatgctcattctttttaaacatcacagaacattagatattgcaaagactgtcataaaagagaaatcatatgtctacagcaagacagatcagatcatttgtcttttcaaagatgggaaattagaagaggtggtcattcatgccaattctgtctctgatctttataatgtggtcggtgaggatttctggtcatctacttggtgcaacagtactgcatttgaagggaaacaacttgaggggacaaggataacacttgtaaaaatggggagcttggttttgactttgcaattagaacaccttgtacacctgctagatgggaggattatgatgcagaaatgccaatggcatgggaagctctctgcaatgcttactgtggtcaaaattatgggtctactgattttgacgtgcttgaaaatgtataacttcatgctactgtcccgaggatctgctgtagtcggatttgttgtcatgctgggtttgttacttgctgctaatatggagttcacaggaagcatcccacaaggttttcaggttgatgggaatccattttga

SEQ ID NO: 106515 - DNA, 1134 bp, Glycine max
  Peptide Sequence Number=SeqID_223293
atggctcctgctacctcccagcgagccgagctagccagggtcttcgattcgttcgtttctcagtctggtgcaatcaaagacatctgtaatagagccttctgttacagccaattggagctgcacaagcacgtaattaaggattgcgacaaagcgcttcagcttgacccctcgcgacttcaagcctacattctcaaaggtcacgcgctttctgcattgggaaggaaaatagatgctctgtcagtatgggagcaagctcgaagagcttttgacaacaataaaacaacgcccaacaatgcattctatgaaaccaatgggtcgcccgttccacaatctgaatccgattctatgagtaatgggaacttgactgaaatttgtaagaatcaagatagtttgagtcctcaagatgaattatgtgacaatacaagtgataaatctttgatcttgctgaagtctgctgataattttgacttgcgaaatgaattaaatagtgaagatagggagtctaataaatctgatggccaagtgaatggaagcactgacgttattgataaactgagttataattctgaatcatgtaataacttaagtgacacttcagaatcacgggataaagataaagtagtggcgagtctagtagtgactcacttgatgttgctgaaattcttagaaagccaagtcactaagtctgtaagtgtagattttcagctctcacagggaatagcagagggaaatatgctcacgccatatccatttttgatcagctgcaatggtctcctccctagtgatatttggggtgtttccttttatttacttgttagtgatacttgtgacatactgaaagaggatcctgcatatcccgaagcactgattggaagagggactgcttatgcattcaagagagaacttgatgctgctatggctgatttttcaaaggctatagaatttaatccatcagctggtgaggcatggaagaggagaggtcaggcacgggcagccttggggggagtttgtggaggaattgccaatttcaaatttaaagagtttgatgctgcagttgaagacctttcagcatgtgtgcagctaggcagggataatgagtctgcctatacatgtttggtgggtcctgagtcttaa

SEQ ID NO: 106516 - DNA, 1821 bp, Glycine max
  Peptide Sequence Number=SeqID_223294
atggagtaccaactcccacaaaatccacccaccaacaccaaaactcataagtcgacacctcctattccaacatacactaacaactactgctcttgcttcttctgcatcatcatgtctgaaacagttcctcccctcagaagagcgaaaatcgctcgctacttcaaacaaatgcctctcacagacgaccaagaacacatcctcgcgttaagtggcctctggaaaatcgccataactaaccccaatgatccagagtttccttcccttggtatcttcagatgcatggccaaactgattcaaaaaggagtgaatcacaaagattggcttcttaggggtcagaacatgtatatcccttattatgcagcgcatatcattggttcttacaccatgaacaaagccaagttcgctgataaagctgttaagttcaacgtggttccgccgctgatggagcttctccgtggcaagattagttgggttgagcaaagagttgcacttcgcgcactgggtcatttggccagccatgaagcaacttttgaagccgtttcggaacacgaagctgaagtggtagaagcagccattaaaatagcttccacgtgcctaaaagaggtgtttgaaaagttcgttgtgttgaaggaatcggagagattggagtaccacagaaacttgctcacaagagggcatgcagacttggaattagagaacagaaaagcagaagaatgggccagccagctccagtgttggtctctctacctccttgattgctttgcatgtagagaaagatctatgggactaatctgcaaaaagaaattcttgaaggacttgtgtggaatgtggggtggtttagcaaacccaacatcaccttctggaataggacttctcagtactctgtgtggcacccaaatagggagagaaagtgttgcagatttggaagaagttgtagtgaatctttgtaatgtgtcaagatcctcagatgataggcaacacatggcaatcgatagtctcttgcaacttctcagagatccagttacaagatataaagtaatagacaccactgttccagttcttgctgatttggttgagctaagaagtttgggagggaaacccaacgttggacaagaaatcatgcaaactctcttacaggattaccacaaagtcaagtttggtgagctgaagttgaagagtgaaaaaaccaagagagcattagaagagttatgggacttgaaggtggaaagggtcaaaaaacaaagcctaatgagtgagcaagaaataagagaaaaagaagtgttggcaggtattttgaaacaagaagggaatcgtgaatttgggtcaagggagattgaaaaggctgtggtgaagtacacagaggctttggatttgtgtccattaaagtctaagaaagagagaatagtgcttcatagcaatagagctcagtgtcacttgcttcttagagatccagaagctgcacttagtgatacaactcgagcactgtgtctatcgagtgtggcgagaactgcgtgtcttcatagcaagagtttgtggagaagatcacaggcttatgacatgaaggggctcgccaaggagagtttgatggattgcttaatgttcattagcaatcgatttgggtcttctacacagagaaagggattcaagatcccacactacgcagcacgaatggttaacaaacagatgaacgccacgtggctctttgcttcagccaagtcgagttggaaaaaagttgctcgcgaagaagtgaaagaatttatggtccaaaataaaattgattctctcaggttgaggaagaaaacgaggaggagaacatcgtaa

SEQ ID NO: 106517 - DNA, 900 bp, Glycine max
  Peptide Sequence Number=SeqID_223295
atggggatagcagctgaagctcataacgtgaagattttgggatcaggcactgaatatatagttctggctcatggatttggcacggaccagtctgtgtggaaacactttgtaccttatctcgtcgacaatttccgtgtcattctctacgacaacatgggcgcgggtaccactaaccctgactacttcgactttgagcgccactcgatcttagaaggttatgcctctgatttgcttgccattttagaagagctccaagttgagtcttgcatttttgttggccactctgtttccgcaatgattggcgctattgcttctatttctcgccccgatctctttaccaaactcatcatggttggcgcttcccccaggtatttgaacgacgtggaatactatggaggatttgagcaggaagatctagaccaattattcgacgcaatggcggcgaattacaaagcatggtgctatgggtttgctcctttggctgtgggtggggacatggagtctgttgcagtgcaggagtttagtcgaacgttgttcaacatgcggccagacatagcgctgattgtgtcacggaccatttttcaaagcgacatgaggcagattctgagccttgtttctgtcccctgccacatcatacaagctgagaaagacatggctgttccgatgatgatctcggagtacctccaccaacacattggtgccgagtccatcgtggaggtcatggcaactgatggtcatttgccgcagttaagctcgccggataccgttattccggtgctgctcaaacacattcaacttgatattgaggcaagaagctgtgataatcaagctaaggaagctttgagaattgatcttggactttgtcacttgagttttcttatggactttgataatagatag

SEQ ID NO: 106518 - DNA, 2076 bp, Glycine max
  Peptide Sequence Number=SeqID_223296
atggcgtcgctatggactcaactcatatccacggtgtccttaattctatcccttgcgcggtgggttgctgtctccggtgactccggcaacgtgttactctttccaagtcgtcatcacgagggttctcgccctgccatgattctcccccttcatcactctgttcccgaatcttccctctctcactttaatcctcgtcgtcatcttcagggatcccagtcagaacaccatcccaacgctcgcatgagactcttcgacgatctccttcgaaacgggtattatacgacgaggctttggatcggtactcctccgcagaggtttgctcttattgttgatacggggagcactgtcacctatgttccgtgctctacttgcaaacactgtggtagccaccagtttttgttagcaagaggggatcaaaccctcaacctttctcctctttcctttttccttaaccatccaaccaatcttatatctcctgttattgggtcactcatttatctaaactctagatgtctattgctaggcatgaaggatccaaagtttcggccagaagcttcagaaacctatcaacctgttaaatgcacatggcagtgcaactgtgatgatgacaggaagcagtgcacatatgagagacggtatgctgaaatgagtactagcagtggggtccttggtgaggatgttgtatcctttggaaatcagagtgagctttccccccaacgtgctatttttggctgtgaaaatgatgagactggtgatatttataatcaacgtgctgatggcatcatgggtttgggccgtggagatctaagtatcatggaccaactggttgagaaaaaggtgataagtgatgcgttctcactgtgctatggtggaatgggtgttggtgggggtgctatggttcttggtggcatatctcccccagctgacatggtctttacacattcagatcctgttcgaagtccatattacaatattgatttgaaggagatacatgttgcggggaagcgactgcatttaaacccaaaggtttttgatgggaaacatggaactgtcttggatagtggcacaacttatgcatacctaccagaatctgcatttcttgcatttaaacacgctattatgaaggaaactcactctttgaagcgaataagcggtccagatccacattataatgatatatgtttttctggtgcagaaattaatgtctctcaactctctaaaagctttccggtggttgaaatggtatttggaaatggtcacaagttgtcactgtctcctgaaaattacttgtttcggcattcaaaagtgcgaggtgcgtattgtctaggggttttctcaaatggcaatgatccaactactcttttaggaggcattgttgttcgtaacactcttgtaatgtatgatcgtgagcattcaaaaattggtttctggaaaactaattgttctgagttatgggaaagactacatgtctcaaatgccccaccacccttgatgcctcctaaatctgaaggaacaaatttaaccaaagcatttaagccctctgttgctccatctccatcacagtataatttacagctaggtgaactccaaattgctcaactaatagttgtaatttcatttaacatcagctacatggatataaagccttacatcacagaattgactggactcattgctcatgaattagatgttaatacttcacaggttcacttaatgaatttttcttctcttggaaatggttctctctctagatgggtcataacaccaaggccatatgctgatttcttttctaatgctactgcaatgagtatgattgcccgactttctgaacatcgtatgcaacttcctaactcattcggaagttacaagttacttgagtggaatgctgagcctccactgaaacggacttggtggcagcaatattatttggttgtggctttagctgtttcgcttacattggttctaggaatatcagccttaggaatattcttaatttggaaaaaaagacagcaagctgagcactcatacaagccagttgatgtagctgttcaagagcaggaacttcagccattatga

SEQ ID NO: 106519 - DNA, 1539 bp, Glycine max
  Peptide Sequence Number=SeqID_223297
atgcctcctgaacagacccaacaacctctgttatcggaggagcaagaagagacagcctacgattcctcggagaaggtggtggtggtcggaatcgacgaccacgacggcgacgtggaggcgccgccgttctcatggcggaagctgtggctcttcactgggcccgggtttctcatgagcatcgcgtttttggatcccgggaatctcgagggggatcttcagtccggtgccattgctgggtactcgctcttgtggctcctcatgtgggccacggctatgggccttatcatccagcttctctcggctcggctcggcgtggctacgggaaggcacttagccgaactctgcagagaagagtatcccacatgggctaggattgttctgtggttgatgactgagattgctcttattggcgctgacatacaagaggttattgggagcgctattgctatcaggattcttagtaacggcgtcgttccactctgggctggtgtcgtcattacagcttttgattgttttatttttctctttcttgagaactacggtgtgaggaaactggaagcgtttttcgctgttctgattggtgtaatggctctctcatttgcctggatgtttggtgaagccaagcccaatggtgttgatgttcttgttggtattttggttcctaaacttagctccagaactatacagcaagctgttggagttgtgggttgcattattatgcctcacaatgtgtacttgcattctgcgcttgttcaatcaaggcaggttgatcccagcaagaaaggccgtgttcaggaagctcttaattactactccatagagtccaccattgcccttatagtgtcctttgtcattaatatatttgtcacaactgtgtttgctaagggcttttatggtactgaaatagcaaatagcattggtcttgtaaatgcagggcagtaccttcaagagaagtatgggggtggactattcccaatcctgtatatatggggtatcgggttattagcagctggccagagtagcacaattactggtacatatgctggacaatttatcatggggggttttctgaatttaaggttgaagaagtggataagggcattaattacacgaagttttgcaatcatcccaaccataatagttgctcttatatttgatacctcagaggaatcgttagatgttctgaatgaatggcttaatgttctccagtcagttcaaatcccctttgcactcattcccttgctttgcttggtgtccaaagaacagataatgggcagtttcagaattggccctgtcctcaagattatttcctggctggtggctgctctagtgatagtgataaatggctatctattgctggaattcttctcctctgaagtgaatggggcagtgtttgccactgtagtaagaaattatgctgagggcagtggtaccttgttggttgtcatacttcaacaaaacaagtcaattatgtatttgtatttctgtcaaaattcgatgcataatgcagctgttagcatgccttggatattgagataa

SEQ ID NO: 106520 - DNA, 1131 bp, Glycine max
  Peptide Sequence Number=SeqID_223298
atgggttgtccttttgcatctagagattcaactcaacacttcagaggtagtgcccattttggagattcaacacccatgttgaagcgtggatacaaaccaaagccatggagtggagctcagaattgccgggtttctgtgttcctcatgttttttacattggttctaatgttagtggttttccttttagtatttcgttatgacagtgatggtgctaatcccattttagcttatgaacttcctaaacaaaaatggaatagctttgactctttggtgcatttgcatccaacaaaagagttccggaatgaaactgatttgatatggcaagtgcctgaatcacctaaaggtgttctctttctggctcatggatgcaatggcagggccatcaacttctgggacaagtcccctaaatgccctgattgcattggtttgcctgaggaacggttgcttgtactccatggtcttgcccaaggttttgctgtcattactatttcaagtgcacaaagatgttggacatttggtaaagaagtgttggttgttaaagacattatagagtggtggattggtagaaagaagcttgagaagcttcctcttgtggctttgggtgcttcttctggagggtatttcgtgtctgtgcttgccaccgccatgaagtttagtagtactgtgctcatgattgctgaggggatgtttgagcaaattgatgttaaaggggactacccgccgaccctttttgttcacatgcccaaagatctttataggcagcagaaaatagatgaatatgtggaggttttaaaagataaagggattgatgttggtgttgttgaatgtttggagtttccattgtcaccaagtactttagctgatagaattccagggcttgatcaggctctttccagaaatttatttgagttctttcaggaaaagggctttattgataaaaatggttatatgaggaaagatgggcgtcaaatcaaatggaaaaaggcttttgaggagaagaaagctcttctgctggataagaatctggtccctcacatccaagaggagctaaaccttgcatttgcttaccatgagatgactagtgtgcattctgaccaaatttttaaatggttggaaactcacatgagctga

SEQ ID NO: 106521 - DNA, 255 bp, Glycine max
  Peptide Sequence Number=SeqID_223299
atgaagttctatgtatctgcaaaggggataaagagagtcgtcgctggaaaaggatccgccaagaccactgctcctgcctacaccgttgccgctcgccggatttccaaccggatggtggtggtgctcggaatcgtattgctgctcagctttgtgagagtggcggttttggtgctggaatcttctgcggtgtgctccacctttgtagctagttcggtaaggaaaactgttgagtgtgggacaagtacatatgaatga

SEQ ID NO: 106522 - DNA, 1320 bp, Glycine max
  Peptide Sequence Number=SeqID_223300
atgggaaccgcatatgagcatttcggaatgagctcagttgctggaaagcagttaacaaacaataacatggtaagactgtggaatacaagaccagacttggatcatgtcaagattccaaaagcacgagagtcttctacagttatgcataacaaaaaaagtcgcagagactgtgaaacaaaggctccaagtcatgttgggaatgccaacaaagccggtagtttgcatgattcaccacctcttcacctccctccgttttctcaacctgtccttcaatgcattattcggcaaagttctttaaatctcagaactcggcagacacagaacaagacctcgagcagcaaggagaatttcaagatttgtcatctaacagaggccagtcagaacttgattgccttggaaggcattcttcttggtcacgcttcctctttgtcccctcatgaactcaaaagcacaaataatccaaagttcccaagtggaagaatggtacagtgcaagaacttgagcatcaaaactgagcgatttgctctttgttactgcacattttcctcaaagtgtcttatgtttggtgaaatggatagaaagcaagaacaagacaagggaaactcaaacatgtctggcattgatgtagctctaatatctcccaaagtcccaaaagcagtttcaccagtttcttctgcagcagcagaaggggacaccttaaggcgaccacgtggccggccagctggctccaaaaacaaacctaagccaccaataattgtcaccagagatagtgctaatgcactgaaggctcatgccatggaagtaagctcaggctgtgatgtgaatgaaagtttgttgaactttgcaaggagaaagcaacgtggcctttacatactcaatggaacaggctgtgtaacaaatgtaacattgcgccaaccaggctcagctggtgccattgtgacccttcacggtcgattcgagattctttcacttctggggtcaatccttcccccaccagcccctccagggatcacaggcctcacaatttacttggcaggtgctcaagggcaagttgtgggaggtgctgtggttggtgctttgattgcttcaggccctcttgtaatcatggctgcatcattcatgcatgctactttcgatcgccttccattggaagatgatgaacttgctgctgcaatgcagaatcagcattaccaaaatggacgcacccaccatcttgatatttctgacttgtatgcaatcccacagaacctgctcatgaatggtacaatgcccccagagatatactcttgggcaccagggaggaacttctcaaaaacctga

SEQ ID NO: 106523 - DNA, 438 bp, Glycine max
  Peptide Sequence Number=SeqID_223301
atggtgtgttcattagacagtgctttttatcaagtaaatggattttctatcctcttcatggaagtgaagattatgaatacttatgaagttgaattgatgtttatgaacaggaggaatcatgaggatttgcatctgttcactataatattgaaccaagaaattagaagattatcaacccaggttataagagtgaaatggtcactccatgcacgagaggaaattgtttttgaacttcttcaacagttgagaggaaatgcagcaatagtgttgctggaaggagtaatgaaaagtacaagacaaatgattgaggagcaagaagcagttcgaggtcgcttattcataacccaaaatgtcatgcaaagctcagtctgggcatggttgcaggagtccctcctgagctcttgctctaggaaagaagcagactcaccaaacagatag

SEQ ID NO: 106524 - DNA, 645 bp, Glycine max
  Peptide Sequence Number=SeqID_223302
atggttaatgaaagaaggaaaatactacagaagaatagaaataaggaatctgaaaaggagaatgaaggtgggcgaggatggttaaaagaaaagggaagacatgaaagggagaaagaatgtgaaagggatggagagaaggcagaaaatcttaaagagctagaacaacagcattacaatcagagctgtagagaaatggtcatagatcaagaagatttggttactgtaaagcatgcagagaacaaagcatttggagggacagaaccaatggatgtctctacaacatcaacattgcaaccatgtcaaattcctaggtcagatgtgatagttttggaagggcatacttcagaggtgtgtgcttgtgcatggagtcctacaggatctcttctagcatcagggtctggggattcaacagctcgtatttggacaatagcagaagggagatgcaaatctgctttgctgaatggccctccgaatgtattggtgttgaagcatgttaggggtaaaacaaatgaaaagagtaacgatgtcactacacttgattggaatggggaggggacactacttgcaactggttcatatgatgggcaagcgagaatttggaccaccaatggtaggtcatttcttatatctccgaccttgcagtaa

SEQ ID NO: 106525 - DNA, 270 bp, Glycine max
  Peptide Sequence Number=SeqID_223303
atgaaagagaaaggaagatatgatgaactagagaggaaaaaagggaagatggttgttttgtgggttaatcatgcaactaaaagtatatatagtggtagtggaagactatgtgaggttgtgagagacaaaggagagggtttaagaaagcaaaaatggggtgtggtgagggagagtgttggagggtgcaagcaagagaaggagcaaaaaggaggggaaaaggtgacgaagaaggttgaaaacgaagtaaaggaagaattgtttggaatatag

SEQ ID NO: 106526 - DNA, 1623 bp, Glycine max
  Peptide Sequence Number=SeqID_223304
atggtgttcccaatggtgcttctgagacttgcagactgggtcttgtaccagctgcttgctaactcgtgttatagagcagcaagaaaaatgaagagttatggattccatttggggtatttgtcatctaaaccaccccttcaaccttcttctttccctagcgttaccaaatgtgatttggagggtagaggctcacaaacacttgttgcttgtgacattcatagagtccttttgaggtcccactccttctttccttatttcatgcttgttgcctttgaaggtggcagcattttaagggcactcctcttgctcttgtcttgtcctgtgttgtggattttagaccatgagttaagtcttagggtcatgaccttcatcaccttttgtgggctaagaacaagtgccatggaaaatatgtcaagggctgttttgcccaagttttatttggagaatctcaaccttcatgcttatgaggttctggcctcagcagggtctaaagttgttttcactagtgtgcctagagttatggtggaagggtttcttagggagtatttgagtgtcggtgctgttgttggcacagagttgcacagtgttggttgctactttagtggtttggtttctggttctggcttgcttgtgaagcacagagcactgaaggattattttggagacagaaagcctgatattggggttggaagctctagtgttcatgatcatctttttctctccctttgcaaggaagcatatgtggtgaacaatgaagagggcaagggcaacccaagttcagtgttgccaagggacaaatatccaaagcccctaatattccatgatggaagactagcattcctgcctactccctcagcaactctatatatgttcatgtggtttccattaggaattcttttagccatttatagaatccttttgggtattctacttccttatggatgggcaatggcattaggggtttggagtggcataaatctgcaagtcaaaggcaatgtcctagaagaaaagtcagagcaaaacaaaggggtcctatttgtatgctcccacaggactctccttgatcctgttttcctaagcacatgtttggcaaagcctttgactgcagtcacatacagcctaagcaaagtgtctgagttaatagcccctattaggacagtgagactaacaagggacagaagaaaagatggtgaaaccatgcaaaggctcctcaaagaaggtgatttagtggtgtgtcctgaaggaacaacttgtagggagccatatttactaaggttcagctcactgtttgctgaattggctgatgagattgttcctgtggctgtcaatagtcatgtgagcatgttctatgggaccacagcaagcggtttgaaatgcttggaccctattttctttctcatgaatccaaggcctagctactatattgaggttcttggaaaggttcccaaggaactaacatgtgccggaggaaggtcaagctgtgaagtggcaaactatatacagcaaaagttggcttgtgctttgggatttgagtgcaccacacttactaggagggataagtacatgatgctggcagggaatgaagggattgtgcatgaagacaagtggagaaaatgctattga

SEQ ID NO: 106527 - DNA, 768 bp, Glycine max
  Peptide Sequence Number=SeqID_223305
atgctttggacatatagtacagaacaaagtaattcagttgtcatttcaaacacaggttcaagtaggacacaaaaggaagtacctggacatgtgaatgtactaggacatgatcaagggaaacaagaattcactgcctcaatttctacagtccaaagggatattaccactcccatcaccaccattccaaacttagttccaaccactcccaccatttcaacatctccattcctgaatcctaattccaatccagacacagtctctccagcctccacaatcccatttaccactcccaccactgtgaattctccaatctcctcaggtgcaagctggtgcattgcaagcccaactgcctcgcagactactctacaaattgcattggactatgcttgtggctatgatggtgctgattgctcagcaattcaacctggtggaagctgttacaacccaaattccatcagggaccatgcttcttatgccttcaataagtattatcaaaagaatcctgttccaaatagctgcaattttggtggaactgctgtcatcattagcactaacccaagcactggggcatgtgaatatccatcaactagcactagtacatcagtgttgaacacaacaaactcaagcggtgccaacgtttttggttcagtgccagtgcccacagaaccctctccctctgctgctgctgcacctgacacattaaatggctttgcagatatttgtatcgttctgtggataatttcaactttgcaaagaaattatctctaa

SEQ ID NO: 106528 - DNA, 1614 bp, Glycine max
  Peptide Sequence Number=SeqID_223306
atgtcaagtaacaatcccattggtattgcttgcataatttttcaagcaattggaatgaacacaattggcacaaaatacgtcacttttctcattaagcaacagaggcttaggcccattagcgtctcagttcccgccacatttatcttgatcttcccgccatctcgttcacacaccaatcacttcgctctcgatttctccgtttcccacttggcgaacacaattctccgattgattcagttcataatttcggtcgcaaagcaaatgatcccacatcaagaacccgatttcaatctcaatcacctcaaactatattacggaaagctgtttccttttgttgatttagtcagatgggtgtcttatggcaacgatgggaagcaccctggttgtgatcaatcctacattgggcgaagagagttttccttcactctggagaatgatatatatctgcgcttccaatctttccacaatgcccacgagctcgaaaactccatcaaagaaaagtgccctgttaagatagatattggaccagtctacactgttgatcctgcaaaaaggaatgcctatgcacagagtggtgataataatgtctttgccccagttgagagggagttgatttttgatataatactgctgttcgggtgcgctgatgtttgtttggtttgctggccgttgatgactacagcgatcaaagtgattgatactgccttaagagatagcagtacatctcatataacatataaagaccatggagttgatatgactttggtttcaaacacattctctgggtatatagtgggcgcagaggtgttcattgttgggtctgtgatggaaaggcaagaaggttgccttcacttatacaggttgacaaatgaacaaagaggtgctattgctgactattttcgtgtctacaagggcaatgaaaatagtcacaagaaggtttctttgatgggtgctgctcttcatcctttcttggcgacatcatacactaatgttctcaaggactattttgagaaaaatctgcttacaggtcaaaatttacttgctaccgaggagagatatgagaagatccttggcatgattcctgatgaatccattgcttctgaacttaggggaagatggcaagatagtaggcggtcttctagtgcaaaagaagacatcaatgttgttcgatgggaacagtgcaaacagttgctgcaatctggaaaacataaggcacaagggctgcgtcggtgcattgaagagattgtgttctgctttacctatcccaggctagatatggaggtttctaaacacatgaatcatttgcttaaagcaccattctgtgtacatcctaaaacaggccgagtttgtgtccccattgatccaaaacggtgtgaggagtttgatcctactacagtacccaccctttcacagggagagaaaaactttccaaaacggtgcttagttcaatggctgatagaagagcttaattatgaaggttcaagagctgatgttgatggtggaggagatagaaaattcctattacttaaaattgcagcagtcaaagaattcccttgcttggtagtgccacctattcttgatttgtcaaatagagctgtcttggggtcacattag

SEQ ID NO: 106529 - DNA, 798 bp, Glycine max
  Peptide Sequence Number=SeqID_223307
atgctcttagcagcatcctacggcgaccattggcgcaatctgcgactcgagatcctctccactcaccgcctcaacttctttttggaaatccgaaacgacgagacactcaagctactccgaaacctggctatggcttctaataataaaaaagacttaacaaaagtggagttcaggtctatgctcgaggatctgacgtttaacattatcatgagaatggtgtgcgttaaacgctattacggcgaggaaaacgaagggaccatcgctgaggaggctaacaagtttagagacatcatgaatgagatggcgcagttcggtttgggatcgaacctcggagatttcgtaccggtttttgagatggttagatttgggtggtggccgcaagaagctacgaaaaactggggagaagaggacgcgttgtttcaagggctcattaacgagcatcggaataagaacgaaaattcaaatactaccatgtaccttcagaatttaattagcgagactctaagattgcatccaccagcgccgttgctgcagccccatttctcctcggaagattgcacggtgagaggttttggcgtggcacgtaacacgatattatttgtgaatgcgtggactattcatggggacccagagttgaggactgacccaaagtgttttaagcctgagaggtttgagaatggtccaattgatacccacaagctaatgccttttgggttggggaggagggcgtgtcctggtggaggcatggctccaagaactttgggattgactttagtttcgttgattcaatgcttttga

SEQ ID NO: 106530 - DNA, 822 bp, Glycine max
  Peptide Sequence Number=SeqID_223308
atgttggggggacctttcaaggaggaagaaataagggcggcagtatggagttgcggaagtgaaaaaagtcctggaccggatggcttaaattttaagttcataaagcagttcttggaggttctaaatcctgatatcagccgtttccttgatgaattccatgctaatgggatcttcccaaggggcagtaataaatcatttgtggccttgatcccaaaggtgaaagatccacaaaatcttaatgaatacagacctatatcactaataggctgcatttataagatcgtggctaagcttttagcaaatagattgaagttagtgatgccagacataattgatgagaggcagtcgacattcataagcggaagacatttgttgcacaacgtgttgatagtaaatgaggtagtggaggaagcaaagaggcaccaaaagccatgtctagtgttcaaagtggactatgaaagagcctatgattcagtctcctgggccttcctatcagatatgatgaagagacttggattctgtaataagtggatatgttggattgagggatgccttaaatccgcctcgatttctgtcctggttaatggtagccctacaaacgaatttttaccacaaaggggtcttagagaaggtgacccactagcgcctctccttttcaacattgtagctgaagggttaactggattgatgagagaagcattggataaaggaatatatagcagcttcctggtgggaaaaaacaacacaccagccaacatactacagtacgcagatgacactattttttggggaagctacaatgcaaaatgtcaagacaattaa

SEQ ID NO: 106531 - DNA, 1887 bp, Glycine max
  Peptide Sequence Number=SeqID_223309
atggagatggaatttttctccgattatggcgatgtcagcaggtacaaaattcaagaggtcattggaaaaggaagctatggtgttgtttgttcagctattgacactcatactggcgaaaaagtagcaattaaaaagattcatgatatctttgagcatgtatctgatgctgcgcgtattctgcgtgagataaagttgcttagacttcttcgacatcctgatattgttgaaattaagcatgttatgctgcctccttctaggagggactttaaagatatttatgttgtttttgagctcatggagtctgatctgcatcaagtcattaaagccaatgatgacctaacaaaagagcactatcaattttttctttaccagttacttcgagcattgaagtatattcacactgcaaatgtctatcatcgagacttgaagccaaagaatatactagccaatgcaaactgtaaacttaaaatatgtgattttgggttagctagagttgctttcaatgacacaccaacaactgtgttttggacggattatgttgctacaaggtggtatagagcaccagaactctgtggatcattttactcaaggtatactccagcaattgacatttggagtataggttgcatctttgctgaagtattaataggaaagcctcttttccctgggaaaaacgttgtccatcagttggatctgatgacagatttgcttggcactccctcgctggatactatatccaaggtacgcaatgataaggcacggagatacctaactagtatgaggaaaaagcagcctataccatttgcacaaaaatttcctaatgcagaccctttagcactacgactactggaaaggttgctcgcctttgatccaaaagatcggcctactgctgaagaggcattagctgatccttacttcaagggactttcaaagattgagagggaaccttcctgccagcctattacaaaaatggagtttgaattcgaaaggagaagagtcacaaaggaagaaattggagagttaattttccgtgagattctagagtaccatcctcaattattgaaagactacataaatggaacagagagaactaattttctttatccaagtgctgttgatcagttcaaacagcagttttctcatctcgaggaaaatggtggtaaaagttatccaattatgccacttgaaagaaagcatgcatcacttccaagtagttatggttatggttacttgaataaccaaatcatgaacagcgttagacataactcaatcccacaaaactcacttgtaaggtcaacaatggtacattcaaatatggtaccctcgaaagagcaatcaaacattgcttcctgcataaaccggcagacaactggggaatttaataataattccagggatacagaaagtcctgcgccaaggtctattccgggtctgcaaaaattttcacaagcaaaacctggaaaagttgttgggccagtgattccatacgaatatgcaagtgttgtcaagggtacatatgatccaaggacatttatgagaggttctgttcttccttctcaacctatcctccctacgaatcattatcaacgatcaacctctggaaaacaagaaaggtcagcaacagaagctgacaagggtgtatctttacaatcaaaacttgctcagcaatgtggtgtgaatgccaaaatagcaccagacacagctatcaatattgacaccaacccttttttcatgacacgagcaggagtgaacaagatagagcaggatgaccgaatagccattgagacaaagttgctgcagtcaaaggctcatcaatatggtgggattagtaccactgctcatagaaaggttggacctgttcagtatggcatgacaaggttgttctag

SEQ ID NO: 106532 - DNA, 699 bp, Glycine max
  Peptide Sequence Number=SeqID_223310
ggtctcggattcgaacatgaatccacaaagaagtgcaagacagaatcgtgggtggaccacgaccctgcgagctctgtctccgatgccaccaccgaggaagacgtggcattttgtctcatgatgctgtcgagggacaaatggaagcgacagagggatcaagatcaaccctgccgatttgcggaaagggaaaatcaatacgaggtggaggatcaagaagaagaagatgatgaagaagacgaggaagacgaagacgacgaagaagccttcgaggagagcgaggagtctcaagaaacatcgaaacagtgcaagaaccgtgtacgaggacggtacaaatgcgacacctgcaacaaggtgttccgatcctaccaagcattggggggtcaccgagccagtcacaagaagatcaaagtgaacggtggtggtagagaacaagaacttgaacacaacaagaagaagagtggaacatgtgttgttgtggaaaagaaaactcacgagtgccccgtttgtttcagagtctttgcttcgggtcaagcgcttgggggacacaagagaacccatgttactggctcagcagcaactgcagctgcaatcgcaacaacacttccgtcaagttccgcaaagtttggaaacagtttcatagatctcaacctccctgctcctattgacgaagacgatgctagccaaatcgagaactctgct

SEQ ID NO: 106533 - DNA, 1140 bp, Glycine max
  Peptide Sequence Number=SeqID_223311
atggataaacaagctgcattaaaaatagagagaatgttttattcttcaggactaccatttcatttagcaaggaatcctcactataggaaggtgttctcttttgctgccaacaagaattgcttatctgggtatcaacctctaggttacaataatttgaaaagaaccttacttgcaaatgaaaaaagacatgtagagaacctattacaaccaataaaaaatatatggaaagaaaaaggagtgagcattgccttagattgttctgatgaagtaaaagatatggatttcaaagatgaacaaatgatggatgtaattatggaggttggtcactcgaatatagtacaaattgttactgataatgcacataaattttatcatggtcattatatgagactatcgatgttcaattcgttcaacactttgaagttgctagctcttgttcccacaagatttgcttcccccatattgatgctaaagaggtttaaaaatttgaaaaaaggacttcaggagatggttattagtgagcagtggtcttcttataaggcatatgatattaacaaggcaaaatttgtgaaagagacattgtttgatgacatttggtggaacaaggttgattatatactttctttcactactcttatctatgatgttctcagaaaaacaaatatggatgcaactagtcatcatctggtgtatgaaatgtgggactcaatgattgaaaatgtgaagaaggtcatatatcgacatgaaagaaagggagaaggtgaagaatctatcttttataaggtagtacatgaaatattaattgactgttggactaagagtagctcacctcttcattgtttagctcattctttaaatccaagaatttctccccaccaagatggagaacttactcgtgaaagattgaaatgcttcaaaaggtattttgatgatgataatgaaagaagacaagtgaatgcagagtttgcaaacttttttggtgaaagagaaggctttgatgatattgactctttaagagataaaggtataatggagacaaagtcttggtggctagttcatggtgcttatgcactaacacttcaaaagatttctcttaagttactaaggcaaccttgttcatcttggtacttttttaggtga

SEQ ID NO: 106534 - DNA, 335 bp, Glycine max
  Peptide Sequence Number=SeqID_223312
atggatagacacaagtgcaagctttgcttcagaagcttcgccaatggaagagcattggggggtcacatgaggtctcacatgatgaaccttcctatctcaaagcccgaagaattagcctcatcgcgaacgatccaactcagcttcgaagctgagtcagcttcatcatcgtcatcgtcttcttcagacgaagaggatgaggatgatgaaaagactctatgttatgatctcagagagaatcccaagctcagcattcacctcgtggatcctgaattttcgttcgcaacagcagcagacactggctccgtgatcctccacgacagagagagcgagtccga

SEQ ID NO: 106535 - DNA, 687 bp, Glycine max
  Peptide Sequence Number=SeqID_223313
atgggggatgcagtggccatgatggatatccctagtgggggaaatagaatgggaaaatacttgtacttcggggcatgtcactcagtttggaactcccttatgactcaggctgatcaccaggggggagagttgtctgtgcttgatagggacttgttggttagtaagccctcatccacccattataccgaagttgttgaggtggctcttgagacgtcatttcaaggacttgagatcgccaatgccacttatgtgaaaaagagaaagattatccctaaattccaaccatcaagagcttccatgatggtggcaaaagttatgctggagaatgggtatcactatggaggtggattaggaagaaatgcacaaggctcaatagttgttgttgaacaagacacttttgaggatgagcaagtcaacttggttcatgcttgcccatcaaattttgagtgtcttaacaatcatgctgatgagaaaattgaggatggtttggggccttcccttgaattattgaggttggtggatcaagaggctaaagagatttctcctcatgaagaattcattgaggtgataaacttggggaatgaagaagggaggaaagagatcaaaattggcacacttatgaaggaaagtgaaagccatcaattgataaagctcttatgtgactataacgatgtctttgcttggtga

SEQ ID NO: 106536 - DNA, 444 bp, Glycine max
  Peptide Sequence Number=SeqID_223314
atggctggacggaatgatcatggttggatcgcttccaatgaaacaatccacctgctttcaatggaggatacaaccttgatgaagaagaagctgagtattgatgggaaaacactcgcgaatgcttggaggttgaaggggaacatgattgtggctgaatatgcagtcatgtttgaggagttggtgaggtactttcctcattatcaacgaagagatggtgaaataggtggccttgttggtgcttgcgtgcttagtgcaattctggctcgcttagcgcgcattagtgaatttcggcttagcgcacatcttttcgcttatcggatggattcaagtggtgcacttagtgggattagccctcgctcagcgaacatgcacaactcatccttcttccagattcttcctcgtgctcagccacaagagtggtgcgctcaacggatggctcgctga

SEQ ID NO: 106537 - DNA, 264 bp, Glycine max
  Peptide Sequence Number=SeqID_223315
atgggcatgggaatgacgatgatgggcacaacagtggtggcgacattgacaagaggtgatgacaatgacacaaagaaaggcacaaaggttccaggctttgatgcgggtgctgggtgttgggcatgttttgagcttttgatgcaactgccggtgaggtatatgggcttggatgtagctgttggtgttgttttcaagcttggatgcaggtgttggtgttgtttccaggctaaaatgctgggtgttgatgctggtttcaggctttga

SEQ ID NO: 106538 - DNA, 513 bp, Glycine max
  Peptide Sequence Number=SeqID_223316
atggtggtgacatacaaagattggcatgaaatgctaccattttccctacatggatatcatacctccatttgcacttctactggtgcaactccattttccttggtatgtgggatggaagcagtcctacctgttgaggtcaaaattccttctttgagagtattgatggaaactgagttagaagaagcagagtggatccaaactcgtgttgagaaattaaatctcattgaggagaaaagattgaatgcaatttgccatgtccaattataccaaaagagattaaagaaagcatttgagaagaaagtataccctaggcaatatcaagagagagatttagttcttaagaagattcttctaaataaaaaggataggattagtaaatggacaccatattacaaaggaccttatgttgtcaagaaagctttctcaggaggagctttaattttgacaaacatggacggcaaagacctttcatatctagtgaattctgatccagtgaagaaatattatgcttga

SEQ ID NO: 106539 - DNA, 819 bp, Glycine max
  Peptide Sequence Number=SeqID_223317
atgcagggtgatcatcagtatagcctgagccagcaagtcctgaactttgagaacacattgaatcagtataggacaatgatggatgcaagtgcattgaatcagttcttagccagttctatagcagttgtggtaactggaagcaatgactacatcaacaactacctcctgcctggcttatatggctccagttataattatactgcccaacagtttggcaatcttcttgttaataaattttggattaaggaagttcttcctagtaggaattgggccactgggttgcatccccaacagaatctgcaacagaatcccaaaacataccccttctccataaagatcaagatacattccctcttcttcccatacataacataccccttccttactttttcttttaccgctcctgagtggtctggtgaggttcggaatatcagctattcccccgattccaagtctgtctctgtcgtctacagagttaccctttatgggactgatgcggagatgacacaagttatggagatcctgtacagaaggcagaagcaattgcttttcgtagagcttgtgcacgctttgggctgggcctccacctttatcatcaagaagatgcatcataaaattaagcactgcttcaatgttttcatgatgcccatcgtttcttttttccatatcatttgtgatcatattgcaaccctagaagggatatattttgttgtaacctggcggagaccttctaagcttctacggtttgccatttgttttatctccagttaccttatctgccatgcaattgggagaattgatgttctattacacacctga

SEQ ID NO: 106540 - DNA, 123 bp, Glycine max
  Peptide Sequence Number=SeqID_223318
atgcggaaagaggttttattttcccttgaatctgtgaatggtacatgggagaaattcatttcagcatccaactccttctctactgctaagtctatgtgccattttcaactattgttgtactaa

SEQ ID NO: 106541 - DNA, 237 bp, Glycine max
  Peptide Sequence Number=SeqID_223319
atggtgatggccggtgacgagcacactcatatggtgactgcaactgtggttatagtagtgacaacgatgatgacgaaggtcatggacaatggtggtggtgtcaacggtgatgcggtcgtagtgttggaggtggtaacaattgatgacaatgatgccgcgataacaacgttgaagaatatcatagctgtaacaatggtgatgataataacagtgatagtcgcgacaatgatgaattaa

SEQ ID NO: 106542 - DNA, 306 bp, Glycine max
  Peptide Sequence Number=SeqID_223320
atgggatggtctaaagttgtacgtcaaccttccaaagtacgggagacggagggtgcggatagtggagcacaatgccaagccaagaatcctcacaacagagaaaacagcgggtcagaatgcaacgcaccacaggacccctatcagatcatatgcaacagtggtagccaatacgacaatgggtgccgaacagaggaagcaaattcaaatctcacactcgaaacaatcgcaatcacactcgacgattcaactagaagcacaatggggggagaagaagtggcttacaggagcatgggtaggatgctttaa

SEQ ID NO: 106543 - DNA, 684 bp, Glycine max
  Peptide Sequence Number=SeqID_223321
atgtctctcacgtgcataagtttgctcctcttccacatctacttccttgcccacttcactattaccttctttgtgcaaaacatcttcctcctcgggttactcaaggattccaccgccctccttctccttctgctttttcattttgaaattttggttgctgatgtttctcgttggtcccaagcttgccacgtagtcaacacctttcggggtgcagataatccaatggataactcgtcgctccttgctccctcggtcctagcgatgtgcgtggttgactacggactagagtccgccgtgttgcgaatcatcgggcactgtcggttgtcgccatcgtcgggtgacttgactgacgaagctgccagcggtgtaccgaagcagctgtcgtcggagtcgatctcctccgacgaccagatatccctccttcgccgacaagtgcagctttcggtaccacggtggatttcctccacaacatgcaccttgtactctaccccccccccccctatgtttacgtatactgtgtgttgtatggcgggactccatggggtgcgaatgagcacccttgttctgtccacccttcgagactcttcgacatcatcatcgacgtccgccacatctcccattgcggccacgatttgctggatatatttcttctccgacgctataagtggaacgccccaacattga

SEQ ID NO: 106544 - DNA, 972 bp, Glycine max
  Peptide Sequence Number=SeqID_223322
atgggggagaacactacatacctaaaggttcgacatcgtacgcgaaagtggttactcgaaacaagcacaccggtggccatgcgaaagaaacaaccagggggaatcacaatcgtgcttcatcatgatcatcgccgtttgaaaaacctggtctggtttgataagctcgaagaagaccctctatgggattttggagcagatataactctaaaatacctaggggatgacatggtgctacttctcggactttcaaatgatagagctgaacaaatgaaccaggaggcaatggagggagaagagtccatgttttactccatggaaaagtggagtccgaagctgcgcgcggggcaaaggttaacttgggttcaatgttggggcgttccacttatagcgtcggagaagaaatatatccagcaaatcgtggccgcaatgggagatgtggcggacgtcgatgatgatgtcgaagagtctcgaagggtggacagaacaaggtacaaggtgcatgttgtggaggaaatccaccgtggtaccgaaagctgcacttgtcggcgaaggagggatatctggtcgtcggaggagatcgactccgacgacagctgcttcggtacaccgctggcagcttcgtcagtcaagtcacccgacgatggcgacaaccgacagtgcccgatgattcgcaacacggcggactctactgataattccgtgtacgcggccatgcaacagaacgaatacctgcaccccgaaagggcggtggaatccttgagtaacccgaggaggaagatgttttgcacaaagaagtggactgggcccttctattctgatgaggacatgaccaagagcaagggcaaggatccacttgaaggacttggagggcctatgacaagggctagagcaaggaaagccaaggaagctcttcaacaagtgttgtccatactatttgaatacaagcccaagtttcaaggagaaaagtccaag

SEQ ID NO: 106545 - DNA, 375 bp, Glycine max
  Peptide Sequence Number=SeqID_223323
atggatgacacatcctgggaagactgggatcagcttcgtgctgactaccaccttgaggacaaggtgtttccgcaagcgatagggaatggtagcaatccaggggtgcaaccagaatcaaaggcaattatctgcgttcatgataataatatgtgccaaattgccaatttgtttagggagagacacaaagatgaatttccttttaataaactaagggctgaaaaaagaaagccttactccttaagcaggagaaaagtggaaagtaaacgtcctaaaatatcagaagcaaaagaagattcccgatatcaagattatattcaaggcgttactagagcaaaacgatgccgcatgagggcacagagggctttactacgatag

SEQ ID NO: 106546 - DNA, 249 bp, Glycine max
  Peptide Sequence Number=SeqID_223324
atgagaatgaccaggttgctccaaccataattgagaaatcattggattttgagccaacattggatgagattgaggaaccatcaggtggtcaagaagagtcatcctatgaaagtgccaagcagtcttttcaaccatcaccaagtgttcctgatgctgaaagcactgaaaatccgaacattgttcctgtggctcaaagggaaaacacctcttggaagagttgctgcggactctttgagattatgaggggtg

SEQ ID NO: 106547 - DNA, 675 bp, Glycine max
  Peptide Sequence Number=SeqID_223325
atggaaccagcttcagctgattcttcatctcaacctactcctccagcttctaatactgaagatcggcactcaaccaaagcgtctggacaaactggcaatgcacatgattcacaattgtcatcacccacttctggcatatcatcctgggcaagaaatctgaaattcccacaggcccttgggcttggaggagcacaacagaactcccaggcccaaaacgctggcatgtcagcttttgctcgcctgactggtgggcttggattgcaaacgctatcaaatgaaactgctccagtcaagtcaggaaccgagcaatctaacttacttgaatccgtcaccaaaggcttggtggactcttccaagagtgcagtaaaggcggtgcaggtcaaagctcgccatattgtctctcaaaataaacgtagataccaggaagatggatttgatttggacatgacatacatcactgaaaatataattgctatgggatttccgggtggtgattttagctctggaatttttggatacattgaggggttctatcgcaatcacatggatgaagtgatcaagttttttgaaacacatcataagatctcccaaggttcttatcaaaaggatggtcaaagaaatctagaacagaaccaaagagtactttatcttctggttaacagctcaggaatatag

SEQ ID NO: 106548 - DNA, 387 bp, Glycine max
  Peptide Sequence Number=SeqID_223326
atgggtttgacggtgtcacggctattgagattgttttatgcaaggaaagaaatgaggattctgatggtgggtcttgatgctgctgggaaaacaacaatactctacaaactgaaacttggagaaatcaacacacaaggtcttatctttgtggtagatagtaacgacagagagagaattttagaagccagggatgagttgcatagaatgctgagagaggatgaacttcgtgacgctacattactggtgcttgccaataagcaagaccttccaaatgctttagtgttgcagaaattactgataaacttggtttacattcacttcgcctgcgtctctggtacatacagccaacttgtgccacatccggccaaggactctatgaagggctag

SEQ ID NO: 106549 - DNA, 1440 bp, Glycine max
  Peptide Sequence Number=SeqID_223327
atgattaggaaaaagaaacaaaaccatgaacccatgatggttgcaactttcccatttagtgatcataattgccctcctattcaacttatagcatcattttgtcaaagtgcatattcatggttgaaggaggatattcaaaatgtggtggttgttcattgtaaagctggtatggggaggactggactgatgatatgtagtcttcttttatttcttaaggcaagtcatgataatcaacttcaaagactttggaatttcttcccaactgcagaggaagctattgattactttaaccataaaagatgtgtagatggaaaggctctaatcctccctagtcagattagatatgtaaaatactttgaacggactttaacacacttcaatggagaagtccagccaggacgaaggtgcatgctaagagggtttcggcttcacgaatgcccttattgggttagaccatctattacaatttctgatcataagggaattctttttaccacaagaaagcatcccaaaacaaaggatctaatgccagaagatttctggatcagtgcaccaaagaaaggaattgtggtttttgccctaccaggagagcctggtctaacagagttggtaggagacttcaaaattcagtttcaagatcgacagggagatttctactgttggatgaatacaacattgacagaaaaccgaaaaattttggatggttcagattttgatggtttcgacaagagaaagatccctgctccaggattcaaggtggaaattgtgatgatagggtataatgccatcctacctgcaaatacaaaatcgaatcctgccagcaaaggatctgatggaaacacaagcaatgccctacctggtctaaagcatactacatctaattcaagtgagagtgaagtccctagaaatggagatgatgatgtattctcagacagtgacgaagaggagacccgggatacacaaagcacgaaagctgcaactgagtacaaatttatggcacctcatcaagtatctgagacaacaactgaccatgtagggatgttgacacacaaaacggatcagttgtcactacaacaagaggaacgcaagcaaaacgttgcttctgaagaatcagatacagataaacttcataaaaatcatacaggcaataacagtataaacatgggatctgtaggggcaagtgacatcaaggcaatcgcggcagatgcttcagttttttcctttggagatgaagattttgaaaggttacatgtttacatgattctctcaagtattctacgtgatatgcttcactgtcctcaatggcctatggagaattccaaaatcattgctagtcgaagtcaaaaggtggcaatgcaacgcggagatgggtggggtggtgatggagcagtggccagagttgtggttaaaggaaagagaatcggggaaagagaaaaatga

SEQ ID NO: 106550 - DNA, 474 bp, Glycine max
  Peptide Sequence Number=SeqID_223328
atgcctccagcttcaagaaggaaagcaaaacaagccaagaaatacaaaactgtgaccattctcaaccaccattcttcccactctgatcaacttcaagggacagctgtttcaccaaaccacatcaagaaaatggaaggatctctcaatggagcattacaagacagccacaaagtagaaacacaaattttgagagaagataaggaggtggttgttgaagttgatgattcccaaaatggcgatattgccatcactgatgaagaggcaccaccaaatgaggagaataaggagctggttgactcaggcaaagttgaagtgacacaagatgtttctgaatcagtttgtgagacttttgagcctgatgctatgaaagatggtcaagttgagaatacaatggaatcagatgtagtagagttggaattgaaggaagaggaagggaaagattttctatctgatctagctgtggttaatgatgag

SEQ ID NO: 106551 - DNA, 318 bp, Glycine max
  Peptide Sequence Number=SeqID_223329
atgttgttgttctgttttggtatttggttttattgctttaagttgtggaagtactcgatcacaaaggcattttgtattgcgtttgtgatgactttctttagtgcatttgatgttccagtattctggccaatactccttttctactgggtggtcctattcacacttacaatgagaagacaaatatcacacatgatcaaatacaaatatgtaccgttctcatttgggaaacaggattacatccatgttgctaatacgctacgccggaaagagagcagcagaaggcacaagcccgaccttggactgaaattttcagcttaa

SEQ ID NO: 106552 - DNA, 306 bp, Glycine max
  Peptide Sequence Number=SeqID_223330
atggaggccatgaaagagcaaatggccacaatgatggaggccatgaagagcactgaagggcaagcagttggtggtataccctttgaaaacactttggagggccctcagtttcgcccacaaccacaaccattgcattttgcggtgggaagagcccctcctgctatggccgaaaagggaaaggcggatcatctaaaggaaaggctcagggccattgaaggaggtgaagattatgcctttgctaacctagaaaagttgttcctaatacccaaacatggtcattcccaagttcaaggtgctggactttga

SEQ ID NO: 106553 - DNA, 183 bp, Glycine max
  Peptide Sequence Number=SeqID_223331
atgtatatctacagaattattaaatttaggtgtttgctaacaggttctcatggtggagaggctagcggcagtgatggggtggctggcgacagtaataggggtggctattgtggtggtggggtggtcgacagcgattgcggagtgggcggccatggaaatgaagttgtcaggaataatggctga

SEQ ID NO: 106554 - DNA, 1707 bp, Glycine max
  Peptide Sequence Number=SeqID_223332
atgaagctctcggcgttgcagcagagttacctcacgcgccgggcgaacagcttcagaggatcggcgcagttggattcgtccgccgacggcgcggtgaagtcgccggcggcgattttctggcttgtaatccacggcgtctgctgcctcatcagcttggttctcggcttccgcttctcgcgcctcgtcttcttcttcctcttctcgacaagcctctacaccgcgccgttccggagcggttcggaaatcgcggctccgcatgacgttcctccggcggcgaaccggacggcgatgctgagcaccgcgagccgcgtggtagtcgggcggcacgggatccgaatccgcccgtggccgcatccggatcccgtggaggtgatgaaggcgcaccgcataatcgagagagtgcagagagagcagagggcgctgttcggagtgaaaaaccctaggacggtgatcgcggtgacgccgacgcacgttcgcacgttccagacgctgcatttgaccggtgtgatgcacgcgctgatgctggtgccgtacgatctggtgtggatcgtggtggaggccggtggagtcaccaacgaaaccgcctcaattatcgccaagtcaggcctcagaacaatccacgttggcttttctcagcgaatgccgaattcgtgggaagctaggcataaactcgagtctcggatgcgacttcatgctttgagaattgtgagaaaagagaagctggatggagttgtggtgtttgctgatgatagtaatatgcacagtatggagttgtttgatgaggcgcaaaatgtgaactggattggggctgtttcggttggaattttgcttcattcggatgaatcttcgtatatggttcaaagtgaggaggaaggtgcttctatgcctgtgcagggtcctgcttgtaatgctacggataaattggttgggtggcatactttcaattcgttgcagtatacggggaggagtgcggtttatattgatgacagggcgcctgtgctgcccagaaagcttgagtggtctgggtttgtgttgaattccaggttggtttggaaggatgtggatggtaagccagagtgggttaaggatcttgataaatttgatggggttgatgaagagatagagactccattgtccttgctcaagagcacctctgtggtagagccgcttgggaattgtggacggcaagttttgctttggtggctgagggttgaagctcgcacagacagcaaatttccttctcgtgcaactgaatcgccaactaagattatccaggaatactcgcatcctggcttgaaaaaattctcacttggcatggacttccaaaagggagaaactgaaatactcgatgtcattgggcacaaaaagtttccaaaggttaaatttaagagctggaaaaaaagggacattgggaccttactttcaacattagcgcaatctcataacatttcaggacatcacagtcaagcaataagatggataattgaccctcctttggacatcactatcccatcaaaacgcagtccatggccagatgctcctcctgagctcccatctaatgaaaaagttttaaccaacacacaagagcagacaaacaagccctctacaagaaccaaatcacccagatcccggcgcagtagaagcaagaaaaagcatgataccaaagtgataggtgtgcaagtctcaacatattccgaacaaaactaa

SEQ ID NO: 106555 - DNA, 408 bp, Glycine max
  Peptide Sequence Number=SeqID_223333
atgaaaggggggctacaaactggtgggggaaggaagatgaagaagtcttcaacaccttacattcctcaaaactcaaccccatgtgcaactttatttgtagctaatctggggccgtcttgtaatgaacaagagctaatccaagtgttttctagataccccggattcttgaaactgaagatgcagagcacgtatggagctccagttgcatttgttgatttccaggatgttggtagctcaactgacgctctaaatagtctgcaaggcacaattcttcactcctcacaatctggcgagggaatgcgtttggatggtcgaatcacattacttatcagtgtttggtttttgcttaacaagaacctcagatatgctaaatcgcgaatgggcatgcggaggaagcccaatagataa

SEQ ID NO: 106556 - DNA, 966 bp, Glycine max
  Peptide Sequence Number=SeqID_223334
atggccgtcgacctcatgatgggatatcgaaaccacaatttcgcccaagagaatgccgttcgtgaagctgcgtcggggctagagagcgtcgagaaactcatcaagttgctgtcgcagacccaacaacaattccagacaacatctaattcaacctcaaactcaaagtcttccatggcaaacatcgacaccgactacagagctgtcgctgacgtggccgtctctaagttcaagaaggtcatttcgcttctgggcagcagcagaaccggtcacgcgcgtttcagaagagcccctgttgctccccctcctccacctgcggaacccagagtctaccgtgctacgccggtgcagcagatcccgccacccacccttcacactcacgctgttgtcactgaccactccttggtccccaaaattgagagaaaggactcttccaagaccattaatttctcctattcaaactcgttcgtctcctccctcaccgccggcgacaccgacactaaacaaccgtgctcgtcgtcgccgtccacggcttttcagatcacgaatctctctcaggtatcctccgggggaaagcctccactttcgtcctcttcgttgaagaggaagtgtagttctgagaacttgggctctgccaagtgtggcagttcctctagccgatgccattgttcaaagaagagcagaaaaatgaggcagaagagggtggtgagggtaccagctataagcttgaagatggctgatattccacccgatgattactcttggaggaaatacggacagaaacccattaaaggatcccctcatccaagaggttattacaagtgtagcagtgttagagggtgtccagcgcgcaagcatgtagagagggcccttgatgatccatctatgttggtagttacctatgaaggagagcacaatcacactctctctgcggcagaagctactaatctcatcctagaatcctcttaa

SEQ ID NO: 106557 - DNA, 546 bp, Glycine max
  Peptide Sequence Number=SeqID_223335
atggctatttgcttccactggggtgttttgcagctttcttattttttcttggatctccttgattccatcatagtcgacgtggcatcagagtgtcacagagtagcaaggctggggcttgattcaaatttggaagaagaggatgaagaattgaagctgtcagcacaagccagggttagggtggctgatcctagtaacagtaatgaagcaaatggcaagtatgtggttgacatatttggacaaactcatcctcctgtggcaaatgaaatatttgattgtttgaattgtggtcgatccatcatggctggaaggtttgctccacatttggagaagtgcatgggaaagggtaggaaggcacgtctgaaagtgacaagaagcagcacagccacgcagaaccggtattcacgaggcggtcccagtcctggttctacacattctccatattcaaattactctaccaatagcatgaatcggttggcatatggaacctccacttttgcaggatctgtgtcacaccttgaacttgtttcttcacagggagacggctga

SEQ ID NO: 106558 - DNA, 759 bp, Glycine max
  Peptide Sequence Number=SeqID_223336
atgagaatcagaagcagaatctttttttttttttttttgagtttggagaaaaagaaactgaatgaagatgatgatgagaaaggactccaaaaaaaacaaacaacattttcttggaattgggtgggacccactttcccactgaaggaagaaaaagtgggtccccgtctaagtactcatgggcacattgtgaatgcaaactccataagtgtccatccaagggtctgtagaggaggacaacataatgcatgcaaagaaaggccacaacaagacaggtggtacacttgttgtggaggatacaatcatgagcctaagggaacctcccactacattttttctcattcacattcagtggtggggcccaaccccatttatgtacacgtgtatactttcccattggttcaagggagcacatattggtgccacgtgtcttttccattagtaatgggggatctgatgattagtgaggaaaaggaagacatttttaaatggaggggcactccggggcatgctagcaacggtgccatctttcaaggccacatgagtgtgtcgcttgggtgtttctccacctatatcggtgtccaatctctcatctatgctgagctcttccctgtcatcttggccatggaatcttccttggagaggaactggcgaaaggtctggtttgaatgtgactccatattagtaatggaagcttttaaaaatcctagcttggtcccttggagacttaggcgtcattggaaaaattgcctctttttgtga

SEQ ID NO: 106559 - DNA, 2724 bp, Glycine max
  Peptide Sequence Number=SeqID_223337
atggctaagcacaacgaccgcacacggtcacagcatctacaatctcaagtttcagttattcaaacatggatggaggatcaacgtactcgtgataaaaaattacaggaccgctttgatgaacttcaagcttcaaaccaagctcggatggatctcatgcaacgatctatcgatttgttgattcaaagtcaatctcataccattggtggttcgaactcaaatcgtggtactccagtcttggagtggatcttcaaagcagagaagttcttcaatcatcataacactccatatctggatcgagttgatattacttctattcattttgagaaggatgtgattccctggtttcaaatgttgcaatggatgcaagttgtgagcacctgggctgagttaacacgttttatggcattagctaatagatctgaaggtttgactcctgaggctttgcgtaattgttttattagtggattgaacaaagacattcgtagagatgttgttgctcaagctcctaatgatttgttgcgtgctatttctttagctaaattgtatgaggagaatgatgatgttgagcttgaaggtcatgatagtaaagacataattgataatgtggatggtaatgcagaggtgattcttgaagagcatcacttatcactaaatgcattgaagggtggtaggggtgtaggcacaattagtcctcaagctacctgtggaaccaacaccttctttaaggtcatggtggggaatggaaattacatggttgctgaaggcgtggtcaacaagttgactatcaaggcccaaaatgccacgttccaattacttgtatttttattacccatattaggagctaatctcatcttgggatctagttggttgaaaactattggtcctcatattgcagactatgataagttgcaattgaagtttatgtatgatggtaagttcaccactttacaaggagaaacttatatgattactgcccaggctcaattacatcacattaggagaatgttgaatacagatgttattgctgagatattcaccatgcagttaattaagcctaattcagtgcaatttcccttagtggaattgcccaatgatatagaacctgaattggcattgcttctccattcttatagtgttgtgtttggaactcctacttcattacccctccaaggtatcatgatcattatattccattggttaaaggctctcaacctgttaagtaaaagcccattctcatctccaataatcttggtcaagaagaaagatggatcatggagagtatgcacggattatagagcactaaatgccatcactatcaaagacacatttccaattccaactgttgatgaattgattgatgaattatatggagcagtggtgctaaataccttgaagcaacaccagttatttgctagattctctaaatgtgcatttggagttagagaaattgattatttgagtcacactctttcaggagttggtgtagctataaaaacaatgaaactacaagttgtgttgaattggccattacctatatctctcaagcagctaataggatttttaggcttgataggttattacaggaggtttgtgaaaggttatgctacaataacaacacctttaactgatcttttaaagaaggattcatttaagtggtctacaagcaccactaatgcagttaatcaattgaaggaggctatgacttcagctacattcttagctattttgaatttcaaagaaccctttgtgttagatattgatgcctcaggaactggaattggggcatataagtcgggtaaagagaatatacctgttgatgccttatcaacaattttattgatggcttggtctgaggcagtagggggcactgagtatatagtgaaggatgagttgttattttggaagggcagaatgatgattcctgagaatcaggcattaaaacaacagattatgaaggagtttcatgcttcaaagattggtggtcatgagggagtcaccaagtcagtatccaggatatgtaagcaatttcattggccaaaaatgcagcaagacataagggattttgtgagagagtgcactatttgccaacgagctaaagtagaacaagcgttgctatcggatggccaaactgaggtgttgaataagacactggaaatgtattcgagatgctttgtgtttgattatcctaaagcatggtttgatatgcttccttgggctcaattttggtacaatacttcattccatcatagcattggtatgccttctttcaaggatttgaaactcaatctgctaagagctcagaattacatgaagcataatgtcaataagaagagaagggatttggcatacaagttaaagttgcctgaaacagctcgtatacatctggtgtttcatatttcggtgttgaaaaagtttgttggtagttcaaagcagccttacttatcattaccacttacaatgagtgctaatggtccaatagtacaacccataacagtgttggattcaagggttatacttagaggttcagcacaagtgaagcaagtgttgattcaatgggagcttgcaagtttagaggaagccacatgggaagatgttacttgggtggggacaacttatcatcagttcaaccttgaggacaaggttgttcttaaagggaagggcaggcaaagcacgcggattaagaggccgaatgtgctatataaggaatttgttacgaagaagtga

SEQ ID NO: 106560 - DNA, 186 bp, Glycine max
  Peptide Sequence Number=SeqID_223338
atggagcttcccagttgtggaaagttaaatcctctgttggatcttccttctcatccttcttccaaattcttcctcgcgctaagctgcaagagtggtgcactcagccgcaagagtggtgcgcttagcggatgtctcgctaaggcggcagattggcttagcgagaagctggaaataagcacttcataa

SEQ ID NO: 106561 - DNA, 2333 bp, Glycine max
  Peptide Sequence Number=SeqID_223339
atctcatatatgctaaagttaattcgttgacttcgattgaaactgagcttccctacaactactacagcctcccttactgccagccggatggcggcataaagaaaagtgctgagaatcttggagaacttctgatgggagatcagatcgataactcaccgtaccgattccagatgaatgttaatgagacgctttacctctgcactacgcccctgttgaatgagcacgaggtgaagttactcaaacaaagggcacgggatctgtatcaagtgaatatgatccttgacaacttgcctgttatgaggtttaccaaccaaaatggggttacaatccagtggacagggttccctgttggatacactccatctgatggcagtgaagattacatcattaaccaccttaagttcacagtcttggttcatgaatatgaaggaagtggggttgaaattgtggggactggcgaggaaggtttgggtgttatttcagaatctgacaataaaaaggcatcaggttatgaaatagttggttttcaggttgtaccttgtagtattaaatatgatctggaagtcatgacaaagcacaagaggtatgatactctttctcctataagttgcccggctgagcttgacgagtatcaagtgataagagagaaggaaaggatatcattcacatatgaggttgaatttgtgaaaagtgatataagatggccatcacgttgggatgcttatttgaagatggagggttcccgagttcattggttctcaatcttaaattcacttatggttatttctttcctggccggtattgtttttgtcattttcctaagaactgtgagaagggacttaacgaggtatgaggaactggacaaagagactcaagctcagatgaacgaggagctctctggatggaaacttgttgtgggtgatgtgtttagggagcctgattgctcgaagcttctctgcgtgatggttggagatgggattcaaattcttggaatggctggtgttactattgtttttgcagcacttggcttcatgtcacccgcgtcccgaggaatgctactaacagggatgatcgtcttatatcttatcctgggaattgctgcaggctatgtcagcgttcgtgtatggaggaccattaagggaacaacagaagggtggagatcaatttcctggttggctgcttgtttttatcctggaattgctttcattattcttacagtactgaattttattctatggagcagtaacagtactggtgccataccgatttccttgtattttgagctgttcttcctctggttctgcatttctgtacctcttaccctcattggaggatttatggggacaaaagctcagccaattgaatatcctgtacgcactaaccagattccaagggaaattcctgcacgtaaatacccatcgtggcttcttgttcttggtgctggaactcttccatttggaaccctcttcattgagcttttcttcatcctttccagtatttggcttgggaggttctattatgtgtttggtttcctgttggtagttcttctattgctaattgttgtttgtgctgaagtgtctgtggtcctcacttatatgcatctctgtgtggaagactggcggtggtggtggaaggcattcttcgcatcaggttctgtggctctttacgtcttcttatactccattaactacttggtgttcgacctgcggagtttgagtggacctgtctcagctaccctttaccttggttattcactactcatggccattgcaatcatgttgtctaccggcaccatcggcttccttatgtcattctactttgtgcattacttgttctcatcagtggacctcatcaagcagaatttggcaagaattgagtatgaaggtggcaaccttttgaagcctatggttcacatagaagactcagtattggatggtctatgtcccctggcagaatgctctgatctgaaacttcttggtaagagcaatggttttcagatggtgaaggataggctaatgaggctatggaatctaaaagttgggtttgatattttggacactggaacatttcatgtgcaaacatggtccccggattttatctcgctagcagcaaaaactgcacttaaaatcatgagtggtggagaaggagtaagagatgttgaactcaagttgttcatgaaggttgttcaagaacaattcacaactctaaatgcagggttggatgatttacaatttacttccaggtctaagatacctcttaggaaaaatcatgatgatgaagaagaggagtactcaaatgggagacataatgaaaggagaaggggtgaaccatga

SEQ ID NO: 106562 - DNA, 2526 bp, Glycine max
  Peptide Sequence Number=SeqID_223340
atggatatagattactcattcaatgccaatacatgtgagatagtagaagcaagagaagagatcatttgtaagttcaaaatagatgaaaagcctgagagtagttgtgcccacaaatcaggcaaaaagtattctatagaggatgatatcaatcgtcttttgcaggctattgatattgaaaattcagctagagctcttaatacacctgattcacaaaagagtgctcttaaaaagcctataaaaatcacttcatctcagacatcaggaattggcctctcagaacctgtaagtttaaagcaggcatttagagggttgtgcatctcacatgcatcaaaaatggctgcattgaagcgattatcaaagccatccacttcgtcaagagtatcaaaggttggaatatctagaccttctaatgaattaggatgcaatgacaataatgagatatcaaattcaagtgctcatcactctccttcttttgttaatgcaacaaacccaaaaccaatgtcaaccagatcatcatatcaaaaccaaattggccctcttgcatcagaagttcagggtgaaaagctagtcacgaggcttgaacaacatgtactagcaaattcaacatctgttgttgcctattctagtaatgaagtgttggagctagatattagacttaaaacgttttgtgattcctccagaaaagattctctcggttcttcaatgccaaataagggaatggaagcaaacttaaattctccacctagttctggcacaggtaatggggtggagaaacccacaagtagtattacatctttcgcaaagccaatatttagggacaagaactttcataaaaataaagtgaagcaagatttatgttcttcgtcgagctgctccaatctatgtaccagaaacattggcaatgatttggctttctgtacaagtaatttgaacaaggtgactgataactctgattcaaagaatgaaatgaaagaaaaaaggaagttgtcattcaaacattcaaaccatagcattgaagtttactcagttaatgctagcatggattcaagcaaacatggtttctgtttgactgacaaaaagagaactaggtttctagtgacaaaatttgatgagaaatcaagatcaaaagagaagggtgaactctcacaaagtcccaaaagtagcactagtgattatcgtagtatcagtaaggagaaaaatctaagtggttccagttacaacgggcacaggcctcacatgtcaaagcacgcaaggtgggaagcagttcatgttattgagcagcaacatggtcatttaagttggaggaacttcaaggtcctcaaaagacttggtcgtggggacattggaattgtttatcttgctcaactaattggtacgagtagcctttttgcagtaaaagtgatggagaatgacattttagtaaaccagaagaaaacatcgagggctcaaattgaaagagaaatattgcaaatgctagatcatccgtttcttcctacactttatgcccattttacaacggataagctctcttgcttggttatggagtattgtcccggtggagatttgcatgtgctacgccaaaggcaaccatctaagagtttctcagaacatgcaaccaggttttatgttgctgaagttctccttgccctggagtatttgcacatgctaggagttgtatatagagacttgaagccagaaaatattatggtacgagaagatggccacattatgcttacggattttgacttgtcactcagatgttgggttaatccagtgttggtcaagtcaccttcaccaagtgtggatccaacaaagatgtctagttcttgtttaaaggctatctgcatgcaccctttctgtcttcaaccaaattggcatgtctcctgtactcctattttattatcaggtggagcaaagcctcaaaaaactaaggctgaaataagtggtcaggttggtccactgccacagcttatagtggagcctatcaatgctcgatcaaactcgtttgttggaacctatgaataccttgctccggaaatcataaaaggtgagggtcatgggagtgctgtagattggtggacttttggtatactattgtttgaacttatatatggtataactccattcaagggcccatcatatgaagatacattagccaatgttgtgtcacagagccttaagttcccagatactcctatagtgagttttcgagcaagagatttgatcaaacgattgttgataaaagaccctaaaagtcgattaggttttgtaaaaggtgctactgagataaggcagcattccttctttgaaggcctcaattgggctcttatacgttgtgcaccaccacccaagctcctcaaattttgtgattttggaactagtcttcaatccatgaagaatgccatcgattcacaagattgtgaagagtttgacatcaccatggttagggcaaaggttgatgagtggaagagagacttcaaggagcaggagcaactgggaagttttgacatagctagtttgagatga

SEQ ID NO: 106563 - DNA, 672 bp, Glycine max
  Peptide Sequence Number=SeqID_223341
atgaggtctgctggagcaaataccccaactcagaaggaaccatacattcgtactagagagaatccatacttcgatggccttctaagatctgatggtcagattcccttgaagtctcaattagaatttacgtatattggtgaaaccagacccaaaaactttgtctcagatatctctgaagaggttatggagttgtcaccggagaattcagcagtctcaggattgaactctaaatcttctgaacattcttcgtctgagaagtggttaaaaaccagcaaaattgctccatttatacaactggatattctatccgagctgattgaaccggataatccaaaacatcatcatcttggatatggccaaagcccccggactcctgaacaatcacctgcaatacacaatacagaaaagacatatactgtcattagaagaaaagaaaagctatcaagtattctacttccactatctgcagcttcatactatattggagtatcaccagaaatggaaattgttgaatcatgtgaaagcattgacaagctaaatgcatttttgaaagcaagaaaggatgatgtcaatgctggtgtacctgggaaattcttacatgctgttatgggttcagatggtgctggtaatttcttcttcttagcttctgtggtatctaactcaaaatcttaa

SEQ ID NO: 106564 - DNA, 2559 bp, Glycine max
  Peptide Sequence Number=SeqID_223342
atggccaagagtccccgtctctttcactttttccagttcttggcaatgctgttactcacttcctactctatttttccaccttgtgtgtctctgacgttggaaacccaagctcttcttcagttcaagaatcatttgaaggattcctcgaattcattggcttcatggaatgaatcagactctccatgcaagttttatggaattacatgtgatccggtttctggaagagtcacagaaatctcactggacaataagtccctctctggtgacattttcccatccctctcgattctgcagagcctgcaagttctgtcactcccatccaatttaatttctggaaagcttccatcagaaataagcaggtgtaccagcctgagagtgttgaatctaacaggaaatcaattggttggagcaatcccagacttgtctgggctgagaagcctgcaggttcttgacctttcagcaaactacttttctggcagcatccccagctcggtggggaatctaactggactggtttcactgggtcttggggaaaatgaatacaatgagggtgagattccagggactcttggaaatctcaagaacttggcctggctctatcttggtggctcccacttgataggagacattccagaatcactatatgaaatgaaggcattggagacactggatatttcgagaaacaagatctctggcagactctccagatcaatttccaagttagagaatctttacaagattgagctcttctccaataatttgacaggagagataccagccgagctagcaaacctcaccaatctgcaggagattgacctttctgccaacaatatgtatggtaggttgccagaggaaattggtaacatgaagaacttggttgtttttcaactatatgaaaacaacttttctggagaacttcctgctggatttgcagatatgcgtcatctcattggattctcaatttatagaaacagcttcactgggacgattccgggaaattttggcaggttttcaccacttgaaagtattgacatatctgagaatcaattttcaggtgatttcccaaagttcttgtgtgaaaacaggaagttgaggtttttgcttgcattgcaaaacaatttctctgggacttttccggagtcttatgttacatgtaaatctctgaagaggtttaggattagtatgaaccgattatctgggaaaattccagacgaggtttgggcaattccatatgtagaaataattgatttggcctataatgatttcactggtgaggtaccttcagaaatcgggttgtctactagcttaagtcatatagttttgacaaagaacaggttttcaggtaagctcccatcagagcttggcaagctggtgaacttggagaagctttacttgagcaacaataatttctctggtgaaataccacctgaaattggatctctgaagcagttatcttctttgcatctagaagagaattctttaactggatcaatacctgcagaactgggtcattgtgcaatgctggtggacttgaatcttgcttggaattctctatctggaaatatcccccaaagcctcaagcatgacgccgagaaaaacttgcaaggtcaaaaggaagtcaggcgaaaatggaaacttgcatctttccatcaagtagatattgatgccgatgaaatatgtaaattggatgaagataatttgataggtagtggtggtacaggaaaggtttatcgagtggagttgaggaaaaatggagccatggtggctgtcaagcaactagggaaagtagatggtgtgaaaattttagctgcagagatggagattttggggaaaattaggcatagaaacatacttaaactctatgcttctttacttaaaggaggatccaaccttttagtgtttgagtacatgccaaatggtaatctttttcaagctcttcacagacagataaaagatgggaagccaaacttggattggaaccagaggtataaaattgctctgggagctgggaaaggaattgcctatttacaccatgactgtaacccaccagttattcacagggatataaaatccagcaacattttgcttgatgaggattatgagtcaaaaattgctgattttggtattgcaaggtttgcagaaaaatctgataagcagttgggttatagctgtctagcgggcacacttggttatattgctccagaacttgcttatgccactgacatcacggaaaagagtgatgtttatagctttggagtggtgctattagaattagtgtctggcagagaacccattgaagaggaatatggagaggcgaaggatattgtttattgggtgttgagtaatctcaatgaccgtgaaagtattctcaacattcttgatgaaagggtgacatccgagtctgttgaagatatgatcaaagtgttgaagattgctattaagtgcaccactaagcttccatcgttgcgccccaccatgagagaggttgttaagatgctaattgatgccgaaccttgcgcattcaaatctccaaacaaagacacaaaggcccttctctag

SEQ ID NO: 106565 - DNA, 489 bp, Glycine max
  Peptide Sequence Number=SeqID_223343
atggagaggctagctggcattcttttggatactgcgaatctaagggaccctcgttgctcctctaaagataagtacatggcttcattattgatcaatggtgctggtcgttatggatgcaatggtctttaccaattattgaggtacaaaatgcatgacctttcctccctccaagtagcagatatcttgcgaaaggattttaaaaagtggacaggacaagtatctgagaaacttcgagcacttattgtcgtttcggggtattataacgatgaaaagaacttcaagagagaagttttaatatctacggaatctgcaaagctattggagagtttgctcttcttcttcgatttcaatgcttcccggctgccactcaagagcttacactttccaggtctgaaaaatgggatgaaagcgtatgagatcgataagattacatcaaggaaaatagtagagcatctcatagaagagttcgttgggataccaaaagcctaa

SEQ ID NO: 106566 - DNA, 1449 bp, Glycine max
  Peptide Sequence Number=SeqID_223344
atgaacaaggtgcttgaatttggagccttattagcatcaggaggacaggaatatgatattggaaatgataatataaagaacccaaaggagcgactggttcgtcagaagcaaaatcttcgacgtcgtttaggtttggatgtctgtgaacaatttatggatatcagtgatgtaataagagatgaagatcttatggcatccaaatcagactcacatctgaatgggatagatcgtagactttttacatcttgttcttcacataacatccagaaaatggtttcaaacatggttcctagtgtcaaatctaagtggccaagtgcaagagaattgaatcttttaaagcgtaaagcaaaaataaactctaaggaccaaacaaaaagctggtgtgaagatggaagtacagaggtatcaggtggtcaaaatttgacttcgaaaggcacatgtcccgattcagtaaattatagtaaggcattcatgagtgttaatcacgatgaagatggcattgagcatgatggggatggacaatggcctttccacacttttgttgagcaacttattattgatatgtttgatcctgtttgggaggtacgacatggcagcgtgatggcattgagagagattttagcacatcaaggtgcttctgctggagtatttaaacccgactcaagcatgggtgggaccttgtttattgaattagaagacaaaagtataccaaatatattgaagagagagagggaaattgatttaaatatgcaagtttccgcagatgagtttgtttcaaacttgaagaggccaaaacttgaagatgtatcatcatcaacctctatggatagtgtgatgacttgtaacaatgaaggtgatattgaaatcagcattagttctgaaacccatggattcaatttaactttggattatgggaatgggcaatttaatggtaattctgttgacatggattactctgacggcttacgcgatgcatgtaaggagcctgctaatatagaggaacagaagggttattctgatgataataagattccctctggaaatattagtgtgctgagaaatcttcctcagaattgtgagctgatgaactcggttaaagtggctagaggttcctggcttcgaaactgtgaatttcttcaagattgtgttatacgttttttgtgcgtgttgtcacttgatcgctttggagattatgtatcagatcaggttgttgctccagtgcgtgaaacctgtgcacaggcattaggtgctgcatttaagtatatgcatcctgcactagtaaatgaaacattgaacatattgttgaaaatgcagtgtaggccagaatgggagattcgacatggcagtcttcttggtatcaaatatttggttgccgtacggcaggaagtagtgcaaggccatccaggctcttcctgctccttgctgccactgttttgttcccatctttga

SEQ ID NO: 106567 - DNA, 2741 bp, Glycine max
  Peptide Sequence Number=SeqID_223345
atgctttctgatttgcttggacgtgttcttcctgcttgtaaatctgggttggaggacccagatgacgatgtccgagcagttgctgctgatgctttaataccagctgcatctgcaattgtttccttgcagggtcaaacattgcattcaattgtgatgcttttatgggatatattgcttgatttggatgatttaagtccatccaccagcagtgtaatgaatctgctggcagaaatatattctcaagaagatatggccccaaagatgtatacagtttttaaattggcagacaaccaaatggaaaatggagtagatggttgttatgatgttgatggggaagaaaatccttatgtgctttcaacattggcaccacgtttgtggccctttatgaggcacactatcacatctgttcgttattctgcgatacggactttggagaggctacttgaagctggatataagagaagcatgtctgagttgtctagtgcttcattctggccctcttttatatttggagatacccttagaattgtcttccagaatctgctattggaaacaaatgaggatattttgcaatgttctgagagagtttggagtctccttgttcagtgttctgtcgaggacttggagatagctgcgaggtcttatgtggcttcttggatagaacttgcttctacaccatttggctcagcattagatgcctcaaagatgtattggcctgttgcctttccacgaaaaagtcaaattagagcagctgctaaaatgagagctgcaaaaattgaaaatgaatgtggtgtggattttagtcttgattctataaaaggaactattccaccagatagaaatggagatgtttctatgaattctgttaagatagttgttggtgctgaggtagacacatctgtaactcatacccgggtagttacatcaactactttgggaatttttgcttctaagctgccagagggttctttaaaatatgtgattgatccactttggagctctctaacatcgttgtctggtgtccaacgccaggttgcatctatggtacttgtttcttggttcaaggagattaagaacagaaattcgtccaaaaaccttgatggtatccctggtgccctcaaagattggttgctagacttattagcatgttctgacccagcattcccaacaaaagattcaattcttccctatgctgagctttccagaacttatgggaagatgcgcaatgaggctggtcaattactaaatgtggtcaagtcttctggtatgtttaatgaattactgacagctacccaaattgagttggatcgcttgagtgtggatgatgccattggttttgcgtcaaaaattcctgctttgtgtaatgatagttctgcaaatgaatccttgggaaagaacatcacggatgatattgaatcctcgaaacagagactcttgactacttctggatatttaaaatgcgtacagagtaatttgcatgttacagtcacatctgcagttgcagctgcagttgtctggatgtctgaatttcctacacgacttaccccaatcattttgcctttgatggcttcaatcaaacgagagcaggaggaaatactgcaaatgaagtcagctgaggcccttgctgagctaatgtatcactgtgttgcgcgaagaccttgccccaatgataaattaattaagaatatatgtagtttaacttgcatggatccgtctgagacccctcaagccaaatccctttgtaccatggagagtattgatgaccaaggtcttctgtcttttcgaactcctgtgagcaaacagaagtcaaaggtccatgtgctggccggtgaagatcggtcaaaggtggagggatttttaagtagacggggatctgagctagcattgaggcttctatgtgagaagtttggtgcgtcattatttgataagcttcctaagctgtgggattgccttactgaagtgcttaagcccagctcctctgaatctctacttgtcactaatgaaaagccagttactatgtctattgagtctgttaacgatcctcagaccttgattaacaatatccagcattctcatgttgcagttagattagctgcttcgcgctgcatcacttccatggcacagtcaatgactgtgaaagttatgggagctgtggttgaaaatgctatccctatgttggaagatgcatcatcagtttatgctcgacaaggagcaggcatgttgattagttttcttgttcaggggctgggtgtagagttggtaccttatgctcctctattggtggttccgcttctaaggtgcatgagtgattgtgatcagtctgtcagacagagtgtgacccatagttttgctgctcttgtacctttacttcctttggctcgaggccttcctcaaccaattggattaggggaaggtgtatctagaaatgcagaagatttgcagtttttggagcaactacttgacaactctcatattgaagattacaagttgtgcactgaactgaaagtaacattgaggaggtatcagcaggaaggcataaattggttagcttttttgaaacgtttcaagcttcatggaattttatgtgatgacatgggacttggaaagacacttcaagcatcagcaattgtggcctctgatatagctgagcatcgaacttcaattgggaatgaggatcttctgccatctttaattatttgcccatcaactctagttgggcactggggccttgagatagagaa

SEQ ID NO: 106568 - DNA, 159 bp, Glycine max
  Peptide Sequence Number=SeqID_223346
atgaaggatgaaactaacagaaacatcaagcctaaggagtggataatcattatgataacttataaaattgggcccactgtagtggttgttaagtatgattgtatgaaggacaagacatttgaacatccatatctgcaagccagtggaggtcatatgtaa

SEQ ID NO: 106569 - DNA, 780 bp, Glycine max
  Peptide Sequence Number=SeqID_223347
atggctgtgctagaaccaagaagaggaatcccgtctgtctcaaggctgaaggaagggaattggctgcggataatgaactcatcctcccaatatggaggtgggtttgccgagtttgctgtggctagtgagagcttaacagcagccagaccatctgaggtctcagccgctgaagctgcagcattgccaatcgccgggcttacagctcgtgatgccctcactcaaattgcaggagtcaagcttgatgggactggccagctcaagaacattttagtaactgctgcttcaggtggtgtaggtcactatgctgttcaactagcaaaactaggcaacacccatgtcacagccacttgtggggctcgcaacattgactttgttaagggcttaggtgccgatgaggttcttgactacaggactccagagggggctgcactgaagagtccatctggtaggaaatacgatgcagtgataaattgtacaactggaatatcttggtcaacttttgatcctaatttgactgaaaaagcggtggtagttgatttaacacctaatgcaagttcattgtggactgctgccatgaagaaaattactttttccaagaagcagctggtgccattttttgtaaatgtccagcgtgagggcctggaatatctacttcaattagtgaaggacgggaaactgaagtctgttattgactccaagtttcctttgagcaaagctgaagatgcttgggctaagagcattgatggccatgctaccggaaaaatcattgtggagccatag

SEQ ID NO: 106570 - DNA, 272 bp, Glycine max
  Peptide Sequence Number=SeqID_223348
aaataccagatgattccaattggtcagttggatctaccgaggacaactcagaatatgagagtacctctgttggttggtatgaacagaaagacacggttgaggaagaagatcttacgttgacattctcagacaaggttatggtcagaagcttctcgagcaaagctaagaaggttctgcagaagcacactgcgtctaatttccatgcatttggcgttgctgttattgcctctacacgatgtaatcaagagattgtgcaatttacggaagaatga

SEQ ID NO: 106571 - DNA, 816 bp, Glycine max
  Peptide Sequence Number=SeqID_223349
atggctcatttactggcgagcaaccccaatgcttcacagaaacttaccttctcaaacttggggtattatggtgttagaagaggatccagaaccaaaggttcgtgttacagagtgggaaggaaaaggcgaggtggtttggtgttgcaatgcagcagcacaactgatcaggatgtgaggttgcagattgagagtggtagcatcggaaagcttaagcagcattttgaatatttggtgtgtgaatatgggtggagagtaagaagactatttgaaaacgcagatgagataaagaaggcatctcatgttcaggccgaagcattccatgttcctgtctctcttttcaacgaattgttcttccaattctttcaggcggaagtgctttcggggcttctttacaagcttaaaaactcacctcctaataggtatgcttgtttggtagctgagccagcaataaacgatccagattcaccaaaacaacttgtaggtgtcatagatgtcactgtcttacgagaccagaacgtgctccagcatcttcctcccgaagctgaagagtacctttacatatcaggaatagccgtctccaaaactttcaggaggaagaaaatagcgaccgcactgttgaaagcctgtgaaatgctttccattttgtggggttttgagtttcttgccctccgagcttatgaagaagatctaggtgctcgcaaattgtacgcaaatgctgggtaccaagttgtgtctcgagatccaccatggacaagtaattggattggaaggaaatgtcgtgttcttatgatcaaaagaactagtttgcccaaatag

SEQ ID NO: 106572 - DNA, 198 bp, Glycine max
  Peptide Sequence Number=SeqID_223350
atggaagaaggatattccacaaacgagccaccactattcaaaggcatcaaatatgactactggaaggaacatgcaacgaaagataaaggagaagaggtgagaggaggtgccatccataagggaataagccatggaaggaggagcttcaccaccaagagagtgccttggataaaaagcttagagagaaagcttcaatga

SEQ ID NO: 106573 - DNA, 699 bp, Glycine max
  Peptide Sequence Number=SeqID_223351
atggagggtgaaggaagaagaagagaaggaggagagagagaaacagcaacagcagcagcaacgaggaaggtggtggagggtgctgatcagagaagatacaaaggaataaggatgaggaagtggggcaagtgggtcgctgaaattagagaacccaataagcgttcaaggatttggctcggttcctattctacccctgtcgcagccgcacgtgcctacgacaccgccgtcttttaccttcgaggaccctccgcgcgtcttaacttcccggagcttctcatcggagaaggcgccgccgccctcaccggcggctgtgacatgtcagcagcttctattaggaagaaggcctccgaggtcggtgctagagtcgatgctcttcaggcaacccttcaccaccatcaccaccatgttgtgccaccacggcagcttctctctgccagctgtggcggtgggtccggtgattttgcagtgcgggttgttgacctgaataagatgcccgaacccgagagctccgactgtgagtggaacgtgatggtggttgttaacgtgcgccggctgaggcaaaatgatgttgttgatgaggcctgtggtggtggtggtggtggtgcggagtactgtactgggaaatggaatgggccactgccaagggaaaacgttgtggccactgctgttttgacaacgatggatgatggggtcggttaa

SEQ ID NO: 106574 - DNA, 237 bp, Glycine max
  Peptide Sequence Number=SeqID_223352
atgaatttattgcctagtgttgttcgtctatcctccaccctcaattcttatccggagccccacaaattgcttgtgattcatgcatcctccaccatcgagtttggaaccccacgaattgatttcctagcgctattcgtctatcctccaccctcaaatcttattcggagccccatgaattgcttgtcattcatccatcctccaccatcgagtctggagccccacgaattgattgcctag

SEQ ID NO: 106575 - DNA, 303 bp, Glycine max
  Peptide Sequence Number=SeqID_223353
atgtgtctaccggggaaggagagtctgctgatgaaatctcccataaccataaatgagattttggatgttagcatttcgtttctaaatgatcatttagaggaaacactgggttcgacaaaaatagaagaaatccactcaaagtgtatcaatctcgcacagggtaaggtttatggtgagtcaggattttggctcaaggcttgtagaatggctagacatgatacatgtcagggtttggtttggttcaaggataaaagggatgccccacattatttccatgacacaaatgcaaaaatgatgatttag

SEQ ID NO: 106576 - DNA, 1896 bp, Glycine max
  Peptide Sequence Number=SeqID_223354
atggccgaggaaccccaaaaaccagcctccgctgaagaagtggtcgctgttcctgcggagaacccaccatctgaagccgaagctgaaaacatcgaagcagagaaggcccagagtggtgtagaagacaagatttcccagtcggtttcgttcaaggaggagaccaacgtggttggcgacctccccgaggcgcagaagaaagcccttgatgagctcaagaagcttgttcaagaagcgctcaacaaccatgagctaactgctcccaagccagaaccggagaagaagaaaccagcagcagagaagaaggaggaagttgaagtgacagaagggaagaaggaagctgaagtcatagaagagaagaaggaagtggaagtgacggaagagaagaaggaaattgaagtaacagaagagaagaaggaagctgaagtcatagaagagaagaaggaagtggaagtgacggaagagaagaaggaaattgaagtaacagaagagaagaaggaagcagaagtgaaagaagagaagaaggaaggggaagtgacggaagagaagaaggaagttgaagtgacggaagagaagaaggaagcggaagtgatagtagaagagaagaaggaagttgaagtgacggaagagaagaaggaagtggaagtgaccgaaggaaagaaagaagtggaagtgatcgaagagaagaaggaaacagaagtgacagaagaaaagaaagaagtggaagtagaagtgagggaagagaagaaggaaagtgaagtgaaagaagaagaaaaaggtcgggaggttgttccagaggaagttgagatatggggaattcccctgctgggggacgagaggagcgatgtgattctgctaaagtttcttagggcaagggatttcaaggtgaaggaggccttgaacatgataagaaacacggtgcgatggagaaaggaatttggaatagagggtctagtggaggaagatcttggaagtgattgggagaaggtggtgttcaaggatggatacgacaaagaagggcacccggtgtactacaacgtctttggggagtttgaggacaaggagttgtacagcaagacgtttttggacgaggaaaagaggaacaagttcataaggtggaggattcagtcgttggagaagagcgttagaagccttgacttctctccgaatgggatatcgacaatagttcaggtgaacgaccttaagaactctcccggactgggcaagagggaactgaggcaggccaccaatcaggcccttcaactgcttcaggacaactaccctgagttcgttgccaagcagatattcatcaatgtcccctggtggtaccttgccttttctaggatgatcagtcccttcttcacacagaggaccaagagtaaatttgtttttgctggcccttccaaatctgctgatacccttttcaggtctagtctctctctctctctctctctctctcatctataccctttctccactaacattctcatcccaccttacagatatatagctccggagctggtcccggttcaatacggtggtcttagcagagaggctgaacaggaattcacctctgcttaccctgttacggagtttactattaaacccgctaccaaacattctgttgagttccctgtttctgagaaaagccatcttgtttgggaaatccgagtggtgggttgggatgtcagctatggagctgaatttgtgcccagcgctgaggatggatacactgtcatagtacacaagagcaggaaaattgctcccgctgatgagaccgttcttaccaacggtttcaaaattggtgaacctggcaagattgtactcaccatagacaaccaaacatccaagaagaagaaactcctctacaggtccaagaccaaacccattgcagagtaa

SEQ ID NO: 106577 - DNA, 252 bp, Glycine max
  Peptide Sequence Number=SeqID_223355
atgggaaaggagagtagcaaagatacggttccggtgacgcagtggctgaatcgaatggtctcagaaccttactacctcttccatttcttaaccttcttctcctatttcgtcgttcgcagctccgcaacccaaatcttagcgcctcatctcactcaccatctccttcgtcgcgaaatacaaacactgctagtgttcgcgatattggctttcatcaaggtgtgtgctgatggaatcggatcgcgtttgtggtag

SEQ ID NO: 106578 - DNA, 2442 bp, Glycine max
  Peptide Sequence Number=SeqID_223356
atggtgaaatccgggaataggaatatggaatcaaccgcaaaagttcacccttccaatgatcctgaactcgatcccgactcttacgccctcgagaagttcagactatacgaaaccagagcgaggttttacctgatcggtagtgatcggaacaagaggttcttccgggtgttgaaaatcgatcggtcagaggcgtctgatctgaatatcagccaagaccccgtgctgtattctccccaggaaatcaagagcttgcttcagcggattgctgaaggtaacagggccactggcggcctcacttttgtcgctaaggttttcgggattgccggctgcatcaagtttctcgagtcctactatttgattctcgttaccaagcgcagacaaattggttctatttgtggccatgcaatctatagcatcaaggagagccaattgatagcgattccgcatgtttcaattcaatctgatttagcccactctaagactgagctcagggaaggattgaaggaggaggagcaacaaaccaggtacttgaaaaggggtgtgaatgatcgggggagggttgctaatgatgttgagacagagcagattgtccttgatgaagaatcaggctcttgcaagggaaagatgagttcagttgtgcaaatgcgtggatcaataccacttttctggtcacaagaagcatcaagatttagccccaagcctgatataatttgtatgagagtagttgagattaatatttatcctaggtatgatccaacataccaagcaacaaaattgcattttgaagacctagctaagagatatggcaatccaattattgttctgaatttgattaagacagttgagaagcggcctcgagaaatgatgttgaggcgtgaatttgcaaatgctgttgggtatctgaaccaaattctaccagtggagaaccatcttagatttattcactgggattttcacaagtttgcaaagagcaagtctgccaatgttttggcagttttaggagctgtagcaagtgaagcgcttgatttaactggtttttactacagtggtaaacccagcatcattaagagagccaacaagagcaatcaaacaagcacagggagggatacttcactgagagatctgagagctagttctgtggatcttgtgaggattgggaacagtaatgaaatgctaaattctgtggttaatcaagacaaagagactgacatgaaccataagaataaaaaagataattttggtagtgatgcaccacattttcagagtggagttctccgtactaactgcattgactgcttggaccgtacaaatgttgcccagtatgcatatggtcttcaagctttaggacgccagctccatgcaatgggtttgactgatgttccaaaagtggatcctgatagtagtattgctgcagctctaatggatatgtatcaaagtatgggagatgctcttgcccagcaatacggtggctctgctgctcacaatactgtgtttccagagaggcagggaaagtggaaagcaacaacacaatcaagagaatttttaaaatccataaaacgatactatagcaatgcttacacagatggttacttccaaccacaggaagggaaacctgcgctctgggagctggattcagattattatctccatgtatctgggattggggatgatctaattcctgagaagtgttctgaaccaaatctcagttcttctggaagaggtggaatgatattcacgcctataccagcttgcagagaagacttctctcgcataaagttgacatcatttgacaagttaattgaaaagacctgtagtacaattaaaaatgtaagactatgccgtgagccggatcagagaccaggtggggtttctggaaacagtggtgtagcacctgatgcagctgagatacagctcaaaagcccaaattggcttttcggccagagaaagtatgaagagggttcctctgctgcaaaagttgcttcttgtgaatctgacgttgaaggatctcatgctaatggcttttgtgacttgaattggctttcctctggcaatgctatgaatgaagaagatgttttccaaaggtaccttacaatgacctcagcaaatgaggccaacggttggtatggaggtagtctccttggtgatcaagatgaaaacagtgagatatatgaacattatgcagagttatgtcagggacctgccttggaacttttccaaaatgaccctgatagggagcaacactatgcagatgctttaagcacgagttcatatgaaattgttaatgatgctgccgttgcagcagaaatggaagcaactctaaaggagtatgaccaagttggtgctgaccttgggatcattcccaaatcttgtaaattctttgctgatgatccgagctggctgacgagatggttaactggggacgaaaaagtaccaaggatatga

SEQ ID NO: 106579 - DNA, 456 bp, Glycine max
  Peptide Sequence Number=SeqID_223357
atgcgcgtggcagctggagtgaaatgtttgttgagagtcagacaatggaattggagagttcaggggacgaagcattactctagcgaaagggtccttcagttttatgcttctttcatgaattcagggcattcccctgaccaattcactttcgcagtcactttgtccgcttgtgcaaaactccagaatcttcatttgggcagggcagttcactcttgtgtaattaagagcggccttgaatccacctccttctgtcaaggcgctcttatccatctctacgccaaatgcaactcactcacttgtgctcgcaccatattcgcatctgcaccattcccccacctccacactgtttcttggaccgctttaatctctggctacgttcaagccggcttgccccacgaggcactccacatatttgacaaaatgcgcaacagtgctgttccagaccaagtggcgctt

SEQ ID NO: 106580 - DNA, 1953 bp, Glycine max
  Peptide Sequence Number=SeqID_223358
atgccagatgatgcacgccaagtatttgatgctatatctcagaaaaatatgattgtctggaatgccatgcttggagtttattcacagaatggctttttaagtaatgtcatggagttgtttttggatatgatatcttgtggcattcacccagatgaatttacctacactagcattttgagcacatgcgcatgctttgaatatctagaagttggccgccagttgcattcagctattatcaagaaaagatttacctccaatttatttgtcaacaatgcgttgatagatatgtatgctaaggctggggctttgaaggaagccggcaaacactttgagcacatgacataccgagatcatatttcctggaatgccattattgttggatatgtgcaagaagaagtggaagctggtgcttttagtttgtttcggagaatgattttagatggtattgtacctgacgaggtatctttggccagtatacttagtgcttgtggaaatattaaggtactagaagcaggacagcagttccattgcctgtcagttaagttgggtcttgaaacaaacctttttgctggaagttctcttattgacatgtattccaagtgcggggatatcaaagatgcacataaaacttattctagcatgcctgagcggagtgtggtctctgtgaatgctctgattgcaggatatgctctaaaaaacacaaaagaatctattaatcttcttcatgagatgcagatattgggactgaagccatctgagattacatttgcaagcctcatagatgtttgtaagggttctgccaaggtaattttaggcttgcagatccattgtgctatagtgaagaggggtcttttatgtggtagtgaattcttagggacctctttgttgggcatgtatatggactcacaaaggcttgcagatgcaaacattcttttctcggagttttctagccttaaaagcattgtaatgtggaccgctttaatttcaggacatattcaaaatgagtgcagtgatgtggccttaaacttgtatcgagaaatgcgtgacaacaatatctcacctgaccaagcaacatttgttactgttcttcaagcttgtgctctcttatcctcgttgcatgatggtagagagatacattctctaatcttccatactggttttgacttggatgagttaaccagcagtgcccttgtagacatgtatgcaaaatgtggggatgtaaaaagttctgttcaagtttttgaagaattggctactaaaaaggatgtgatttcttggaattcaatgatagttggatttgccaaaaacggttatgcaaaatgcgccctgaaggtcttcgatgaaatgactcaatcatgcattaccccagatgatgtcacatttcttggagtgcttaccgcttgtagccatgcagggtgggtttatgagggtcgtcaaatttttgatgtcatggtaaattattatggcattgagccccgagtagatcactatgcctgcatggttgatcttcttggtaggtggggttttctcaaagaagctgaagagttcattgacaaacttgaagttgaacccaatgctatgatttgggccaatttattgggtgcttgcagaatacatggggatgaaaaaaggggacagagggcagctaagaaacttattgaactagaaccccaaagttcttctccatatgtactgctttctaatatgtatgctgcatcaggaaattgggatgaagctagatctttgaggagaacaatgataaagaaagatatccaaaagattcctgggtgtagctggattgtagtcgggcaagagacaaacctatttgttgcgggtgatatatcgcattctagttatgatgaaatttcaaaagcattaaagcatctgacagcactaattaaagacaacaacagattccaggacattgtaatttcctgggttggtcaaatttag

SEQ ID NO: 106581 - DNA, 525 bp, Glycine max
  Peptide Sequence Number=SeqID_223359
atggacactaccagattcttaggcgtatcaccagatgcggatttagaagaaattaaagttgcttatcggaaactgtcaaaggagtatcatcccgacacaacttccctccctctcaaaactgcctcagaaaagttcatgaaattaagagaggtttacaacgttcttagcaatgaagagagtcggaaattctatgactggacccttgctcaagaggttgcaagccgccacgcagagaagatgaaaatgaaattagaggatcctcgcgagcaacaactcaagaactgggaacctgttccagacatggttgaccgccttggtggaaggaatatgaagcttagtgatcaggcagtttctgccatcactattgatcttttcatcattgtttttgccatatgttgtatcatatatatgatgccacattccttggagtgcttaccgcctgtagccgcgcagggtggttttatggcaaactactacatggcattgagcccaaagcatattgttattgttagaaatattttgtaa

SEQ ID NO: 106582 - DNA, 717 bp, Glycine max
  Peptide Sequence Number=SeqID_223360
atgttgcatactgcagcttttcatggtttaggaaggttgcaattaatctgtctaacctacagaattgtccgctcctacctgctacactatggctatgaagatacattgaattcatttgatgtggctagtaaaagtactgttcctcctatatacatagctcaagaaagtggaattgatgagcaggaaataacatatgccttgaatcatagaaagactttacgacagctaatcaggaatggggacattgatgttgcatttggtaaattacgtgaatggtatccacagattgttgaggacaatacatcagctacatgttttctgcttcattgtcaaaaatttatcgaattagttcgggttggagcacttgaagaggctgtcaaatatggaaggatggaattgtcaagtttttatgacttgcctgtgtttaaggatttagttcaggactgtgttgctttgctggcatatgaacggcctctggaatcctccgtaggttatcttctaaaagactctcagcgtgaagttgtagctgacacagtaaatgccatgatattgtccacaaatcttaatatgaaagattcaaaacattgtttgcactcttatcttgagaggttacttagacagcttactgcttgctgcttagtgaggcgatccctgaatggagagcagggagaagctttccaacttcagagagtgcttagcagtagtagaagaggctag

SEQ ID NO: 106583 - DNA, 957 bp, Glycine max
  Peptide Sequence Number=SeqID_223361
atgggtggaagttctattggtgatgactgggagctcacttcctcatctaacgagggtcggacagtggtcttagttggacgaactggcaatggcaagagtgcaacaggtaataccattcttggaaggaaggtcttcaagtcaagggctagctcctctgctgtatccacctcatgtgaattgcagacaacagaattaaacgacggacaaattgttaatgttattgacaccccaggattatttgatttgtctgtcggatctgagtttgttggtaaggaaattgtcaaatgcattgatttggccaaggatgggatccatgctgtcattgtagtgttctcggttagaacacgctttactgaggaagaagaaactgctcttcggagcttgcagacattatttggaagcaaaattgttgattacatgattgtggtcttcactggaggagatgaattggaagaaaatgctgagacacttgaggattatttaggccgtgaatgtccagagcctttaaaggatgaagggaagcgctttggacaagttcaacaacttctctcttttgtaaacacagttctatcacgtaatggtggacgaccttatacagatgagttatttacacaactgaagaagggagcaatggagctgcataaccaacaaagagaggttgattctttaaaaggatattcaaaaggagagatattgaagtttaaaaagcaaatgcagcaaacatatgatgaccaattaaagcgaattactgagatggttgaatcaaagttgagggaggcaactatgaggcttgagcaacaattggcagaagagcaagctgcaagacttaaggcagaggagaatgcaatgttagctcaaatgagatcagatgatgaaatacgaaaactcagagaacatcttgagaaggcacatgaagaacttcgcaagcgaggtgaaggtcgttgtgccattctttga

SEQ ID NO: 106584 - DNA, 519 bp, Glycine max
  Peptide Sequence Number=SeqID_223362
atggttggaggctgcaaactgactaagacaggttctgaagatgtctctgaccctaccttatatgggtctgttgtaggggcacttcagtatgtcacaatcacaagacccaaaatttgcttttctgttaataaagttgacccgtttatgtctaaaccctctgaacagcactggtcagctgtcaagaggatcctaagatatcttaaagctatcttccttggtccaaacttaatttcctggtggtccaagatgcagactgttgttgcaagatccagcactgaggctgaatatagaagcatgaccttagttgcagtagaagtcacttggattttgtctctgctttctgaactcaaggactctcatgcttctcctgttattctttgtgacacaatgtgcagacatcctcacaaaagctcacaccttccaccttttctgcctacagagacaagctcagagtgcttgaaaagctttcagccaacccctcatgagctcgcggggggtattagagtatacctactctga

SEQ ID NO: 106585 - DNA, 210 bp, Glycine max
  Peptide Sequence Number=SeqID_223363
atggcatctgttggtttcttaatgtccatggcagctatgcagcagtggcccctttatcagttggacataaaaaatgcaatcctacacagtgttttagctgaggaagtctatatggagcaacctcctgggtttgttgctcaggggctgtctagtgtttgcaaagtccgagaggaagtctatatggaacaacctcaggatactgtgtcctaa

SEQ ID NO: 106586 - DNA, 150 bp, Glycine max
  Peptide Sequence Number=SeqID_223364
atgaatctgggtatatgtttatcgcgtatctatttggaactgtcccattggtgggggatgcttccaggaacatgggcttatgttagtgctggtgcttttggaagagcaataattgggtatgagatgatgaaagaaatggatgatgcttaa

SEQ ID NO: 106587 - DNA, 2082 bp, Glycine max
  Peptide Sequence Number=SeqID_223365
atgaagagggccatggacaaggaagacgaagacgccaataatgacaggggcagcgctgagttgctaggcgaagaggtggagaggaagaatgggcaggacttggaaggtgcggctgacacaaattctgatcacaatgagtcctctcaagaggtaaagcaaaggtggactcaaagaggaagcactcgcgcggcttcagaggatgcagagtcaaggaatggagtatttgagcccgatgaggtcaccatggggattgctgttctcttgtacaagaggccggcgagtttcgaaaagctctttcttgagtttttcaggagatggataagaggtgcaccttttagattaggtgtggatgataaagatgatcaaacaaggcagggccttgaatacagttgcactcaatacttaaacataccgcaaatgattcacttgtatggaaaactgtggacatttacgacaagcttcgcaaagtttggccaattggaaatgggagaagaattatacagggagatgcttggatatgcgcctgatgtcattatttatggtgtttttatcaatgcttttgctgatgcaggaagctacctgaaagaagcacaagaaacatacaagttgcttcaattatcggatgaagttctttctttattttcctttaattgtatgattgatctgtatactgagagacttatggttgagcaagcaaaagagatatttgagagcttgatgaagaatgaagttgttcttcttgtgtcagatattaagaaggatcttggttactgtggatcgcgtccaaaacaaagggcttggcgacaaatttctcaaaggttgaaagcacatggtattgtggagcagtttgacgctaaggtgaatggcaagattgaggcttgcctgcgccttcttgacccaataactacagaatctggaaatgaagataaaaagttgaactctgggaaaatatgtcaagttattgatcagcttgtggagcttcccatggagcatcaaatttatgatattattgatgctgcaggatcttgtggcattactttgaaggaggaagaacaatgcctaaaatctaaggcaaatcgagtttggatttctaaaaatttcaaccctgaaccagaagttggacttatttgcaagcttgatgaaaacaaaactttaaacaatgtgcctgacagttcaaaaatattatctgaatttgagacttcaactaccagtggaaaacttgatgaccctgcaaaattggaagatagaggtgttggtgcagaactatcttgtgtatctccaagaaatactgagtcaaactttgtaggaacgtcagcagacttgcaagatttggtccttgaccgaagaagtacagtttctcactgcaaatcggtcagttcatcagtggaggcagacaatgcaccatcaggagcatttccatctgacatgttgaaaccattctctactggaccaaatcaaagatatgcaagtttatctttaagtgtggataacactagaagggcaaataggatactagaaagactaaaggatgaaaggttcattttgaaatctgagataaataggtgtcttatttgctttgagaaggataagtctacaaaagtggaccgcaagactattgaccgaatattaactaaacttcaagaacaggagaagggtattcagaaaaatcaaagcgttatagttccagatgggcaggctagtaaagcagaagccatgcgtgctaatggatttgtattagcaaaaatgatttgtgcaaagctgctgcacagttttatttgggattgtctgcataggtcaacaagccatattgatgttttatcatctaaaaaatgtgccttcgagggaactgatactcctcatagtagcagcaaactattttttctagaagcaactattaaagaaatgccagttgaactattcttaaaagttgttggttccactaaaaattatgaagaaatgattggaaagtgcaagatggatttacatctctctgatcttcctccggaggagtacaagtttttaatggatgctcaagcaacaggaagattgtcgttagttattgacattttacggcgattaaag

SEQ ID NO: 106588 - DNA, 444 bp, Glycine max
  Peptide Sequence Number=SeqID_223366
atggagtccagaatggtgcgcaccactgagctggtgcttgagttgtgtgttcaggtcaaggatcattgcagactactaacaaggctggtccagagtggaaatattgtcattccttggaagaaaataacaggagcactttttattagagatatccgcacaaaaaatgctgtcatatcccatctattggagtatattgactaccctgatcaaattgagtcattcaatattttacattccttctttgatgatgttgaggtttatatgaactgtcataagtttgataaccagagagaagggctcagtgtagtcaaagctgggctgttggtgaaatccctttgcttccagtcaagccttgtatttgttggtgctgccatctgggttttccttgaatctaaagactcatttgcatcctactgcttgtctatgggcttgaagaggaactaa

SEQ ID NO: 106589 - DNA, 480 bp, Glycine max
  Peptide Sequence Number=SeqID_223367
atggatgttcaccacaccccaggaaatagcaaaacaggaggagatgacagggtagatagttggatatgggaagcagatcctatgggctcctacaaggtcaattctgcgtatgccgcaattactgatgcgagagaaggtgggtttagtgaggaattgttttgcaagatctcgaaattgggagtccctcctaaagtgcaatgtctcatgaggagaatctttcatcatagcttcttgccattgaaatctaatctgaccaaaagaaggatcataatagatcacatgctatgccccttttgccattcacaggaaaaatcacaacaacatctcctcttcacttgtcctgcatcttctcaggtatggaacacttattactcttggctgaatgaactgactgttctacctagtgcaacagctcatttctggcaaaatatggggtgtgcatcatcaaacagagagaaaaaagtcatgacgtttatgtga

SEQ ID NO: 106590 - DNA, 354 bp, Glycine max
  Peptide Sequence Number=SeqID_223368
tttgacgaaggcattaatagacatccagactccattttcaaggagaggactgttgccgagttaggttgcggaaatggatggatttccattgccattgccgagaagtggttaccatacaaggtttatggccttgatatcaatcctagagcggtgaaggtttcctggataaacttatacttgaatgctttagatgaaaatggccacctaatctatgacgtggagaataaaactttgctggatagggtagagttccatgaatctgatcttctatcctattgcagggaaaaagacattcaacttgaaagaattgttggatgcttacctcagaaaatcaaagtaaaaggagatatatga

SEQ ID NO: 106591 - DNA, 1464 bp, Glycine max
  Peptide Sequence Number=SeqID_223369
atggctgagctaagccaaattcagcttggtctgaattgggctaagccagagccatccgctaaacgccaaaatggctcgctaagcgagcgtgttgagaaaccaaacgtctctcgctattacttagcagttgtactcgctaagcgagttggtcgaaaaatagataaatggcatcaaggaaaaggaagagcactgcttctaggccacaggctcagtatgataccaggagattccaatcctaggaagcctggaaccgatatacagataacattctggaccggaggatccatccggaaaggaatctcggaacaccagagccctaagcaagttagggtgagaggacatttaatcaggattgatgctgatagcctgagttctttcttagagactccaatagtcttggaggagggtgagacacagcctacctattctaggttttcgaggatgaggattgatcctcaagagtttactgcccgtctctgcatccctggtaggggttttgttctgaatgcagagggccatccttggaagcttctgaggaaagatctcaccactcttgcacaaacatggagtgtcctctcctacagcaacctgactcccacttcccacacctctgatcttaatatggatagagccaggttggtttacggcttagtcacaagcatgtacatgaacatcggagccataatctcaggtcagatttctaccattgcccagagtaactcctctaggctcgaatttctagccttgatcactgccctatgcagagctagaggagttacctctaacagtctgacctatgagagcctgagcccggccattaacttggcctacattaagaaaaactgttcgaatgtggatgatctgacaattaacttcagaggggccaggaaggtaagggctcaactagcagatgttccttcttcttctgcactatcagctcctcccattttgccatgcctacaccagcttcccatgactctcagcgctttgaagccatgcttcatagtatcctggcctggaaccataccttctgttgtgagagagggtgagggccctagtgctcaattacctcaacaggctaccatccctggagctcctgatttttcagatgcaggagtcgagatgagacctgatgaggctatttttcctgagccaattgtgccagttatacatgagattattgaagcaggtgagtcacaattgagacaggaggctactactcctgaaaggacaccacagaccccagaagatccactctcaccagggatggagctatcttttgctcagctggtagcagatcctcctacaccagaccctaccacaccggtcctgacactgaacaccactctactagccacacctgagcttcaattttcagatgaggaggggggacggattactactcctccggggacgcctgatggaagcttgcttgtggggcttctatggaggctggatctttga

SEQ ID NO: 106592 - DNA, 417 bp, Glycine max
  Peptide Sequence Number=SeqID_223370
atggtggaaagggaaaaattcaatcatatagaagaaaggttgagggccattgaaggaggcagagattatgcttttgctgacatggcaaagttgtgcctagtgcccaacatggtcattcctccgaagttcaaggtgccgaatttcgataagtacaaggggactacttgccccaagaatcaactgaagatgtactacaggaaaatgggggcatgcaacatgtgcaagagagataatgaatcgttcaaagaatacgcccagagatggaggaatctagcagctcaagtagcgccaccaatgatggagagggagatgataacaatgatagtggacacattatcggtgttctactatgagaagatggtgggttatatgccttcaagctttgcaaacttagagtttgctggcgagaggatcgaa

SEQ ID NO: 106593 - DNA, 1092 bp, Glycine max
  Peptide Sequence Number=SeqID_223371
atgccgggaacgctggcctcttattacgccttgcggctggtctcagaaaatcaactcgactatcaaaaattgattaaaggtgggttttcagtgggggcggggattggtgccatgcactataccggcatgctggccatgcaaatggagcctgtgctgaaattcgacctgacctgggtactcatctctgtggtcgttgccgttggtttgtccttcctatcactgtggacgggtgtctatcttaatcagaaaggcaaaatacctaaccaggtcagcattatcctggggggcttgctcatgggctgtgcaatcaccgccatgcattataccggcatggcctcagcccggtttgtggggaaagcacaacctgggtttaaccccgttgataatcaatcggcctccctggccttgggcatcacattggtgacgattctggttgggtgcattgctgcagcaatcaatgccttaatccgctaccggcaaatgttggccaccatacaagccagtgaaacccggctagccaccatattgaacacagcggttgatggcattgtcaccatcaacactaccggacagatcatttcctgcaacgatgccgtacaaacattgtttggctgggaaaagtcagaaatgaccggtcaaaacatttccatgctcatgccagagccggaccgctcaaatcacttgtattaccttaaaaattaccaggccggtggtcaggcacaaattattggcgaggggcgcgacctgaatgccatgaagaaagatggcactattttcccaatcaggttagctatcggcgaagtcaagttgaccaatgaaacactgtttgtgggatttatcacagacctgagtcaacgccaggcgattgaaaaagccatccgcgaaaaagaccagcaaattcgttccatgatgaacaatattccagattggagtatgcgccttatcagtaatgcagtggtatccatgacaggctggcaagcagaagacttcctgcatggcacagtgcattttgcacaactgattcatccggatgatgctcaacgtatccagccgattgtagaggctgcgattgccagccgtaccaactaccat

SEQ ID NO: 106594 - DNA, 174 bp, Glycine max
  Peptide Sequence Number=SeqID_223372
atgttacctgaactcaatctgagagaccagtactgtagtaggaaaccgttccttttagccttcaaactcaatcagacaaagagtgatagggtccgtcccttggttgttgaggcagaaaagctcatagatgtggggcacaagggaaagtggttgagggagaggcgagaggtgtag

SEQ ID NO: 106595 - DNA, 324 bp, Glycine max
  Peptide Sequence Number=SeqID_223373
atggttcacttaatttttcatatgatcagagaaatcaaatgttgtggtcccatttatttgcggtggatgcacccggtcgagcgatacatgaagatcttaaaagggtatacaaagaatctacactatccggaagcatctattatggaaagatacattgcagaagcagctattgagttttgttcagagtacactgaaaaggaaaaacctgttgagcttcccgagtctcagcatgacgaaagagtgagaggtttagtgaaggaaagtaatccaaaaatgttgaagaacaaggtgttgaaagagcataacaagactttcctaaattag

SEQ ID NO: 106596 - DNA, 636 bp, Glycine max
  Peptide Sequence Number=SeqID_223374
atgttttataaaccagtaacatgggtgcctgatcgtattgggaaacctgatttcccggctcaatttatacagcacacaagtagagagagacacataacatttggcattgtggaatctgaagtgaaaggaaaagaaaaaaagatctttgcatcaaaccctaatcctaaaaatgtgtacctcgtcggaggtttgcaagtggagtttccctaccaaccatatggatctcagtttgcgtttatggctagagtgatttccacccttaatctagttcagaaagaaggccattgtcacgcgttgcttaagtctccaagcggtactgcaattgtccttcttgtagtttcagaaattcccgaccatacgcaaattgagatcaacaagaagcagaagaaaaaggaagcaccaaccatatattatgcctcgagaacgcactcacaaatttctcaagtggttcgtgaattgcggaaaactgcatacagggtgcctatggctgtgttggttgctgttcgtgctcgttctatgtcaaatgatgctcaattggtattttgtccatataactacatcaataatccagtcatttgggcaccaatggaagtggatattaaagtaggcatagttattttcgacgaagctcagtga

SEQ ID NO: 106597 - DNA, 603 bp, Glycine max
  Peptide Sequence Number=SeqID_223375
atgatagaggcagaatccccatcattttacctggtggcaatgaggagtaaagctctaaacttggttcatgtccttgatagtgctgctgctgctactacaactgcacctgttgttgtctcacctatgagactttggattcatgtccttcatgaaatacaacagaaaagcctcatggatgggttttcccaaataacgggagttcaatacaagttcattctgtttggagatggagacaagaacccaagctactgtgatcttgtcaacatgattacttctgatgtttttgatgctgctgtagtggtgtggattcttgaacatagaacaaacgatgagtttcgagggtcactgagggaacatatagttacagttctttggtttagtttgtcaaccatgttctttgcgcacaagaaaacacacttagtccacttggttgagttgtgtccatccatgtcctgcatttacatactcacttccctcacatgcatctcacccccgaaagtgacagacatgttgaattgggccacatttgtcgttgatccccctcttcgtcgctccaccgacaccactctcacacttgatgtgtttagcatgcaatttccttaa

SEQ ID NO: 106598 - DNA, 189 bp, Glycine max
  Peptide Sequence Number=SeqID_223376
atggacaaagatgatattttatgggcggatttggaggtaggtgatgacaacaatgagggagagaaggaagagacaaatatcgagacaaagtccaactactttcggtgctcgtcatttagaatcgatgttattgatcaaaatgagctagtgacgacgatgatggagtatccacagagcgaggaagcgtga

SEQ ID NO: 106599 - DNA, 2463 bp, Glycine max
  Peptide Sequence Number=SeqID_223377
atggcttcctctttgcttctttttttcctcttctgctcagtgattttgctaccctttgttgtagctcaaaccaaaaccaacatagccattggtgattctcatactgcaggaaaaagcacaaccccatggttggtttcatcaccttctggtgactttgcctttggtttcctcccacttgaggccactcctgatcatttcatactttgcatttggtatgccaacattcaagacagaaccatagtttggtttgccaatagggacaacaagcctgcaccaaagggctcaaaagttgagctttctgctgatgatgggttggttctcactgccccaaatggtgataagttatggaacactggtggcttcactgctagagtttctagtggtgtgttcaatgacactggcaaccttgtgcttcttgatggtgcctccagcagtacttgggagagttttgatgattatagagacaccttgctgccttctcagactatggaaaggggtcagaagctttcttctaaacttaggaggaatgacttcaacattggcaggtttgagctctttttccaaaatgatggtaatcttgtgatgcactctataaatttgccatctgagtatgttaatgctaactactatgcaagtggaaccattgagtccaacacatcaagtgctgggactcaattggtgtttgataggtcaggagatgtgtatattttgagagacaacaaagaaaagtataacttgtcagatgggggttctatttccaccactcaattttaccttagagcaactcttgattttgatggggtgttcacactctatcaacatccaaagggttcttctgggagtgtaggttggaccccagtgtggtctcatccagataatatatgtaaggattatctttctgctacaagtagtggcgtttgtggatataatagcatttgcagtttgggagattataagaggccaatttgtaagtgtccaaaatggtactcactggttgatcctaatgatcctaatggtagctgcaaaccggattttgtacaatcatgttcagaagatgaacttagtcaaagagaggatctatatgattttgaggtgttgatagatactgattggcctctttcagattatgtgctgcaaaaacccttcactgaagaacaatgcagacaatcttgtatggaagattgtttgtgttctgttgctattttcaggttaggtgacagctgctggaagaagaagttgccactttcaaatggtagagttgatgccacacttaatggtgcaaaggccttcatgaaagtgaggaaagacaactcctccttggttgttcctccaatcattgtgaaaaagaatagtaggaacactttgattgtgcttttgagtggttctgcttgtctcaatctaatattggttggagcaatctgcttgagcagtttttatgttttttggtgcaagaagaagcttagaagagttggcaaaagtggcactaatgtggaaaccaatttgcgttgcttcacttatgaggaacttgaagaagctaccaatggctttgagaaagtgctaggaaagggagcttttggtattgtgtacgaaggagtcatcaacatgggttcccttactctcgtggcagtaaaaaggttgaacacttttctcttggaagaggttcaaaaggaattcaagaatgaactgaatgtcattggcctcactcatcataagaacttggtccgtttacttggattttgtgagactcaagacgaaaggttgctggtttatgagtacatgagcaatggaactttagcaagccttgttttcaatgtggagaaaccaagttggaaactgaggctacaaattgcaactggggttgctagaggacttctatatctgcatgaagagtgcagcacacagatcatccattgtgacataaagcctcaaaacatactccttgatgattactataatgcaagaatttcagactttggattggccaagattttgaacatgaatcagagcagaaccaacactgccataaggggaacaaaagggtatgttgcacttgaatggttcaaaaacatgccaatcacggccaaagtggatgtctatagttatggggtgctgctacttgagatagtttcatgcagaaaaagtgtagaatttgaggcagatgaagagaaagcaatcctaactgaatgggcttttgactgctacactgaaggtgttcttcatgacttggttgagaatgacaaagaggcattggatgacatgaagaccttggagaaattggtgatgattgccctttggtgtgtgcaagaggatcctggtcttagaccaacaatgagaaatgtgacacagatgcttgaagatattggactatgttcaacttctgatatgcaaaactcactagccacaggactagtacaagcctacaagggaaggccaaagcttaaaactccttcattgaagttgtaa

SEQ ID NO: 106600 - DNA, 468 bp, Glycine max
  Peptide Sequence Number=SeqID_223378
atgaataggtggatgactatgaagaacctcatgctagaggacacggggacacaacgctctgataggatggtgtcacaaagtgtggttgcttgggtggcttttggcagctctacatttctcaatgtcatattaattggagccttatgtaggatctttttcttcatttttcagtacaagaagaagcatagaggaattagcaaaagtgaaaaggcccttgaaactaatttgcattgcttcagttataaagagcttcaaagagctaccaatggtttccaaaaagagctaggaagagggtcttttggtgttgtttatgaaagagtgataaacataggctcagctattccaatagcagtgaaaaaactgaacaatttgcttttccaacaggttgagaaggagttcaagaatgagttacatgtcattggtctcactcatcacaagaacttggttcggttgattggttatttgtga

SEQ ID NO: 106601 - DNA, 239 bp, Glycine max
  Peptide Sequence Number=SeqID_223379
ggaagagtgtggaagatcacaaattggagcagatgttgggaaacgtgtgcaatttagttgcgctggaataggggcactgttcatttcttctcaaaagtggaagattaaagcgagaggcaaatttaccaaactgggggtatcgccattgaaaatggcgacaagcctggtgccgcttgttctgctggcgagacagtctggtaccgccagtgctgctggcgagacagcagcctacgtggaag

SEQ ID NO: 106602 - DNA, 2358 bp, Glycine max
  Peptide Sequence Number=SeqID_223380
atggcaccaagaaacagtcgcggaaaggccaagggagagaagaaaaagaaggaagagaaggttcttccggttgtcatagacatcactgtgaagcttctcgatgaaactcatgttctcaaggatacggtggacgtgtccgcactgaagccctgcatcctcgatttagttgaagaggattacgatgaagaccgagcagtggcgcacgtgcgaagactcctcgatatcgtcgcctgcaccacgagcttcggtccgccgtcgccgaagaacgactccggtaccgtccagaaatccggcaagtccgaggcgccgccgtcgaagcaatcggcgaaagatgcggcggcggccgacctggacggcgagataagccactcgtgccctaagctggagaacttctacgatgttaatgacggagtgtgtgaatcgatgcatgcagatgtgaagagaggttcgaggcggcacgtggaggagatatcggaggaggattatctgttctcgctggatgtgaaggtgtgtaacgggaaagtggtgcacgtcgaggcttgcagaaaggggttttacagcgttgggaagcagcggatactgtgccataatctggttgatctgttgagacagcttagcagagcttttgataatgctttcgatgatctcttgaaggcattttcagaacgtaacaagtttgggaatctcccatatggcttcagagccaacacgtggcttgttcctcctgttgctgcacaatcaccctcatcttttcctcctcttcctgtggaggatgaaacgtggggaggaaatgggggtggtcttggaagagacggaaagtatgatttggttccttgggctaatgagttttcatttattgcatccatgccttgcaatacagcagaagaaagacaagttcgtgatagaaaagcatttcttctgcacagcctgtttgttgatgttgccattttcagagcaataaaggccatcaaatatgttatggaagagcccaagtttagctgctcaattgtagaaaataatattatttacactgagagagtaggtgacttgaatatcaacgtcttgaaagatgtttctgttgcaagctataagattgatactaaaattgacagagttgaagctactggagtaaatcaaaaggatctactagagcgaaatatactgaaaggaatcactgctgatgaaaatactgctgcccatgatattaccactttaggtgtaattaatgtaagatattgtggttatgtggtcacagtgaaagttgagcgaggagttaatgaaaatgttgactctccatctcaacaaaatattgaattgtttgatcagccagagggtggtgccaacgcgctcaatattaacagtctgagattacttcttcacaatacaactccaccagaaaacaataaaccaatgtctcagatacaaacatttgagagtgaagagtttggtgcttcccatgcttttctggagaagctgattaaagaaagtcttgctaagcttgaggaagaagaaccaggtattgactattttgtaagatgggaacttggagcttgctggatacaacatttgcaagaccaaaataatacagaaaaagataagaaactatctttggagaaggctaagaatgaaatgaaggttgagggtcttgggaaaccccttaaagccctaaagaattataaaaagaaatctgattctagcaatactaattctgcaactgaatattcaaagtttaatcgggaggctgaaagccctccatttccctcaattgaatcccaacttgaaactacagaagctgagaatgagcttgttctgaaaaggatattatctgaggaagcttttacccgattaaaagaatcgggaactggacttcactgcaagtctatgcatgatttgattaacttatctcgaaaatattacacagacgttgctctcccaaaattggtagccgatttcggctcattggaactctcaccagttgatggacgcactctaactgattttatgcatactcggggtctacgaatgcgttctcttggacatgttgtcaagctttcagaaaagctttcacatgtccaatcactttgtattcatgagatgatagttcgagcttttaagcacatcctgcgggcagtaatttctgctgttgacaaggagaaaatggcttcatcaattgctggtgcattgaatttgctgcttggtgttcctgaaaatagagaattagataaatcacgtgaagttcacccattggtgtggaaatggctagagttgtttttgaagaagcgatttgattgggatcctaacaagttgaattacaaggatgtgaggaaatttgcaattttacgtggcttgtgtcacaag

SEQ ID NO: 106603 - DNA, 204 bp, Glycine max
  Peptide Sequence Number=SeqID_223381
atggcctatagacatcagtcagatcctgctttatcttggtcaatgtcagtgaagaagaagatgaaattggcagaggccaaacgaaactcacacacagcacattgttcttctgtttgtgtgaaggagaaacgagaagggggagtagatggagggagtgtcaatatgaaggaaaaccggataaagaaagcaaaggagattttttaa

SEQ ID NO: 106604 - DNA, 357 bp, Glycine max
  Peptide Sequence Number=SeqID_223382
atggggttgaaccaagcacatgcttttaaggaaaggttcatcaagtcaaggcattgctcattgcattctttccttgaaatcagaattgtaatcattgtaatcaaaaggaaagaacgcactttacggtgcccttaccaaacgcgtgtcagatctagagtaatgagtgaaatagaggaggtgcaagaacagatgaaggccaacatggaggccatgaaagagcaaatggccacaatgatggaagcgatgatgagtttaagaagaacgatggaggtcaatgcggctacagttgttgccgcaagtactgccatagaagttagggaggcaaagagttgggaactgtggcggaccccattttgt

SEQ ID NO: 106605 - DNA, 366 bp, Glycine max
  Peptide Sequence Number=SeqID_223383
atggctgaagtagacgaggtgcaagagcggatgaaggctgacatggaggccatgaaagaacagatgaccacaatgatggaggccatgatgagcatgaagaagataatggagaacaagcatgttttcccgccatatggtttgcctccaaactatactccacccaatgaaaatgtcaataactccactcctatactcattgagagccaacaacctcaaactgatcatgcacatgtctctcaacccatgggggagacacatgaaatatcccatcacaatctagtcgacttcgagcctcgcctcggatatgccactgaagggcaagcagttagcgatatacccctgcaaaacactttggagagcccttag

SEQ ID NO: 106606 - DNA, 222 bp, Glycine max
  Peptide Sequence Number=SeqID_223384
atgttgaaaactgtgatcattattgggtcatttctatgccatgactcggattctaccgggaccgcacttcattgggctgtaaggtttgggagaaacctttactttatccttgggagaagggaataccaatgcaaagaaagagaacaagaaggacaaataaagcctccaatacctacccagttagtcaaacattacaaattgttggctgcatttaaggagtaa

SEQ ID NO: 106607 - DNA, 210 bp, Glycine max
  Peptide Sequence Number=SeqID_223385
atgaattgcattcatgtcaggcttgtaactttaaagggttttaacgagagaaccaaggttgcagctttaaaggaggatggttgccccaaagtctgggtagtcacttctgatcaatgtcatcagcaagcagcacatggagttttttatactgctactgactttcagggagcctttatttggagttgtaaggcattggttactgagatttaa

SEQ ID NO: 106608 - DNA, 372 bp, Glycine max
  Peptide Sequence Number=SeqID_223386
atggatctaggtcatgttcggggtcaggcatgccttcttgtagatatagttcagtactttgttgatgctaagctagaatttgatgcttcctacatttatgaagatgttattcgtgcaattgaccatgtccatcgaagtggcctggttcatagaggaatactatctgatccacacagatacttagtgaaaaatggaaagatattacgttatcttaatatgctaagggagcaggggaagaagcttttcctgttgactaattctccttattattttgtggatggagggatgtgttttatgttggagcctggtgcaattattcttcaaagagtaccaaaagagtataggtggaaaaatgaattcagtcagttataa

SEQ ID NO: 106609 - DNA, 198 bp, Glycine max
  Peptide Sequence Number=SeqID_223387
atggaggaggtgactgtagatagcagggcaagcaaagtggtagtgaaaggaaaggcaacagaccccatgaaggtgcaggagaaaaaagaagaagaaataaccatagcaagaggagaaaaaggaggaggttatttaacatttaacattggtacttacgtcaccaccgatgttaaaacacacaagttattcaacatttaa

SEQ ID NO: 106610 - DNA, 213 bp, Glycine max
  Peptide Sequence Number=SeqID_223388
atgaaaggaattgttggtacataccctatggtgggacttaaatgctctcccggcaagttacatgcttcagtcaaagttgaccttcaagcctacactttcttcatgttgaagcatgtgtttcccgtaactatttctctgatgtcgtatatctatatgagggttctacatggatctttacaaactcatcaaggcaccaagtgctaccacaaataa

SEQ ID NO: 106611 - DNA, 147 bp, Glycine max
  Peptide Sequence Number=SeqID_223389
atgattgtaggagacattttgataattgagaatcttggaaaagcaggcataaggcctcctcagatctttggttcattagctaacatttctagtggagcaattccttcaatcaacgaaaggaaagccattgatcttggtcataactaa

SEQ ID NO: 106612 - DNA, 210 bp, Glycine max
  Peptide Sequence Number=SeqID_223390
atgaatgagaagaatagatttggaaagaatggattcaggatcattcttactaaggaaaatgtgtcacagttgccaatgactacaccaatcccacttctcttctgctggaaccatgaagaccatattgacaacagcaagggagtaagggacactcctaacgacagtgagagagcacgagggagagtgacagggggagaacaagagttgtag

SEQ ID NO: 106613 - DNA, 174 bp, Glycine max
  Peptide Sequence Number=SeqID_223391
atgggaatactcacagttgcagcccaaattactcaacaatatctactagagagaggaataaatgtggaaaagaagatggatccaacggtcaaaaaactttcccagcatgcaggacctactgagcttcgcttcctagaaggtgttttcaaacatacatctaaacatcttggttaa

SEQ ID NO: 106614 - DNA, 1481 bp, Glycine max
  Peptide Sequence Number=SeqID_223392
ttgtcaatctgactctggttgatcttccggggcttactaaagtagctgttgatggtcaaccagatagcattgtgcaagacattgaaaatatggttcgggcctttattgagaagatgtatgagctccagtggtggaagctaaacttcctgagcatgtcattgaatcctaattgcatcattttggcaatatctcctgccaatcaagaccttgctacctcagatgcaattaagatttcccgagaagtagatcctaaaggtaaggtgaagctgaaagtaaggaagatgttgaaaatacagaacctagaaggggaaaggacatttggagttttgacaaagattgatcttatggacaagggtactgatgcagctgagatccttgaaggaaaatcatataagctaaatttcccttggattggtgttgtgaaccgctcccaagctgatatcaataaacaagttgatatgattgcagctcggaaaagagagatggagtattttgctaatacccccgaatatagacatcttgcttccagaatgggctccgtgcatctaggaaaggtgctatctaagcatttggaatctgtcatcaagtctcggatcccaggcctacaatcactcattaacaagactatcattgaactagagacagaattgaaccgtattgggaaacctattgctgctgatactggagggaagttgtacatgataatggaaatctgtcgaacttttgatcagatatttaaagatcatcttgatggcatacggccaggtggtgagaaaatttaccaagtatttgataaccaatttccagcatctataaaacggctgcagtttgacaaacatttatcaatcgacaaggtgcggaaactaataactgaagcagatgggtatcaacctcatctcatcgctcctgagcaaggataccgccgtcttattgaatcatgcttagtatcaattaggggccctgctgaagcagctgttgatgcggaattaaagcagtatcccaccttgagggtagaactcggaagtgcagctgttgattcattggagaggatgagagaagaaagtaagaaatcaactttgcttttggtggacatggagtatggctatttgactgttgattttttccgcaaacttccccaagacgcagagaagggtggaaatccaactcattcacttttcgacagatataatgattcttatcttcgtcgaattgctaccactgtcttgtcctatgtgaacatggtatgtgggaccctgaggcataccattcccaagtccgtggtttactgtcaagtgcgtgaggctaagcgcagcttactggatcatttctttacagaattgggaaaaaaggagggaaaacaactagcttcactgctgaatgaggaccctgcaatcatgcagcgccgcacatcccttgcaaagaggctagagctatacagaaatgcacaatcagaaattgaggcagttgcatgggaaaggtag

SEQ ID NO: 106615 - DNA, 717 bp, Glycine max
  Peptide Sequence Number=SeqID_223393
atggaatggtcttcaaaatctgccacaaaagcatactttgacacccttcaactgtgcaacaatcacaaaagacaatatggcacttggagagttcaaaatccgggaagcaatgaatttgtatcagcattagcagcaggaatgaaagcaaaactcatagtggaagtgacatctcacgtatccctaaccacattagcccttgcagctgctgcaagacaaaatggagtcagaatggtgtgtattctacctgagtcaatccttaatgattcacaagaagttatcaacaactcagggcttaaagaccaagttgaatttagaactgaagacccctccaagctactacccttctatgagaacatcgatttctttcttgttgattgcaacaaggatgaaaactatgcaaagttgctcaacttggtagatgtcaacctcacaagatcaatagtggtggcaaagaacatggttggtgatggtgacaaaaaaggaataagatggtgcctaagaggaaaagatgagaaattggaagtaagatctctaaagcaccctttagggaatggcatgaaagttactaggattagcaagagtgatgacactaatatgagatttgaggttaaaggagattatagcaagaaaaggagaaagagctcatggattgccaaatttgatgaggagagtggtgaggaacatatatacagggtgcctcaggttgattggttctga

SEQ ID NO: 106616 - DNA, 1245 bp, Glycine max
  Peptide Sequence Number=SeqID_223394
atggcaaatagtagatcttggactcagatatggccatgttttgtcaagctatgtgttctgaattttgtcttggttttcaaaatcacggcattgggggatggcagtggaagtggtcctactgttacagcagaaaacacttgcaagaacacaaattatcaaagcttcctccctccaccgtaccagaatatatctcaaatgatatgcacacctgtatggcacacctatgaattgaggtacttccagaatggtgataccacaactatcatattatctgctccctacacaatagggtgggtaggaattgggttttctagggatggtatgatggttggttccagtgcaatggtgggatggattagtaaacatggtcatgcaaaaatcaagcaattttacctaaggggtaggaagcaatcagaagtcataatagacaaaggtgaactcctcctcaataatatccctgcggctgtggcgactaatggagctgaaattcatatagcatttcagttgcagatgacaaccccatttcagaaacaaccaattctgttggcttttggtagcaaatatccacagaaccaccacctctccaagcatgaagacaaaacagctatcgtgtttgatttttctgcaggttctacgggtcctgtatccagtgaattgattcagatgaggacgaaccatggaattttggctataatagggtggggtctaatcctgcctgtaggggctattattgctagatatttcaggcacaaggatcccttatggttctatctccatgcaatcattcagtttgtaggattcacatttgggcttggtacagtagttcttggattacaactctattccaaaatgcatgtccatataccagctcacagaggcataggcatctttgctctggtactaagtattcttcaggtattggcactcttcttgagaccaaacaaggattccaagatccgaaaaatttggaattggtaccacagttggtttggaaggatggcacttatatttgcagccattaacatagtgttggggatgcaagctgcgggggcaggcagtgattggaagataggctacggattcgtttttggtattatggttgttgtagctattgttcttgaagtattggcttatttgaaaaaatcagagatgcgttctctacctcctaacttccaattggaccctgttggaggagctacatttccaagtaatcaagcactttattttctttttttcattccctga

SEQ ID NO: 106617 - DNA, 2952 bp, Glycine max
  Peptide Sequence Number=SeqID_223395
caagcagcatgctcatctgcagatggaaggcagctcctagagtcatccaaaactgctttagacaagggaaagcttgaggatgcagttacctatggcacaaaggctcttgctaagctggtagcagtttgtggtccctatcatcggatgacagcgggagcctacagcctccttgctgtagttttatatcatactggagatttcaatcaggctacaatttatcaacaaaaagctttggatatcaacgagagagagttaggtctggatcatcctgataccatgaagagctatggggatcttgctgttttctattacagacttcaacacaccgagctggctctgaagtatgtgaagcgtgctttatatcttctgcatctaacatgtggcccatctcatccaaacactgctgctacttacattaatgtggctatgatggaagaaggtctgggaaatgtacatgttgctctccgatatcttcacaaagctttaaagtgcaaccaaagattacttggtgcagatcatattcagacagctgcaagttatcatgcaatagcaatagcactttcattgatggaagcatatccattgagtgtccagcatgagcaaacaactttgcaaattctgcgggcaaaacttggccctgatgacttgcgcacacaggatgctgcggcttggcttgagtattttgagtccaaggcttttgaacagcaagaagctgctcgaaatggtactcgaaaacctgatgcatcaatagctagcaaaggccatcttagtgtgtcagatttgcttgactacattaatcctaatactaaagggagagatgcagcagcaaagagaagaagccagataacaaaggtgagagcaacgtcttacccaaacgttgggatgtcaagttctgatgaatcttcaaaagaaattccaaaagaggcttcagatgaagaggtacaaatacccatactagtaggtagtgcagattctgagcaggaaaacaactctggacctgatttggaacaagctattttgaaacaaatatcggacgaaaagccacaaatttatgatgaaatcttgtctgaagcacatgctgaaggagaggatggatggcaaccagttcaaagaccaagatcagctggctcatatggccggagactgaagcagagacgggcaacacttggcaaagtttatagttatcaaaagaatgtggaagttggctcagaatctccttttgtaaggagtcctaatccgagtagtaggtattatttcttgaagaagcggacaatttcacatgggagttatacagatgatcataccgtaaacatcacccaaggtactaaatttggaaggaaagtagtcaaagctgttacatacagggtcaagtctgtgccctcaacttccaagccttgtgtaaatgagaaattagaaaatggggataagctgctcagttctcttccagaacctgatccaactgatgctaatccagttaagaagtctattgttagtcttggaaagtctccttcatacaaggaagtggccttagctcctccagggacaatctctaagtttcaggtctataatcctcaaagtgtgatttctgttagcagtgagcatgatggtggaaaacatgaagaggaagatattgaagctgatagaaatgttaatgttgatccaaccccgacagaggtaaatgatatggttaaagagaagaatgatgattctttatcagattctgtagatgactcacaggatgatactggagttgctattgaggggaaagaagaaactcagttgattgttgctgtgcaagataattgtatgagtgctgaggggcaatcaggagatgttgaagctcaaggagcagttgataacagcatattgattcatgcagtagatgatcatgtggattcttccaagcaagaacttgatgcaagtaattcatctgccagtttagaacctagtgataatacaaatcccacttctcagggtggtgaggatttaaaggtcaatgtatcaccatcaagtcagagtcatactgggggcatcccatataagaaattgtctgcatctgcagctccattcaacccatcacctgccattgcacgtgctgcaccaattgccatgaatatgactcttccttctggtcctagtgcagttcctgcaattggcccctggccagtaaacatgaatgttcatcctggacctactactgtgctacccacagttgccccaatgtgctcctctccgcaccatgcatatccatcacctccagcgacaccaaacatgatgcaaccgctgccatttgtgtatcctccttttactcagcctcaatcagtagcacctagcaactatcctgtcactagcagtgcctttcatgccaatcattttacatatttgaacccaacaatatctaagtttggtcccagtgctgtttggcctggttgtcatcctgtagaatttcctcttccagtacctattgttgaaccaatccgtgatcccatttcagagtcacaagttctgtgtcatggctctgaaagtccaagttcagcttcagttcttcctgaggacattgacagtattggggattccaatcaaggggtaaaaactttatcatcagagataagtgaagatgaagcagtgagagctggttcagaaaatataaaagaaaatggtaatatgaattttcacgggtctgaaaatgctgggaacaagcaaaatcaaaactttggttcaaatggcagctctagcagtagtgaaactaacatggatggtgagaaaacctttagcattttgattcggggaagaagaaatcgaaagcagactctgagaatgccaataagtttgcttactcgacctaatggctcacagtcatttaaggttatttataaccgtgtggttagaggaagtcatgctaccaagtctatgaatttgtcttctagtaaagattgtacagctactgcatag

SEQ ID NO: 106618 - DNA, 372 bp, Glycine max
  Peptide Sequence Number=SeqID_223396
atggagaatctgatacagttggtgaacaaaatccagcaagcatgcaccgccctcggcgatcacggtgaggaaggcgcaatgcctactctctgggacgcccttccttccatcgccgtcgtcggaggacagagctctggaaaatcttcagtgttagagagtgttgtcggaaaggactttttacctcgtggatctgggattgttactcggcgtcctcttgttttgcagcttcataagattgatgaagggagagaatacgctgaatttatgcaccttccaaggaagaaatttactgattttggtattctgttacataaaacattttcacagacatatggtttaatgtatattgcacttaacatcagtgtgtggtag

SEQ ID NO: 106619 - DNA, 1785 bp, Glycine max
  Peptide Sequence Number=SeqID_223397
atgtcatctgctggtgtcaccactcttagccctgttcccagggagctattgttgtccccagatggatactataccccattgcacttgtcattggatcgagagtttattttcatatatctgtcctattttggatctttgactccaatgcgagttcttccctgcgataccattgagtccgtgaaactcaaaatccagaagtctgaggggcttccttcattgacaaacaaacaaaagttggtctgtgatgggcgggaactagcacggagcaattccctgctgaaagaatatggggttacggaaggaaatgttttgcatttggtgattaggctgtcggatctccagaccatcagtgtgagaacttcttccggaaaggactttacttttcaggtggagagatgcagagatgtcgggtacattaagcaacagattgggaaaaaggagaagtgctttgctgatcctgaacagcaggaagttatgtgtaatggcaagctgcttgaggatcagatgcttattgatgatatctgcagtaaatataacgatgcagtgattcatctttttgttagagtgaaatatgcagaagttaggacgggacaagatgagttgtccgtcgtggcaaaggagttgaatgatacaaaagattatgaaactaattgtaggagaaaatatgatattagtaaagaagatacaagaagggagtatggagtcgttgagccaattatgccaaggaaggctcttgatagggatcttcttttggagccggttattgttaacaaaaaaattgaattagcttctgagatttggaatatgataaactctacatatgaagggctagacattggaaattatccaatcagatctgcagagggtacagggggtgcttactttatgcttgattcaaccgggcaaaagtatatatctgtttttaagcccattgatgaagagccaatggctgtgaataaccctaggggtttacctttctcagaagacggtgaaggcttaaagaagggaacaacagttggtcagggagcattcagggaagttgcagcttatattttggatcacccaatgagtggtcgccgatcattatttggtgatgagaagggttttgccggggttcccccgacagttatggttaagtgcttgcataaaggatttaaccatcccggggagttgactactaagattggctccttgcaaatgttcatagagaataatggaagctgcgaggatatgggccctggggctttcccagtgaaggaagtgcataaaatttcagtagtggacatgcgactcgcaaacgcagatagacatgctgggaatattttgatcggcaaagtggaggaaaatggccaggctgttttgattccaattgatcatggatactgcttgcccaaaagttttgaggattgtaccttcgaatggctttattggcctcaagctcgccagccatactctccagagatcattgactatataaagtcactggatgctgatgaagatattgcccttttgaagtttcatggatggaatctgccagttgaatgcgcgcgcactcttcaaatctcaaccatgcttctgaagaaaggagtgaagagagggatgaccccctttgccattggaagccttatgtgcagggaatccttgaacaaggagtctgtgattgagggaattgtaaaggcagctctggattctgttcttccttgcacaagtgaagccacatttctggatactgtttccgaaatcatggaccagcaccttgatgagatcacgggttccatttcttaa

SEQ ID NO: 106620 - DNA, 1566 bp, Glycine max
  Peptide Sequence Number=SeqID_223398
atgacaaatgaaaattctgtgaagaagaaacctaggatcatacagtctgttaaggaagctagggattatctttcgaaaaaacatgacaaacaagatcctggcactagcacaaaatctaaaattgaacttgtgaaagaaaatattgctgatttgaagtcttcaaaatttgagaagaatacaattgtgtctaaaagtggcacattaaatagaataacggattctaagcctctcataaattctagcgatgattctgatcggaaggataaggatgttagcccaagaaagaatgaatacatcaaagattctggtattgaacctggattggaagagcttcaaaaggatgagaccactttagaccatgaagtccgtggcattagtacagagacaaggctacctgtaaagccagaaaattggccggacaaaaacctcattgaagttgagcatagcaagagtgatgctttaaatggattatcagattctaagcctgccacaaatcccagtgaagattctgatcagaagaataaggaatttggcacaacaaaggatgactacctcaaacctggaataagaaaccatcaaaagtcaggcaccactttagacagtgaagttaatggcattagtacagagacaagggcgtctggaaagacagaaaactggctggagaaaaacttccatgaagttgagcctatagatgatcatcttagagacattgtctttcgagtccgtgagaatgagctgtctggacgggacccattttatttgatgaatgatgaagataaggacacatttttcagtggtcttgagaaaaaagtggagaaagagaataaaaaactttctgacatacatgaatggctccattcaaacattgaaaatcttgattacggagcagatggcattagtatatatgacccaccggagaaaatcataccacgctggaaggggcctcccgtggagaaaattcccgagtttctaaatgaattcctcgatgaaagaatgacaagttccactggaaatatgaacccagtgaagaaagatgagagtggctttgctataacatcagctgagtcctctttacaggaaaaggttgatggccctacagtacctattaagaagttgaaaaatccaaagactattattgaaggaagtgatggttcagttaaagttggcaaaaaatcagggaaggaatattggcaacacacaaagaaatggtcccaaggttttttggactgttacaatgatgagacagacccagaagtaaagtccataatgaaggatatggcgaagggtttggatcgatggatcactgaaaaagaaatagaggaagcagctgaactaatggaaaaactacctgataggaataggagtttcatggaaaagaaactcaacaagattaaaagagagatggagttgtttggaccacaagcagtggttagcaaatatcgtgaatatgcagtcgacgaagaggaagattacttatggtggttagatctttcacacatactggttaaagaggaagttgaagaaacccagaaagggatgatggttttcaaactttcaacaaagtga

SEQ ID NO: 106621 - DNA, 522 bp, Glycine max
  Peptide Sequence Number=SeqID_223399
atgacaggcaggcgaggatacgggggaggaagccggctaatggaagggaggaaccctcaatcatgtggaggcagagaggcaaaggcgggagaggcggaaccagcgatggacaaggcatcactgttgggagatgctattgcttacatcaatgaacttcaagcaaaactcaagaccatagaatctgagagagagaggtttggaagcacctctatggatggaccagaattggaggccaatgcaagagtagaaaatcatcataatggaactcctgatgtggatgttcaagttgcacaagatggggtcattgtaaaggtgagctgtcctattgatgttcacccagtttcaaaagtcattcaaacctttaaagatgcagaaattggtgttgttgaatcaaaagttactgctacaaatgtttctgttttccatacatttgtagttaaatcccaaggacctgatcagctgacaaaggataagttgattgcgttgttttccaaagaatccagcaccataaagacattatga

SEQ ID NO: 106622 - DNA, 1305 bp, Glycine max
  Peptide Sequence Number=SeqID_223400
atgaagattgaggtggggttgggaggggtgtgggatgaggaagagaaagcgacggtgatggaggttctgggacgtggagcgttcgattacttggtggcgaattcggtttcgaacgagaatctgttaatggcgttcgggtgtggcgagaatatgcagaacaagctctcggatctcgtggagcgacccaactcgtcgaacttcagttggaactacgcgatcttctggcaaatttcgcagtccaagtatggggattgggttttggggtggggagatgggtgttgtagggagccaagagagggagaagagggtggtggagaagtgagaagggttagggttgtttttgatgatgatgatgagaaggtgcagaggatgaggaagggggtgttgcagaagctgcacatgacttttgggggttctgatgaggacaattatgcttttgggttggaccgcgtgaccgacacagagatgttctttcttgcttccatgtacttctcttttccccgggggcttgggggtccaggtaagtgttttgcttctgggaagcatttgtgggtttcggatgtgttgaaatctagttttgattactgtgtgaggtctttcttggccaaatctgctgggattcagactgttgttttagtgcctactgattttggggtggtggagatggggtctgtgaggatggttggtgagagttttgagttgttgcaggctgtgaaatctgtgttttctgcacaggcatcatcattattagtcccccacatggttaagccaattgcaccgttggatttggtgagggaaaagagagatgggagtgagagtgcaaatgctcttttatctggtttggcaattggggataagaataagaatattaataacaatagtagagtagagggaattggagttccgaagatttttgggcaggatttgaattgtgtgactcaatttagggagaaacttgctgtgaggaaaatggaggagaggccgaggccatggggaggccatccccccaatgtgaatagtattggctttccgaacggtgttcagggttctagttggggggctggtcaagttgtgaggcatcttggtcctcctgaaatgcttgctcctaggttggccagctccggcacattgccaaagctggccaatggtgcgaggcatgactttgtgcataacaactttgagcagcaacggccggtacagatgcaaattgatttctcaggagccacttcgagggcagcttctgggagatcaataattgccgagtctgagatttctgatgttgaggcgacgtgcaaggaggagaga

SEQ ID NO: 106623 - DNA, 219 bp, Glycine max
  Peptide Sequence Number=SeqID_223401
atggaaggcataacagagggagtgaacaacatcatgaatcccctcttccaagacgttggatttgatctttgttttctgaagcatgagtttcctctccctcgcctttttcccacattacttcatccatatagttgttgcagtgtaggtgttattgatcgaggggcaatcggtgaggctgttaagttcgacaacaccaattgttactgtcccagggcatga

SEQ ID NO: 106624 - DNA, 456 bp, Glycine max
  Peptide Sequence Number=SeqID_223402
atggtgatttctaaaccaattgctacaattgctcaagcaccagaagtggctgagtccactctagtcacaggtcttgagaaacaaatagataaggttgatgaggctctaactgaaccaacctcaaatgaagccacatccaaagacacgactattgtcactatctacaccactaactgcaccactaactctggacccactccaattaactttgctcctccagaaatcgtaactaagagctcagatgcatctgtaatgctactgatgccccaatactgcttccacccgtctaacctcaaccaccaaccttggatattcttcatcaatggagtcctttgtttcttgaagatcaatggcagcgaaatggagaagaagaaagatgattggagacgccacttcaaggagaagatgagtcaagaacaagctcaccaccataggaagccatggataagagcttga

SEQ ID NO: 106625 - DNA, 240 bp, Glycine max
  Peptide Sequence Number=SeqID_223403
atgtcagctgagccacaaactccagtggtgaatccacctccttcttcagagcttgatgtagttcccccatctccacctctagttgtcatctccaatgcatcatcagatgaagcggctggccctcctgattcaccagctggagaaacaactgacccccctgcttccctagttggaggaattgtcgatctttcttatttgtcatctggagaagttgttgctctcagtgattccccagtttag

SEQ ID NO: 106626 - DNA, 228 bp, Glycine max
  Peptide Sequence Number=SeqID_223404
atgtatcaccttgaggacaaggtgatgttcttaggagtgggtgatgatagtaaaagcctagtacctgcaaaccatgaaggaaggcccaagagaagcgcaacaggtcctacccacttgaaggattatgctgtggaagcaatgccttccaaggttattttgatgatgccaaagaatcaagagtcaaacaagtttcaagaatcaagatcaagattcaagaatcaagaataa

SEQ ID NO: 106627 - DNA, 1008 bp, Glycine max
  Peptide Sequence Number=SeqID_223405
atgttatccctcagccatatgcaatcacagggactcgcactgcctcctgaacctggtgttggtccttcaactgctcgtgtcagtacaaaggagagttgtgctgatccctcagggaacgatccagacacgggtgactcatacaaatgcgggttgtatattgaagaatatcctcctcgcctggttgccctaggaagagtttatgaggggtccacaagcattcacaacattcctttgctgcatgatcaagtcaaggttggtgttgaggagattagagatgcaaatgctcccattcctgtacccactaaagaggttaaggtcatgggacaggctcttaacacattccttgcttggccgacacatcttgtcaagcgtttatcagaacagggagttgtgggacccgcgaaacctgtagatagaccggatgatgaggttgatgatcccctatatctaatgacattgaccatcccacagctttttctgaagccattgcaggttatgtgggatgctaccttgtttggcctattttatgaaaacttccccttgtacataaagcatgaagatctgtctgaaattgcacatggtggtcaatgtctcagcatatctgttatacagttgtggattctgcatatgactgagacaagtatgcgagctgggaatatcgatgtgtatggattcctcgagccacagtctatccagagatctggccaatcacaatttgaatcagaaaattacattaagaactggatgcaaaattcaaaacgagatgtgtacctaggagcctacttgaatggtgcacattggcaaatggtcgtcattttgcctaaggaaaatgttgtcatttggttttgttcgttgcataataagccagacaactacctcaaaggcataattaataggtcagtgttgttttttaatatatttgcattagcattagtcagtgctttgaaaggacttgacgatactcaacaaagtaaatccaagactcctgctaggtggattgttgttaaa

SEQ ID NO: 106628 - DNA, 153 bp, Glycine max
  Peptide Sequence Number=SeqID_223406
gggcagaatcgtcttaggccacggttagaagtcgagacaaagttaacggtagaaaccaaccaagaggatagggtcacgaccgacagatcatcatcccttcccggtgctggacaagcgaaaaacgtcgctgcagggcagcccaatatcctttaa

SEQ ID NO: 106629 - DNA, 360 bp, Glycine max
  Peptide Sequence Number=SeqID_223407
atggatgccctacaatatattaaggaagtacaatgtgcatttcacgacagcggagaaaagtttgacaagtttatggatgtcatgaaagattacaaatttcatagaattgatgttgggattgtcgtagaaaaaatggaggagattcttaaagaccatggggatttgattttgggattcaacaagtttttgccaaaaggatatgaaatcttacttctagatgagggtgaggatggatttggaaatgcttcgaaatatttgaagaagattcaggctgctacactttttgagggtcaccgggatcttcttcgtgacttcactaagtttttaccatctgtacatctaaggggaaaatctacttaa

SEQ ID NO: 106630 - DNA, 201 bp, Glycine max
  Peptide Sequence Number=SeqID_223408
atgcctacctctgaggccaacaaagaatctctaaggttgttcatggaaatgtatgcagccatctcgatcaagattaaagaccttgacccagttgtcatgctacattccattgtaatggcgttgaaactaggatcattcgccgataatctttgcaaaaaacaacccgaggacttggataagttaaaggcaagagcaacatga

SEQ ID NO: 106631 - DNA, 423 bp, Glycine max
  Peptide Sequence Number=SeqID_223409
atggcaccacactgcacaaaagcattcaatgccaagattctatatttgccccctccagccaggtcattcaacttggctgacagatcaaagcaatctagatatcatcaaaactttggtcgtaccacagaggaatatgttgtagttaaagaaagaatagaagagttaatacaagaaggtgccctcacaaaatacatatatagccctaacaacaatagggacagagacagaggttggggagaagttgaggcagccatcatagtgttaaaggtaaaaaaatatgttgacgataaacaagagcagataaaagccaaatcggacccagctaataacttatcaacaggggaaagtggcttacacgtggttattaacaccattataggaggttttgaaatacaattaatcacactagaagggattgaatag

SEQ ID NO: 106632 - DNA, 2889 bp, Glycine max
  Peptide Sequence Number=SeqID_223410
atggagtggaaccctcagaccctccaattcctctcggaatgcttcctccacactctctccccctcgccggagccccgccgccgcgccgagtcctccctcgccgaggccgccgaccgccccaactacgccctcgccgtcctccgcctcgtcgccgagccctccatcgacgatcagatccgccaggccgccgcagtcaacttcaagaaccacctccgcctccgctgggcctccgacgactcccccgtccccgaccccgagaaagaccagatcaaaaccctaatcgtccccctcatgctctccgccacccccaaaatccaatctcaactcagcgaagccctcgccctaatcggtcaccacgatttccccaaatcctggccctctcttctccctgaactcatcgcaaatctccaaaaggcttcccagtcctccgattacgcctccattaacggtattctcggcaccgctaactctattttcaagaaatttaggtttcagtataaaaccaatgacctattactggacttaaagtactgtctcgacaacttcgcctctcctttgttggagattttcctcaagacggcgtcgttgattgacgctggcgccatgaacctgcgcccgctctttgagtcgcagaggctgtgctgcaggatattctactcgctgaattttcaggagctgcctgagtttttcgaggatcacatgaaagagtggatgggtgagtttaggaagtatctcaccactagctaccctgctcttgagagcagtggtgctgatggtgttgcgcttgttgacgagcttcgggccgcggtttgcgagaatattaacctctacatggagaagaatgaggaggagtttcaggggttcttgaatgattttgctcttgctgtgtggactttgcttgggaatgtgtcacagtcgtccagccgggaccggcttgcgattaccgcgattaagtttttgaccacagttagtactagcgtgcaccatactttgtttgcgagtgatggggtgataccgcagatttgccaatgtattgtgataccgaatgtgagtttgagggaggatgatgaggagctgtttgagatgaattatattgagtttattaggagggatatggaagggagtgatcttgatactaggaggaggattgcttgtgagttgctcaagggtattgcgatgtattatggggatgctgtgaaaagcattgtttctgcgcagatacagaatttgttgagttcgtatgctgctaaccctgggacaaattggaaggacaaggattgtgctatttacttggtggtttctcttgcaaccaagaaggctggggctagtgttgtctccacggaactcgttgatgttcagagcttttttgagtctgtgattgtccccgagctgcaaagtgcagatgtgaatgggtatcctatgctcaaggccggtgcactcaaattttttactatgttccggacgcaaatatcgaagcctgtggcattgaaattttttccagatttggttcgtttccttactgcagagtcaaatgttgttcattcttattctgcaagctgtattgaaaaactcctgttggtgaaggatgaggggggtggagcacgttatacttcagcagatatcaatccaattttccctgtgctgatgaacaatctcttcggtgcctttaagctcccagagtctgaagagaatcaatatgtaatgaaatgtattatgagggttcttgctgttgcggatatctctattgatgttgcacgagtttgcgttgaagggttgggctctcttcttgctgaagtttgcagaaatccaaaaaatcccacattcaatcactatctctttgagtcagtagccattcttgttaggcgggcttgtgagggggactcaactcttgtatctgtttttgaagcaagcctttttcctaggcttgaagtaatattgaccaatgatgtgactgagtttttaccatacacgtttcagttgcttgctcagcttgttgagttaaacaggccacccatccctccaatctacatgcagatatttgagcttctattgtcacctgaaacatggaaaagagcctcaaatgttcctgcacttgtgcgtctgctccaggccttccttcaaaaggcaccgaatgagatcacccaaggggataggctgaccaaagtgcttggcatatttgacacactaatccaagcttcaagcacatctgaacaaggattttatgtgcttaacactgtcattgaaagtcttgagtataatgctattaaaccatatatttctcacatttgggccgcacttttcagagagctccagaaaaggcggacagtaaagctcatcaagtctctcttgatatttatgtctctcttcctgattaagcatggtgctgcaaatgttgttgatactatgaacagtgtccagcctgatatttttgttgtgattttgaatcagttctggattcctaatcttaagctgattacaggagctatagaactcaaattgactgcagttgcctcaaccagactcatctgtgagtctccagttcttttggatcctgcagcttctgtgtcctggggtaagatggtggacagcatagtcacactcctttctcggccagaagaggatagagttcaggaggaacctgacatgccagatataacagaaaatgcgggttatagcaccacctttgttcttctttataatgctggaaagaaagaagaagatccacttaaagatataagagatcccaaggagttttttgtggcatcattgtcccgactttctgcactttcgcctgggaggtatcctaaggtcatcagtgaaaatgttgatcctgcaaatcaagcagcattgcttcagctttgcaacacttacaatctttcaatagtttga

SEQ ID NO: 106633 - DNA, 495 bp, Glycine max
  Peptide Sequence Number=SeqID_223411
atggactcaaggatcacaaaggttgaagaagatgtcaccatcattcgcgactgtcttgatttacctccacaaccatcagattgtcatcatcaaaaagggggagattatggaagcaatgtcttccaaggttattttgatgatgccaaagaatcaagagtcaagcaaaatccaaagattcaagaatcaagcatcaagtttcaagattcaagactcaatattcaagattcaagaatcaagactaaagaatcaagattcaagaataatcaagatcaagattcaagactcaagattcaagaatcaagagaagactcaatcaagataagtactaaaaaaaagtttttcaaaacattgagtagcacaagaagttttcacaaaatcattaccaaagagttttactctctggtaatcgattaccagaaggtagtaattgatatgaaccctcatgtcctcatcagtaatcgattaccagtagccagcattattttcaaaaactga

SEQ ID NO: 106634 - DNA, 402 bp, Glycine max
  Peptide Sequence Number=SeqID_223412
atgagtagaaaagattcatacatatataaaatattaaaagagatacgtaagggtacgaagattacatctaatcctttggagaaactagccgatcattgtgtagagaacacggtcaataagagaaatgacgaaggatgcgatccacggtcacaactctgcaatgctcgggctccactttgtatatcttcttccttctgcattcttcctctggtttctccttcattctgtatatgtttatccctcatttgcatgactttttatagaaaaaagagccaagaggtgtggaccaactcacccaggcgagttgaactcgcccagtcaagctttttgcttagtgctaaagatactcactcactcaggcaagctgtagctagcctaggcgagttgattgcttatgcctga

SEQ ID NO: 106635 - DNA, 447 bp, Glycine max
  Peptide Sequence Number=SeqID_223413
gatccgttggaggagcaggcctcacagggttcctttgtcgcctatggacccggtgtcatggtcaaacaatactttggaccggctccaaggacctcccacacttcttcgtccatggctcccgaagaccaggagcagctaatgcaaaaaatcagggaccaactggaggaggactcacactaccgccttagcccaagattggtccttcagcttctcatgtcaacacaaaggagagttgtgttgatccctcagggaatgaccaagacacgggggtccacaaccattcacaacatccctttgtgccatgatcaaatcaaggttggtgttgaggaagttagagatgtagatgctcccattcctatacccactgaagaggttcagttagtagggcagacacttaacaccttcgttgcatggccgacacatcttgtgaagcgtttatcagaatag

SEQ ID NO: 106636 - DNA, 465 bp, Glycine max
  Peptide Sequence Number=SeqID_223414
gcgagggcatgcagccctctaaaggcgaggacatatagtcctctgaaggcgaggacgtgtagtcctctaaaggtggcgtgtagccctctgaaggtgagggcgtgttgccctctgaaggtgagtgcgtgtagccttctgaaggcatgggcgtgcagccctctcaaggcgaggacgtgtagtcctcttatggtaagggcatgtaggcctctgaaggcaagggcatgcagccctctcaaggcgagggcatgcagccctctcaaggcgaggacatgtagtcctctgaaggcgaggacgtgtagtcctctaaaggtgacagcgtgtagccttctgaaggcgaggacgtgtagtactcttaggtcgaggacgtgtagtcatttaaaggggagggcgagaagccttctgaaggcgaggacgtgtagtcctctgaaggcgaggacgtgtagtcctcatatggtgagggcgtga

SEQ ID NO: 106637 - DNA, 153 bp, Glycine max
  Peptide Sequence Number=SeqID_223415
atggctactccacctgcctcacctcctcctcctgtagtagcatcagtgtttatgtccacccagaagcggacacgcaaagcaacacgactacgatccttggccactagaccacctagggcaaagagaccagtggtcaacgtcgaggatattcag

SEQ ID NO: 106638 - DNA, 294 bp, Glycine max
  Peptide Sequence Number=SeqID_223416
atggtggcccaagcccgggctgttgatatgctcgtggagacgtcatcatcgcgattgtggatggcagcgcgcgcccttggcgtgcctcggcacctgcgcgctcctggcgtcggcctgtgggctccccattcggcccgtcttgaaacacggaccaaggagtctgacatgtgtgcgagtcaacgggcgagtaaaccccatacctgtcgggacccgaaagatggtgaactatgcctgagcggggcgaagccagaggaaactctggtggaggcccgcagcgatactgacgtgcaaatc

SEQ ID NO: 106639 - DNA, 477 bp, Glycine max
  Peptide Sequence Number=SeqID_223417
atgcatgctagagctagagtaatgggtgaaatagacgaggtgcaagaacagatgaaggtcgacatggaggccttgaaagagaaaatggccacaatgatggaggccatgatgagcatgaagaagatattggaggccaatgcggctgtagctgccgctactagcaccgttgctgaggtgtacccgacccctccatctagccccaagcaaataaatcatcctacctcagatatgataggtcagggaggtaaagaattgggaagtacgggcggcccccattttgtgcaagttcaaaacaagcatgccttcccgccatatggcttgcctcccaactatacaccacccaatgtggcgcacacttccgatgagaatgtcgataactccactcccatactcattgagagccaacaaactcaatttgatcatgcacatgtctttcaacccatgggggaaacacatgaaatacccaccacaacatag

SEQ ID NO: 106640 - DNA, 1060 bp, Glycine max
  Peptide Sequence Number=SeqID_223418
acgactacacgtcctcagcttcagaggactaaacatcctcaccttcagaggactacacgtcctcaccttcaaaggactacatgtcctcgcctttagaggactgcatgtcctcgccttcaaaggactacatgtcctcacctttaaaggactacacgtactcaccttcaaagggctacacgccctcaccttcagcagactacacgtcctcccctacagaggactacacgtcctcaccttcaaagggctacacgccctcgccttcataggggtaaatgccctcaccttcagaggactacacgtcctcgccttcagagggctacacgccttcactttcagaggactacacgtcctcaccttcaaaggactacatgtcctcgccttcagaggactacatgtcctcacctttaaaggactacacgtactcaccttcaaagggctacacgccctcaccttcagcggactacacgtcctcgctttcagaggactacacgtcctcaccttcaaagggctacacgccctcgccttcatagggctaaatgccctcaccttcggaggactacacgtcctctccttcagagggctacacaccctcacctttagaggactacaggactacacgtcctcacctaacaaagggctacgcgccctcgccttcaaaggactacagatccttgcctttaaagggttgcacgcccttgcctttaaagggctagacgccctcgccttcaaagggctacacgccctcgcctttaaagggctgcacgccctcaccttcagaggactacatgtcctcagcttcagaggactacatgtcctcaccttcagagggccacaggccctcactttcagaggactacacgtccccgtagtcctcaccttcagagggctacacgccctcaccttcagaggactacatgtccttgccttcagaggactacacgtcctcaccttcagagggctacacgccctagccttcgtagggctacacgccttcaccttcagaggactacacgtcctcgccttcagagggctgcacgccctctccttcagaggactacat

SEQ ID NO: 106641 - DNA, 768 bp, Glycine max
  Peptide Sequence Number=SeqID_223419
atgtttggcgagctgagccgcgtaaagaaacagcaggctgtgtacgcgccgctgatggaatacattgcggataaccgtattcatgcggtgtccatcaagacttataccccagccgagtgggcgcgcgaccgtaaactcaacggccccacccgtttaagcggtgaagtgaccatttccggggcgaagaatgctgcgctgccgattctgtttgctgcgctgctggctgaagagccggtagagattcagaacgtgccgaagctgcgtgacatcgataccaccatgaagctgctgagcctgctcggtgcgcgcgtggaacgcaatggttcggtccacgttgatgcgcgcgaagttaatgtcttcagtgcgccgtacgatctggtgaaaaccatgcgcgcctccatctgggcgctggggccgctggtggcgcgttttggccagggccaggtttctctgccgggcggctgtgcgattggtgcgcgtccggtcgatctgcacattaccggcctggagcagctgggtgccgagatcaagctggaagagggttatgtcaaagtctctgtggacggtcgcctgaagggtgctcacattgtgatggataaggtcagcgtgggcgcgaccgtgactatcatgagcgccacaacgctggcaacgggcaccaccatcattgaaaacgcggcgcgtgaaccggagattgtcgacacggcaaacttccttaacacgctgggcgcgaaaattagcggcgccggcaccgacaaaatcaccatttga

SEQ ID NO: 106642 - DNA, 1233 bp, Glycine max
  Peptide Sequence Number=SeqID_223420
gtgttctacgatgcgctgcagaacaagaactacccggtattcaaggcgcagctgtggcgctttacctatctggcgctgatcttcatcgtgctggcggtctacaagatctacctgactcaggggctgcagatgcgctggcggcgctggatgacggaaaagttcatggaaaaatggctggcgcaccaggcgtattaccacgccgagcagcagcagatcgtcgataaccccgatcagcgtattgccgaagatctcaacgtattgacccaatataccctgtcgctgtcgctcgggctgctctccagcctggtgacgctgttttcctttatcgacatcctatggcacgtcagcgggccgatgaccttcgcgctcggccagcacgccatcacgctgcccggttatatggtgtggttcgcgctgctgtatgcggtgctgggatcgctgctgatctggtgggtcggcaaaccgctggtcatactgggcttcaaccaggaacggtatgaggcaaacttccgtttcggcctgatccgcatccgcgaaaacaacgacgccatcgcgctgtaccacggcgaaccgcgcgaggcgcagcagctgggcgaccgttttgacaccattcgcagcaactggtgggctattatgcgcatcacccggcggctgaacatcgccaccaacttctacggccagttcgccatcgtatttcccctgctggtggcggcgccgcgctacttctccggcgccattcagatgggcggcctgatgcagatcgcctcggccttcggccaggtacagggtgcgctgtcatggtttatcgacgcatttaacgatttggcgacctggaaagcctgcgtcaaccgtttggccggcttcaacgccgccgtcgatcaggttcatcatcagccgcgcggcattcagctgcgggaagagaccgcccatccgttgacgctggataacctcagcctgaacttgcccgacggccagccgctgctggccggcgccgagatgacgctgcaacgcggcgatcgcctgctgatcgtcggcccttccggctgcggcaagtcgacgctgctgcgggccatcgccggtatctggccttacggcgcgggcgccatcggggtagcggccaatgccaacacgttgttcctgccgcagcgcagctacattccgatcggcacgctgcgcgaagcgttgagctacccgagcctagcgtcggaatacagcgatccgcagctgatgcgg

SEQ ID NO: 106643 - DNA, 579 bp, Glycine max
  Peptide Sequence Number=SeqID_223421
atgtcttgtcacattaccaaccttgcttgcctttttgaaggtggtgcacacaccgtgtctgtttttgataatcatgtgggaggtggttctgtatccccccttattgtgactggtggtaaaggtggtgatgttggacttcatgacttccgctatatagctactggaaaggctaaaaggcataagcgtgctgataacattgggcaaagctctgtctcatctttaactcgtgataaggatcaaaatgtagatgggatgctttggtacattccaaaggctcactcagggagtgtcacaaaagtagttaccatcccaaataccagcttgtttttaactggaagcacagatggagatgtcaaactctgggatgcccagagcacaaagttaatacatcactggtcaaagatacatgaaaaacacacctttctgcagccaagttctcgtggatttggtggtgttgttcgggctgctgttacggatatacaagttgttccccatggttttctttcttgcggtggggatggaattgtaaagctggtacggctggacaatcacctgcgtgcccatggaattgagttatga

SEQ ID NO: 106644 - DNA, 1335 bp, Glycine max
  Peptide Sequence Number=SeqID_223422
atggccacagcagaagtgagagcttcgtggcagagagctgttaaccgttgctttgtcccagaagatgcaaaaagagcccctaagttggcttgttgtcaatcttcatgtgcaacatcaaaattgtttgatgctggagcagccagtgcttctgatgaatttgatcatgctgctgttgatgtcacccattttaaccagaactcttcattttccaatgtgattcctgattcaagatggtggttgttgcaattgcaacctaactatgaagttcaaaaaggtttaacatatgaacagttaaatgcattagaggatgaagtagaaaatttgaatgctagtaatgaaaataaaacatgcaaaggagatgctgatcactttggtgatgagaaccatgagtatatttcttccatggaaggaatgcaagaggctaatagtaaaaagtctcaaggatgtcctcagctaatggatatgattgctaaacatgagaaagtggagactgattctgttggttgtacaatgtccaagcaaacaaatgatttctcctttgattctgattattcatggattggggttgagaaggcacagccatggtggagaactacagatagagatgagttagcttgctttgtttcgcgcaaatcactcaaccatattgagaattgtgaccttccccctccacagaagtatctcagagtacaaccaagtgctgatatcagtaatgtcaaaataaaaacatcatcttttgaccgggaggccaaatccagtgccttttccaatttcaatgttcaagcaaaaagaagtttagaatcagaattgatgcataggaagcttgtgccttccaccaataaagggcatttaaattttgattgtgacaaatattcaagttatcccaccatccatgggggtgtcacagaacaagtttttgagggaaaccccagcaaagctcaacttatggaagcattgtgtcatttccaaacacgtgcgaggaaagcagaggaggcagcaaaacaggcttgtgctgaaaaagagaacactattgcactctttttcatacaagcttcacagctttttgcctataagcaatggtttcaactgttgcagctggaagctcttaactctcaagtaaagaacaaggatcaatcaatctctactctcttcccatggataggtacggaacccggtgagagaatgctaaaatttggcaatgccaaacaaaaaatgcttggcaagccagaaagtggcattgcaacatatgctgttgcattggctttaggattgagtcttgttggggctggcttgctcttaggatggactgttggttgcatgttacctcgtttatag

SEQ ID NO: 106645 - DNA, 726 bp, Glycine max
  Peptide Sequence Number=SeqID_223423
atgggtggttgtgaagtagagtttgaggcagatcagtgcaagataccaaagctacccttgttgaaccctcctacaatgcattctccagagagatcagggatgaaaactccaccacttttcacctcagcttcagttccatttggttgggaagaggagccagggaagccaaggccttgcactgatattgtgagcttctccaaccctactccaaagtgcttggaacttcctccaaggttgctacttgattcccaaagcaacaacaacaaaagcatgaaactttcatcacccaccactgttttggagggaccatacccctatgtggctaccaccaacaacacttgcaactccccatcttttagaatgagtgaagacttgtatggctcttttggttctgaaagagggcaacttgggaccatggttctaaaccaaagtgtggggatcaaggagaaggagcaggagaaggagaaagggtggtttggttcttggagggaaaagaccttgaaaagagaggctagtggtgggggtagtcatgtctttccatcttctgttgattatgttggcactcataagaaggtgaggagtatgagaaagaggaaccgtcctgggagctttactaacccattccatgccaagtctagtagtgtctggacaaggatgtgtgaggggttgaagcaggtggttccatggaggggtaaaaaactgaagaaatatgggtgttggccttag

SEQ ID NO: 106646 - DNA, 3540 bp, Glycine max
  Peptide Sequence Number=SeqID_223424
atgacagaatcagagaagatgaaccccatcgatcaccttcccctccgtctgctcagatccgacacggttccacccgcccctaccttctctgaatccaccgtggatttcctccctcacttctccggctactcctggatcgcctacgccgcttcttcacttctcaccatctcccacttcccttcccctctctcccctcaccaaacccgcatcggcccctttttccgccaatccttccagctctccgcccatcccgtcgccgccgtcgcctggtcccccagctccccctcctccggcgacctcgccgccgccgccgatgactgcatctggcttttccgccacgactccgccgccggtaaaggttctttttgttggagccagaatgcagtgcttgtacaacatatgaaagtggcaaacatcaaatggacaggatcaggagatggaataatttctgttggaatggaggtggttttctggaaaaagagtaacacatgttgggaagttgcttggaagtttaaagcagatcagccccaaactcttgtttgtgcaacttggtctattgagggcccttcagcaactgcagcacatccaagtagagaacacattgaagggaccttgaccaatgaggaaagcaaatgtgtattggtatgtcaaagcaatggactatctgaatattcaaaagtcaaactacatcatcctctacctgtcgtaatgattcaatggagaccatcaagaggaaagctatcaaacagatatggtaagtgttctgtaaggcatgtacttttgacttgcagcttagatgggactgcaaggttatggagtgaaattgataatgcaaaggccaggagaactgcgaaggacatcaatgatcagaagaatgccggatgctctttttgtgttgttgctgttattgagattaatcagtccttaaatgcaactcttagttcagatatatttgtgagatggggaacagaatttgagggactatttcaaactgacaaagaggccaaacaagttttttccaaagaaggatttgagcatgatgttagaaattgtgattggcttgttgggtttggtcctggaatgctgcttagcttttgggctgtccactgtcttgatgatgtttcaccactgagattcccccgagttacgttatggaagaaacatgaactccagaaccatgacatagcaaatgtttacaagtttaactcatctgattttaaaaatgcactatttcttcataaggttattatattgagaagttgcctgtttggtccaccaactatatgctcttcacttcagctattgccttgtaattccttagtttggtcaaatttccgtattcaaacaatacataatgctgtggaggactccaatgataatgttaacacagataacatctcctcccatttgactggtggggttttaaacttagatggtcatagtgggaaaatattaaaggtttcacttcatccttgtacatgcaaagttcaatttgctgcttctctggattctaatggactgcttcttttttggtcactttctaacatttcaaactgcattttgggatgcccaactttggttcctactatggaactctgtggaaagcttgcaactcaagactcgtgttccttgtacactagcttgaaatgggcaccttcaatacttggtgacaaactggttttttttatggggcatactcgagggattgattgcttcattgtcaacatttgtcaaagtgaagaagaaaacatagaatgtcactacttatgcactattcctttcagtggtcatggtccttatgaggatggcccttttgatatctttacaattcctttaaactccacctgtgacaaaactttccgtaataataaacttatgctattggcaatatggatggggagatttcaggccctatcatgggaagtaaacttgcactcatttgacatgtcaacaaactgttgtgaatgcaattttgatgttaaaagcattgataactgcagtgttcgggcatttgaaagtacatttgctaataaaaaatattgcattactgtaaatccatgttcatgtgagtttccaagttccaaagatctggttactagttttgcggtggctgattcaggcactctaagccataggcaacaagagtttagccttgcaaatgatctgtgtagtagttatcccgcatatatcatggccacaggctcatctgatggcatcttgaaactatggaaaagtaaacctggcaactcattgacccaacacttgccatgggagcttgtgggttcgtttgttgcacatgatggtcccatcaaggatatatgtttagctaattgtggtgagaagattgctacgttctgctacgaaagcaattcaaatgctatcaataccatccatatatgggatgctgtaccactaatcagcgctgggacttttattttggaggataaaataaagactgaaagtgatgttattgctctaaagtggttaactttaggaactggggagttattgcttggagtttgtttgcaaaatgaattacatgtgtatgctcctaagcgttgtgttggtacaacattgtcagactctgtaaattttccaaaaatgaatatatgggtttgcattgcatatgctcacacttccattccaatttatgatttcttatggggacccagagctgcagcagtggtgattcatggaaattactttagtatatttagtcattggctgttccatgaggataaaaagcaagggagtaaatttcgtccttgtgattcaaagcctaatacctataattgcaaggatgaaatatatgaagacatactttcttcagttttcactgaatatgacattggtgcttacagagaacagtcacttggagacagtcatgcagattttgattctgtgcagtccatcaaaattaatatgaaggacaattccagtagcttgtttctggccaaggaacaattaaaatctgaacttcttaccaaggttggtttatggagcatcttagaagtagctgagataattagtggatcattgcctacttatcaccctgatgtactacttactaatataagctcaggaaactggaaacgtgcttatgtagctgtgaggcatcttgttgaatgcctgactaattatgatcctaaaaagagacacatctccaaaagaattggccttccaaatgttttattgtcatattatctagaaggctgtataccaaaaggttcccaacctaagggattccagtggggcggggacgctgcattgatcacatcaatttcacaggctcagagtagcttgttccggtttccatatcattcagattccagtgttgaaaatgaaagcatttcctcatcaacaaaatccgagcttaatgactttattgaatctcttgagaaatttcctgatttaccatttttggtcgacatagagaagacgcagattcttgcaattatagatctgcttagtgaagttagtagtgctcactcatcttctgcatatcagagtcttgatgaacctggacgaaggtattcatga

SEQ ID NO: 106647 - DNA, 3327 bp, Glycine max
  Peptide Sequence Number=SeqID_223425
atggagaaattggcaagagctcagtatttgaagaacaaaaatcccaaggattgtgctttgctgtatattgcactgaatagagttcaagttttggctggccttttcaaaatcagtaaggatgagaaggataagcctcttgtgggctttctttctcgcaattttcaggatgagaaaaataaagctgctgctttaaaaaatgcttatgtcttacttggaaagcatcagctggaattagcaattgctttctttttgcttggaggtgatcattcttctgctataaatatttgtgctaagaatcttggggatgaacagcttgccttagtcatttgtcgtcttgttgagggccatggtggaccattggagcatcacctaattacaaagtacatacttccatttgcaattgataaaggagactactggcttgcaagccttctggagtgggaaatgggtaattactaccaatctttttatagaatgctagagttttcagtaaaccctgtgcctcgggagtccactgtcatgtccaattgtggtccctttctggaccctaccgtcggtttttattgtcaaatgttagcaacaaagaatagcatgcggaatgctgtgggggagcaaaattctgcaattcttttaagatgggcaactttgatgacagttgctgcactaaaaagatgtggtaatcctcttgaggcgttggagtatttctcgtcttcgcttagcatgcctgggactgcagatcaagagagtgaattaggtgacagtcatgatgtgctgtccagtactcttaagcctttgccaagaaaatgctctaactggttgtctgctaacatgtctgtgcatctggagttccatattaaattgaatttggcactttgctacttatcaaaattgataaaagagcatccaagctggcttgacacttttgcagaatataatggagaagcttctgattctgacgagtacatgatgcaatatgagaaatcagttgaaagttttaaacaaaagttatacacagggcttgctctatttgaacggaggtttttattggctcctcgctgtctaatcagtatgattttactcttactttgccatcatggatcattgtacattgggtatgatatgacagatggatacactcaagcagaactgtctcaaaagaagagcaatatatttgatgatttcaatttatattactctcggattaaacccctgttcaagactgcagaagaagtctcctttttctattcaagatttttttgtgcctgcagtatggaaaattctcaacaaaattcatctattgatagcaaacctaagtttttggatgcttttcaatgctgctttgaaggtgttttgatttcattgtggtttttaagagcaaattttaggattcagttgagttctatttgcaaagatcttgtcaaaacacatcttgatatcctggatttgtatgaatattatttacatttttcattagcttggcttcaaaaaaactcggaagcgcttttgtatatgttggaaccattcttggttgcacaatctaatgaccgtaatccttacaacattgatattgtgaatctgaagaagcttatcccaaaaattgggcagttgttggctcaaacttctttcatgtctaatatacaaaaccttcaactatccgaacgtgcagaagataaactagttgcagatataaagcattcaattcctgatgatgaaagatggaagattatagggacctgcttgtggcagcatatgtctagattcatgatatttaatttgaatctggttcttgccaaacttgaagatggtaaactgtcgggtcctttccacagaaaatatacttatggggagtcttatctcataaatatggattctgaaagcatcagcttgccagagaagattcggttagtcttgtttagcctatgtgatctactgatgacaacagttactcacatttcttcttatcatgttaaacaacaagcagaatttctgtggcagaaagtagggaatgatttgaatgtaatgactcttcaatggttaaaacaaaaatcagaattcagccagaaccaaaacctggacattttggaactggggaacatgaaagataactattcagttaatcagttattatgggatcgctgtgcggatcccaaattgatatctgattgctttgcacaggaaaaactcaattggccaaatgatttggatcagatgaatactaaaggatggaatgatttgtctataattatgacaggactgcataaaactgatgatacatgtggtgatggatgtaaacttagcactagatcttctaatcatgaagttggaactcctgttaaaggaacatctctaagtggcaatgcttctgcaagatcaaaccagaaagatataacttatacaaattttgcagttttccagagtcccagagaaatgtacaagagaaatggagaacttttggaggcattgtgtataaactctaccaatcaacgggaagctgcagttgctggcaacaggaagggttctgtgttgagttttttgttatgggtgggcattgaatgtggagccaagaagggtataatgttctttcattgggaagatgagattccttttagtggtaaatcagatgatcttttgtgggccacagctgattggcctcagaatggatgggcaggttcagaatccacccctgctccaacatgtgtttctcctggtgttggccttgggagcaagaaaggggcacaccttgggctgggtggagcaactattggtgtggactcttcagcttggcccagcaatgacttgacaggtggtggagtattaggaatgctaggttatactggtattggtgcctctggattaggttgggaaattcaacaagattttgaagattttgtggatccacttgccactttggagaacataagtaccagggctttgtctagtcatcctatgagaccttttttcttggttggttctagcaatacacacatttacttgtgggagttcaacaaagacaaagctactgctacatatggagtgctgcctgctgccaatgtccctccaccttatgcccttgcatcaatttcagccttgcagtttgaccactttggacaccggtttgccagtgctgcattagatggaactgtctgcacgtggcagctggaggttggaggaaggagcaatgttcgtccaacagaatcatctctttgctttaacggtcatgcatcgtatgtactttctctttctcaacttttagttgcaattgttgagatattagcacttcagcagatattattcagattttattgtatccccttgattctttcctag

SEQ ID NO: 106648 - DNA, 150 bp, Glycine max
  Peptide Sequence Number=SeqID_223426
atgaacattattaagatcaacatagaaggatccttatggcataactttgtccaatgcatccttgaagaactcacagataaaggtagcagaaaggttcatcatgaagatcaacatacaagaatagaatacttaatctgcaaaatgttatag

SEQ ID NO: 106649 - DNA, 399 bp, Glycine max
  Peptide Sequence Number=SeqID_223427
atgaccaaactccgaccatcaccaaacaacattgttacaccaccatcgtcgtgtcacactaaaggtatcaaggaatcaaggttagagcaattggatgaaattcaagtgaaagctatcaatgcttctaatggagagaatttgcctaaatgtccaactttaatctttgaattcacacttgttgcttttggtaaaatacattgggtagctttacttttacttcgtaccccattgcccggaggctcttcgctatgcgaaggtatgggggagggatgttgtacgcagccttacccttgcatatgcaaagaggctgtttctggattcgaacccatgaccaacaagtcaccaaggcacaactttaccgctgcaccaaggcacaattttgaattgggtagcttatga

SEQ ID NO: 106650 - DNA, 246 bp, Glycine max
  Peptide Sequence Number=SeqID_223428
atgggatggctaacttttaagctgtcaagaacaaggaaacttcaagtttcaaaaggaaaagcttggaaggggaagtgtaaacatgtgttcacacacttcagagaatttctcaagaaacttgatgtaaatgaatgccaggaaacattcactagtgaaccaggactcacagatgttgcaaaccttaaagctgattctgtcggcctgccattgtcaagaagtgaaacaaggtcattatttcaatcataa

SEQ ID NO: 106651 - DNA, 1704 bp, Glycine max
  Peptide Sequence Number=SeqID_223429
atggccaacttaatcaccttgttttcgctgtggttgagtatgatgtctactatctacagtgtgaagcttatagcaaatggaagtactaagggagaatccacaaggttctatgatttcaagtgctctccaatgcctctttctccatttgttgatgctcttaacggttactgcacaggacctgttgtttacgcccaagaagatgatagaatcatagtaaaagtgaccaatatgacacctttcaatgttacaattcactggcacggtgtccggcaaaggctatcatgctggtatgatggggcatccttgattacacaatgtccaattcaatcaggccaaagtttcacctataattttacagtggtgcagcagaagggcaccttcttctggcatgctcatatttcttggttaagaggaacagtttatggtgccatgattgtttatccaaagacaggagtaccatacccatttaactttccctatcaagagcacataattatactaggggagtattggctgcaggatctccaacaaattgagaatgccactatagcaagtggaggacctcctcctatagcagatgcatataccattaacggtcatccaggacctaactacaactgctccactaatgatgtctaccaaatcaatgtgattccggggaagatctatttgttaagactgattaatgctggtttgaacactgagaacttcttttccattgcttatcacaatttaacaatcgtggaagctgatgcagaatacacaaagccattcaccacagacacagtaatgattggacctggtcaaacactgaatgtccttctctctgcagatcaaccaataggaaaatactccatggctataacaccttacaagtctggaaggtttgtcaaatatcaaaacatttcggctatagcctacttcaactacataggcacttcatctgatagcttacctttaccagctaaattgcctaaactagatgataaattggctgtcaagacagtcatggacggattaaggagcctaaatcaagtcaatgttttcaaagaaattgacaaaaatctattcgtcaccattggattgaatgttcaaaagtgtcattcaaagaaaccaaagcaaaactgccaattcatgcacaatggggtattagcagcttcaatgaacaatgtaagttttgttaatcccaatatttcaatcctgggagcatattataagaagattaaaggatcatatactgaagatttcccagacacccccccaaagttctatgactttgttaatggtgcccctaataacatttcatacgacacgcagtcattgaatggtactagaacaaaagtccttaaatatggtagcagggtgcaactcattatgcaggacacagggatagtcaacactgaaaaccaccctatgcactttcacggctacagcttttatgtggtagggtatggcacaggcaactataacccacgaacagcaaaattcaatttagtggatcctccatacatgaacacaattggagttccagctggtggatgggcagcaattcgctttgttgctgataatccaggggtgtggtatatgcactgtcacattgatatacacatgcaatggggactaggaatggtatttatagtaaacaatggaaaaggagagctggaatccttaccacatcctccaccagacctgccacaatgttaa

SEQ ID NO: 106652 - DNA, 1713 bp, Glycine max
  Peptide Sequence Number=SeqID_223430
atggccaacttaatctccttgtttttgctgtcgttgagtatgatatcacttatctacaacgtgaaccttctagcacatgggagtaccaaggtagaatcaaccaagttctatgatttcaagtggaatgaagtttctccaatgcctttttctctatttatttatgctcttaatggttacttcataggaccagttgtttacgcccaagaggatgatagaatcatagtaaaagtgaccaatatgacacctttcaatgttacaattcactggcatggtgtccggcaaaggctatcatgctggtatgatgggccatccttgattacacaatgtccaattcaagcaggccagagtttcacctataattttacagttgtgcagcagaagggcaccttcttctggcatgctcatgtttcttggttaagaggaacggtttatggtgccatgattgtttatccaaagacaggggtaccttacccatttaaatttccctttcaagagcacataattatattaggggagtattggctgcaggatctccaacaacttgagaatgccacaatagcaagtggaggacctcctcctataacagatgcatataccattaacggtcatccaggacccaactacaactgctccactaatgatgtctaccaaattgatgtgattccggggaagacttatttgttaagactgattaatgcgggtttgaacactgagaacttctttgccattgctaatcacaatttaacaatcgtggaagctgatgctgaatacacaaagccattcaccacaaacacagtgatgattggaccaggtcaaacactgaatgtccttgtctctgctaatcaaccagtaggaaaatactccatgggtgtagcaccttacgagtcaggaaggatgatcatatatcaaaatgtctcggctatagcctacttcaactatataggcactccagctgatagcttatctttaccagctaagttgcctaaactagatgatgaactagctgttaagacagtcatggacggattaaggagcctaaatcgagtcaatgttttcaaagaaattgacaaaaatctattcgttaccattggattgaatgttcaaaagtgtcattcaaagaaaccaaagcaaaactgccaattcatgcacaatggggtgatggcagcctcaatgaacaatataagttttgttgatcccaatatttcaatcctggaagcatattataagaaaataaaagaaatatatactgaagatttcccagacacccccccgaagttctatgactttgttaatggtgccccaaataacattccatatgacacacagtcattgaatggtactagaacaaaggtccttaaatatggtagtagggtgcaagtcattctgcaggacacaaggatagtcaccaccgaaaaccacccaatgcacttccatggctatagcttttatgtggtagggtatggcacaggcaactataacccactagctgcacaattcaatttagtggatcctccatacatgaacacaattggagttccatcgggtggatgggcagcaattcgctttgttgcggataatccaggggtgtggtatatgcactgccaccttgatatacataagtcatggggactaggaatggtatttatagtgaataatggaaaaggagagctggaatccttaccacatcctccaccagacctgccacaatgttaa

SEQ ID NO: 106653 - DNA, 255 bp, Glycine max
  Peptide Sequence Number=SeqID_223431
atgggatggaactattccaactcgcgtatggcgagattcgttgtatcaaaatcagatggtaaacaatgggaaggatcactactgagtttaaaaaggttggctaagattttgttaaaacataagcacttagacaatgaaggaaagctggagttgctgcacatgatgtccaacgatccacgatgtcggatacaatgtcctgacatcctgctcgagaatactggaagtgctgtacaatgcaagataaaagtcaagtga

SEQ ID NO: 106654 - DNA, 485 bp, Glycine max
  Peptide Sequence Number=SeqID_223432
accagatataaagagagggaacataacaccagaagaagatgatcttataatcagaatgcattcacttttgggaaacagatggtccctcatagcaggaaggttaccagggagaacagacaatgaaataaagaactattggaacacccatctaagcaaaaagctgaaaattcaaggaacagaagacacagacacacacaacatgttagagaatcctcaagaagagccagccagtgatggtggcaacaacaacaaaaagaagaagaagaacggtggcaaaaagaagaacaaaggcaaagacaatgctgagccaccaaagacccaagtttacctaccaaaaccaattagagtgaaggctatgtatttacagagaacggatagtaacaccttcacctttgattccaattccaattctgctagtggatcaacaagccaagagaaggatgaaagccccgtgacaaaagaatcaaacgtggttagtgaagttg

SEQ ID NO: 106655 - DNA, 489 bp, Glycine max
  Peptide Sequence Number=SeqID_223433
atggctgaaactccctctccctctctctctcagtctccctcacccccctttggccccatcataagtgatggccaagttggtggattcgattggatggtccttttggcagcaattttatgtgcctttgtgtgtgctcttggcctcaacacaatgttacaatgtgcttgtcgtgtcttcacagagcctcgccaatggattgcttcacgcaggctcaactctggcctcaagagaaaggaaatggtggctttgccaacctcaacttacactacacactcttctgctgcctcttctccatcttcttcacctaattctagtacttgtgtcatttgcttggctgagttctctgatggggaccctataaggttccttccaaagtgcaatcactatttccatgtggtttgcattgacaagtggctactctctcactcttcttgccctacttgcaggcacctcctcaagtcaaatgattctcttcactccttacagtag

SEQ ID NO: 106656 - DNA, 207 bp, Glycine max
  Peptide Sequence Number=SeqID_223434
atgtcgcggaacttcacggattgcttaacgatgggtttcaagttcttcgaagcggtcaagcaaaggttgcatgccatcaaacaatggtccccggacgaaattagggcaatcaattcatggggctccggactcgatggtggaggatgcacgaacagcgttaggcaatcaattcgtggggctccagactcgatggtggaggctgcatga

SEQ ID NO: 106657 - DNA, 304 bp, Glycine max
  Peptide Sequence Number=SeqID_223435
atggctccgaaaaagctttccatgaagaggtctagaaagaaggctgcgggggaaggctccagtacagccttggaatttgatagtcaccggtttcggagcgtcgagcaccagcagcgcttcgaggccatcaaaggatggtcgttccatagagagaggcgcgtccagctcagggaggatgagtatacggactttcaggaagagatagctcgtagatgttggacgccgctggtgactcccatggctaagtttgaccctgagatagtcctggagttctatgccaatgcttggcctacagaggaaggga

SEQ ID NO: 106658 - DNA, 897 bp, Glycine max
  Peptide Sequence Number=SeqID_223436
atgacctccttgactcacctcgacctctcttattctcgattcatggggaagattccatctcagattgggaatctctccaatttgctctatcttggccttggaggtaattatcatgctgaaaatgtagaatgggtatcaagtatgtggaagcttgaatatcttgatttgagtagtgcaaacctatccaaagcatttcattggctacacactctccaatctcttccttctttgacccacctatatttgtcaggatgcaaactccctcactataatgaaccatccttgctcaacttctcatctttgcaaactcttgatctttccgatactagttattcccctgccatttcttttgtccccaagtggatattcaaattgaagaaacttgtttctcttcaattatcagataattatgaaatccaaggtccgattccttgtggtattcgaaacctcacacatcttcaaaatcttgacttgtctttcaattcattttcatcttctatacctaattgcttatacggtcttcatcgtctcaagttcctcaacctaaggtacaacaacttgcatgggactatttttgatgccctgggaaatttgacttctcttgttgaacttgatttatcagttaatcaacttgaaggaaccattccaacttcttttggaaatttgacttctcttgttgaacttgatttatcacttaatcaacttgaaggaaccattccaatttctttgggaaatttgacttctcttgttgaacttgatttatcagctaatcaacttgaaggaaacattccaacttctttgggtaatctctgcaacttaaggaaattcttgctccttgtatttcccatggactcacaagacttgcagttcagagttcacgactttcaggcaatctga

SEQ ID NO: 106659 - DNA, 306 bp, Glycine max
  Peptide Sequence Number=SeqID_223437
atggacgttgctattgtgaaggaattttatgctaacctcaatgaccccgaggataaatcacctaagcaggtgagggtgagaggtcatctagtgaaatttgatgaggatactttgaacatatttttgaagaccccaatgattttagaagagggggaaattttatgtacttattccaagtttgcactcctgaggcctggtcctcaggagttggctgctaagctttgcatcccagggaggggattcgagctaaatgctgatgggcaaccgttgaagatattgaggaagaacatgaccaccttggcttag

SEQ ID NO: 106660 - DNA, 360 bp, Glycine max
  Peptide Sequence Number=SeqID_223438
atggggacgaggggttgcatcagctacaatcccgttcttgctataagacaacttggctacccgatgagaggggcaccactagaggaagagctcgcacctgtcatttcacgagggttcagtgagaccaacgtggagacgcttcagaaggtccgcaaagcatgggaagtggtacaaaagaaggacaaagagcttagaggcagtaacaatgggcccattggtggctaccgcgagtggttgaaagcccacgtgcaaggtttggattggctttcgagtttgagaaccgctaaaagagaggaagttgaggcaccggaggaagacgaagaactgcaggcccttagggcggaactcgagcaagcctaa

SEQ ID NO: 106661 - DNA, 522 bp, Glycine max
  Peptide Sequence Number=SeqID_223439
ctcttcctgcaccagcgtcatggcaggctggatgacctcatccataaagcgcttaaccagcgagcgttttggcagataggcgatattgcgcagcctgcgctgccagggaatggggttgcgggcggcggtgggggcgatggtggccatattttggctgtcgcgcttggtcagatcgcgacgcagcgccttaagcaagccgtagatggagaccagcaagatggccgagaacggcaatgcgctggcgatggtgacggtttgcagcgcgctgagccccccggcgatcagcaaggcgatggcgacgatgcccatcagcgacgcccagaaaatgcgttgccaaaccggcgtgttgctggagccgcccgaagccagcgtatccacgaccatggcgccggaatcggcggaggtgacgaaaaagacgataaccatcgccatggcgataaacgaaagcacgctggagaacgggaaatgctccaggaagttaaacaacgccagcgccacgtcttgctgtaccgtagcggcgag

SEQ ID NO: 106662 - DNA, 180 bp, Glycine max
  Peptide Sequence Number=SeqID_223440
atgcagccatgtaagatggaaagtgacccgacgtcgcatcacaaacactcggcaatcttcaatggggatgatgccaccagggtgtatcaaaatagtgacggagtaaagcccggcgtatgcagcaaccgatggggaataaacatttcttgggagaacgtgccaatccaaaaaacatggtag

SEQ ID NO: 106663 - DNA, 399 bp, Glycine max
  Peptide Sequence Number=SeqID_223441
atggcatttacgcatgattttgtagggaaacaacctatgggacaatttgggctagaaagattgccccacatacaccctaggcctgggaaccgaagcttgtttttggatgcaagagaacacgagaatgggtgcatattaggtgaagctaccctttttggccagcaatcagctatgggctatgccataagagtttccttacacttagatgttcagaaattttgttcatcatggacatgtaggtgtagaataggtagcaaaatacctttagcaatttacacctttggatatggtagcaagatacttggatttgtgtacatgaaatggcatcaaggtagcttgcctcaaagagatccaggaaagacaaagcggccgaaggaccaattctactcccgtatatga

SEQ ID NO: 106664 - DNA, 882 bp, Glycine max
  Peptide Sequence Number=SeqID_223442
atgggaagggctccttgttgttccaaagtggggttgcacaaaggtccatggactcctaaagaagatgcattgcttaccaagtatatccaagctcatggagaaggccaatggaaatcactacccaaaaaagcagggcttcttagatgtggaaaaagttgtagattgagatggatgaactatctgagaccagacataaagagagggaacatagcaccagaagaagatgatcttataatcagaatgcattcacttttgggaaacagatggtccctcatagcaggaaggttaccagggagaacagacaatgaaataaagaactactggaacacccatctaagcaaaaagctgaaaattcaaggaacagaagacacagacacacacaaaatgttagagaatcctcaagaagaggctgcaagtgatggtggcaacaacaacaaaaagaagaagaagaagaagaacggtggcaaaaagaacaagcagaagaacaaaggcaaagaaaatgatgagccgccaaagacacaagtttacctaccaaaaccaattagagtgaaggcaatgtatttacaaagaacggatagtaacaccttcacctttgattccaattcagctagtggatcaacaagccaagagaaggaggaaagccccgtgacaaaagaatcaaacgtggttagtgaagttggtaatgtgggagaagaaagtgatggttttggcttcttcagtgaggaccatgacttagtcaacgtctcagatattgaatgccactcttattttcccacagatcatggcaacctacagcaattgtatgaagaatatttccagctcttgaacatggaccatggccaattcgaactgaattcatttgcagaatctttattagattaa

SEQ ID NO: 106665 - DNA, 879 bp, Glycine max
  Peptide Sequence Number=SeqID_223443
atggattctaacaaaaaatggatggagacagaaaaacactctgctagggtttctaatggtgacccaaatcagagtaagaagaaggcaaagtttagaaatgataaagctatcattgattatgagatggttgctaaattgaaaggatgggatgcttatttgaataatcccttgatcgttaatgttctaggtaaacaatgcaaaggtggaggccatttttttcccaatgcaagtgaaaagaagaaggttgtagtttggatccaaatttcaagactttcattggagctatataatggaatgttccaatggaagcaaaaagagatcttcaaaaccaaatttgatgcctatgacttcaaccatctcagtcacgctcgcgtcgccgtttccttcgatatcctcttaaggtaccttaagcacttgggttatgagattacatatgtgcggaatttcactgatgttgatgataagataattaagcgagcaaatgagactggggaggatccattgttgttgagcaaccatttttgtgatgaatacaatgttgatatggttgatcttcaatgcgagacaccatctaaggaacctcatgtttctgaacaccttaatgagataaagaacatgataacccagattataaacaatggctatgcgtacaaagttaatgatgatgtattctatattgttgataaatgcccaaattatggtatgctatctagacaacggctagaacataatagagttgtagaacgagtagttgtggactcaagaaagcgtaacccaactaattttgcattgtggaaggttctaaaccaggcgagcctagttgggacaacccttgggatcctggaagtcctgggtggcacattgaatgcagtgcaataa

SEQ ID NO: 106666 - DNA, 627 bp, Glycine max
  Peptide Sequence Number=SeqID_223444
atggatgttatagttcaagaagatcatgatcagtatatgtataataattctaagaatcatgatgaacaaaagctaccacttttgcacatcatggaagtaccagatgatgatgcacagagaagcctcattcagagagccatgagtcaaacatttcaaagcacagctcatttggcaaatctcttaccaactggcactgttctttctttccaacttctgtctccaattgtcacaaaccaaggcatctgtgactcagtttgcaagttcatgacttctacacttgtggctctttgtggtgtctcttgtttcttgcaatgcttcactgatagcttcagagatgacaaggggaacgtttgttatgggcttgccaccttcaggggcatgtgggtcattgatggatcaaccacaattccaccggaacttggtgcgaaatatagattgaggcttattgatttcttgcatgctgtgatgtcaattttggtgtttgcagcagttgcattgtttgatcagaatgtgcatgctgtttgtggcgtttcctacgcagaggcatggaattggcttcccactttcaacaaagtaaaatgttgggtcctttctgtatttatgtatggaccattttcaagagtgtga

SEQ ID NO: 106667 - DNA, 144 bp, Glycine max
  Peptide Sequence Number=SeqID_223445
atggcaactaaaactgaagtgttggtggtgatggtcttcgaagtagtttcctcagtgatgggtaagcgtctaaaaatggcagttgtgagatggacttgttgcgattttgatggcaataatgatcctgacaattgcaagagctag

SEQ ID NO: 106668 - DNA, 240 bp, Glycine max
  Peptide Sequence Number=SeqID_223446
gatgttgatggtcagtgggttcgcaaacaagacttgccaccgcctattcctgacgaacataccccatctcctccaccacaaagagatgcttcttcttctctactaactgaagtcctcacagagctctgcaatcttcgagcatttgtgggtgaacattttgatgtgatggatactcgctttgatgggatggatactcatatcactaggcttaaagattatattgaattagtttatggataa

SEQ ID NO: 106669 - DNA, 264 bp, Glycine max
  Peptide Sequence Number=SeqID_223447
atggtgagcaaagtttggagctttgatggaggcttcaatggagaggaagaagaagagaaaagcaacgtgagaagagaacatgagtcttttaaagaatacgctcagcgttggagagacctagcagcacaagtggcccctcccatggtcgagagaaaaatggttactatgataatggataccttgcttgtattctactatgagaaattagtgggctacatgccttctagcttcgcggacttggtattcgtcggagaaaggatcgag

SEQ ID NO: 106670 - DNA, 168 bp, Glycine max
  Peptide Sequence Number=SeqID_223448
atggaagttgttcttaaaattgccataacattaagaacaagtagaagagcacatgattcccttggtctgaagcctaacacgaggggagagaagcaacatttctttggttattgtcattggaaatttgttgtaccacatcataatgccaacattgttggtggtggttga

SEQ ID NO: 106671 - DNA, 204 bp, Glycine max
  Peptide Sequence Number=SeqID_223449
atgaagatgaaagtggtctcttccaaaattgaggcacacaattctaatgacattgaaatccttcatgcccataccagcattgcggaacattttttcctcctcatgacaaagtatccccttgctgaacaagcacttcatgagttggatccactctggccaaggatgagaaaccgaagccacccactgttgagatggtggaaataa

SEQ ID NO: 106672 - DNA, 256 bp, Glycine max
  Peptide Sequence Number=SeqID_223450
caccggaggcacgacccggccagttaaggacaggagcgcatcgccggcagaagggacgagccgaccggtgcacaccggaggcggaccgatcgacccaacccaagacttgcctccaatggatctcgttaagggatttagattgtactcattccaattaccagactcaatgagcccggctccctctccggaatcgaaccctaattctccgtcacccgtcaccaccatggtaggccactatcctaccatcgaaagttga

SEQ ID NO: 106673 - DNA, 589 bp, Glycine max
  Peptide Sequence Number=SeqID_223451
atggaatcaagcaatgtgaagaacaagtcaggtggaaaaagaaagatgtctagtgaggacacaagaagttacttcgcatggaacttggaaatggaacgtgtgctagctgatgtgcttagagatcaaagaaatttgggcaataaaggtgatggaaattggaaagcagtagcatacagtactgcagctcaaattttgtccaagcgttttggagttcacctcatggcagataatgttaagaatcgttttaagctttggagaacatggtatggaattgtgagtgacattcttagtcaaagtggatttgactgggatagcacaaagtacatgattaccgttgaaaatgaaattgcatggaatgaatatgttaagtcacatgaagaggccaaacgatttcgattcaaagtcattcctaattgggatgatattgttgacctatgtgcaaaggatagagctactggactcggagcagaaaatgcattagatgcagatgatatcatgagcaaagaaacaaatgaagaggaagcaattcatagtgtgagttttgacttagagggatcaagttctgccacgagaaaaaacattcgcccaa

SEQ ID NO: 106674 - DNA, 716 bp, Glycine max
  Peptide Sequence Number=SeqID_223452
cccaatgacatgcggagataccttatggttatccgcaccttttgtcagctagaggcaagcgagcctgttgacacgcagagactaacgtcgtcatctgcacctttgtcatccagagacagcaagtccgatgacatgcggagataccttatggttatccgcaccttttgtcagctagaggcaagcgagatacttatgcatatccacaccttttgccagctagaggcaagcgagcccgttgacacacagagactaacatcatcatctgcacctttcaagagatgtcagcatcttccgaccgagactgcgaaaaagtctcgtttgctatccgttagactcaaggacggcaagtccgatgacatgcggagataccctatggttatccacaccttttgtcagctagaggcaagggatcctgttgacacgcagagactaacgtcgtcatctgcaccttcgtcatccagagacggcaagtccgatgacatgcggagataccttatggttatccgcaccttttgtcagctagaggcaagcgagcccattgacacgcaaagactaacgccaccatctgcacctttgtcatccagaggcgaaaagtccaatgacatgtggagataccttatggttatctgcaccttttgtcagctagaggcaagtgagcccattgacacgcagagactaacgtcgtcatctgcacctttgtcatccacagacgacaa

SEQ ID NO: 106675 - DNA, 1414 bp, Glycine max
  Peptide Sequence Number=SeqID_223453
gacattgatcaccgcgctgatcaacgcctttggtcacaaagacccgaaagccgagccagtcacggattccaacggcaagctggtgccagacacagatttaactgattacgagaacgtcccctatctggaggacatcgacgactactttgcccgcgaagtgcttcctcatgtgccggatgcctggctggatgagagctttaccgatgctagggatggccaattgggccgcgttggctacgagatcaacttcaaccgcttcttctaccagtaccagccgccgcgcaagctgcaagatattgatgaaaacctgaagcaagtagaagccgagattgccgcgctactggcggaggtgccagaggagtggttaaataggaaggtttttcatgctttccaagccattgggagtggaacaacgccaccggcaaaggagcatgaatggtatcagggaggaaccattccgtggataacaacaagtgagcttagagaaaacaccgtcgttaaaacaaagaagtgtgttacctcagatgccatgcagaaattctcagccttgaaaatttttcccgctggttcattagctattgccatgtatggtgcaacaattggtcgcctagggtttcttggaatcccagcaacaaccaaccaagcttgctgtgtgctgtctggtgaacgcgatttgaatatccagtttttgtattactggttgatggcattcagagccgatatcgtggctttcttctctgagggcgggggccagccgaatatcaaccaagaggtgatagccagccttagggtgccatccccagcccctgatgaacaagccaccattgtcgccaccctcgaccgcgaaaccgcccgcattgatgcgcttatcgagaagaaaacccgctttatcgagctactgaaggaaaagcgccaggcactgattacccatgctgtcaccaaggggctagaccccaacgtgaagatgaaggattccggcgttgaatggattgggccggtgccggagcattgggatgttgttccaagcacatggctatttgtcgaaagtaaagagcgagcgcacgaggacgaccagcatctttcagcaactcaaaaatatggggttatctctctagcagagtatgaacgattagaagggcggcaagtcacccatgcagtgaaaaacctggaacaacgtaaacacgttaaactggatgattttgtcatcagcatgaggagcttccagggcggtattgagagagttaaagctcttgggtgtgttcgctcgtcttacgttgttatacaggcgggagatggtgcagataagaattattttgcttacctgttcaagtctggatcgtacatacaaggattgcaggccacatcaagttttattcgtgatggacaggatcttaactatggcaattttcgccaa

SEQ ID NO: 106676 - DNA, 143 bp, Glycine max
  Peptide Sequence Number=SeqID_223454
atggcgttttgttgcataaaaaattggttcagaaaaatagaagctgtgggtttcgcattggagaaggagggaacatcgtggtttggaattggaaggaagaaggcaatgggagctcagtggtcactttacattttacaagaggg

SEQ ID NO: 106677 - DNA, 387 bp, Glycine max
  Peptide Sequence Number=SeqID_223455
atggcatttttgggactggttggactgtcctccataggaaaatctacccataatggtgttgattacacctctgatttactgggtaggttcctgttcttgtggaggttgtcgctcacgctgttgttgctagtagtccgtcctgctagacaatgcatgtgggagatacttaagtcatttgcagtgttgattatgcatcaggggtgtcattccccttgggtgcgctcaggaaatctttctcagctcctcctcgtggggtcgctccatctctgcaatgcggttttggagttgctaaagagtatctgtgtccgtcatagctatcggatgaggatgggagtcttcgaaaggagtctcgcgtatgaggccagactgagtactaatcatgcatga

SEQ ID NO: 106678 - DNA, 198 bp, Glycine max
  Peptide Sequence Number=SeqID_223456
atggaggtaaaagatctggtgaggctggttagggcagagagcaaaagaagggagagaaagggatggctgtgttgtgtgcgaagatgggaagtgaggcaaagactccgcaccccaacccactctctatcctcctttgcatcgccgcaagaaaccccgaaccctcccccttcttatgtcgcacctacccctgttcgctag

SEQ ID NO: 106679 - DNA, 225 bp, Glycine max
  Peptide Sequence Number=SeqID_223457
atgcacatgaggatcaaaaggtcttttaaggttgtaatggggtcaaggacaaggctcatgtggcttgaggcttataagaacaaaatgcctaaatcatctcctaacatgcatgtgaacaaagaagtatcaacaagagtcaagccaaggctattgtgcaagcaatcaatggggcaaaacacaccgaataaaacagatgatgatggctcaaattctcatcaagggtaa

SEQ ID NO: 106680 - DNA, 897 bp, Glycine max
  Peptide Sequence Number=SeqID_223458
atggggttcagccggctcggcctggcgattggcgggctgattgctggccctgccggagctgccgtggatgctgctcagcaccgtcggcatgatcacgctactggcgctgtggtggcagttccagccgcgccaggtggcaccggcgatcttcagcagctagtttgccggttcaggcgttctcttccatacttcccgcacgtccggaaaaagggtgacctccgtcaccctgagaatcacaggagaaacgggatgaaactttacatctacgatcactgccctttctgcgtcaaagcacgcatgatttttggcctgaaaaacctgccggttgagctgattgtgatgctcaatgatgatgaagcaacgccgaaaaagctgattggccagaaaatggcgccgattctgcaaaaagccgatggcagtgcgatgccggagagcatggatatcgtgcgctttgtcgataatcaggatcgccagccgctgctgaccggcaagcaaaatcccgccatcgccgactggctgcgacgggtcaatggctacatcaacaagctgctgctgccgcgcatcgctgaggccgcgtttgctgaatttgccacccccgaagcacgtgattacttccgcgaaaagaaacaggccagcctcggtgactttgccgaactgcgtaagcatgccccgggtttcatcaaaaatatcagtgatgatctgcgccagctggataaattgatcgtcaaacccaatgcggtgaacggcgagttgtctgaggatgacattcatctgtttccgctgctgcgctcgctgacgctggtttccggtatcgaatggccgagccgcgtcgccgactatcgcgataatatggcgaaacagacgcaggtgaatctgctgtcgtcgattgcggcctga

SEQ ID NO: 106681 - DNA, 423 bp, Glycine max
  Peptide Sequence Number=SeqID_223459
atgacattagaagaactcagagccaaaactagttcaacgacaccaaatgaaacattaattttgaaggtaaaaataattcaaaagtatgttgaaacacttgatgtgttgaaggttaagaattctatgcctagtagcaatggagaccatgccacagtgcagcttcaacaaaagcattcaaatgggcaacaacaaaagtatttaaatggacatcatagatcagccttagcaccaattcaagagcagcaacaagaacaagaacaaccctcaaggaattccacctcaggagttgtagttaccacaaattgggaattgtttgattctgtcccaccattaatccctgtgccatccacatccccatccccacatccctcagagaccaataaatctggtcctcccaagttcaattgggaattcttcaactaa

SEQ ID NO: 106682 - DNA, 336 bp, Glycine max
  Peptide Sequence Number=SeqID_223460
atgcccgagcactccacgcgacaaacctcactcgaacgcttggaggaagcagtccacaagctcacccaacaccaagccactcttgctcagaacaatcagactcttacccaggccaatgctgacctcactctcaaactagactccgtcctcgaccgccttgctgcactcaccaccacaccatcctccccacagcccccaccttcctcaccaccacctcacataccccgtccacacatgaaactggaagtgccatgtttcgacggccaagatcccctcggatggatctttaaaattcagcaattcttcgattaccaaggcgtttttgatgccgactga

SEQ ID NO: 106683 - DNA, 186 bp, Glycine max
  Peptide Sequence Number=SeqID_223461
atggcggggacatattcccagctggtgacatttataattgctgcttcatgccttctagcggattctgtgaggaacgcgtaccacaccaagtatcatgatctcatgggagagagagcaccttcatgccagaccttgaggaagggagtgtttggagctagagctgccttcatgttttcacaggcataa

SEQ ID NO: 106684 - DNA, 1090 bp, Glycine max
  Peptide Sequence Number=SeqID_223462
cgcgattgttacgcccggcatcatcgacatgaccggcgtcgccggactgcctgacgaagaggtgttcggaccgctgctgcaggtcatccgctacgaccattatgcgcaggcgattcgcctcgccaatgacacgcgctacggattgtcgtgcgggctggtgtcaccacagcgtgaccagtttgatcagctgttgctggaagcgcgcgccggcatcgtgaactggaataaaccgctgaccggcgccgccagttcggcaccctttggcggcgtgggcgcctccggtaatcaccgtgccagcgcctggagcgacatcatgaaggcgtttgaagcaaactttgatggtctggtcggcctgacgcaccactacgctggcctgtcgtttggcaacgaagcctccacgcgcaatcagctgcagccctccaatccgcggctggcggctaaacaggggctgctgaaaatgaaggcgctggccgacatgggctatgtgcagggggttatccctccgcacgagcggcctaatctgccgctgctgcgccagctgggattcagcggcagcgatgcgcaggtgctggccaaagcagctcggcaggcaccgcagctgctgtcagcggccagttcggcgtcggcgatgtgggtggccaatgcggccacggtttcgccatcggccgacagcgccgacggcaaagtgcattttaccgtagccaacctcaacaataagttccaccgggcgatcgaagcgccggaaaccgccgacctgctgcgcgccatcttccgcgatggccgccacttcagcgtgcacgacgcgctgccgcaggtggcactgtttggtgacgaaggcgcagccaaccataaccgcttcggcgctgactatggcgcgcccggcgttcagctgtttgtctacggccgcgacggccagcagcaaggcagcgcaccggcgcgctatccggcgcgccagacgcgtgaagccagcgcggcggtggcaagactgcatcagctggatgacgcgcgcacgctgtttgcgcagcaaaatccggcggtgatcgatcagggggtgttccacaacgacgtaatcgccgtcagcaatcagcag

SEQ ID NO: 106685 - DNA, 507 bp, Glycine max
  Peptide Sequence Number=SeqID_223463
atggcagagccatcgaagaagagaaagggatcatcctccaccgccgccgctgctggccatcgccaccacggcccatccggagcacccacagcacctattcatccttctttgtcatctccaagatcatcaacattgttttcatccaatgatcagcgtctacggtacctttctcagttttcttatagaataatcttagaccctaagtacctagacgtagagttctttaatgatgaaacgtttgattgctatcaagtgtttcaaaattctggccttgttgatttcatgtcattaaaattgccacattatcctgaacttgtaaaggtcttctactgcaatttaaaaattcaggatggcattattacctctgaggtgcatggtattcctatggtcattgatcagtcattattcttttctttaactcatttacccaatcaaggtgcaccttttgagggcaccattgttgatgactggaagtttgattattctagtcatgatgctcgccgtatg

SEQ ID NO: 106686 - DNA, 213 bp, Glycine max
  Peptide Sequence Number=SeqID_223464
atgccgatctccccctgtggaagtatcagttggtctgtgtcgttccgacgagggcgagactccacaacagcctggggatggccagcaacaggcaacaaatgcaccgccgccacctctagagccagtcagctcatccacagaaaggttcctgatcgacaagtcatcaagcgtccagctcaagacattaaagaagcgctactaggaggcaaccta

SEQ ID NO: 106687 - DNA, 511 bp, Glycine max
  Peptide Sequence Number=SeqID_223465
atggagaacatcatgaaccattatcaggcagcaatcatcggatttggtaaagcaggtaaaacgctggcggcggctctgggtcgcgccggctggcgcgtcgcgatcatcgagaaatcccgcgcaatgtatggtggcacctgcattaatgttggctgtatcccaacgaaagcactggtacacgatgtgcaacatcatgccagtttcagcgatgccatgcagcgcaaagcggcagtagtagaattattgcgtgagaagaattacctcaacctggccgccattgcgcaggtcgatatcattgatggtgaggcggaatttgtggatgcccacacgctgaaaatcacctcctcacagcaggtcagccagattcatgctgagcgaatttttatcaatagcggtgccgaagcggtgtttcctgtgctggaaggcttagttcccggaccgcgcgtggttgacagcagcgggatcctgaaattaacgcaactgccgcagcggctggggatccttggcggcg

SEQ ID NO: 106688 - DNA, 2166 bp, Glycine max
  Peptide Sequence Number=SeqID_223466
atggcgcacgttagcaaagcacggtttaacgtggggaacttcatccactatctatcaacgtttctggcgggtctagtggttggctttgtttcagcatggaggcttgcacttctgagtgttgcagtgattcctgggattgcttttgctggtggattgtatgcttacacactcactggcctcacatcaaagagtcgtgaatcttatgcaaatgcgggcatcatcgccgagcaggccattgctcaagttagaactgtttactcttatgttggtgagagcaaggcattgaattcttattctgatgcgatacaaaacacattgaagcttggatacaaggcagggatggccaaaggattaggtctaggatgcacatatggaatagcttgcatgtcttgggcactagttttctggtatgctggagttttcatcaggaatggacaaacagatggtggcaaggcattcaccgctattttctcggccattgttggtggcatgagtttgggacagtcattttcaaacttaggcgctttcagcaaaggcaaagcagctggatacaaattgatggaaatcatcaatcagaaacccaccatagtggaagatccatcggaaggaaagtgcttagccgaggttaatggcaacattgaatttaaggatgtcactttcagctacccttcgaggccggacatgtttatctttcgcaatttctcaatctttttccctgctggtaaaactgttgccgttgttggtggtagtggatctggaaagagcacagttgtttccttgatagaaaggttctatgatccaaatgaaggtcaggttctgctggataatgtggacattaagacactgcaactaaaatggttgcgcgatcaaattgggttggtgaatcaagaacctgcactctttgcaactactattcttgagaatatactctatggaaaacctgatgcaacaatggctgaagtggaagctgctacttctgctgcaaatgctcatagctttattaccttgcttcctaatggctataacactcaggtaggagagcgaggagttcaattatctgggggccaaaagcagagaattgctattgccagagctatgttgaagaatccaaagattcttctgctagatgaagcaactagtgctcttgatgcaggatctgaaagcattgttcaagaggcactagataggctcatggttggaagaacaaccgtggtagttgcgcatcgtctatcaaccataaggaatgttgataccattgcagttatacaacaaggacaagttgttgagacaggtacacatgaagaactcattgccaaggcaggcacctatgcctcactcattcggttccaagaaatggttggaaatagagacttctccaacccatcaactcgccggactcggtcatcacgcctgagccattcgctgtcaacaaagtccttgagcctccggtccggaagcttgaggaacttgagctaccagtacagcaccggagctgatggccgcattgagatgatatcaaatgctgaaacagacaagaaaaatcctgccccagatggatatttcttcaggttgctgaagatgaatgctcctgagtggccttactcaatcatgggagctgtgggttctgtcctttctggattcattggccctacttttgccattgttatgagcaacatgattgaggtcttttacttcagaaattatgcatccatggagaggaagactaaggagtatgtcttcatctacattggtgctggtctctatgcagttggtgcatacttgatacaacattacttctttagtatcatgggagaaaacctcaccacaagggtcagaagaatgatgcttgccgctattttgaggaatgaagttggatggttcgatgaggaggagcacaactcaagccttgttgcagctcgccttgccacagatgcagctgatgtcaagtctgccattgctgagagaatatcagtgattctacagaacatgacatctctccttacttctttcatagttgctttcatagtggaatggagggtttccttgctcatcttggcaaccttccctctccttgttctagccaattttgctcagatccttaccttactctcacacttgcccttttacactggtgagaatctagcttcacatacaagctggcattaa

SEQ ID NO: 106689 - DNA, 486 bp, Glycine max
  Peptide Sequence Number=SeqID_223467
atggctgaagcttctgagcctaaagcattgcctgaggcagagaagaagaaggagcagactctgcccttttacaagctcttctcatttgcagacaagtgtgattggatgctcatgatctctggcagcataggagccattgttcatggctcatccatgccagttttcttccttctctttggtgaaatggttaatggctttggcaaaaaccaaatggacttgaagaaaatgacagaagaagtatcaaagtatgctctctatttcgtgtaccttggtcttgtcgtttgcatatcatcctatgcagaaattgcatgttggatgtacactggggagaggcaagtgagtacactgagaaagaagtacttggaggcagtgcttaaacaagacgttggtttctttgacacggatgcaagaacaggagatatagtttttagtgtctccacagatacacttctagttcaagatgctataagcgagaaggtgctttga

SEQ ID NO: 106690 - DNA, 763 bp, Glycine max
  Peptide Sequence Number=SeqID_223468
tcctggcgctgaacgcggcggtggaggcggcgcgcgccggcgagagcgggcgcgggttcgcggtggtggccaccgaagtccgggcgctggcgcagcgcagcgccagcgcggcgcgcgacattcgcacgctgatcgaaggttccctgcacaagaccagcgagggtttccgccaggccgatcacgcggccggggtgattcgcgaggtggtgtccagcatcgaccaggcggcacgcatcgtcggccagatcggcgaggcggggcaaacccagagcgcggatatcgacgcggtaaacctggcggtgtccaacatggacgaactggtccgcgagaccgcgtccgaggtggcccaggcggctcgcgcctcggccgcgcagcaatcgcaggcggcggccttgctgcgggcggtggaagtgttccgcctgcaagccgacccagcggccgatgccgtggccgcgccgggcgcgcggccgccatctgccgcgttgaggttggcgggcgcgtgacccgatatctcgaaatggcgcgggccatggcgcctttggcgcttccggcgctttcggtttttgcggtgtttggggtgtttgcggagttggtggcgtctgtccttgcgatgaccggaggccgcgtgggccaggcgctattgcgtgatcaacgcagcagcgacagcaccgtctgcggcacctggttggcctgcgccaggaccgacgtgccggcctgttgcaggatctgggccttggacatgttcgacacttcggtggcgtag

SEQ ID NO: 106691 - DNA, 489 bp, Glycine max
  Peptide Sequence Number=SeqID_223469
atgaaggatgaggacgggcttcagatgatgacgacgaccgcggccacgaagaaggaaagcatggattcgagtctgtttgggaaagggaggtacaaattctgggtgttagcggccatgttgcttcaggtgttctggtccatgtacaacggcaccgtctcgctccactggtttggcactctcaattccctttccagcgacatcaacactcccatccacgatgacctcgatgttctcgaaatggaggagagggagaaggtggtgaggaacatgtgggatgtgtgcaccaacaatcacagggtgaggttaccgaggttttggcaagaggtcttcaaggctgcctataaggatttgatgagcgatgccgctgaggtcagagacgctgccgtcaccgagatcgccaagatgtttgttcgctccattcattttgatccacctcctctacaatccatggtgttcctcaatttttttttcaatcttcctagaatttaa

SEQ ID NO: 106692 - DNA, 468 bp, Glycine max
  Peptide Sequence Number=SeqID_223470
atggcgagtcttcgaaagaggtttggtgagacaatcaacaagttggtcagctgtgcaaacatgatgaattctgatttttccttgctggaccaagtctcgaacaaagtgaatgtcaatggagatatgcttcatacgactgtgatatactggattacgataagtggctctcaagttatcacaaaaaaaatttgcaacagctctatattcagcctccgttcagaatttggctacagctcgttgtttagaggatttccaagatatcaagttggagccatagtatacaagatgtgcagaggtagaggtgaaatcatctttgtttccagcccaatcagcatcactctatgcaatgagggaagaggaccttggtttctgaagcaacaacccatgaaaaatgtgggtcgttgcgtgaattgggccagcttgtttactgagaaagcaatgtctggccgggtcatggacaagtattga

SEQ ID NO: 106693 - DNA, 816 bp, Glycine max
  Peptide Sequence Number=SeqID_223471
atgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataaatgacgaggcatttggctaccttaagagagtcatagttactcccgccgttacccgcgcttgttctgagttgactgttcgacgcccggggaagaggccccgaagggcccgttcccaatccgtcccccgaccggcacgcgacgacccgctctcgccgcggaagcagctcgagcagtccaccgacagccgacgggttcgggactgggacccccgtgcccagccctcagagccaatccttttcccgagaggctgttcaccttggagacctgatgcggttatgagtacgaccgggcgtgggaggcactcggtcctccggattttcaagggccgccgggggcgcaccggacaccacgcgacgtgcggtgctcttccagccgctggaccctacctccggctgagccgtttccagggtgggcaggctgttaaacagaaaagataa

SEQ ID NO: 106694 - DNA, 461 bp, Glycine max
  Peptide Sequence Number=SeqID_223472
ggacgggggaagcccgtctgatagcgctctgtgcgcgtactccgaaagggaatcggcctgcccaccctggaaacggctcagccggaggtagggtccagcggctggaagagcaccgcacgtcgcgtgcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaatcaccaagcgcgggtaacggcgggagtaactatgactctcttaaggtagccaaatgcctcgtcatctaa

SEQ ID NO: 106695 - DNA, 114 bp, Glycine max
  Peptide Sequence Number=SeqID_223473
atggctttcaatattgctaacccatggttcaggtcaatggaacatggttgtatgcctttgttgttgtcaggagtgaaacaatggaagcatggctcttcttcatccaaaatttaa

SEQ ID NO: 106696 - DNA, 294 bp, Glycine max
  Peptide Sequence Number=SeqID_223474
atgagggttcactgtaatcaagcaagtcggagacctagcatgatcacggattcacctccactccttatgttcccacgaacccggtccccagtggagtcgccaactgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcaggagttgtatttacgtgcggggaaggtattag

SEQ ID NO: 106697 - DNA, 776 bp, Glycine max
  Peptide Sequence Number=SeqID_223475
tgtgcaagaagccagggcatttcaagtcaaaatgtcctgaccttgaaaagccaaaggataagaagaagaagttcttcaagtccaaaaagaagagccccatgagctcttgggaggacctagaccattcatcgtctgatgagcacagcgaggaagaagccaaccttcaaggcactactggacaaaaaaggtatccagtggatgcaaaactcttcttaaggattttcaagactttgaagaaaggacacaacttccattgggttgaggaagaagttgtcgcatgctcttcgtccattcataaagatgataaagttacatcatcttttgctgagctggatccaccaacctggatcaaagttcttcccccaccaacatggaagcgacttcaccctaaggtgtccaagccttcatcccccgcagccctgcgtaaaagtgtctacaagattccattaggggcttgtagaaaagtgcatattcaactattcactccaatgtctaagtttagtcctttattcaatggtcatcaagtcatccctctgactaaggaagacatcttcaatgttgggatgataatgatgcagtgtggactgactgaccaatggccaagctacccccctgaaattcacattaaaccaaccaccaccatcaagttcatgtcggatagagcttctccaaggtggcctccattggacctcaggaagaagaaacacaaggttcctccttgtctcacgtccacatccgagtacgacaaggaaggcatctccaattatatgtgcatg

SEQ ID NO: 106698 - DNA, 291 bp, Glycine max
  Peptide Sequence Number=SeqID_223476
atgtaccccagaaagccacagatgagtgctgtggctgccaccaagagccagatctctgagaagctgaagcctgaggttgatctggtcactgaagaagccatgaaactgccagggagggagactcaaaactcaagagtgtgctgcaaagtagtgaccactgagagactaattactagatttatatcaagggtgttgctaggtgcacccagcagtattgctggtgcacccagcattttcgtatttttccaattttgtcatttcattcgtttgagtcatacgaatgtagtatga

SEQ ID NO: 106699 - DNA, 947 bp, Glycine max
  Peptide Sequence Number=SeqID_223477
gggcacatgataatggaagaggaggaatgttgggattgtttgaagtgatgggtgctcttctggaagacccttacagggcccaaacacatccacagccatgtactgatactccatggccaggtgttgagtgtgaacttagcaatagtaaccaaccaatttttcatgtcacaaaaatccacattggtgctgatatagtcttcccattccaaccttgcaaaccctcagcttatctgtcacagtccttgatgaaactcaagtatataaaaaccctttcaatatttgactgttttggtgcttcaccagtcattcttcccaaaactctctttggtcctttcacttccctagagcacttagctttggagaataacccttctctctgtggtgacatacctactagtttgggagagcaacttgaccttagttataacaacttgagtggtcaaatcccaatggaaattggaggggttttgctttattctcttgaacagcttcaacttctccagaagctggatttgcactctaacatgctcagtggaaacattcctcctgatataggaaaactcaagggagggataccccagttcatagggaagcttaggaagctcaaatcattgagtttatcaggtggacaagttccaccaaatttgggttcacttccaagcctagatcaacagaatatcagccacaacaagctgagtggggttctagagctacctggtgacttcattcaaaagttaggcaaaatgttggatttaagaggaaacagtgaactctgcatcagtgatcagtcaaagaagaagaacctctcttcatacttggaaatcccttcttgtttgaacacgcgacagagaaatgataataattattttgctggtacggtagcaacccaagttcatgttcatcatggccaaaagatctacatgtcatcatatttaccttggttttaa

SEQ ID NO: 106700 - DNA, 1295 bp, Glycine max
  Peptide Sequence Number=SeqID_223478
atggagatgataactaatgttaccgagtatgaggctattgcaaaggaaaaattgccaaagatggtttatgactactatgcatcaggggcagaggatcagtggactttgaacgagaaccgaaatgcgttctcaaggattctgttccggccgcgtattcttgttgatgtaagcaagatagacttgactacaactgtattgggcttcaaaatatcaatgcctatcatgattgctccaacagccatgcaaaagttggctcaccctgaaggagaattagctactgctagagcagcatcagctgctggcacaatcatggtgcttaaagacagaaatgtggttgctcagcttgtgagaagagctgaaagagctggtttcaaggcaattgcccttactgtggacactccaattcttggtcatagggaggctgatatcaaaaacaggattggatcttggaaagctggacaagggtttagagaagcctctgtggtatgcgaagacataaacgtacgccgagatgatttttccacagtgattgtgaatgacattcacggcgagatcaaggtgggagaggaaggtgtgaagggagggattgcggtcgccgctagcaacccagtcggggaactactcgatgacggtgacctccccgtcaacgtaatcaaaggtggcggcggaagagccggaaacgagagagttgtgttcgcaatggactttcttctggtagtcttgctcagcggcggaggtgaatttgaaggcggtgccaaagttgtttcagatctgaaaactagtgactctggtcttgcctcttatgttgctggacaaattgatccgtcactcaactggaaggatatcaaatggcttcaatcaatcacttcattgccaattttagttaagggtgtacttactgttgaagatacaaggatagccatacaagctggagctgctggaatcattgtttccaatcatggagctcgtcaacttgactatgtccctgcaactattatggctttggaagaggtagttaaagctgcacaaggaaaaattccagtttttctggacagtggaattcgccgagggacagatgtatttaaagcattagctcttggagcagccggtgtattcattggtagacctgtggtgttctcattggctgctgatggtgaggctggtgtaagaaaggtacttcaaatgcttcgtgatgagcttgaattaactatggcactaagtggttgtcgttcactcaaggagataactcgtgaccatgttgtcacagagtgggatcgtccaaaattttctcccaa

SEQ ID NO: 106701 - DNA, 222 bp, Glycine max
  Peptide Sequence Number=SeqID_223479
atgactgatagagatgttgtctcctggagctccatgattgctgcctacgtcgcttgcaactcccccttggatgcttttcacatgtttcgtgaaatggggatggaaaatgaagagccgaactcggtcacgttggtgagcttgctctctgcttgtactaaaatgctcaatctcagtgccgttggtgagccgaactcggtctccctcggtcacgttggaaaatga

SEQ ID NO: 106702 - DNA, 396 bp, Glycine max
  Peptide Sequence Number=SeqID_223480
atgggcacttgcactgacaaggacagtgtcgatgacactgtatgcaaaaaatgtgcgaaagaaggcacaggccatccagaaacaaaacattgccccttatgtgttgtctcgtggggttatgaatttctagaaaacaagttaatggaggagaagaaaaagaaacaactggaggaagttgctaaatctggaagcaccgacatcgtcattgatcttctatctcccatcaaacgacacatgaagtggaagatggcccacaccaagaaaattgagcaaattacttctgaggcagcaaaggaaattgctgacaagattgcaagattccttggaggagcaggcctcactgggttcctttgtttcccatggacgtcaggatatactgtctactgccattggtga

SEQ ID NO: 106703 - DNA, 252 bp, Glycine max
  Peptide Sequence Number=SeqID_223481
atggagggattcaccgatggtgacagaggaatagcgagcgtaggccttgagggaaaaagggtaggtgaagtcgtaggggttaaggggcgaggtttggaggaggcggaagagagtgagggagtggtgcggcgttggggtggcggcgaaggctctgatgagggtgttccgggcgaagaggggggagggagtggaagaatgaggcggcgaaagggagggagatggtggaggcttgtaagaggaactgggagatga

SEQ ID NO: 106704 - DNA, 798 bp, Glycine max
  Peptide Sequence Number=SeqID_223482
atgaaaggaggatttaaaagaggagaattagctactgctagagcagcatcagcagctggcacaatcatggtgttaaaagacagaaatgtggttgctcaggttgtgagaagagctgaaaaagcaggtttcaaggcaattacccttactgtggacagtccaattcttggtcgtagggaggctgatatcaaaaacagatttacattgccaccaaacctggttttgaagaattttgaagggttggatcttggaaagctgaacaagattacattccagactagtgactcttttgctgcctcttatgctgctgaactatacgatcggtcactcaactggaaggatatcaaatggattcaaacaatcacttctttgcctattttattaaagggtgtacttactcctgaagatacaatgatagccatacaagctggagctgctggaatcattgtttccaatcacggagctcgccaacttgactatgtccctgcaactattatggctttggaagaggtggttaaagctacacaaggaagaattccagtttttctggatggcggaattcgccgagggacagatgtttttaaagcactagctcttggagcagccggtgtattcattggtagacctgtggtgttctcattggcagctgatggtgaggctggtgtgagaaaagtacttcaaatgcttcgtgatgagtttgaattaactatggcactaagtggttgtcgttcactcaaggagataactcgtgaccatgttctcacagagtgggatcgtccaagattttctcccaagttataa

SEQ ID NO: 106705 - DNA, 282 bp, Glycine max
  Peptide Sequence Number=SeqID_223483
atggtgggaagccttgtgtatgccatgatatgcataagatcagacattgtccaagcagtgggggtggtgaatgggttcatggcaggccctagtaaagagcattggagtgttatgaaaagggtccttagatacatcaaaggaacctcgaatgttgcattatgttttggaggaccagactttgttgttggagattatgttgattctgattatgcaggaggggcaatgagttggttatccaaattacagactgttgtagctttgtttactacaaaagttgaataa

SEQ ID NO: 106706 - DNA, 681 bp, Glycine max
  Peptide Sequence Number=SeqID_223484
atggggcttgtctctacaattcacagcttcaattcaatactattctttctcccatctcgtctagccgtaaaccaatctgctccaatttttgtggagacaaagatttctgctactgctccagctcctgctgcccctgcaattcctcgttttgcttatttgatttccggctcaaaagatgatttggagaagctatggaggactcttcttgctctttaccatccactgaaccattatcttgttcatttggatcttgagtctccactagaggtgaggttggagcttgcttctagaattgagaaacagtctgtcttctctgaggtgggaaatgttttcatgattccaaaagctaatatggtcacttacagaggaccaaccatgattgctcacactcttcatgcttgtgccattctgcttaagagaactaaagactgggattggtttattaaccttagtgcttcagattatccccttgtgactcaggatgatcttctagatactttttctgaggtagacagaagccttaacttcattgagcacacaagtcgtttggggtggaagctggaaaaacgagcaatgcctttaattatagacccaggtctttacaggacaaacaagtctgatgtgttttgggttggtcctaagagaactttgccaacagcatttaaactatttactggttag

SEQ ID NO: 106707 - DNA, 231 bp, Glycine max
  Peptide Sequence Number=SeqID_223485
atgatacaggggattccagaaaatattgttgttggttctcatgtttgggttggagatccagaactagtttggattgatggacaggtagtgaatattaatggtcaagaagcagaaattcaaactagtaatgagaacaagttagtttcagagccctacaaaggtagaaggggatggcttaaacagtgcaagaaagaaaggaaattcaaagctgtagccccattgttatattag

SEQ ID NO: 106708 - DNA, 279 bp, Glycine max
  Peptide Sequence Number=SeqID_223486
atggggggtgggaataggtcaggccggcctacaggggctataggccaagcgcaggactcaaaaattcatcgtaggctaggctcaggccttttaaagcctagtctggcctggcctattcccatccctaattgtaaagaatggcccaatgtagaaggctctcattgttgtgggagtttggagagagtcaaatacatgaaccccatcaaagggacactttcaatgacttcaacatttgaacaacaagttgagctacaaagttggagagaaagcaatgcatga

SEQ ID NO: 106709 - DNA, 201 bp, Glycine max
  Peptide Sequence Number=SeqID_223487
atgaggcactatagcacattcatcatggatccacatgagttctacatgaagggcatgcgcgctggggcgtgcgatgacaagttcatggcagtcctaaacaccagtgatttgggaaacacattgaggtgcctcgaattagaccaaggtgcagtattttcaatgggtttgggtggggttaaagagaaagacgttactgtttag

SEQ ID NO: 106710 - DNA, 570 bp, Glycine max
  Peptide Sequence Number=SeqID_223488
atggacaagtattgtctagtgtcgagtgtgcttatcaagctcctgagcctgaacaagtgttgttcgggttgcttttgtcaagttgtctgtgatggacatatctttggtgtgccagataaggcgtgtgcggcacacatgcaatactcttgcatgtggcaaggactctggggctcgattgaggagcccataattgaccgcaaggtcatcttgataggtagttccttgtttgaggatacccgccgaggttcctctgacactgagttctcctcttcggagagggtgagtgcctcatttctcgcccccacggaatggcatgactttctgttgctatcggggagccagtccaggtcactattgtcgcaacatgcccttttgcgggcgtgcgaggagaggctcacgggtgcgctttccaaaggaggaaagatgcgcggagtcgccaccaacgaaggtattagcacctctcacgtcgacaaaagcggggctcttgctcctacgtaccctccatcgaagaggaaatcagacctacgtagttctttcttaagagtgaatcaagcgattctttttacttga

SEQ ID NO: 106711 - DNA, 291 bp, Glycine max
  Peptide Sequence Number=SeqID_223489
atggaaaatttgaagaaattaaatcttgttggcaatactattacagtttctggtgatatctttggattgaaaagcatacctacatactgcagtggcctagaaatcaatactaatgttactaaaaaggatgttgaggaggggctgaggcaggatattcttactcaccattctatactttcagttgggaagcctgtccgtattgcaaataaaaatcttattgactacatcttcttacaaagtttggaagttgctcaatcctatgacttgccaatgcagatacacacagggtaa

SEQ ID NO: 106712 - DNA, 1025 bp, Glycine max
  Peptide Sequence Number=SeqID_223490
gacttacatatcgtgcaacaaagggtgccaagtattttgaagcggccaatcaaaggttgcatatcatcaatcaaagtgttgggtcaccatcatccaccccagtcgttgttggctatgaatcggtgcgggacgacatactaaaatacatgtcatgtctcacctctacggcgagtgtcactgtgcttcaacgccaagtgaagttggaaaaccctaaaaactcctgtaaactagtcgttcaggcttgcaagagtggtcctgggtctcattctactcttaatcgcttttcagtgtgctctgttagagcacttgaatgtggccctttctcaactccacccaaacagttggacaatgtcttcttgttcttctttcaaatgaaactgagtggcaaaattggatgggtttccttgaacagcgtatccaagaagctgtttgagtttgactcaaacatcttttgccgttttaaggactatttctttaaggtcttggctacttgcatcgtgactgatggatctactgacccttgtggagaaggtcgacaaagcaatttggagcagttgcctgcctcgctggacatgcgggccattctatctcttccttcgatgagcgatccactcatttccttggatggtaaagtgcctaaccttgcccttgtcagacctataggtgggatcgtgttgtcatctgccactgctctggatgctggagaagggggtcaacctgctggtgaggttggctctattgctgttgtgactagacatggcaacggggcggggcggggcggggcgaggatgggtatgcctcccgattccccgaccctgattcctcaacatatacctatattcgtccccgatacccgacgagttaaaatttgttaccccatccccgtacctatcgggattgatgtccgatgcgaccacccttcaattgcgcaagatgtgcctcaggctccaccggccatcaaggttcttgttgttgctgctactcatgctcctccgcctcttcctgtaaagagaagaatgacatga

SEQ ID NO: 106713 - DNA, 948 bp, Glycine max
  Peptide Sequence Number=SeqID_223491
atggatgagaagagaaagggaaaactggaggaagctgctcaatccgaaagcactgacaccatgattgatcctctatctcccatcagacgacacgtgaagtggaagatggcccgcatgaagaaaactgaccaaataacgtctaaggcagcaaaggaaattactgagaagattgatgtattgactgctgccattgggcgaccagaacaccctggtcgtgtgtgtgctactggagctggtgtcacaatcaagcaatactttggaccgactccaaggacctctcgcacgtcttcctccgtgactcccaaagacctccagatgcagtcccaatttcagttgcagatgcaatcacagggactcgtactatctcttgagcttgaggttgatccttcagctgctcgtgtcagtacaaatgagagttgtgttgatcccttagggaataatccagacacgggtgactcagacaaatgcgggttatacatcgaaaaaaatcctcaccgcctggttgccctaggaagactttatgagggatccacaaccgttcacaacattcctctactgcatgatcaagtcaaggttggtgttgaggaggttagagatgcaaatgctcccattcctgtacctactgaagaggttaagttagtggggcaaacacttaacaccttccttgcttgggcgacacatcttgtcaatcgtttatcagaacagggagttgtgggacccgtaaaacctgcagataggctagatcatgatgtcgatgatcccatatatttgatgacattgaccatcccacagttttttctgaagttgttgcaggttatgtgggatgttgtcgtgtttagggtgtataatgacaacttccccttgtacataaaacatgaagatttatctgaaattgcacatggtggtcaatgtctcagcatctatgttatacagttgtggattctataa

SEQ ID NO: 106714 - DNA, 423 bp, Glycine max
  Peptide Sequence Number=SeqID_223492
atgggggtggttcctcataaagatcataagataaaatcatacagagttatctccaacgatacttattgcaatggtactaattgcaaagatagaatggctgctattcaccttgatgccactggaactgaactgataatgcggttaagaaccactggaactccactctctagcgtagagccaaaggatgtttgttcacaatgtggtcgacgacaaagagtattcaaatctaaaactatcagaaaacaagcagtcacgtacctcaatcgcggtagtgatgaaccccaactcgtttgcggtagttgcaccttgagcgacacttgtagcttcagcagtgcagtttgcggtagtgacagggtcaggagtaaggagaaaggacaaagagggtttgagcgtgcaggggaaaaaaatgaattcgggttttaa

SEQ ID NO: 106715 - DNA, 336 bp, Glycine max
  Peptide Sequence Number=SeqID_223493
atggcccgcatgaagaaaattggtcaaatgacgtttgaggcagcaaaggaaacagtagacaagattgctagcttcaggggctctcacacctcttcgtccatggctactgaagacctaaagcagctgacacaaaagatcagagaccagctagaggagtcaatcacacaaaaaagtgactcaacaattaacgatgtccttcatccagatgcagctgaggttggtccttctgctgctcgtgtcagcataaaggaaagtggtgtcaatccctcagggttggtcccgaaaatgggagacttgtacaaatgtgggttgtatgtcgatgacagtcctccatga

SEQ ID NO: 106716 - DNA, 354 bp, Glycine max
  misc_feature (278)..(278): n is a, c, g, or t
  Peptide Sequence Number=SeqID_223494
atgacagtggataacaagtacttcatgcttcaggacgaagactcgcgtgctcctgggagtcgggtcgcagcttcgccgggtgcaaagtcgttgtcggagtcgtcggacggagtcgtcggagtcgcaggtcgcaagtcgaggttgtactcgcagcttcaatggagacaagggtttctcgagcaagccaaacaacgcaatcagggagggagggagaacttggccagcgcgcaaaattgtcgtccagatcccgcgacggccgctactctgaaccgccccgnttctcctaccttcgtcgcggtagggtgtcgcgtcgcgccgcgccgccgtgatagcggctgcgacgaccgctattaa

SEQ ID NO: 106717 - DNA, 576 bp, Glycine max
  Peptide Sequence Number=SeqID_223495
atggttttttcaagattttctcaaggttataactcttccaatggttttcttgaccagggtacatcctttgtagtacaagtagagggtacatctacttgggttgttgtaactgagaacaagagagagtacatctcttgtggatcagttcaagtggagggtacatccacttggttgttcaaagagaacaagggaggtaaaagcctaattaaatctagtaacattaagaaggatagatccaacaatcaggtgcgggacagacgtgtggccttatcttccagaaagggtgctgaggcaatttggtcatgttcagagcaacctatgccatccactgcagcatctcacgtttcccaccccctatgccattctgccagaagagggagagacaccacttcctcctgtatgtttatcgcccatcctagtacagctaccacctgtgcaaccactacccgagtatgtaccatgacgaaacttctcttgccaggagggcttcaagctgggtgtagcttagagaggcaagggaagaaggatgctaaggatggtggcaagggtgacaagaaggatgacaggggtagatga

SEQ ID NO: 106718 - DNA, 1006 bp, Glycine max
  Peptide Sequence Number=SeqID_223496
atggatgagataagcattcttcggggaggaaatagttttataattagtaccatagcaatttcaatcaaggacatggcttcaagcagaattaatgaatgtataggtcttaatccatgcaaaattagagtgaagcaggtggagtttcaacttaccaacaaacaatctttcttgtcacaaaggcaattggacaacctctcctcacaacctgaaccaaaccctaagaaggaggatgtcattgttgtgatgacaagaaacaagaggattcaagataactccgaggagaaggaaggttttttcctaaaagctacagatggcgtccttattgagaaggaccaagcacctaagaaagttgaagttcttactgatgggaatccagtgctaaagaagaaagtgaatgaaaagaaggagatactgacatttcctaagaagttggacataacaaacttagaaactactaacatcaatcttcaccttgctcgttcagttgtctatcctagaggggtgattgaggatgtgctggttaaggttaggcttggtagactcaccctcacattaggggatgaaatagtgtgtggggattctttgatgaaatcctaccccgcaagggcattagatagaagactcaaagtagattggactagagatgcaagagaaggccctagggttctcatgagccttagggcctacaagctccaatggagctacatcattcttgaccctctagagagagttctcactaatgaggaccttgactgggagttgaatcccgaaccttctattaaggaacctccttccaacttcaaatatgtttttattaatccaccatcttctcttccagttatgattgctgcaagtttacatgaaattgaggagaaaaaactattgcggttttgcaaggacaagagggaaacctttgggtggaacattcaagacatgaaagttgtgaaaggagaggatgctaagcccactgtcaagatgaaggcataccataaggcatttcaacagg

SEQ ID NO: 106719 - DNA, 144 bp, Glycine max
  Peptide Sequence Number=SeqID_223497
atgccaagaccagacaaacccaattggcctacgatgcattcgcgctcagcgccacacctcgcgcttagcgcgttcagatcgtgcgctgagcgcgccatgcacgctgggcctgtgcttctgttggatcgggcgctgggcgcctag

SEQ ID NO: 106720 - DNA, 1653 bp, Glycine max
  Peptide Sequence Number=SeqID_223498
atggcagcactcaattcgagcacttgggccaaacctcaattccatcaccctctctcttcttcttcctcattattaacagacatgggcttccccactaggtttcccaagaagcccattggagagtggaacccattccaaaaagccgccgccaaggccctcgacatgttcgagagcgcgttgctctcacgcgagctcagccaacccctccccaaaaccactgacccacgcgtccaaattgccggtaacttcgcccccgttccggaacaccccgtccaacattccctccccgttattggcacaatcccagacgcagttaacggcgtttatctccgtaacggcgccaacccattgttccatcccaaagccggtcaccacctcttcgacggcgacggaatggtccacgccgttaaaatcaatcacggcaccgccagctacgcctgccgcttcaccgaaacgcagcgtctcatgcaggagcacgcattgggaaaaccggtgtttccgaaagcaatcggcgagctccacggccattccggcatcgcgaggctgatgctgttctacgcgagaggcttgtgcggcatcgtcgaccaccgcagcggcgccggctccgccaacgccggcctggtcttcttcaacggaaaactcctcgccatgtcggaggacgacctcccctacgagctccgaatcaccgcctccggcgacctcgaaacaatcggtcgctacagcttccacgaccagctcaattcctccatgatcgcgcatccgaaggtggatcctatctccggcgagcttttcactctaagctacgacgtcacgagcaagtacctcaaatacttccgtttctcgccggaggaggagaagaagtcgccggacgtggaaatccccctcggcgccgcgacgatgacgcacgacttcgcgatcacggagaatttcgtcgtgatcccagaccagaaggtggtgttcaagctcggcgaaatgataaaaggaggatcgccggtgatctacgacgacgagaagaaatcgcggttcggaattcttccgaagtacgcctccgacgcgtcgagcatcgtgtgggtggagtcaccagacacgttcttcttccacttctggaacgcgtgggaggaacgcgagacggacgaagttgtagtaataggttcctgcatgacgccaccggattcaatattcaaagacaccgaagagagtctgaaaagtgtcttaacagaaataaggcttaacataagaagcgggaagtcgacgcggcgtgtggtggtagaggaaatgaacctggaggcggggatggtgaaccggaacaggctggggagaaaaacccggttcgcgtacttgtgcatagcggaaccgtggccgaaggtgtcgggattcgcgaaggtggacctggagagtggggaagtgaagaggcacgagtacggagagagaaggttcgggggagagccattctttttgccaacacgtggagagaatgggaatgaggatgaagggtacgtgatggcttttgtgcatgacgaggtgacgtggcagtccgagttgcagattctgaatgcacttgatttgaagttggaggccaccatcatgctgccttccagagtgccctatggctttcatggcacgtttgtggaggctatggatttgccccagtga

SEQ ID NO: 106721 - DNA, 546 bp, Glycine max
  Peptide Sequence Number=SeqID_223499
atggcttctcgcaagcgccatgccgtgccctcaccaggggaagcagccaactgggacacttcccgcttcacatctgagatagcttggcaccggtaccaagacaacattcagctccggaacatccttccggaaaggaatgttgaactgggacccaggatgtttgacgagttcctccaggaactcaggaggcgcagatgggaccaggtgctgactcaccttccggagaagcggatcgacgtggctctggtgaaagagttctattcgaacctttatgatccagaggaccacagtcccagattctgcagggtgcgaggacaggtcgttcgttttgatgctgacaccattaacgacttcctcgacaccccggttatcttggaggacggggaggagtatccagcatacactagatacctcagcactcaccccgatcctgacaccatcgcggccacactgtgcactccaggggggcgctttgtccttaatgctgatggtctcccctggaagctgctgaggaaggacatgatgacacttgctcagacatggagt

SEQ ID NO: 106722 - DNA, 1059 bp, Glycine max
  Peptide Sequence Number=SeqID_223500
ggcaaggatgtatttgaagcattctataagaaagatcttgctaaaagactgcttttaggaaagagtgcttctattgacgctgagaaatctatgatctccaagttgaagactgagtgtggcagccagttcacaaacaaactggaaggaatgtttaagaatatgttccctagcagtaatgtgcagcaagatcatggtggcatttttgtttgtttggttgatatggagcactggccaacatatccgcccatggatgttagacttcctcatgaattgaatgtttaccaggttctgcacgtgctagtgactgatttctcttttaactgtggtcttggtattttgagtgattcccttgacatggatattttcaaagagttctatctaagcaaatacagtggaagacgtctgatgtggcaaaattcactaggtcattgtgtcttgaaggcagagtttcccaaaggaagaaaggagttggctgtgtccctatttcagtttatcttagcatcttttattgcacaaatttccatttttttttatattaattctgcacgcctggctgtcctccagactgttgttctaatgttattcaatgatgctgagaagctaagtcttcaagatatcaaagatgctactggtattgaggacaaggaactcagaaggactctgcaatcactagcttgtggtaaagttcgtgtcctacaaaagatgcccaaaggaagagatgtggaggacgatgacttatttgtttttaatgatgggtttacagctcctctttaccgtataaaggtgaatgcaattcaattgaaggagacagtcgaggagaacacaagcaccaccgaaagagttttccatgaccgtcaatatcagattgatgctgctattgtgaggataatgaagactagaaaagtgcttagtcacacccttcttattactgaactcttccaacagctgaaattcccaataaaaccagctgatttgaaaaaaaggattgaaagcctcattgacagggagtatctagagagggacaagagcaatcctcaaatatacaattacctcgcataa

SEQ ID NO: 106723 - DNA, 1317 bp, Glycine max
  Peptide Sequence Number=SeqID_223501
atgtctaatacgaaactgtcaccgcctatgaagaaggcgaaatctatcgactccaagaacgacgacgccgttttgaaatcccccgccgccgcttccgatgaccccaatgcgcccgctctcgtcgccgccaatctgtctcgcaaaaaagccactcctccccatccccccaagaagctcctcattaagttccacaaaggtataccaacattgcccccaaattttgaggaggatacatgggcaaaattgaagtcagctattggtgctatattcttgaagcaacctgtttcttgtgacttggagaatctttatcaggctgtgaatgatctttgcctttacaaaatggggggaaatctttatcaacgaattgaaaaggagtgtgaagcacatatatctgcagcactgcagtctttagttggccaaagcccagatttgattgtttttctatcgctagttgagagatgttggcaggatctttgtgaccaaatgttgatgattcgtggtatagccttgtttctggataggacgtatgtgaaacaaacaacaaatgtacagtcattatgggacatgggtttgcaacttttctgcaaatatctttctctatctccagaagtagaacataaaactgttactggtcttcttcgtatgatcggaagtgaaaggaaccatcactctgacatgagggaactagaattgagatttctgaatgggtttggaatggagttcttatcaggtgaatcagtggatagaactcttctaaatcatcttttgaagatgtttactgctctgggaatttatgcagaaacctttgagaagccattccttgagtgcacatccgaattttatgctgctgaaggtatgaaatacatgcagcaatcagatgctccagattacttgaagcatgttgagacaagattgcaagaggaacatgaaagatgtttgttgtacttggatgcaagtactaggaaaccattgatagcaactgcggaaaagcaacttcttgaacgtcatatacctgccattcttgataagggttttactgtgcttatggatgggaatcgtattgaagaccttcagagaatgcactcgctcttttcaagggtcaatgctcttgaatcactgaagcaggcccttagttcatacatcaggagaactgggcagggcattgttatggatgaggagaaagataaagatatggtctcatcccttcttgaatttaaggcttctcttgacacaatatgggaagaaagctttttcaagaatgaagctttcagcaattcaattaaagatgcatttgagtatcttatcaatcttcgtcag

SEQ ID NO: 106724 - DNA, 645 bp, Glycine max
  Peptide Sequence Number=SeqID_223502
atgaaggtcaaaaccgcccgtggatgtctgaaggaggatgccaccgatgttgtgccaatggtgaatgagtttgggatggggggggagtggatcagtggagtaaaaccccttgtagccagcggtgatgtcaaaaatacgacggatgccatagagttgccacaggcccaccacaagctctctcatgacggtgttaaggttggggcagagacccttgcaggtgacaatggcaacacgaacactagaaagggcggtggtaggcgaagcaaggagagggagaaaaattttcgatttggcagagattgggtgagtgatggtggaaaagttgtttttgttgtcggggaggcaaatggagggtttggtagggagatttgtgccactccattcgcttcgtcctcgtcatcttcctcacagacacaccggcgaacctccccaccaggctaccacctccttcaaacaagtcgtccaaatgctcacaggatctcaacatcaaccctctcctccccgtcttctccaacaccaacaacgtcgttttcgctgtggaaacccgaggttctctcccccagcatcctcgactgccccgtcccttttgtgggttggttcagatccagtggacatggacggactgagccagatctgggtttatga

SEQ ID NO: 106725 - DNA, 342 bp, Glycine max
  Peptide Sequence Number=SeqID_223503
atgacgagtggaccaaagatagtgcacatcgaaacacggtacgtggaaaccgacgctatacacttcagagatgtggttcagcacctcacagggaagaactcctcaacaacaaactgggtaggaaatggtgcctcattctcatccgtggcatgttcttcagattataataaaagaggaattgcaaatggtggtgtcatgagtgccaagccacatgaagatagcactactgatgataaaaagaatagtgttgcatcttccatgctactcatgaacgtgtccttcaaagactttgagggtctgttgtctgatatgcctcccatggaggagttgctcatgttgtag

SEQ ID NO: 106726 - DNA, 228 bp, Glycine max
  Peptide Sequence Number=SeqID_223504
atgtgtttgagacatgaattggaattttcggtgaacttatatggtgtggctttgagtccttgggagagaattggatcacatggggtgaggaatttcgtgctgtttaagaagccagagggtgtggcggatgtagatggaagtacagcactttctcgcagcagcagggggagtgggagctggaaggcttggttcaacaagtccctcaacctcaagatttctacccactaa

SEQ ID NO: 106727 - DNA, 1053 bp, Glycine max
  Peptide Sequence Number=SeqID_223505
atggcgacaacaactccacccacattgacagacatcaaagcaacgatgcacactattgggcttaatccttcggatgtcaattggtacatggacactagtgccacctcccacatgacatccgagcaagggatacgtctcatgagacgtaagaattggggcgacctttatcctatcattactaatcaagccacttcaccatctacttttttcgctttagcaccatcgttatggcatgctcgtttagctatctctaaagcaagacccattcaccaacttgatgtgaagaatgttttcttgcatggagaactcaaagagactttgtacatgcatcagcccatgggttttagggactcaaatcatcctaatcatgtatgcttgttgaagaaatctctatatggcctcaaggaggcccctcaggcttggtaccagagattaactgattatgtttctactcttggattttttcgcagtacttctgatcattctttcttcatttaccgacaaggtacaattttggcttacattcttttgtatgtagatgatattatcttgatagcttcctctgatgttattcgcaagtctatcatatcccttcttagctcgaaatttgctatgaaggacctagggaagtatgcaacaaagatcattgaacgggccaacatgccatcttgtaagctatctcctattccggttgacaccaaaccaaagctcagtggtaattctagcacaccatatgttgattcatcccattatcgaagccttgtaaatgatcttcaatatatcaccttcacgagacccaatattgcttatgttgtgcaacatgtgtgtttattcatgcatgactcgagggaagaatacatgcacactctcaagtgcattgtgtgctacattcaggttgggtgtccggataccagacgctctacatcgggttattgtgtgtttcttggtgataatttaatttcttggtccgtcaaacggcaagctacattgtcacgatctagtgcggaggcagaatatcgaggtgataccaatgtggtttctgagtcttgttga

SEQ ID NO: 106728 - DNA, 480 bp, Glycine max
  Peptide Sequence Number=SeqID_223506
atgggggggggtgaaagaagaaaagggacagagaaggagggaaatttttcatgcaaccttgcgttaagcgcgacttctgcgcttagcgagtatagtggtgattacatgcttaatgcggaattcgcactaagcacgccttcaagtttattcgtgggctttcttcgtgctaagctttggctggccgctgatcgaggtgtcgagctgaacttgtcttacgcgctaagcaagatgctctttaacttcaacttcttcttcaagactttacttcaagcctgtagaatggtcattcccttcaggattttcattgcacctgatggaacaatcggggtttttgaattggatgcacatgtcagtgaatggtatccatggagggtgctccgattgtgcgacagaggcttttggatatccaatcttaggtttggagacgatggtttagaggaggaagatgctagggttttaggatgtgaggaggagccttga

SEQ ID NO: 106729 - DNA, 141 bp, Glycine max
  Peptide Sequence Number=SeqID_223507
atggctgtcaggaaaggattatacggaatggtttgcgataaatggtttttcttttggaccaaaatcacatccaaatttagcagtgcgccaaatgacgccttaattgtcatgggatgttcaattttaaataatccgaactaa

SEQ ID NO: 106730 - DNA, 446 bp, Glycine max
  Peptide Sequence Number=SeqID_223508
atggcggcagcagcacctactgaggtaggcattgatcagcatgatcttcggcatgcagtggatgactttgcagcaattgatgataggttggacaggcttatgaacctgaggattttgaccgaaggaacggaagcctacactattgttgaagaatgtgtgggcatcgcaagacgctacactggccagccaactgtagcccacagatccaggcgaaggcgtgatcaaggggttcccatgaaccctaagagaatgaaggtcattcttgagtggcccactccaccaacaccactcattgagttggtgagaaaccatgttccttcatgggaagatgcccaggaaatgggtgttgagggaaggagcccagagtatgaagaacctcgggatttgaggtcaaatcctttccaaggtggagggaatgatgcaatcctatcccgcaagggcattgg

SEQ ID NO: 106731 - DNA, 264 bp, Glycine max
  Peptide Sequence Number=SeqID_223509
atgaccaaacttggtctctgcttgtcatcgggcccgccgcctctggatgacaaaagggtgcgaataaccataagaatgaccaaacttggtctctgcttgtcatcgggcccgccgcctctggatgacaaaagggtgcgaataaccataagaatgaccaaacttggtctctgcttgtcatcgggcccgccgcctctggatgacaaaaagggtgcgaataaccgtaaggtatctccgcgtatcatcgggcccgccgcctctggatga

SEQ ID NO: 106732 - DNA, 396 bp, Glycine max
  Peptide Sequence Number=SeqID_223510
atggatgaagatcaatggatgtatgacagtataatgtctgaagaagttaatatggattatcaaaatgaagaagaatatggtgtgaatgaaccacatgttgattgttcgaatgtgttcaatacttctcaagtaataatgtgtttgacagctgagatgatgtattgcggtgggctcgatccattgctcatgaaaacggatttgtggcggagtgacgagtataggtgtagaaagaaagaatttgttagaagagatactgggactaggaaatgtgggtgtcccttcaagcttcgtggcaagctagtggatggaggacaaggctggatgatgaagttgatgtatgggattcataatcatgaattggtcaagtcattagttggacatccatatgttgggtga

SEQ ID NO: 106733 - DNA, 195 bp, Glycine max
  Peptide Sequence Number=SeqID_223511
atgggctcaaaaatctaccctaaggttcatgagaaccctagggccttctttagtagctctagcccaagcctcttggaatcttctatccaatacccttggggggtaggattgcatcaagtttactttattggtaaaaaagtctttaagatgaatggaagcaatgcctcttatgtcatgtctgagagatatcgataa

SEQ ID NO: 106734 - DNA, 186 bp, Glycine max
  Peptide Sequence Number=SeqID_223512
atggacttcatggttaccactaaggagcctgaatttcttagagatgttgatgggacgggacatagttctaattcagctgaacaaatattccacattttaggtcagagtgagactacttcgaaacaggatggggtttctgcttcgaattcgaaaaattttaattctgttgctactgagcttatctag

SEQ ID NO: 106735 - DNA, 483 bp, Glycine max
  Peptide Sequence Number=SeqID_223513
atgtatcaatcatgtctaaaccaaagtcaagcttcaaaacacagcaacacagaatctaggtgtcccatacccctcaattcaatgggttttctaggtttgagaagtgaaatggaggatgagcacagtccaaactttctcataagtcctaaatggcatttcaagctaggattaactcattttaacctctatttaccacagaatccagatttaaccttccaactctcaaagcctcactctttttccactcataacaccacattctcactttctagccctagaaacctagcaagactacccatcatatctcccaaaaccccatacccacgaaaatcaaaggagaaagaagtccacccaaacctgaaatttcgaagtcccacacgtagagacgcgcttcacgactccgaaaatgccctcctttcacgatttggggcagaaatgatggccaaaggttggagctttgtttggagcttcaatggagaatga

SEQ ID NO: 106736 - DNA, 561 bp, Glycine max
  Peptide Sequence Number=SeqID_223514
atgcaagccctcgccttaacaggactgcatgttctcatatttagaggactacacaacctcgccttccgagggctagacgccctcgccatcagaggagtacacatcctccccctgagagggctacacgccctcgccttcgtagggttagacacccttaccttcaaaggagtacacgtactcaacatcagaggactatacattgtcgccatcagagggctacacgtcctcgccttcagagggttacacgtcctccacttcagaggactacatgcccataccttcaaaggataccttcataggactacacgcccttggcatcgtaaggcttcactccctcaccttcagaggactacacatgctcgcctacagaggactacaagcctttgccttcgtagggctacacgccctcaccttcagaggactacacatcctcgttttctgagcgatacacgccctcgccttcagaggactacacgtctaacctttcagggggctgcacgtccttgccttcagggggctacacgtccttgccttcagaggactacacgtccaagcctttag

SEQ ID NO: 106737 - DNA, 513 bp, Glycine max
  Peptide Sequence Number=SeqID_223515
atgctttgtatgatcatagcaggtccaaggcagccatggaatgatattgatgtgtatctcagtccgttaactaaaaacctaagaaaattgtgggaagatggggttgatgtgtgggatgggaatctacataagacgttcaggttgcatgcaatggtattttgtaccattaatgactttctagcctatgagaacttaagtggatatagtatcaaaggatatcacgcatgtcctatatatgagaaaaatacaagcttcatccaactaaaacatggaaagaagactatatataccaggcaccaaagatttctcaaacattataatccatatcggcgattgaaaagagccttcgatggaagtcaggaaaatgaaagtgcgcctagtccattagctggcaaagaagtttatgatcagaaaaatgtttgtgattctttaattggcaccctccttaacattaaaggaaagacaaaggatggtttgaagtgtcatcaagacttggttgacatgggtatatga

SEQ ID NO: 106738 - DNA, 678 bp, Glycine max
  Peptide Sequence Number=SeqID_223516
atgtcgtatggtgctgttgtgacacaccagtcgggatcttgcacctcgctcattcaatcaaatcagcgcgtggcactaccatctgttgacggtagaggaagaataatgagaagtggtgaggcagtcagagaaatggaaatgggttcagtggtggttgaaaaagtgggaggcagatcatctgtcacaagttgcttctcaagataccccctcaagttcatcatacccaaaaaggtgggttcttccaaaacagatgctgtatgggtttatgccctcaactatggaggtggaattgtatctgtttacaaatctgtgggatccaagtgttctcaacaaatattagaggctagagttggaagcaatgcacttttagctatcattccagatccagtaacatgcttttccactgcaagatactgtcagaaacaagtcttctgtgtgttgccagactcaaatttggtcatggttgattggattacaagtgggcgccatgaaagtggagaaaaatgggattttgatctatatagaagcactaataatatattcttagaagatggtcaacctttatttctggatacggcagcaggctcaactaattatctttattactgtttgggaatgtgcgatcttaaaaaggagaggtttattccttatacaagatttgtccttgttgttttgtga

SEQ ID NO: 106739 - DNA, 144 bp, Glycine max
  Peptide Sequence Number=SeqID_223517
gttcactgcgaaggatgtcagggcatggctcaggatttaggagcgattgctgaggatttggagtgggtcatcaacctcaggatggtcactgagggcactgacttacatgacatcatgactcattcgttgtctaaggagagctag

SEQ ID NO: 106740 - DNA, 793 bp, Glycine max
  Peptide Sequence Number=SeqID_223518
aaacgctaacgaagacatgaagctcaaactctcgttcggttcaaaatctgagaagcttgtgattcctccaacatccatcaagggacaacaacaacaacaaccccaaaatgggtggtcaacggctcggtcaacgaccaccttcactgaccatggtacggtccttgttcgtttgttgcttcaggatttgtgttcgtggttgtttttctctgctttgtttgattggtgggtgggtgtccaagataaatgtaatcacaattgtggttgcggtgatggtgaaaaccttgatgttgtggccaaaatcgcggttgtggactgtagcaaagaggaagccttttttgattccaaggcctggttagactcagattgtgaagatgatttctatagtgtcaatggtgactttacaccatctagagggaccacaccagttcaccacacttttgggaccccttctaggaatagaattcatggctctatggctgaaacatccccagaaaagaaaaagaaattgttagagctttttcgcgaaagtgtcaaagatgaccaaggtgatgttcatggacacaaagaagtcaagccaactatacaagatgttattatgcctaaatctgcacattgcactccttatctctcagaggctaactctgcctgtagtagtgaaaggaccatgagcatgagcgaggatcgttcatccattagagagaaatcagtcaagtctttgcagtggtgcattccaagcttgtcttcatgccgaagctttcgcgagaggaggccaaagacgagtcctgcagtagaa

SEQ ID NO: 106741 - DNA, 624 bp, Glycine max
  Peptide Sequence Number=SeqID_223519
atgccaatgaaaaagctacttttcttagaactttcaggagttggaaaacaaaaggatctaaatgagctgaatgaacttcataatcaccaaaaagaagaaagatatgatctttggagagaatgtgcacaagcacacaaagattatgaagacctcaaaatgagtaaacataatctttgggtggaatatgaagaacacaagaaatctatgagtttcttgaataataagcttctgaagaatcaagaatttaagggtagtggttgctcgcgacacatgacaggagaaaagtctatgttccaatgtctgactttctatcacggtggaacaatcacttttgaaggcaatcaaagaggcagaataactagtgtaggtcttaaacacaatcaacaaagcataagtcaactatgtgataatggatatggtgtctccttcaacaaggatgagtgtgtcatcctatatgatgatgggtcccttttattctctgccaagagaaaaggcaacctctacaaaataagactggataatgtagctccatgtagagcttgtaagcctttgatcttctttatcaatggagtcatttgcttcttgaagatcaatggtagtagaatggagaaggaggaaaggtga

SEQ ID NO: 106742 - DNA, 609 bp, Glycine max
  Peptide Sequence Number=SeqID_223520
atggataaaagcttgaaggtaggagaagatgagtggagggagggagagagaggggaacaaaattttaagagagagaagaggcagaatgagctatggtttatcccactaatccaagatcaaatccaagattctccactaagtgtacttaggtgtcatgaggcatcccatgggcccaaaatctaccctaaggctcatgagaaccctagggccttctcttgcatctctggcacaatcttcttggagtcttctatccaatgcccttggggggataggattgcatcactaggggaaatctcaaatcaaaaagtgtcatgcttactatctatcaaagaaatcattggttatggcataaaaatcttggccatgcaagttggaggtcaatctccaaactgcaaaaaaacaaccttcttgcttgtggagtttctatggaagatggatcttggagcttcaatgaggtccttcaatggtgatttttcatcatggagatgcagtggaaggcaaaggagaagaggagaggggaggcaccatccactaggaaataagccaaggaagaaggagcttcaccaccaagaattgccttggataagaagcttgaagaggatgctttaa

SEQ ID NO: 106743 - DNA, 306 bp, Glycine max
  Peptide Sequence Number=SeqID_223521
atgtgggacactctggctataacatacaaagacacatcacaacaagatgaaggtctcaaaagagagaagtctctggctatcaggagtcagaagaacaagaaggcatcatcatccagagatcaagtcttgcgaagttcatccaaagcacttaaagtcaatgattcatctaatgatgaatctggagaagactcggatgaagatgagctcgccttcatctctcgcataatctcgcaatatatagagaaacaaagatgggtccaagtggagaaactcctcaagaagaatgctctgagacaagaagaataa

SEQ ID NO: 106744 - DNA, 402 bp, Glycine max
  Peptide Sequence Number=SeqID_223522
atgaaggttactttagaacaaagcttgaaggaggctccccaagcggacctgaatgctatacataaaaggaaacaaaagaggctagccaaggccatcgctgatgaagaccaagatgcccctacaccaaagagggaaaaggaagtccaaccagtctctgaactccaggcacctgtcatcctctctgctatttcaagatgcattaaaacaagggagaccaaggccaacctagagattggagataaagaatgggcagtttcctttactagaaacaaggaggatctaacctctcaatcatcagatagtgagtctgcggatgatacttttatctttaccctctgcaaacatccattgtccactcaactgtgtcctcctcaatcacctttgcatctagatagatactga

SEQ ID NO: 106745 - DNA, 207 bp, Glycine max
  Peptide Sequence Number=SeqID_223523
atgtcccttgaaaagcttgttggaatcttgatgaaaggaaattccctagctcttagcatccaaaagacaaagaagggtccagagtccaaagattcatcgtccaacccatcatccaaagcactaagtgctgacagctcctctgatggagacttcaagggagaatttgaggaggatgataagctttctttcatctcaaggaaaatttga

SEQ ID NO: 106746 - DNA, 379 bp, Glycine max
  Peptide Sequence Number=SeqID_223524
atgttgagcccagctaagccaaactcttcctccttggatagtcctctatcacctaagacgagactttggcgcttcacggactctaaggcttattctattaagtcaggatactctcaagtgattaaaaagatgattgtggagattaagttcattcctaaatgtgtccactttgtgtggaaagtgtgcaaagacattctccttgtgagacaaaatttgtctagaaaaggcatggatgtggacccaatttgtccaagatgtggccaagcggaagaagacatagtgaatgcgttcctgctttgtgatgaagtgaggagaatttggtttgcctcaacttgggaggaagaatcaaagttggtcaaggatcttcctttgcgggctg

SEQ ID NO: 106747 - DNA, 375 bp, Glycine max
  Peptide Sequence Number=SeqID_223525
aactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtggtgtccgggtctccaaggtgaacagcctctgggtcgatggaacaatgtag

SEQ ID NO: 106748 - DNA, 1341 bp, Glycine max
  Peptide Sequence Number=SeqID_223526
atgtctggagctccaagattgaggtctatgaatgttgctgattcagaggcaaggcctgtgcttggaccagctggaaacaagactggctctttgagttcaaggaaaacagcttcaaagccactgaggaagaaggttgataagttgctggatgagattgcatcagtcaaagagaagaaaccccatcaagtgttgttgtcttcagttgccacttcctctccacagtcacattcagccagtgtttctttgctgctcccccggcatgagcagttactgcattctaatctgtccctgaatgcttcatgttcatctgatgcctctacagattcatttcatagcagagcatctaccgggagattgactcggtcttatagcctaggtagcagaaggaagccctatgtgtcaaagccaagaagtgttgcctctgatggtgtgctggaatctcccactgatggatcacaatccaacaagaggtgtgcttgggtcactcctaatactgaaccatgttatgctactttccacgatgaagaatggggagttccagtacatgatgacaagaaactatttgagcttcttgtactttcaagtgttctggctgaacacacttggccagccattctaagcaaaagacatatttttagcttcaaatctttactatctgtctgcttgaagactttgtcctcatctgtagcctatttcctcgactatgtttacatcatttttgttaataaggctctttacagggaagtttttgtagactttgagccagttgctgtgtcaaaactgaatgagaagaagataatgacaccaggaacaattgcgagctccctactttctgaagttaaattgcgtgctataattgagaatgctcgtcaaatatcaaaggtagattggagctttttctataatatttttgaaaaaattgtttcattttctgcatttatctttggagaaattaccaaaaataggaaagtcatagatgagtttgggtcctttgacaagtatatttggagttttgtgaaccacaagcctatagttagcagattcaggtatccaagacaggttcctgtgaaaacaccaaaggctgatgttattagcaaagacctggtgaggagaggtttccgaggcgttggccccacagtggtatattccttcatgcaggttgctggtttaaccattgaccatcttatcagttgcttcagattcgaggagtgtatagccgcagcagaagggaaggaagagaatggcatcatggacaatcatgctgatcagaaagagagtgaaaacatcatggaatcagatctgtctattgccatggaggacttgagcttcgcctctgaatga

SEQ ID NO: 106749 - DNA, 291 bp, Glycine max
  Peptide Sequence Number=SeqID_223527
atgacccctactcatgatgcccttctatattacaatgggaggtggaacatgccacgccaaaacaactttgtaggttacgcgtttacaggaaaaaatccaaaaaaatttgacattcctttagtatgtaccattgatgaactgaaggatttgataaagcaagttgcacctcaagggattccccctcatggtcatttggagtattcagacaaagttattaaatttgaaattattgagttgaaaactaacgatgacgtgatgaaggtcttagtacaatctaactattggaaataa

SEQ ID NO: 106750 - DNA, 885 bp, Glycine max
  Peptide Sequence Number=SeqID_223528
atgaaggatgttttgttctccctcttacttttcatgtctttttgctccgtatatttaaccacaacattagcccaagcacctgatacagccccatcaaaaccaattgtccaaacactaccccagtcaccctcttcagatacctctgattcttcccctgatgacatcatcagaatattaaggaaggccaaatcgttcaacgtcctaattcgcctactgaaaaccacccaattgatcaaccaaatcaacgctcagctcataaccataagatcaggtggcttaaccatctttgcaccagatgatggtagcttttcacaactcaaagcaggattcctcaactctctggccgacaatcaaaagatcgaacttcttcagttccacgttcttcccacttatgtttcaagttcaaacttcgattcgctgagcaaccccgtgagaactctggctggggataaccccggcaggttgcaactaaacgtgacagcatatggcaacaatgtgaatatctcaacaggagtggttaatgccacggtcacaggagttgtatactcagataaggtgcttgcaatatatcatgtggacaaggtgcttcttcctttggatttcttcaagcctaagccaccagctcctgctccctctcctgcaatggcaccaaaagctgataatgataactcatctgctgatgctcgccttggaacatccaaagacagcgctggagcgtgcagtttgcaaaatcaattccataaattgttacttggtctcgagctaacagttttcccatttttggcagaacttattcaacctattggatttggattttactgggttgaaggtgcactgtgggaggattcaaagagaatgtccaagaatgaggagtatgacagctga

SEQ ID NO: 106751 - DNA, 336 bp, Glycine max
  Peptide Sequence Number=SeqID_223529
atggatcaggaaatagaggagacattgatacagatccagagtacaactgtacaaataaattcttgcaattcagcaattttggtagttaagacttctataattggattggaactccaccaactggaattctgcagttcctcttccaatggtattagttggaaaaaggttgatttttctttttaccatattagtgcagcgtctctttgcatatgcaagggtaaggctgcgtacaatatccctcccccataccttcgcatagcgaagagcctctgggcaatggggtacgaagaagagaagaagaagaagaagagctcccctagcatccctcttggttaa

SEQ ID NO: 106752 - DNA, 315 bp, Glycine max
  Peptide Sequence Number=SeqID_223530
atgagccatatcaggacaataattaagctcgaagatcctgatttgcgtgtttcaaaggacgcgttgatggccgtcaacactgccgcggtaggtttctattcgttctcatctttctcgatgtctctatccttcgtcgcttcccttttaatttccttgcaggagacgttcgttgagcaatttgtgcaagaagcttatacctgttgtgctgaggaccgcaagaaatgtctcagttatgatcacctagattttgttcctgagagagtgaaagctgaggatgcattgcgtgagagaagtgcagcaggcaaaggaggatga

SEQ ID NO: 106753 - DNA, 180 bp, Glycine max
  Peptide Sequence Number=SeqID_223531
atgattgtgaaaaagaggctaagtcatgaagtgctaaaagtgatagttgagcttagctcatcaattgggctaagcgcgcatccaccgctaagtgcagtttcagcgtgcttagcgcaacagaagaatttggcaaagcatcaatatcaaggtcgcacgctaagcgcgagatcagtgcgctaa

SEQ ID NO: 106754 - DNA, 99 bp, Glycine max
  Peptide Sequence Number=SeqID_223532
atggataggaaaatgcaaggatcatgcattagtgaacatgacatgcgtacaatggaaatggaatatatgcagttagtagaacaaaagcatgctaaatga

SEQ ID NO: 106755 - DNA, 198 bp, Glycine max
  Peptide Sequence Number=SeqID_223533
atggattctaagattaaggtggtccactatgcactatgcatcacacttaaattcctagattcatcaagaggactatctagaaaggtcaaggataaaggacttgaagaggaattgcgtaaaaagatcatgcaaggaatgctcatgctatccaaggatcagggagaaccaaagggggtaaattggtgcaatgactcttga

SEQ ID NO: 106756 - DNA, 408 bp, Glycine max
  Peptide Sequence Number=SeqID_223534
atgtcacgaaaccttacggattacgcaatcatcccttctttggctttcggaatggtacgaaactttacagattgcgccttgacacgtcctttcaactctcgacatgtcgcagaacttcacggattgcctaacgatgggtgtcaagtacctcaaagtggtgaagcaagggtcacaccccaacaaacagataatccccagacgaaattagggcttacttgcatccttaactctaactacaaggcacgtcttgttgctaaaggctacattcaaaaggaaggtgttgactacaatgagattttttctccagtggtcagacacacttcaattcagatcttacttgctcttatggcaattttggacatggaggtagagcaacttgatgtgaaaacaacttttctccatggatag

SEQ ID NO: 106757 - DNA, 890 bp, Glycine max
  Peptide Sequence Number=SeqID_223535
tctcaaaacaacgaaagcaagtgacatcggacttgccgtctctagacgacgaggtgcagataaccgtaaggaaaggtgctgatgatcacattggtctttgcatgtcatcgaacttggggtctctgaatgacgagatgcggataaccataaggaagggtgcaaatgaccacattggtctctgtgtgttatcgaacttggggtctccgaatgacgagacactgaggtctccgacaaagggtgcagatgaccatcttggtctctgcgtgtcatcggacttgccgtatctggatgacgaagatgaccatattggtctctgcatgtcatcggacttgccatcttcggatgacaaggatgaccatattggtctctgtgtgtcatcggacttgccgtctccggatgacgagggtgcagaaaaccgtctccgacaaagggctcagatgaccatcttggtctctgcgcgtcatcagacctgtcatctctggatgacgagagtgcggataattgtgaggtgtctccgcgtgtcatcagacttgccatctccggatgacgagggtgcggataatcgtgaggcgtcttcgcgtgtcatcggacttgccatctcggatgatgaggttgcagataaccgtgaggtgtctccgcgtgtcatcggacttgccatctccgggataatgaggttgcggataatcgtaaggtttctccgtgtgtcatcggacttgccatctttggatgacgaggacttgccgtctccgatgacgagggtgcggataaccgtgaggtgtctccatgtgtcatcggacttgccgtctctggatgacgaggatgaccatatttttctctgcgtgtcattggacttgccgtctccggatgacgagggtgcggataaccgtgag

SEQ ID NO: 106758 - DNA, 362 bp, Glycine max
  Peptide Sequence Number=SeqID_223536
atgatgattcatacattgatacttatgcctatggctactccacctggctcgcctcctcctcctcctcctcttcctgcagtagtatcacagtctctgtctaccttgaagcggacacgcaaagccacacggctacgatccttggcgactagaccacttggggcagatagatcggtggtccacatcgatcctgcgaccgggaaggacgacgatccccacaagaagaaattaagaatatatttggggattgtcgctcatgataagccgacaaggacagtgtggatgacactgtttgtgaaaaatacgacattagcaaggagaaataggcctagttttgttagacccgcagagacccctcgtgggag

SEQ ID NO: 106759 - DNA, 1146 bp, Glycine max
  Peptide Sequence Number=SeqID_223537
atggaactcaaacacataggtgaaactaataaagaattatcagagccagatgatttctttgtggaattgagattggaagaaggcataagcgacaaagcatcaatcaacaccaacactaaagttgcaacatctagtcaatatatggatgaccctcaagaagaaatcatgtttaaacaaggtcatcactcagatcacagggtgaaggcaatgcaagatgagaactgggtgaaggctatgcaagaggagctcgaccaattccaaaagaatgacatatggaagttagtagagctaccaaaagacaagaaggctattggagccacgtgggtcttttgtaacaagctggatgagaatgaggaagtttatgttgaacaacctcttggatatgaaagtgacactcttcctcatcatgttttcaaacttaaccaaacattgtatggactcaagcaagctcctcgagcttggtatgaaaatttgagttcttttcttttggaaaatggctttaaacaaggaaaagttgacacaacttcttttcataagaactatgactttcagtttatattagtacaagtttatgttgatgacattatatttggtgccagtaatgaaatgctgcgtgaggaattttccaagctgatgcagacaaaatttgaaatgagcatggtgggaaagcttatgtttttccttgaactgcaaataaagaaaacaagcaatggaatttacattcatcaaaccaagtatgtgaaagaacttatagagaagttcaacatggacgatgcaaacgaaatgaaaatacctatgcatccaaccctataccttagactagacgaagaatctataaagctggacgagaaccaatatagagcaatgattggatcacttctacagttaacaacgcctacaccaaatataatgtttagtgtttgcttatgtgcaaggttccaaaaagaaccaagggaagtccatttatctgttgttaaacatatttttagatatcttattagaactttcaatcttggtctatggtttaagagaagggaagatttcaaactcacaagttactgtgatgctaactatgctggagataaacttgaaaggaaaagcacaagtggaagttgtcactccattggtggaaacttattaacttag

SEQ ID NO: 106760 - DNA, 417 bp, Glycine max
  Peptide Sequence Number=SeqID_223538
atgacaagagaaaggtgtatgttccaattcctaaatccctatcatggtggaaccgtcactttcagaaggaataaaaaagagcaaataataggagtaggactcaaaaagaatctgttgagtataagtcagttatgtgatagtggatatgatgtttactttaacaaggataagtgtatcatccagaataaggatgggtccttactcttttctgctaagaggaaaagtaacctctataagatcaagttgggtgaactatcaaatcaaaagagtgatgatggaacatttcttggatactctgaaacatctaaggcatacatagtttataactctaaaaccttggtagttgaggaagctattcatgtgaagcttaatgacactgagcctcagcgacaaagcatcaatcaacaccaacactaa

SEQ ID NO: 106761 - DNA, 780 bp, Glycine max
  Peptide Sequence Number=SeqID_223539
atggacccttctcaggaagtagaacctccaaaggccattgcatatccacctaatttgtacatctccaaggccactgaaattaagataattgcagataaattttgttgtcatctaccgatatggaatgcaacaaagaagaaaggattcaagctctatcactatgctaagatgcccaatagtaaaataaaggtggaagtgattgtgaggaattacacattaaaagcttcatcattcgactatgatggaagtgataatgctgaccaccacaacttcgtccaattaccacgtcctgttaagacgtatcactttgattatgcttatgtgtgcttcacaaaggacactgatagttatgccttcatcaccaggttgaagaaccttcccatcatcttcaatgaaaccacttatgatcttacgaagatggatgaaagggacttcaaagatcatgtgattcaactccatgatgctcaaaaggtaaggagggagaagtttgaagaggagcttgctggaagaacaaatgctgaaaaactccaagttgaagctattgctaaggttgtggacaacaacattattaatgagaaagaacctgtgtccaagcagttagaaaccttacatgaagctacatccaggaaaaaggatgttcctgatgcagtgattgtctattccacaagctcatgtctcccacctatcacctatgcaccttcaaacactatgaccagagatcaagttcatgattggtcaagcagcacatttgttgagcgtcacaaacaagagaatgagtaa

SEQ ID NO: 106762 - DNA, 234 bp, Glycine max
  Peptide Sequence Number=SeqID_223540
atgcactttacaagaggaggttgttttggtaacggtgaaaatggtgatggtggtgtagcttctgttggggcaaatggaacacttgttgttggtggttcctcaatagcaggtggttgctggatagatgaaggtgaaggatcgaattatgatgcaatagcaagcgcaacaacgggaggtgcaacacagctccaaatagagacatttgggcttgttgtatattttgtagcaagatag

SEQ ID NO: 106763 - DNA, 429 bp, Glycine max
  Peptide Sequence Number=SeqID_223541
atgtatgcctgtgtttctcatgtgtcatcaggaaaagctgcgcagtctatatattcatcactcgttgacccccactctctccacggagatagcactgcacactctcacacatccgtgtcgcccaatcgtagcatgtcagagggtgagtccgcggtacaaatgttagaggcaggctcaggggtcactgtacatgtggaccttgatgagcgcgtcggagaatatgttgtgaagatcaagaggagcattaattcaactgcagaaaatgaacataaattggaagagacaaagcaattggctgaaagtgctggaatgttgttagttcaagctgaggtccttcgtcacatgggagagcaactacttgttaagtacagagaatcggttcaacgtgtaatccgaaagcctgcgctcagaattgatttctcaccatga

SEQ ID NO: 106764 - DNA, 408 bp, Glycine max
  Peptide Sequence Number=SeqID_223542
atgaagccacacaaagaagagacagaaatcgtaaacttgggtgttgacgaggaaaagaaagaggtaaagtttcacataggcatgaccacacctatccgagatgaattggtggctctgctacgagactaccatgacatcttcgcttggtcataccaagatatgcccggcttgagccccaacattgtgcagcataggttgcctctgaatcccggctacaccctggtgaaacaaaaattaagaaggatgaagcccgaaatgtccttaaaaataaaggatgaggttaaaaagcagtttgacactggctttttggttgtggttcgataccctgagtgggttgccaacattgtgccagttcccaagaaggatgggaaagtgcgaatttgcatgggctatccaaatctgaactga

SEQ ID NO: 106765 - DNA, 141 bp, Glycine max
  Peptide Sequence Number=SeqID_223543
atgcttccacgcaaaagccccgaggctttcagcctatcctgggataatgaagcaagctttgaagtgcttattttcaccctctcactaagccaatctgctggcttagtgagccatctactgagcgcaacaatccttggctaa

SEQ ID NO: 106766 - DNA, 858 bp, Glycine max
  Peptide Sequence Number=SeqID_223544
atggctccgaagaagctcatagccaagaggtcgaggaaagatgccaccggagagggttccagtgcggccccacagaggcgagtccagttaaggaatgaagaatacgctgagtttcaagaggaaattgcccggaggcaatggactcagcttgtatcacctatggctaagtacgatcccgagatagtcatggagttctatgccaacacctggcctacagaagagggagtcaaagacaagtgctcctgggtgaggatgccattaaccagtttctggggcatccactggtttgggaagaaggccagcgctgtgcgttttcccggaggaggaatcatgcacaccagcatgaccaccgtcacgcagatttggatgacgttgctgcttagcaacattctccccagcgaccataattcagacctccccctgtcgaagtgtcagctggtctatgttgcccagctgatttcggatgctaactatcagtttgcagggattacacctctaagacacccagtggacccagagaagtccaacaaggccctggggtttcttgctctaatcacaggcttgtgccaattctatggagtgccagcaggcatagagttaagcattgcaacagccagaggaggacccacagcagccaactgtggatgcaccaccatcgcctctacaggagataccatccctggggtccatctccaatcacctgaggagattagagctctagatgcgcaggccacagtggcctggcctggagatgaggtcgattttgagacaaggtcgggacccatgggagcccctagggacgatggaggagctcaggaggatgacaacatggttgatgtgctggatttcttcacttga

SEQ ID NO: 106767 - DNA, 456 bp, Glycine max
  Peptide Sequence Number=SeqID_223545
atggaagaaagttcagggtttcctgtgttatttggtggtgaaaattcaaaccctcctgatgatggtggcaaagacaagattctggggctgcaacttagtgcaagacttcaaaacaatggtctcaaagataagatatttctagggttggaacttattgcaagacttcaacaccgcaccagaggtttaagacatttaactaggatacatggtgtggatttgacgaacgaaactcaggatacatgccccaagagatctataaagaaagaaatatatgaagatgtgctgggaatttcttattccacggtgagtcaatcagagaaggttgtggcacatgatctgaaagagccacattctggtgcaataaagaccatgtcagctagcaggaagctgaacacaggagaaaaaactgtgctttcgtggatgattgaaactggaacaatactacaacatgagaag

SEQ ID NO: 106768 - DNA, 156 bp, Glycine max
  Peptide Sequence Number=SeqID_223546
atgggaatgactcgcgtgaggagaccaaagcttttgatgctccgccagccactccgtaaagtactgattgaaacctcccaggatagattaggcatcgaacaaagcagcgctttccgcttgtcccgggctaggttaaggacgacgacctattggtag

SEQ ID NO: 106769 - DNA, 726 bp, Glycine max
  Peptide Sequence Number=SeqID_223547
atggcgaccgttatcactttgccgctgatccttttcgtcggctacttgatgctccgcctggaagcggaaaaacgcgacgacctgcagcgcgagacgatcgaggatgtacgggtcgtcagccgcaacatcgatcgccgtctgcaggaaatcgccacctcgctcaatctgctgtcgcaatttcccgaactcgagagcggcaatctcgccgcctttcagggacgcgtagcagacagcctgaaacgggagggtctttatgccattcttgccaccaaggatggccagcagcatctcaacacccgtgtgcccttcggcaagcctctcggcaaggtgccggccgaggccgatctcgccaaagcgatagaatcccgccgtataacggtatcgaacatttttttcggctcaaccagcaaggaatgggtgttcaacgttaccatgccgctcgatccggaactcgggtctgccggagacgccctcatcctgacgcagaatgccagtgacctgagccggctcatctccaccgagaacctgccgcgaaactgggcggtcgctatcatcgacggcaccaatcgtgtcgttgtatccaccgctcctgacgaggcggcgattggcaatccgttcgtcaccccggccatactatccgaaatgcaggccttcagcggcaattttttcgacggcaagggcaatctttacgcctatgcgcaattgccgggctggcagtggaaaacc

SEQ ID NO: 106770 - DNA, 255 bp, Glycine max
  Peptide Sequence Number=SeqID_223548
atgtcgtaccggatgtcacgacatcacgcttcagaacatgcagattatatgtgtccgtatgaacagattaaacaaggtaccatcaaggtggctcacaaaacactcaagtcccaaaactcacaaaataactcttcaatcccggacttggtacagaactcgtgcagcctccatgattatatagccgtgtacgattctgggctgcaactccttgatgctggaggagatctatcttcttctgaaaaatctgcagtttaa

SEQ ID NO: 106771 - DNA, 327 bp, Glycine max
  Peptide Sequence Number=SeqID_223549
atgacttatcaaggtaatccttgtggcgtctacccggacttatcttccttcaccggaagtggcgtctacccagacttatcttccttcaccggaagtggcatctaccctgacttatcttccttcaccggaagtggcgtctaccctgacttatcttccttcactagaagtggcgtcatccaaaaaaaaactcttcaacctgtatcaaacgatccgctcctactcaggatcgcatcactttcagggcagacgtcggctaacatttttttcgatcagtatcggggaatcatgatttttgtgccgaggttggttattgtttggcatgcctag

SEQ ID NO: 106772 - DNA, 240 bp, Glycine max
  Peptide Sequence Number=SeqID_223550
atgggaaagaaaaagctggagttaggcattgataatcagaaaatcagcttcgagttgtttgatgaagaaaaacatttgtcggaccaaaatgtttgcttacaggtgaaggagtttgatgagaagaaaaagaacttacaaaaaatttcaggtgttcactcgctaagcgcaacacttgcgctaagcaccaagtcttcatgcgctaagcgagctattgctcatgctaagcacttggacccctaa

SEQ ID NO: 106773 - DNA, 234 bp, Glycine max
  Peptide Sequence Number=SeqID_223551
atgatggaggaaaatacatctccaattgacaaaggacaatggcaacctcattctccaaatcatctaattttcgaggacattgacacaaacttctcttctctattattgacattgtgcggcatgttgggggcaaatacgttcatcgatcttgtgatattggatgcaactgctctcgtattcccatgtcaaccaggtcttgacgacatttcaaaccatcccttgtctttcctttaa

SEQ ID NO: 106774 - DNA, 279 bp, Glycine max
  Peptide Sequence Number=SeqID_223552
atgttgtctagaattcaattccgcacattgtcaccgttgggatttacgataaaatattcctggagagagaataaggaatcgcacgaagacagtaaaaatggaggcttcaatcccttctccgtttctatgacgtttaggaattctatcggaacagtcggaggaaaagctagaggaatcaatagagatgctattatcgctgtcagaagacacgtgatcccgcttagaggggttggacctgaatcaagagggaaaggccttgacggactcttcagagtgtag

SEQ ID NO: 106775 - DNA, 615 bp, Glycine max
  Peptide Sequence Number=SeqID_223553
atggtgtgcggtgctgcagttaaccaaagaacgcgttcaggaagactccaccttcggaggaaatccgatgaaaaatggacaaatgaggagaaggcagcctttcttcaggctgtatcgtctttcggcaatgattttacgatgatagcacagcatataggaacaaagtccaaagatcagtgcaagaaatttttcatcaagggtcacaaatcccataggttggatctcatccaccacagacttgaaaatattggatctctactaaatgaagtaaatctcagcagcagtactaacactaactatgcccatgtatgggaggcagattcagtcattgacaatgatgagtcaggcacaaaaacaaatgatgaccagccttcatcggtcgtgaactcgagccgtgataaatccaaacctatggaagccatgaatctttcagcttactttaaggaatcagttattggcaatgataagtcaggcaccaaaacaaatgatgagcagccttcatctaccatgaactcgagccatgataaatccaaacctgtggaagccaggaatcggtcacctgacttaaatgaatcaaatgaaattaatagagaatttgatcatcacagaacatag

SEQ ID NO: 106776 - DNA, 726 bp, Glycine max
  Peptide Sequence Number=SeqID_223554
atgttttcaatgttcaattctagtaatgagctggttgaagatccattggcagttgagagagaaggagctatgatcaaccgttggacattagaggagagaaatattttctccgagaaattggcagcctttgaaaaagattttaaaaaaattgcttccttccttgaccacaagacaactgctgactgtgttgaactctactacaaagatcataagaccaattgtttagagaaagataagaagaaaaagaagaagaagatgggttgtaaaagtcagaagtcaaaaacatccacaactaccttaaccaaagaacgcgttcaggaagactccacctttggaggaaatccgatgaaatggacagatgaggagaaggcagcctttcttcaggctgtatcgtctttcggcaaggattttaggatgattctacggcatgctggcttacttggatcaatctcggtgctcataagctccagcacaatgtttcttgttcctatcctatcattgatggcatccaaatgcttcaagatagtctctttgaaatcctatttgattttattcctcactatcaccaccgctctgactttgaattgtactggtttctctgcatgcactgtcagtgtggtctttatcaaatcctcactaatagctgccatcggaaactttgctcccttcctcaacctcacaactcttgtgttttccgtgggaaacgggttagaaaagatccagaag

SEQ ID NO: 106777 - DNA, 477 bp, Glycine max
  Peptide Sequence Number=SeqID_223555
atgatagcacagcatataggaacaaagtccaaagaccagtgcaagaaatttttcatcaagggtcacaaatcccataggttggatctcatccaccacagacttgaaaatattggatctctactaaatgaagtaaatctcagcagcagtactaacactaactatgcccatgtatgggaggcagattcagtcattgacaatgatgagtcaggcacagaaacaaatgatgaccagccttcatcggtcgtgaactcgagctgtgataaatccaaacctatggaagccatgaatctttcagcttactttaaggaatcagttattggcaatgataagtcaggcaccaaaacaaatgatgagcagccttcatctaccatgaactcgagccatgataaatccaaacctgtggaagccaggaatcggtcacctgacttaaatgaatcaaatgaaattaatagaaaatttgatcatcacagaacatag

SEQ ID NO: 106778 - DNA, 444 bp, Glycine max
  Peptide Sequence Number=SeqID_223556
atgaaggctttgctaggttcccaagatgcttgggaggttgtagagaaaggttatacacaacatggaaatgaggattctttgccacaaaatgagaaggagactttgttgaagatgaagaagaaggatcaacaaaccttcatctatcaaggtttagatgaaggcatgtttgagatggtgaccaatgcctccacctccaaagaagcttgggagattttgaggacatcccttgaaggtgttgacaaggtgaaaaagatgcatctacaaactcttcatggagagtttgaatccttgcatatgatgtctgagtcaattttggattttgtcaataaggtgtgtaaatccaatgttgaagaaaaagttaattttgttgatgagaaagaagatgaagagccaacactattgctagcacataatagtgaagagaatgatgataagtgcttgtga

SEQ ID NO: 106779 - DNA, 990 bp, Glycine max
  Peptide Sequence Number=SeqID_223557
atggtacaagctgatggattcaaatactatgatttggatgaagccaaaggtctagtcgctgaaaaaggaacaagtgttcaagaacataacataaatttcttttgccttcaaatctcttcgacatcgacatcagcaccattgtcacggccatcattaggtggctcgaggatttggagattgttgattatgaaaaatgctatgagactccatgcctcatatgttaaggagaagagagggtttggcgagagttgttttgtgagaaatgatggggttgctgctacatcgaacaattttgggtttagaacaatgctattagattccatgcctcatgtgttgaggagaagagtgggtttggcaagagttgttttgtctagtgatgttgtgggacagggtggaggaggaggcaggggtgatgagcttgctccccactcggccttgagtttttctcttggttacctaggtttgtctaatctgcttgttgttgaaaggaaaaagaaagacaacggaatccataagacctggagaaagtgctcgggtttttcattcaatgaggtcggttgccttcattcaagaaaaagcaaggttttgtctagccatttttcatcggatggaaaagttttggtaagtgctggacatgagaagaaggtaataagatgcaataaattttcaaattctagttttgtttatccattcagaatcattgcaacttcttcctttgatagatctgtgagactatgggatgcagccagaccaactagttctttgctcaaacttactgggcaagccaatcaagtaatgtcattggacttccacccaagaaaagtggaccttctttgctcatgtgataacaatgatacacttactgtaaaaacaccaagccaactatcatgtcttgatatgatcatgatgaatttcagggaggtagtaaacaggtcagcttgctcttcacccagccttgagtttttctcttggttacctgggtttgtctga

SEQ ID NO: 106780 - DNA, 501 bp, Glycine max
  Peptide Sequence Number=SeqID_223558
atgaggcttcacacatggaaagttgctagacagacccttgtcacgaatgttatgagacatgctaggggcctagtggaaaatgacatgtgcccaaatggtcatggtgcctttgaatccagtattcatgtcttcagggattgtactttgcctcgcaagggtagtcacctggatcatgggcttatagcgtgggaacctccattgcagggtgaactttgggcaattgctaaaggggtcgagattgcttggtccagaggattcactaatcatactgttgagtctgactctaaatttgctatttccatgcttgatggggggtgtgaggaggcaaatttctcgaaatgggttacttttagaaacatattcccgaaatgggtgacagctggcactagtctcgccagtgatgttagcgctttcaggcagcagaggccgtttctgagggtgcagtctgagcaacgcgtagagggagcagggagtcgccaggcacaatggcgagttggttga

SEQ ID NO: 106781 - DNA, 876 bp, Glycine max
  Peptide Sequence Number=SeqID_223559
atggcttcctcaagcaatgtttctacaaccatcagttcaatctacaacaatgtccaagttcctttatttgaaggagaaaattatgatttttgggcaataaaaatggagactttgttcatttctctggatgtcttagagcttgtcaaagaagggtatgaagaactagtagccacaacaaaagctacagccacacaacgtgaagaattgaagaagaaaaaaatcacagatgctagagttctaggcatgattcaaagaggagtctcaatagccatatttccaagaattatgagagcaaaaacaacaaagcaagcaagggaaattttgcagcaagaattcaaaggagattcaaaggaaatcaaagacttatcaactatgtctattcaagggttgatggggtcacttagatcttatgaacaaaggttgttacgatgcattgaaaagtcaattgaaagcgccgaggaagaggtagaaactcccgtcgaagaggaagaggctcctatggaggatgaggaagtagtggaggatcaaataaatggtgtagaatttgcaaaaacaactttcatgaagagaaagattgttggaacaaaggcaagccacaatgtcacaattacaaaatcaaccaaccatatgatgggagataaagatgctttcattgacatgaattcttcattctgcttaaaagtcaaattgggcaatggagaatatgttgaagttgaaggcaaaggcagcattggagtcgcaacaaagatgtatgcttggaaaacaccattgcccaccatttccaaaggaaggagcaagaagaaccaaagaagtgttggaattggtgcacataaacgtatatggtctcatgagtaccttgtctcatgctcaaagtag

SEQ ID NO: 106782 - DNA, 1044 bp, Glycine max
  Peptide Sequence Number=SeqID_223560
atggaatggaagaaagccttcagtgaaccacctaaaattttttgggtgtgtttctatgctcaagttcccaaagaaaataggacaaagcttgaagaagcaaatgtgaagtcaacattattgaaagaagaggtctatgtggagcaacctcaaggctttgaaattgaagggcaagaagaaaaggtttatagattgaagaaaacactttatggaataaaacaagcacctagagcatgggacaacaacattgacaattatttcatggagaaaggctttgaaaagagtaagaatgagcctactttgtatgtcaaaaggcaagccaaccgatataccattggttgtgaatggaaagttgaagaaagaagatggtggagaaaggtagatgctagcaactatagaagcttgattggtaatttattttacctcactagtacaagccccgacatcatgtttgcaacaagcttactttctcgattcatgaatagtccaagccacattcatctaggtgcagcaaaaagggtgctaagatacattcaagacactttgaaccatggaatcaaatatgacaaggaggtggaaacaaatgtaattgacttttgtgatagtgattgggtaggctatatggatgaaatgaaaagtacttccgaatatgttttctcacagggttcaggagcattttcatggtgctcaaagaaacaacaaactgttgtcaaatcttctgcaaaagctgaatatatttcagctggcttagctacccaacaagcaatatggttgaagagaatagttgaagactttggtgaaaagcaaggggcaataactatccattgtgatagcaaatctgctattgctatggctaagaatccaatctttcatggaaaaacaaagcacatcaccatcaaacatcactttattcgagaagcaattgaagaagagaaggtgcagctgatgttttgtaagtcgaatgatcaagttgctgatattttcacaaaggctctacctagagaaaaattccaaaaattgagagaagcacttggagttcaagaatag

SEQ ID NO: 106783 - DNA, 525 bp, Glycine max
  Peptide Sequence Number=SeqID_223561
atgttagacaaaagtgaactcaccaatgagaacccgatgaagaactctcaaagggatcctcctacactcaaagatggtaacccacaagtggagatccatcttgatgctcatcatttgaaccttaaaatcttggttcttggtaagcaacataaccatgacaaaaggataactgccttccaaaacaacaccaaccatctgacaaccatggaatattggtttaaggcaagagcatcattagaccttgatcatagacttttgattgacttcaagaattggatagacttgcccttgtgtgagcttatattttatgcattaaacccctataaggcttcgggtctagatggatttcaacctatattctatagatcttactgcaatattgtgggggatgaagtctggcaacttgtagcaaaggcttttgcaattgaggatttacctcctaagttggttgaaactcttattgttcctattccaaaaattgataatccaacgtctctaaaggagtttaggcccatcagtttatga

SEQ ID NO: 106784 - DNA, 540 bp, Glycine max
  Peptide Sequence Number=SeqID_223562
atggtgaagttctcaaagcagtttgaggggcaactcattccagaatggaaagaggcctttgtggattactggcaactcaagaagaacctcaaaaaagtccaactcttaaataacgccaacaatacacaaaacaagcaccaagctagtacttctctacctaagtacatcttttcatcaataagaaactactctctatttggccaccaacatagagagcatggaccaattcaagtccataggaaacttgcctcatcatcttttaatggggacatgtatgagactgaattgcttgagcaattttctgacactgatgctactaaagaattttttgcatgtctggaccagcaactaaacaaggttaacaagttctatagaacaaaagagaaagagttcatggacagaggagattccttgaaaaaacaaatggaaattctccatatgctcaaaaccacattcaaggagctgcagagcaaagcaggctcttctcatggctccaaggatgatcaatctatctcatgcacattctctaatggtacataa

SEQ ID NO: 106785 - DNA, 222 bp, Glycine max
  Peptide Sequence Number=SeqID_223563
atgagagggagacttgagaatggaaaaagtgactggtacacaggtaggagggagatgggtgcaagggttgggaaagaagaatttgggcacaagggttgtgctagagctttaaaggcctttcctctagaaccaacaaagtctacaatattttatgtccatgtggatggtcttttgaaactagttccttaccctttagatatggaaaatatgggtgggatctaa

SEQ ID NO: 106786 - DNA, 1743 bp, Glycine max
  Peptide Sequence Number=SeqID_223564
atgatggacactactagcacagatgatttggaaaaaaatgaagcaccattttcagattcccctcgtgcagaagaacttgccaagtccatgcagattaaaagagaaaatggaaaattgaaaactctttctggccgtgtaatcaattgccaagggaagaatctgaggataaacattcccttgacgacaccatcgagaaccttttcagccataagctaccttctcagggaagatttgctcaatcagtcttcaaggcaatgtggtccagaaggtgtcaacaacattcacctaaacaaaactaatttgcaccatgctgaaaagatgatcaaaggaggtttcattgaactctacaaaggactaggatatctcaaagtttactggaacttgaacatgcttgcatttattaagattctgaagaagtttgataaggcaagtgaattaagggcttcaaagttgatgttgaagatagtcactgaaaaacaaattcttcccatctatatcaaagtggtcgagagttcgtatttcaatagctcagacaaggtgatgaagttagccgacgaagttgaggaactgttcataaaaaattttgccgaggaaaatcgaagaaaggccatgaaatacctaagaccaagccaacgcaaagaatctcatgctgttactttcttcattggactatttactggaaccttcttggcacttcttgcgggatatgctataatggctcatgtgactggtttgtatagaccacatcaaaattcagtgtacatggaaactgtctaccctgtgcttagcatgttcagccttgtgttcctacatttctttctttacggttgcaacactcttgcatggaaaagaactcgcataaactacagcttcatttttgagcaagcccctaccaaggaactcaagtatatagatatattcttaatttgcacaatggcaatgagtgctgtggttggggtaatgttccttcatttgactctactgacaaaagggtattattatgccaaagttcaagacattccctggcttcttcttctggttgtcatgctggattttttcatggctgatcaactttgtagtcaggtgccaatgctcaggaaccttgagtatgtggcatgttactatataactggtagctacaaaactcaggactatggatattgcatgaggacaaagcactatagagatctagcttatgcagtgtcatttctaccctattattggagggctatgcagtgtgctagaagatggtttgatgaagggcagacaagccaccttgtgaatctaggcaaatatgtatcagcaatgttagcagcaggagccaaagtggcttatgagaaagatgggagtgtaggatggctttgtgttcttgtgatcatgtcaagtgcagcaactatgtaccaattgtactgggactttgtaaaagactggggtttgcttcaaatgaattccaagaatccatggctaaggaatgaattaatgcttcagagaaaagccatttactacttgtcaatgggattaaaccttattctgaggcttgcttggttgcaaactgtccttcattcaagttttgaaaacgttgattatcgagtaacatccttatttttagcttctcttgaagttatcagaagagggctatggaatttcttcagattggagaatgagcatctaaataatgctggcaagtttagagcagtgaagatagtaccacttccttttcatgaaatggatgaagaagactaa

SEQ ID NO: 106787 - DNA, 306 bp, Glycine max
  Peptide Sequence Number=SeqID_223565
atggctaaaactaaaggcaagaagatgaagagcattaggcacagacctacaaccctaaaaacaatatcacaaaaggaaaatgagcctacaaagggtcactcttccaataagggcaaaaggacaacatggtctccatcaccaccaccctctccaaaggtcacttcatggttttcaaaggaacattatgaagtgtcctacgtaactcttcgagtatcatgggttgaagaagcttgtggagatgaagggcacatctaccctgaattgattttgtatggaaccttaggagctttccatgtttcgaaataa

SEQ ID NO: 106788 - DNA, 168 bp, Glycine max
  Peptide Sequence Number=SeqID_223566
atggcaagcatgtgggtggtccatgagtcttcaatgccatggtgtcttgatgtgagaacaatgggtccaaagaggtttagtgacgaggggaatacatacataatggagcatggagattcagtaaggttcaatactaaaccggtagcatctaacaacacgtttggatag

SEQ ID NO: 106789 - DNA, 840 bp, Glycine max
  Peptide Sequence Number=SeqID_223567
atggaaaagaatcacttggcaagtttgatgcaaaactcgatgaagggagtccaagggaagcttctccatggagtgaagaggtggaataaagcaaggctagtagtcaagggctataaccaacaagaggatatagactttggtgaaacctatgcaccagtaactagatttaagattttataccaaatggatgtcaaaaatgttttactaaatggatacattgaagaggaagtttatgcttcccaaccttcattctttgaggatcataaaaatccaaatcatgtatacaaccttaagaaagctctttatggacttaaacaagtaccaaagcaatggtatgaaagacttaataacttctttcttgaacaaaagtttgagagagttatagttaataaaacacttttcattaaaaatttctctcacaacattttacttgtgcaagtttatgtagatgacatcattgttggttccacttacaaatctcttaatgaagattttgtgcacaagatgcagggagagtttaaaaagtcaatgatgggagagttaaattactttcttggtctccaagtgaagcaattggaccatggaacgtttattcatcaaacaaagtactacaaggacctcaaaaagtttgagatggacaaaaataaggagactacaactcttatggctacaaattgctaccttagtactgatgacaaaggaaaatccattaataaaacaaagtatcaaggtatcattagttccctattttacttgactgttagtagacctgatatcatatttagtgtttgcatatgtgcatgctatcaacctaatcctaatgagtattctctactgtaa

SEQ ID NO: 106790 - DNA, 201 bp, Glycine max
  Peptide Sequence Number=SeqID_223568
atgaagcatggatacagatatgaacactggacacccatggacatgtacacgcacagggaaagaaaaaaccaaaggaacaagtggaaggttagaaacatactggagtcaaacgaaacctatagcacaaagtcacatagagagtgtgaaatagaaatagagcaagtcattggaaagcaatggaagtcaagaacgagaaattga

SEQ ID NO: 106791 - DNA, 5265 bp, Glycine max
  Peptide Sequence Number=SeqID_223569
atgaactttggaaaacaacttttaggccaagatgacagacaatttgaaatgaacaatacatgggtacccatcccccctgagaagctcattcaactaacatctaatacaccatcagactggccagtgaaccaaatgagcggaccaaattatcaagaaatttctgtacctggaagtgattacatgaaagaaaagctgatgcattacccaggaccacatcagaatctccctctgatgggacaaataggtcatcaaactagagagaacaaaatgtttgatggcaaattgatgcatagaaacagtgttctagattacattccaggctcctacactcagccatggcactatgagagcaatggatcaaacagtaatacctcagaacaactgctcaagaaggacataactaatatagattctgctaacaggaatttggatgtgaacaataacatggcagccagaaatccgttgctatcaatgttttatcctcaggctagcagcgatatgagtgatccctatgcaggtgtacaaagatgcaatatccattcagctttagacattttgttcagagaagctaacagccttctgtttccaaataggaattctgaatttggtggcagtagctcaaacagcttgctcaacaatgacattcattgttcagtcccgaaccaactggagggcttcttctctgagataccctatggtgatccttaccacaattataatctgaattatgtgccaatagctgaagctgggaccacagctagttttaccaactctctccaatcagtaccagctgaagctggtgccactgctagttttaccaactctctccaatcagtaccagctgaagctgatgccactgcaagttttaccaactctctccaatcggtaccaaaattgatggatcaactcaaatttgtggacaaccagttttttacaataccagattacataatagctgaaagcacaagtcaggagaaagacaaacaaaaggacttagtttcttccactcagaatgaagttagggaacattgcgatgggcttctacaggaaaatgttgattcatcatctgcagcaatttctacaacatatggggatcaaaagggttctgacaacatccgtggcaagggaagtgacctgggttttgacctgaacaagacacctgagcagaaagcaacccagcgaagaaagcataggccaaaagtaattaaagaggccaagcccaaaagaactccaaagcctgcaactcaaaagacacaggtgaaggagaatctgcacaaaaagaggaagtatgtccgaaaaactgcagcaacaccacagaccgatgttatagaagaaagtgttgattctattgttgcaactaaaaaatcctgcagaagagctctaaattttgacttggaacataataaatatgcaagccagagcaccataggttgccagcaggagatcaaccatagaaatgagaaagctttcaataccacttcagaccacaaggccacagagatgctggatggagcaactatgacctatggtaaaaactcagctttgctgatcagctcatgggatgaacttacagtagaaaaccaacaacccagaaacacagaagataatacacttctactgcatgaaaagcaagctaataatatcctgtcagaaaggaaatcaatcacagccttgtcagccactacacaagagccacagatagcaaaatttcttgtcgctgaggaaggtccagctcaggaagattctgatttgtgtcaggaaggaaataatggatgtatgcatcaatatattcatacaaagcaaattgccaacaggtatcaatcagaagcatgttttgaaaactcacagaagaccagagaaccaatttgtcagaatacccttcagttggtgcctaacatcctctccaattccattgaagcagcaaagggttccaagagaaaatatcgcaaaagaactcagaagcaacatgactcagccacaaattcatgtgatacttccttgtgccaagagactttacaagcacatggaaatttcagaggtgcaactcctgccaaagatgttattaaaaaacagaagattaaaaaaactcaaaatagacacaatgcaaaaatcagtggaaggtcttccagccaaataatgtctaaagagaaaattggatttcatacacagtctaatgaagaaataccatatatctgtattgaaagtaatagatttgtagagcagcaaaacaatggaaccctcactggggaatgctttgctatctcagaggaacattctaatttgatagatgagataatttgtcgaccgaatgatctcaaacttagggagagcaacatgtcagagatggaaggactaaaggcactagtcccatataatggagatcgttctgttgtaccctatcaggagtttgaattacttaaaaaacataaaccaaggcctaaagtggatcttgatgcagaaacagagagaacctggaaactattgatgggcaaagtaggaagtgaaggccttgaagaaactgacaaggaaaaagagaagtggtgggacaaagaaagaaatgtttttcacggacgagttgattctttcattgcacggatgcatcttattcaaggagatagacgcttttcaaagtggaaaggatctgttgttgactcagtgataggtgttttcctcactcagaatgtttcagatcatctttcaagctctgcctttatgtctctagcatcaaggtttcctcttcagtcaaaaagcagcaagaaaacatatgatgttgacacgaacacattgtttaaagaagcaggactcaacatactaaatccagctgatacaataacatcatatggatatgggacattaaatcaaccaacctatcatctaggctttgagacaccccatcatgcaaaagagctttggagagactgtgaaacctcaaggacaaaagggagcctaataaagctaaataatcagagctcagtggaagaatttttatcaccacaagattctcttgattcttcaattactcaagatgccagaaatagatattcctcaggatctaattcagaatcagaaggtcttgactgcaggtgtgaacacagaaagactcagtttttaacttcaacaaattctttacaggtaggaaagaccactatgttccaggaattttacaacagtgtaaatggagtgtcactatttgaggagagaaataaagatggacagctgcatccagcagaacaagtgaaacaaaattgtagcataggcagaaacagcagtcccaatgtctgctcagcatttagtcatcctagcaactttgcttatccaccaaagcaactacctgtagttccttcaactgactatggactatattactcagacacacaagggctgaagactattcaaatgaatggtgaaaagttttcttggactgaaactgtttctgttcacagtgagtttcaggacaacaattctggcaataggaaagagggagatagtgcagataaacccacagaaatccagtacacaaatggaacactagggtctccagagataccaacaattgacccttatgaaccattaagcaagtatttagtccttccacaagatacttctcaatttggatctcatacaaattacagtcaaccttcactaaatcatcatattgtaggccagaaatccttagaatcagaaagcagggaattcacaaactcattaaatgcttctcgtatattgggtagataccaagatggtgtagttaatgatagctacaatattcctaaggatgcagaaggtcttgacagtaaaaaaatatctgcagcaaacagccagggatgctcagaaaatagtagggctgaatcaaatcctcagaagcaagtttattatcccaaccctatcaataaaaagagccaaataaaggtttcaaaagcaaggaaagaaaaacctgagactgagaaaaagcttgcaagcgactgggacaaactaagaaaggaggtacaggtaaatgggacagagaaagaaagaagtatggacacaatggattcactggactatgaagcagtaagatgtgcctctgttaaagagatatctaaaactattaaagagcgagggatgaacaacttgctagcagaacgaatcaaagaattcctggacagattggttacagaacatggaagcatcgatcttgaatggttaaggcatgttccccaagataaagcaaaagactttcttctgagctttcgaggattggggttaaaaagtgtggaatgcgtacggcttctgacacttcaaaatattgctttccctgttgacaccaatgttggaaggatagcagttagacttggatgggtccctctccaaccacttcctgaagcacttcagttacacctccttgaactgtatgaactgcactaccagatgattacatttgggaaggttttctgcacaaagaaaaaaccaaaatgcaatgcatgtccaatgcgagcagagtgcaggcactttgcaagtgcttttgcaagtgcacggcttgccttgcctggaccagaagagaagcacatcgttagtatgcatgttcccattgcagctgagagaaactattttgtcaatgagaaccccatggtcctacctctccttgagaacaacttgagcagacaagtaagtcctcaaagttggcagtgtgaaccaatcattgaagaaccagcaacaccagaaagagagtggacagaggcagaagaaagtgacatggaggacttttttaaggaggattctgatgaaattctttccattgacctcaatgcaaaaaagtcaacagtgaatgtacagaactacttgcaagaatacaatgagcataatgaaggttgcatgtctaaggcacttgtggccttgaatccacggtctgcttctatccctacgccaaaactgaagaatgtgagtcggctaagaactgaacaccaagtatatgaacttccagattcacatcctctcttggaaaagatggataaacgggaacctgatgatccaagcccgtatcttcttgcaatatggacaccaggtgagactccaaattctgttgaaccaccagaaagaaggtgtggatcccaagactcagccctgtgcaatgacaacacatgtttttcatgcaacagcattagggaagccaattcacaaacagttagaggaacacttctgataccttgtaggacagcaactagaggaagctttccactgaatggaacttactttcaagttaatgaggtatgtgtaatcaaagcttag

SEQ ID NO: 106792 - DNA, 418 bp, Glycine max
  Peptide Sequence Number=SeqID_223570
gtatctccgcgtatcatgggtgcagaatgaccaaacttggtctctgcgtgccatcggacacgactgtgtctgaatggcaaaggggtgcggataaccataagggtgcgaataaccataaggtatctccgcgtatcatgggtatctccgcgtatcatgggtgcagaatgaccaaacttggtctctacgtgccatcggacacgactgtgtctgaatggcaaaggggtgcggataaccataaggtatctccgcgtatcatgggtatctccgcgtatcatgggtgcagaatgaccaaacttggtctctgcgtgccatcggacacgactgtgtctgaatggcaaaggggtgcggataaccataagaatgaccaaacttggtctctgcgtgccatcggacacgactgtgtccgaatggcaaaggg

SEQ ID NO: 106793 - DNA, 936 bp, Glycine max
  Peptide Sequence Number=SeqID_223571
atggcgcgtggcacgcagccgatgatcaggtgtggcgcgaacggcaactcagcggggcgcgcggtcgggaactggccgaagcgacgcgctgcctggcggcagtgtctgcgtgtgggggcgtgttgctggcggcgcagtcggcgcgcgagatggatgatttgcaggcgcagtgtccgccacaggtggaggaagggttgctgcatgcggtggtggtgctggccgatcatgccggggcgctggtggaaccggatgcgtgcgcaccactgttgtagaaccgcgcctatgctcggctgcgcggaggtcatggcgtcggtgggattcgtgccgaccaaggtcggcacctaccagagcaacgtcgtggtgtcggtgggattcgtgccgaccaaggtcggcacctaccagagcaacatcgtggtgtcggtgggattcgtgccgaccaaggtcggcacctaccagagcaacatcgtggtgtcggtgggattcgcgccgaccaaggtcggcacctaccagagcaacgtcatggcgtcggtgggattcgtgccgaccaaggtcggcacctaccagagcaacgtcatggcgtcggcgggattcgtgccgaccaaggtcggcacctaccagagcaggtcatggcggcggaaagcaccgtgccgaccaaggtcgacacccaccagagcggtccgcgcgcaggccgatgttgccttcgatgatgcggcgcttctcgttgcggtcgccgcccagctcgcgtgtgtagtcggccacggcatacgcgctgatcgtgcggttgaagcgcccgaccacacccacaccggcttccagtgcacgcaaacgctgcaaattgacgatcacgtcatcgtcgaagccgatgcgatcctcgccggaacggccatgccattaattgagcttgaaatacggctgccagccgttgtcggccaactg

SEQ ID NO: 106794 - DNA, 555 bp, Glycine max
  Peptide Sequence Number=SeqID_223572
atgggtgaaacacgttttctcaaaaattgtaccttcttgatggcgattcttactctgctttctagctttctcttgaaccatgtcatggctagtgtttacactgttggtgaccaagaagaatggagtagccaaacaaattatgcttcatgggcagagagatacaattttagccaaggggatgttcttgttttcaagtacgtgaaagggcaacataatgtttatgaagtgacagaagacacattccgatcgtgtgatgcaagtagtggagtgttggccaagtatgagagtggagaagatcaagtggcactcagtgaggtgaagagacattggttcatttgcaacatagcagggcactgccttggaggcatgaggtttggaattgaagtaaaagatggcaacagtgttactaattccacggatgttgcatttaacccaccaattgaaccaactccctcgcataattcttgtacctgttattatgtgtctgaaagatggagagtgattgagaattttattcctttaggattattattattgttgaactattacttttga

SEQ ID NO: 106795 - DNA, 640 bp, Glycine max
  Peptide Sequence Number=SeqID_223573
gatctctaagctggatagggcatccattcttggagatgccattgagtatgtgaaggatttgcagaagcaagtgaaggagctccaagatgagcttgaggagaatgcagacactgaaagcaactgcatgaatattggtgtaggtgctgaacttgggccaaatgctgaacatgataaggcccaaactgggttgcatgtgggaacatcagggaatggatatgtctccaaacaaaagcaggaaggtgctactgtcattgataagcagacccagcagatggagccgcaagtggaagtggctctgatagatgagaatgagtattttgtgaaggttttctgtgagcacaggcctggtgggtttgtgaaattgatggaagcgttgaacactattggcatggatgtagtgcatgccacggtaaccagccacacgggactcgtctcaaatgtttttaaagtggaaaaaaaggataatgaaacggttgaggctgaagatgtaagagactcactgctagagcttacgcggaaccgttatagagggtggactcatgagatgacagcaacgccggaaaatggggtgggaagggatcaacatcaacttcacaaccaccagcagataggtgcctacccgcaccagtttcatagttaa

SEQ ID NO: 106796 - DNA, 965 bp, Glycine max
  Peptide Sequence Number=SeqID_223574
atgaacatcagcatgcaacacttagtagagagactaagacccctcgtgggtttgaacggatgggactattgcatctactggaaattgagtgaagaccaaaggtttcttgagtggttgggatgctgttgtgctggcactgaaagcaatcaaaatgctggggaagaacatcttttccctgtctcttctgtggcttcatgcagagatatcacttatccacaccccagaacaaagccctgtgatcttctttcacagctttccacttgcatacccatagataattctgggattcatgcacagaccctattaacaaaccaacccaactgggtgaactattccaatggcatggatcctaacattttggaagaaacaattgggacccaggttttgatttcggtgccgggtggactagttgagctgtttgtaactaaacaagtgtctgaagatcatcaactaatagattttgtgacaaaccagtgcattgaagccgtgaaccactcaatgagcttcaacattgacgtgagcaacatgcaatcaaacccacttatacaagatgaaaacgaagggaacaacaacaggaacaataatcacttattccatccatcagaacatgtcatcactgatatggaccaccgcaatattggtctgtgtaattctcaactgaacttcatgcagcagttcaactacaaccagcacaacagaatgaagagcgatgctgctttctctgaagaataccaagctggtaattccttccttcacgacgagcaaaccaacccagaagatgatcaggagcctgggcatgagcatgacacgtatcagaaaagcctcatgacaacagattcacaatacgtggaggcaaaagatcagaagcaagaggaagacaaggacttgatgaaaaacgttgttggcagatcagattcaatgtcagattgcagtgaccagaacgaagaagaggaattagatggaaa

SEQ ID NO: 106797 - DNA, 249 bp, Glycine max
  Peptide Sequence Number=SeqID_223575
atgaagcacggacatgccgctgaagtgttgtgtcccgcgtcggaggcgcaccggacatgcaaacgggtacgactccggtgcgacgcggtgtgcgttgcctccgtggtcaccggacatggttggacgcaggaagcgttaataatcgagcacgctcctcctccgataaggactcaccgtatacagaatcgcgggctgcgaatatcaaaagaagagaaggtaggaaagaaaaaggacagaagaatcggttga

SEQ ID NO: 106798 - DNA, 168 bp, Glycine max
  Peptide Sequence Number=SeqID_223576
atgtatcatgggcatccctggactggacatgtaccctcagtagacggggacagcgatgcgttcagtaccttcctcgttagaaagaggcatttgcagaaacaaggactaggaggagccagtggggcacgcatgaacgatgaaacatcaaacaagcttaacctagactag

SEQ ID NO: 106799 - DNA, 270 bp, Glycine max
  Peptide Sequence Number=SeqID_223577
atgaaaaattggatctatgtccaatggatcacaattacgaaaaaaacggataggatcaatttagtaattagagttgattcagataccttggatgttagacaaggtaaatttgcacgtgtatgtgttcaaatcgatttagacaaagatgtggttggcaaagtttggctaaaggatttctggtataaagttgagtacgaaggattgcctgcatttgttcatcgtgcaggtagaggtactatgggcacttggccagagattgtcctaaggtag

SEQ ID NO: 106800 - DNA, 420 bp, Glycine max
  Peptide Sequence Number=SeqID_223578
atgggcaatggtggttctagcaaagagccaccaaacagtggtggcggtggtaaacgtcgtgtttccttcaaggacttgatgataggcaacaaggcacctgtagcccttcgacaaaaaattgtgtttgaggataataaccccttgaagactatggttcatatattggattcagtttttgaagggctatgtgtggcatggcaagatgctttaatggtggtgaaaattcttgggaaaaattttggttttaatgtcatgaaggacaaactctctagaatatggaaattggtggcagggtttgacatgttagatattggaaacaatttctatatggtcaagtttgatacggaggcagacaaagtgaaggttatgacagaggatccatggatgatatttgatcattatgtgacagtgcaaacatag

SEQ ID NO: 106801 - DNA, 141 bp, Glycine max
  Peptide Sequence Number=SeqID_223579
atgggaatcaaatccactgttccaatgaaggcaatatcactcatcaattggttattctttgtgatgaccaagaatgccaatgtcaacctatggagatggcaaagaataatgatatcttttgctctttatttcattctatga

SEQ ID NO: 106802 - DNA, 576 bp, Glycine max
  Peptide Sequence Number=SeqID_223580
atgacactgctagcagctatagccagtgacagctaccaaaacagttatagcaaacttggtgatggtgccggtgttgtatctgattctgctgtggaatcaggcgctggagccggtacctctatcactggtgctggtgccggtgccggtacctctattacaggtgctggtgctggtgttggggttggcggtggaggaacaggtgatggtgttggtgctggctttgtgggtgcaggtgctggtgttgcctttgctggtgcaggtgctggtggtgttttggctggtgttggggctatctttggtggtggtaatggtggtggggaagcaacaggtggtgggggtggtgatgtgggaggtgagactggtgaaggttttggttgttgtggtggtggggcttttggacttgaaacaggtggctgcgatgtaattggtgtactggtggcaggaggagattccgccactgtgggtggctgtgttaccgccggtggtgtgccagaagacaatggagatgttgcagttggtgttgttggtggcaaagttgtaggtggcaactttactggcatggttgctggggcttga

SEQ ID NO: 106803 - DNA, 1150 bp, Glycine max
  Peptide Sequence Number=SeqID_223581
atggttagaactagaggtcttggtcggactttaggacgatcaatagaaaaagtgttggggtggagagacgagagtgacgatgatgcccccagcaaagtacctgttgaagaaggtgttgctgatgttgagggttttccaagcggaccctatgacacatcagttctgagtgattttgaaaatcacattgctttgagagtgtggaatggagaggaacgtcctgagttgaagctatcttcccatggaaggaagatggctaagtttaggaggcttgccctagagattgaaggccttgtggtggccagtggactgagtcctttgatcgcttgtttcctagatacaggcgatcggggactaatgtctgcttttgtggaacgttggcataaggaaactagcagtttccatttgcccgttggagaggtgactatcaccttggatgaggttgagtcgttgttacatttgcctgttgtagaggcattccacatcttgagcaacttcatgtcgacgacgctgtccagatgttggtggagttactcgaggtcagcattgcagaggcaagagcagagaccattcagtgtcatgggtcttatgtgcgattatcgtggttgcgcgacccagtgcgagttacgcttggggtgttgctgcacttgtgcacatcattttccgctcgttgcttccgttgttattgctgaggattacgacgagaggagaccacgtgcatgtcattggacctctgacaaggcactgcccgtttccatgtattggaggcgtctggatagactaaccctttacgcggtgtgttggattctatacagtgaccaccgttcatttagagaatttgaggtcatctcattatttttcgtccatctcagatggggccccttgatggtcattcaccaaccggagagggttgtacgacaattcggctacatccagactattccgccacacccttttgtgtcttcgctgtttgctgtagaaattgatgatagatggatgcagtttggtgactacattgcacctgatgactttgcagaaattgttgataggttagacagactactgaacctaaggatcttgaccaaaggaattgaagcctatactgttgttgaagaatgtgtgggcatcgcaaggcactacattggccaaggcg

SEQ ID NO: 106804 - DNA, 555 bp, Glycine max
  Peptide Sequence Number=SeqID_223582
atggcggcaagcgcactgtataatgcccatatgttccttcttcctcccctctcgcacaaaacccgtaaaccttttcactccctctgcttcaaccctcctccttccattagcatccccaggtctaagttttatggtgctacagtagcagcaacaaagcttccccgtcggatatttagagggcatgggttggtggctgatgattctgggattgccccagaaccagaatcgccctattctgaagcgggtgctggtattgacttaaatcttccaagaagaagtttgcttgtacagtttacatgtaacttgtgtggtgaaagaacaaagaggcttgtaaatcggttggcttatgaaaggggtgctgtttttgtacagggccgcagatctgagggagagaggatcgcatgcacctttgaggatggtggtttgattgttttgatggtggtgtttgggggtggttttgatggtggtttggtgggtttgatggtcgctgttataggtggcggccctagggtggggttggtggtggttgttatgggtttgggcggcggtttttaa

SEQ ID NO: 106805 - DNA, 498 bp, Glycine max
  Peptide Sequence Number=SeqID_223583
atgagacctattgtgtatattaatctttataagaccgagaaaggtatgctttgtacaatgcctcttaggtgggactcctcctcaggatacactggtcatgtgatcacatttgaggttggtgcggtgcttgaggatgcaaattggcaggctccagtgaattgttttgatgagaatgacaaggaaaagaatatccccattttgggatctgctgttcgtggtggttctcttgggagttatgacgtaggctctgccacgtgggcagaccttaggaaagcacccctccaaagtgcaatggaagtcacttacatttgtgtccactttgttttaaaagaacttgtgcggaagtcaatttcagaaactgaggtcagcaatgtttcagcaatgtcccagcaatgttttcagaaacggaagtcaatttcagtgcaccgttatttgagactaaatatggtggattatctactatctatattgaaaatcgtcacatggcttattaattag

SEQ ID NO: 106806 - DNA, 366 bp, Glycine max
  Peptide Sequence Number=SeqID_223584
atggattcaacgacgttcctcttcaagcaccgatgtaacttggttcctttcgacgtcgttgctttcggcagcaacgacgtagttggccaaccattcaacggcggtggttgccggtgcaacgatgtggtagcccttacacaccacgtcggtgccaccatacctgaccttaaaagcttacctttcaacgtcgttcgtcgtgccgacaacgtcttcgaaggcgaacctgcaactacgggcctccagtcatccccgtcgcaggaatcgtgtgcttctaaaatggtggatggagaccgtcgtagattggccggaggcctacgacgacctctcattcaaagtcggccctgcaccgtcgttgaactccgatga

SEQ ID NO: 106807 - DNA, 216 bp, Glycine max
  Peptide Sequence Number=SeqID_223585
atgactattcagcgtagtagtgggcgtcgtttaatatggagcatgtctatggataatggcattcgatgtatggctgcaccttggtaccgatttttaatggacaataacgtaatggctggagatgaggtcgccttctatttcaggcccaaccagcatgtatgggaacttatcttgaggaagcaactcatatgggaagatgaaggccagtcacattga

SEQ ID NO: 106808 - DNA, 135 bp, Glycine max
  Peptide Sequence Number=SeqID_223586
atgatggcctccagaaagaggaaagccactgcatcccggccccagcagccctatgataccaccagattcacttttgaagtggcctggaacgttactcatagaacattcactcccggaacatccttccggagatga

SEQ ID NO: 106809 - DNA, 228 bp, Glycine max
  Peptide Sequence Number=SeqID_223587
ctcatatttagtagttatcaacaaccaatagttgaagttccacaagtcgctgaagatgatcatgtagatcaagttgttaacaaggaacaacaagtcaatgttgaaaatccggttgaacaacaagttcctcaacaagataatgagccaacattaagaagacctactagagtcaaaatgtcaacaattcctagtgattatcaagtgtatttgcaaagaatcggactataa

SEQ ID NO: 106810 - DNA, 351 bp, Glycine max
  Peptide Sequence Number=SeqID_223588
atgcaggatttcagcatcaaaaaaggtccaaatttttctcctttgtggctgagtatgaagtcaaatcaaaggaaaaagaaaagaaaaggaaaaagaaaagaaaatcatttttataaaaagctcaaatcttctctctcttcctttagaaaaatttcagaggcttcttccctccttccacgttgctttttctcttcttcttctccaccattgttgcctccattgaagctccaaattcctcttcctttctaccccaaattgcaaggaaaagccattttcggagtcttggagcatacctctacttcgtggggctttaaatttcagaaaactggcagagatgatggggagagttaa

SEQ ID NO: 106811 - DNA, 468 bp, Glycine max
  Peptide Sequence Number=SeqID_223589
atgcatgatatgaatgcatttacagacacaagagcccggaaaattatctcttcttacttgcgcattcgggggcgcagtaccccatgtgtgcagtttgtagaagcaaagcttcatggtgaatcaagattgattcaaagaagttttgatgataacaaaggtgatgacaaaaagctcaaagaatcaaagaataagttcaagatgttcaagatgtttaagatgttcaagattgaatcaagaacacttcaaggttcaagaggaaatttgatttcaagaatcaataatcaagattcaaggtttaagcattcaagactcaagattcaagaatcaagaaaagacttgatcaagataagtatgaaaaagttttttcaaaaactgagtagcacatggatttttctcaaaacatgtttaccaaagagtttttactctctggtaatcaattaccagattgttgtaatcgattaccagtaa

SEQ ID NO: 106812 - DNA, 483 bp, Glycine max
  Peptide Sequence Number=SeqID_223590
caccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcgggttttcccagtcacgacgttgtaaaacgacggccagtgaattgtaatacgactcactatagggcgaattggagctccaccgcggtggcggccgctctagaactagtggatcccccgggctgcaggaattcgatgtttgttactaatgctattgatggcgaggagattgacttcaagtctcctaaagctgatgagatcgatgtccaaaggagacggctacagaaaaacgaccttgatctcgacggcaaggtgcagaagtactatctttgcacggggacaccgttgaggaagcaattgatggagtggctgccggacaaggagctagtattcgaagacttcaatttctag

SEQ ID NO: 106813 - DNA, 1128 bp, Glycine max
  Peptide Sequence Number=SeqID_223591
atggattttgatgagtatgagtatttagagaacgcagttgaaaaccctcaagctaagcacagggctaatggtggggacaaaagtgtgaaatctgaagagagagggcggaatgggagttcaaagcataagggtgatgatgatgatgatgttgatctccatcccaagcattcaaaacctggagacgattctcatgatcgcgagaggctcagagaaaaaagaggctcatcccgtcatggttcaaagtcccgagatggagacaaggacagaagctctgggggcattagggataggaagagggatagggacagagatcatgagaacaaggataggaagagagaccatggggacaaggatgtgaagagagatagggagagagacagagaccacggtcgtgaccaagaaagggacagaagggaccgtgggagtgaggctgagcggcaacagcgaagcagaagtaggtctgataggcatcgaactgatctggatgacaaagacagagagacaagtcgtgacagggagtatagagatatagagagaagccgggataaggattacaaagacagaggaagggtgagggaatcaagggaacgggatagacaagacagacggcataaagagaaaaaggaagaagcaacagaacctgaggctgatcctgaaagagatcaaaggactgtgtttgcttatcagatttctctgaaagcagatgaaagagatgtatatgagttcttctcaagggctggcaagttttatgatgtcatgtctgtccccatggcaatagcactttcgggccaacctcttcttggtcaaccagtgatggtgaagccatcagaagcagaaaagaatttggttcagtccacaacatctgttgctaatggactcactggacttataggcccttattctgggggagcaagaaagctgtatgttggcaatctgcatgtcagtattactgaagctgatattcgtagggtgtttgaagcatttggtcaggttgagctagtccagctgcctcttgatgaaagtgggcactgcaaaggttttggctttgtgcagtttgcacgccttgaagatgcaagaaatgctcagagcttgaatggtcaattagagattggtggtaggacaatcaag

SEQ ID NO: 106814 - DNA, 1191 bp, Glycine max
  Peptide Sequence Number=SeqID_223592
atgcaggctgagatgacactgcgaaaagatgttaaggaagtgcgattttctgaaaaaactgaagcaaaagacctgaagaacaaagcagatatgattaaaaagttaatggagaagggttatcgagtgaagtgcaaggtatcgggcaaggaaaatcaggacttgacagtattattttctcctattcttgctctgatggaagatgtctgtattgtggaaagtggaccacatatggcaaaaaaagatgcatttatgattgtcagacacattaagtatgggctatcaaagaaaggtgggaaaaaattgcaaaatgcaacaaacgttacgactcaggagggtgatatggagatatcaactgccaattctagtgattccattgaatacgagagtcatgctgaatctgggtttgaaacggaggaggaggtgctttctgatggtaacaagctttctaaaagttccttgtctgtatttagcaacaatgtgaacatgactgcctctcctaataatcaaacaaatgctgctccagaagcatctcctgtgtccgaaaataggtataggagccaagagaataacgtccaatctaatgcacaagtgcctcctgctgtgactgagaataggtacaaaagaatagagccaagaggcagattccaacaaacatcaaataatacatgtatgaactatcaaggtcctggagcaagagacgcattcaggtcaccaccaccgaattggaatcggacaaggcaagcgccagtaaatgctaaccttaatccaagaatagaaaataacaggctagcttttactcctcctggaccaagacactcaatgccttcccatgagaatatctgcaatcctcctcctaatgctcctaatacccctagaccgggttatggcaattttagtagcccaagtgagggtattcctatgcatcatggtgttcccaataccccaagatcttctagttatggcaattttagtggtccaaatgagggtatccccaggcatcctggtgctcccattacccaaagatcttctagttatggcaattttagtgctccaaatgagggtatccctaggcatcccagtgctcccaataccccaagaccttctagttatggcaattttagtactccaaatggccatgagacacaaggtgtaaaagcagggatgcataggaacagagaagggaatcagtaa

SEQ ID NO: 106815 - DNA, 1105 bp, Glycine max
  Peptide Sequence Number=SeqID_223593
tccttgaatgcatgttctcgagcaattctcatgcagaagttggatcgtagtggtactgcatcaagcatggttggttccatcggtaattctggtgtcaacaacacaggtcttaatctacctgcaacaggaaacatactcgcagctgcgcctgtgggtggattggcaggtggaggtctccaaattcccacggctacaattccttctattgatccaatcggtgttccaagtgaatgcttaatgttaaagaatatgtttgatcccaaagatgagactgaaccagattttgatttggatattaaagaagatgttgaagccgaatgctctaagtttggggccttaaaacacatatatgttgataagaagagtgctggttttgtctatttacgatttgaagatacccaatctgcaataagtgcacagcaggccttgcacggaagatggtttgctgggaagatgatcactgcaagcttcatgtgcctggaatggagatcgctaacgcatagtaataatggaaacagaagagatattgtgattgtggcagctggaattgctggccttacagcatcctttggacttcacaggttgggtatccgaagtttggtgttagaatcttcagatactttgaggatcgctaggtttgctttatcaaaatgggaaaatgcttggaaggcattggatgctgttggtgttggacacattctccgccaggaacatgcccagctcatgggtatgcactatgcagctacggttgtcactacttcattgattacagggcaacaaacatcagctatgcgtttcaaagaatcaggaaatcagcaaacagaccgtgaaattcgttgtgttaaaagaaatttactgttggaagtcctagccaatgagcttccaagtggcaccatcagatacttgtcaaaggttgttgctattgaggaatctggcttctataagatactccatcttgctgatgggacagccataaaaaccaaaggagatatgcaatcaggggctgtgcagagttcaagaacgatcacgggtttgagcccagcttcatgcagttctttggcaaaggtatctgagctgatgctattcctgcacacccaccaacaag

SEQ ID NO: 106816 - DNA, 703 bp, Glycine max
  Peptide Sequence Number=SeqID_223594
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcaccgggctggtgaggtgtctcgttagccctgcgacaggcctggtcctcgccatcaccgggctggtgaggggtctcgtttccagggaaaatgcactaatcccaggggctcaacagaaggggaggcaagtggtgagggcagaagggccagcggacaccaggcccagacacgggctagtgggggctgcctgcggctcccccagggacacggcggctctgaaaacaggctgtgatgcgcaccacacctgctcgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 106817 - DNA, 567 bp, Glycine max
  Peptide Sequence Number=SeqID_223595
atgaaggtcgcccccgcagccagtctgcgccggccgccaggggggctctttctgtccttgacctgggggagccgcaggcagcccccactagcccgtgtctgggcctggtgtccgctggcccttctgccctcaccacttgcctccccttctgttgagcccctgggattagtgcattttccctggaaacgagacccctcaccagcccgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 106818 - DNA, 323 bp, Glycine max
  Peptide Sequence Number=SeqID_223596
acaaagagctagaagagaaccctgctaaactgaaacaatatgtgttaaacaagcttgagaatatgccaagagatgttagatactacatagaaaaaatagaactagatgccttcctatcatctccactgagacataggcatccctgggagctgatgtttgggaatattagtaaagacaatgtttgtgttggtggagatgctttccaccccatgactggggaccttggccagggagggtgctgtgcctttgaagatggggttgttttagccaggtgcctagctgaggccttctctaaacatatcaagcagaaggatgaagaatag

SEQ ID NO: 106819 - DNA, 1068 bp, Glycine max
  Peptide Sequence Number=SeqID_223597
atgcctgaaactaaagtatacaggaaattggagtgcaggaatgtgactacatctttgattttagggcagcaaacatcaagcttgtctttcgagggcacaggaaaacatggagactgtgaagttcgttgtgttagaaggcagttaatgttggaagcaattgctaacgagcttccaagtggcaccatcaggttcttatcaaaggttgttgctattgaagaatccggcttctctaagattaagatagtccgtcttgatgatggaacaaccatcaaaaccaaggtattgattgggtgtgatggaataaactccgtggtggcaaagtggttgggcttcaaagaggcctcttttaccgggagatacgtaatcaggggctataaaaagttgatgaacaatcatgggcttgagcccaaattcatgcactactttgggaagggctttcgatctggtgtaatgccttgtgatgataacactgtatattggtttctaacttggactcccaccagtgaagagaaggagctagcaaagaacccatccaaaatgaagcaattggtgttgagaaaggttgagaagatgccaagtgatattaaaacctttatagagaaaacagagacaaaagacattttaacatctccattgaaatatagacatgagtgggagctcatgttggggaaaattagcaaaggcaacgtttgtgttgttggagatgcatttcaccccatggcccctgacctagggcaaggtgggtgctgtgccttggaggatgggattattttagccaggcatctagccgaggcattcaccaaaaaaactggcaaacatgttgctaaagagatgggtgaagagggtaagtctaaggagcaatacaaaaaaattgaggctagcttgaggaaatatgctaaagagagaagatggagaaatattgatatcagtgttacatcttatgttctgggttttgttctgcagggtgatttgaaattggtctcacattttagggacaaacttttccctgctttcctagctgagctgctgttgaagaaatcagattttgattgtggaaaacttaattaa

SEQ ID NO: 106820 - DNA, 742 bp, Glycine max
  Peptide Sequence Number=SeqID_223598
gttccttcaggtttcttcttttttcgaggatgagggtgagagccccgtcgagtctgatgaaataaaagtccaaacttggagcaaccaacactacaggaacgaacctgtggttgttgttgctgctccacggttgcaaaagtattctagttttcatgaacagagtggggagccgcctctgcttttgcccattcgaagcttgaaatctcgcttatccgaagaagatattgatgttcaatctctgaacatgttaatgagttctaaaaggttttcaagcaattcaaatagaaatgcagaagttgaagctgatgttgttgatacagatgttcaatctctaaataggtcaacaatttctcaaggattttcaagaaattccaatagaaaagctgaagttataatgttgtcttcaaacacttatgttataatgttgtcttcaaacgcagaggattcggtgaggaagaagggcttctacaagtcttgtcctccaccacctccgccaccgccaccaacaatgtttaagaaatcagtgttcatgaaaccaaggttcgatggttcatccaacgaagcaccttccttcaataaggagttgaagagaagcttcacaagtgagagaaccacaccagtgggaaagaaaagtcatgaagaaaataaatccaagcaaggcacattgtttagaaataacaagttcatggggcatgcaagcgtgcctcttgtgtcacaaccagctgagaaagaaagccttctt

SEQ ID NO: 106821 - DNA, 360 bp, Glycine max
  Peptide Sequence Number=SeqID_223599
atggcgcctatgagacaccttgtggacttggagaagtccaacacgaccctggggtttcccgctctgatcatagggctctgccagttctacggagtgcctgtcacccccaacaagggcgaggcaccacagcagcctggggaacggctaaacgagagtttctatcagtacactctccgccaacagggccagaattccagcccttacgcatggccgactccagagcagtttgaggctgcagtagcatggcctggagattggcccgattttgagacacaggcaggacccgcggggacctctgaaggtggagaagaagcccaggacgatgaggacatggccaacctgatagacttcctcttgtaa

SEQ ID NO: 106822 - DNA, 321 bp, Glycine max
  Peptide Sequence Number=SeqID_223600
atggctaaatttgttccggagatagtcatggaattttatgctaatgcctggcctacagaggatggagtccgagatatgcgctcctgggtgaggggccagtggattcctttcgatgcagaagcacttagtttgttcttgggccacccattgatcttggtagagggtcagcagtgcgagttcagccaaatgaggagtcagatctctagctttgataaggaggccattgcccagctggagatgggtgtggatcatgcgcaccagcatgaccacccttacataaatatggatgacattgctactcaacaacaatctgcccagtga

SEQ ID NO: 106823 - DNA, 384 bp, Glycine max
  Peptide Sequence Number=SeqID_223601
atggctttgtgttcagtttttctcaatcttcatctttggctttttgtttgtttgaccattgaagcgttaggtgtgccgaagccttcagtagctagttaccttagccaggagctactggcagagcaagaagttgatagagtgcatggattactagcgcagcctccagtgaagctcaacaatatgttggttatatcactgtcaatgaaactcaaggaagagatctgttctattggtttttcgaggccacccataaatcggaacaaaaacccgttctcttatggctcaatggagaatcacaaaccagaaggtcaggaagtgagtgcagcaggagtaaacattgataatcacatgaatgaaggtagtggctggattaactcagcataa

SEQ ID NO: 106824 - DNA, 683 bp, Glycine max
  Peptide Sequence Number=SeqID_223602
gtgaaagaggatcgtttccggtccttcctcggggtgccgatcattcatcggcgccagctgctgggtgtgctggtggtgcagcagcgcgagctgcgccagttcgacgaaagcgaagagtctttcatggtcacactggccacgcagatggccgggatcctgtcacagtcgcagctcaacgccattttcggccagtatcgccaaacgcgcgtgcgcgcgctggcggcctcgcccggcgtggcggtggcggaagggtggcaggacagcagccagccttcgctcgatcaggtttaccgcgcttcgacgctggacaccgccagcgagcgcgagcgcctgacgctggcgctggaagaggccggcgcggagtttcgccgcttcagcaagcgttttgccgccagctcgcaaaaagagagcgcggcgatcttcgatctttactctcacctgctaaacgacgcccgcctcaagcgcgaactgttcgccgaaatcgacaacggttcggtggcggagtgggcggtgaaacaggtgatagaaacctttgccgagcagtttgccaaactgcaggacacctacatgcgcgagcgcggcagcgacctgcgcgcgctgggccagcgcctgctgttccacctcgacgacaccactcagggcgctacccagtggccggcgcgttttgtgctggtggcggatga

SEQ ID NO: 106825 - DNA, 769 bp, Glycine max
  Peptide Sequence Number=SeqID_223603
atggcgcacccggcaggaaacagtgatattctctggcccatcacgtcagatgtgctgacggcgatctttcactggaaacccgcgtgcgagcggagacgcgttgtgtctgaattgtctcaactttccccgcagccgctgtgggatatcttcgcaaaaatctgctcgattccgcacccttcttaccatgaagaagcgctggccgaatacgttgttggctgggctaaagagcaaggtttctgggttgaacgcgatcaggtcggcaatatcctgattcgtaaacctgctaccgcaggcatggaaaaccgtactccggtggcgctgcaggcgcacctcgatatggtgccgcagaagaacaatgacacggtacacgacttcaccaaagacccgattcagccgtacgttgatggcgagtgggtgaaagcgcgcggcaccacgctgggtgcggataacggtatcggtatggcctctgcgctggcggcgctggctgataacagcctgactcacggtccgctggaagtgctgctgaccatgaccgaagagtcgggcatggacggcgccttcggtctgcaaccaaactggctgcaggcggacatcctgatcaacaccgactcggaagaggaaggtgagatctacatgggctgcgccgggggtatcgactttatcactaccctgccgctgagccgcgaggccgtgcctgccggtttcgaaaccctgaagctgacgctgaaaggtttgaaaggcggccactccggcgcggacattcatcttg

SEQ ID NO: 106826 - DNA, 1155 bp, Glycine max
  Peptide Sequence Number=SeqID_223604
atgcaggaagccggtgaccggactgccgccgctgatgggaaaggtcagggatttaagctcgccgggcaggcgctgggtggcttcttcataagcgcgattcgccagcacctgcgcctgatccgccagctcatcgcctttaatgtagggatacgcggccaggctgtagagactggcggcatgcagccactgctggccggcctcatcgtgatcggcgttctgcatcgcgcactgctgccacagcgccgcctgcttcgaccactcatagttccagttgccgccgcgatagccaattaccgtgtccagcagcgtttcgtcggtgtgttcaaatttactgacggcaatgcgcgccagcacttcgctgatctcctgcggcgccaggccgcgccacgtccacagcagcttattcagcatgcgataccagccgcgctgggtatcgccttccagggcattgtgcacctgcgccgtcgggtggtgctggcgatgcaccagcgaggaggtttccgggtgtttgaagcggggtttgaacagttcttcgctgagatttttctcggccatcttaagcttctcctgcggcagtcgcatagatggctaagagtgtactgcacccgccgcacgggcgcgaggcgcagaaaacacaacgcccggcataaccgggcgttgtttgcgttgcatcaatcagctttttacaatcggcggaatgtacaccacgcccatgtcccacggctgctcgatccaggtgttctgcggaatatcgacaatgtagtcgtccaccagcgcgcggccagccggcttggcgaagatggtgcagaaacgcgcttttggatacatatcacgaatcgcctgcgcggtaccgccggtatccaccagatcgtcgatgaccacaaaaccttcaccgtcgccttctgcgcgcttcagcactttcatttcacgctggtgatcgtgatcgtagctggagatgcacacggtatcgacgtagcgaatccccagttcacgcgccagcagcgatgccggaaccagaccaccgcggctgaccgcgatgatgcctttccactgttccacaggaagcaggcgctgggccagtttacgggcatgaatctgcagcatgtcccaggtaacgacgtatttttcgctcataaaaggaatcccggccaatga

SEQ ID NO: 106827 - DNA, 693 bp, Glycine max
  Peptide Sequence Number=SeqID_223605
atggcgcaggcgattcgcgccgatatcctgcgcgaaaccggcctgaccgcgtccgccggcattgcgccgatcaagttcctcgccaaaatcgcctcagacatgaacaagccagacggccagtatgtgatcacgccgcaggcgatgccggactttctgctgacgctgccgctgagcaagattcccggcgttggcaaagtggccaccaaaaagctcgaagagatggggctgcgcacctgcgctgacgtacaacaggccgatctggcgcagctgctgaagcgctttggaaaatttggccgcgtgctgtgggagcgcagcaacggcatcgacgatcgcgacgtggtggtggagcgcgagcgcaaatcgctgggcgtcgagcgtacgctgggcgaggacatccatcactgggagcagtgtctggaaattattgattttctctacgccgaactcgatcgccgtctcagcgcgatccgcccggataagcagattgcacgtcagggcgtaaagctgaagttcaacgatttccagctcaccacccaggagcatgtctggccggtgctgaataaagacgacatgatcgccgtagcgcgtcaggcctgggacgagcgccgcgccggacgcggtgtgcggctggtggggctgcacgtcacgctggtaaatccgcagctggagcgccagctggtgctggggttgtaa

SEQ ID NO: 106828 - DNA, 189 bp, Glycine max
  Peptide Sequence Number=SeqID_223606
atgacttcgtcactcgtgaagatccaaggtcaccaccaacccagccatcggccaccactggtgttgccagtcgtgccactgctcgtgccagcgccagctaccaccagtaacttccttcaactctcaaacctcacttctctcccagtctctctctcacacttggccctcaaactcacttgtgtgtcgtag

SEQ ID NO: 106829 - DNA, 453 bp, Glycine max
  Peptide Sequence Number=SeqID_223607
atgccactgttaacttctctaacatcaatcacatttgaagtggctccaaacaccagcaagagaagaaagttcatgtcaatgatgtttgtgatcgatatcaaccgattatatttttttaccaacatcttgtcaggactattttttggtcaacgtcaccttggttttttcggtcaatgcgacaaagcttgttaccaggaacaacttgaggcacttgcggactcgcttgtcaggtttttcatcattgacatgcaagctcagatggcaagagaccagaaggagatcctgcttaaggttaggagaatacttagcgctgttaataaatttccctcccacacagttgatgcatctaaccctgaagaaaatgcaattctagtatggaagcaacaaatacaagtttgtctttgtcctgctattctgatcctctctctatccagatgtatatatgtttgttag

SEQ ID NO: 106830 - DNA, 306 bp, Glycine max
  Peptide Sequence Number=SeqID_223608
atgaataaagaaggatacgctgaacccaatgaatcagatattcgaaattggtttaaaggcatcagagacagtggacagcttgttcattccactttgattcctttggttaaaaattgtcctttggatatgtgggagatttggctggaaaagcttctacacccattttttgtccatgctcagcaagcacttagctgttcatggtctagtcttctacaagatggtagagcaaaggttccggatgctcatggcattcttagtggatcagacttgaaagtggaagtgatggaggaaacaattccaggataa

SEQ ID NO: 106831 - DNA, 588 bp, Glycine max
  Peptide Sequence Number=SeqID_223609
atgaccggccctttcgatgggccgatctcttgttctctcataaaggtggacccttgggtactagtacctatcacctttagaggactatatgtcctcgcctgcagagggctgcacgccctcgcctttagagggctacgtgtcctcattttcagtgtgctccatacccacaccttagaagaatataagggatcgcgcccacaagacgcccagtgggcccgaagaagtccaacagggccctggggtttccagctctggttatgggcctctgtagtcctacagggtgctcgtttcacccctgcagatggatcgggatcgcgcctgcaagacacccagtggacccgaagaagtccaacagggtcttggagttgtcaagctctaattacgggtctctgtcaattctacagagtacctgtcacctccagcaagggcatcaggccccctactaatcgagctttcatcaagaagtactgcgtccctaggcaggcacagggcgaaataccacagcagcctggggatggccggcagcgggcaacagacgcaccaccatcacctctagagttcgcctcagctcatccacaaaaaggttag

SEQ ID NO: 106832 - DNA, 438 bp, Glycine max
  Peptide Sequence Number=SeqID_223610
atgcgtacctccgacgaaataggaagaacaacgactaacaaaacttcaaatacggaacacctgcctcacggggaccaccaaatcttcaaatacttctcgggaccaccaatggaaagcaacagcaagaaaaggaaagaaagcaatgaaggaagaaggcgcaaaagttcttctggaaatggtcttcacggaagggcattttcatcacttcactgtttgatggatgccccagcaataatgctgggtgcacgtagcaactccctaataacaggagcacaaactaaattagcccaaagtatatacaatggagcactgctaagcccaattggattagaaattcaaacatctaaattgatgctatttcttcttttattccataaaaatcaaggagtacctcctttacattttagaaagacaaattcagatactcacaaaaagtaa

SEQ ID NO: 106833 - DNA, 357 bp, Glycine max
  Peptide Sequence Number=SeqID_223611
atggttttggttgaaggttctacgtctagggagtcggttggaaatgggtctgaggtgggtgagaatgttgtggctccaatgatgtatcctattgctaaggcggggacttccataggagttgcacctccgcccaagaagcgccctgtgctgaaggagaaacgcttgcctccccctatcatgcttcctgggtacattaagggtgacgacgatgcctttgcatttttgagacctgagcttgtaacctttacaatatcaaagagaagtcagtctagtcctctacaacaatctctctgtttttctgatcagtcggttgctccattgctattgtattcgcttcagttgtcgttattgctataa

SEQ ID NO: 106834 - DNA, 564 bp, Glycine max
  Peptide Sequence Number=SeqID_223612
atggctgctacaacatcttgtgatttttcttcgttggaacctcttcaacactatctgcttaaacatggttccaaacacttggtctctaatggcgtggagagcatcaatgatgcaaagaaattgtcagagtgcaaaagggatcagcctagggcatcacctgaagttcacgcgccacccaaatggaagcactaccgtggcgtgaggcgaaggccgtgggggaagttcgcggcggagataagggacccgaacaaaaacagtgctagggtttggcttgggacttatgttactgaagaagaagcaggtttggcttatgatagagcagcttttaagatacatggcagcaaagctaagctgaattttcctcatctcattggctctgacgtatcattgtcagagccaatgagagtggtggcgacaaactcacatgagccttgtttgttgccattggagtcacaaggatcaaagaaaaagaagaacctagttgatttgttgaataggttggccaaaaatagaaaaagggttgggtttaaaagttctgagatctcagctaaaatttatgcttag

SEQ ID NO: 106835 - DNA, 291 bp, Glycine max
  Peptide Sequence Number=SeqID_223613
atgaagaattatgcatctgaggcatattcatcatcatctaatctagaaacaccgattgaaaatgttgaagttgacacaccgtctccaattgtccatccaatagggcaaaaagaagagcaagagaaaaggaataggaacatctacaatccttgggacttgattggcgtggaggaagcaataagggaaataaatattctcaacaccaaactagtagccttaacggagatagaattggaaaatgagtattacgacattctaataaaggacacatctacaatgtctgaaacttaa

SEQ ID NO: 106836 - DNA, 534 bp, Glycine max
  Peptide Sequence Number=SeqID_223614
gctttgggcttcgatggctgcttgaaagacacatattgggaagttggctatggtccgtcgtgcattgtgcagacgactgatggcttacattgccaagagggcattgtgagacaaaggaaagggctgaaaaggatggtgcccaggatctcactattacctatgcatgtgcgagaatgcgatacggtagagtggaacttcacttcaaggggatgtgatgtctggtgtggcgtgatttgccaccactacttccggagtgaaccgctttcgaacaagatggaacggtctttctttcttcaaaggtcggcttattacgccgctaacttacctaacaacgggaccaagtggtttaggaagccggaccggaagacctatagccgaggatactctctaagtgaaagactccacttttttaggatgcaatcctaccccgcaagggcattggatagaagactccaagtagattgggccaaagatccaagggaaggccctagggatctcatgagccttagggtagatttcaagcccatggaccaa

SEQ ID NO: 106837 - DNA, 767 bp, Glycine max
  Peptide Sequence Number=SeqID_223615
tacctatcttcttcagagggctacatgtccacgccatcagagggctgcacgccctcgccttcagagggtcgcacaccctcgccttcatagggctacacgccctcacctttagagggctgcacgccctcgcctttagaggactatacgtcctcacctttagagggatgcacgccctcgcctttagaggactatacatcctcgccttcagaggactacacatactcgcctgcagaggactacacgtccttgccttcatagggctacacgccctcaccttccgaggactacatgtcctcaccttcagaggactacacgtcctaaccttcagaggactacatgtcctcgcctttagaggacaacacgtcctcgccttcgccttcgtagggctacacgccctcaccttcaaaggactacacgtcctcgccatcagagggctgcacgccctcaccttcaaaggactacacatcctccaattcagaggactacacgtcctcgcctttagatggcttcacgtcctcgccttcagagggctgcactccctcgccttcagaggactgcacgtcctcgtcttcagaggtctacacgtcctcatcttcagaggtctacacgtcctcatctttagaggactacacgtcctcgccttcaaagggctacatgtccccacctttagagggctgcacgtcttcgccttcagagggctacgtgctcttgccttcagtgggatccatatccgcaccttaagagaatttaaggtcctctacccttaa

SEQ ID NO: 106838 - DNA, 192 bp, Glycine max
  Peptide Sequence Number=SeqID_223616
atgatgagaccaccaactctattatgtagaccagcttcagggaataaatcaccttttgtctatatcctgcaagaaaataaatccccttttgaccaaagggtgagccctggtgcagcgataaagttgtgccttggtgacttgttggtcatgggttcgaatccggaaatagcctctttgcatatgcaagggtaa

SEQ ID NO: 106839 - DNA, 1337 bp, Glycine max
  Peptide Sequence Number=SeqID_223617
atggccccagatcgtgatcaactccgtgcgatgacgcaaaaagagaaggaaacattcaaggaatatgcccaacgttggagggaagtggctgcccagattgtcccgccgttggaagaaagggaaatgaccaaaatatttctgaagaccctgagccagttttattacgagaaaatggttgcaagtgcaccaacagacttcaccgaaatggtcaacatgggggtgcgattagaggaaggtgtccgagagggacgtttgactggggaaagtgcccctgccgcaagtaatgccaagaagtttggaggccactttgcgaagaagaaagatcaagaggtgggaatggtagctcatggtaagcctcagcagaatttcaccccatatcgtcaggttgcgaatgtcgcatccactatcccaaacccatcatatcaccaacaaaggccacaataccctccacaacaataccctcctcaccaataccctccacaacaataccctcctcaccaataccctccacaacaataccctcctcaccaataccctcctcaccaataccctccacaccaatactctccacaacagtgtcatccacaacaatatccttcacagcaataccatcagccacaataccctcaaaaacaacaaaatcgcccgcagaccctccaacaaccatatcactcacaaaaccgccagaaaacaacctttgatccaatcccgatgaaatatgctgacttactccccgccctgctcgccaaaaaccttgtccaggtcagaacaccccctcgtacaccagatgttttacctccctggtttcgtcctgatttaacctgcgctttccaccaaggggccccaggtcatgacgttgaaaactgctatgtcctgaaaaatgaagtgcaaaaacttgtccgagccaacttgctatccttcaaagatcagaatcccaatgttcaggcgaaccctctgccgaaccatgggcctactgtcaacatgatacaagattgtggtgaagaaggtgtcatcctaaatgtccagcacattcgaactcccctggtcccaatacatatcaagatgtgcgaggcagctctgtttgaccatgatcatgcagcgtgtgaaatatgtccagtgaatgtaaaaggatgcccgaaggtacaagaggacatacaagggctgatagacagcagagaactaaccatcacgaggaaggacagagaagtgtgcgtcattacccccgagtttcagcggttggaaataagctataacagtggggaatcaactactactccactagtgattagtttgccaggacctatgccgtatgcttctctaaaagcggtcccttacaa

SEQ ID NO: 106840 - DNA, 1074 bp, Glycine max
  Peptide Sequence Number=SeqID_223618
atggccgttcaagctcaatatccatccaatgtcctttttctaaacagcagaaacgggcaagaagggcatgagtattcttcattgcaaccacaaccaggaggagttgtactcttgaatcagcctcacatgttatacgacaactgcaacaacgacaatggaagtaacaataacaacaacaatatcaattctcgaaagagaggaagagaagatcagccgggtgttggcaacaacaacaacaacacaatcactacagcttcaaatgttatcaatcaattttctttgcaatctcagcctctgcaactcgttcatctctctcagctccacaatcaccaacaacaaaataatgtggtctccactggcctacgcttatccttcgatgaccaacactttcaacaacaacaaagactacaacttcatcaaaatcaatctcaacaacaacaacaacatgggtctcaatcttctgctttcttatctctattatcccaaggcttgggttctcaaatcaaacaacagcgtgatgagattgaccaattactccatgcccaggcagagcaactgcggcgggcattggctgagaagaggcagaggcattaccgcgcgctgctgagcacggcggaggaggcggtggcgcgtaggctcagagagaaggaagcggaagtggaaatggccacgcgcaagaacgcggaattagaagcacgcgcggccaagctgagcgtggaggcccaagtgtggcaggccaaggccagggcccaagaggcgacggcagcctccctccaggcccaactgcagcagacaataatgtcccatggcggcgaagaactcgccgccgtgggcgtatcgtctgctgttgagggccaggcggaagacgcggagtccgcctacatcgacccggaacgtgtcgttgttgccacgacggcgcgtcccaaatgccgagggtgcgcaaagcgcgtggcctcggtggtcgttttgccgtgtcggcacttgtgtatctgtacagaatgcgatgcgcatttccgagcgtgcccggtttgtctcaccctaaagaattcaaccgttgaagtttttctctcttga

SEQ ID NO: 106841 - DNA, 210 bp, Glycine max
  Peptide Sequence Number=SeqID_223619
atgggagattcagctaaagttgtgatcaaacaagacatgaagggaagaaggcataaatatgggtttaacaacaatgaacgtgagaaggcacaaaagaaaagggtggtggatgatgaaactgccgacaaacatcagctggatgaacaccaagagcggctacgcaagaagtttgcacttgaggagggaaggatatttgcagctaatgaacaa

SEQ ID NO: 106842 - DNA, 393 bp, Glycine max
  Peptide Sequence Number=SeqID_223620
atggttttgcttttgctaggcagtaagcacaataactcagcaaagccgttgccagaacggaacagagtcgaaacgacgtcaccggaacgaaatggagtcaccgaaacggaggatgcaggcgtcgcaagtgtgcagagcagcaacggcgctagggttgaagatgatggagccccaatcgtgagagtcttcgcagcttataggaaaaattcgaaaaacctaaaatactctcacttaccctcattaagtgaggcggcgcgaaaaaccgctccagaacctgcgtcgctccgccccgtgccaccgcgacacaaaaccgctccgctacagaggtgcccatcgcggatgggggccgctacgacctctattgactacataggtctttggtatgggtactaa

SEQ ID NO: 106843 - DNA, 237 bp, Glycine max
  Peptide Sequence Number=SeqID_223621
atggtgaagaacagaggacaaccttcactgaattgcttacggaaacatctcggaagcgttacggaagcgcatcggcttagattttcttcacagaaacaatttttttcacccaaaacagctgaaatgcatagccatgggatcaggggaggtggttgccacctagctcgcccaggcgagctaggttgcttccaccttaaccaagaaaatgcccagaaacctctagaagggccagattga

SEQ ID NO: 106844 - DNA, 765 bp, Glycine max
  Peptide Sequence Number=SeqID_223622
atggaaaaattaataccaaggcatactgagatactgcaggagctggaaaagaaagattatgttctcgtgcaggaattatgcgaaaagtataatgtttcttccgttaccattcgaaaggatctgaactatttagaaagcttgggtcttctttttcgaaatcatgggggtgcaagcaagcatgtgaggtatgcgtatgaaaagaacgtagatgaaaaggagaatattaacgtagaggctaagcagaatattgccaaggcggcagtgaaacttatagaagaaaacgattgtattattctggcttcaggaactacaatgcattatctggcaaggatgctggtgaatttcggccgtcttactgtgcttacgtcatcgctgagagtggcactggaattatgtaataatcctaatataaatattatacaattggggggtgaggttcgtaaaagttctacatcgatcgtgggttctatatccgaaacaattcttgctcagttttcatgcaataaattattcctgggggtagacggcattgatatggattttggaatcagtacttccaatgcagctgaagcacatctcaatcaattaatgatagaatgttccgataaagtgatgatattggcggactcatccaaactaaacaaaaaaggcttcggtaagatttcttctttagataaaatagattatctgattaccgatgatggcatactagaagaggataaaaagaggctcgaagaaataggtctgagtgttatcacgaagtag

SEQ ID NO: 106845 - DNA, 213 bp, Glycine max
  Peptide Sequence Number=SeqID_223623
atgtctaaggcatgtcttagcatagtgtatgagattaggcagggaaatccgaaattgacaagttgtggcttaaaggcttttcaagattctcagttctgggaagaaggaaatgacaggttaaaaatatgtttagacaaaaaaaatgggatcctgagcaagaaccaccatgttgtgagcccacgagaggtttcatgttgcgtggcatgctgctga

SEQ ID NO: 106846 - DNA, 360 bp, Glycine max
  Peptide Sequence Number=SeqID_223624
atgattttgagcgccgtcaaagacgaagccgagaaaacaatagaacctctcgaagaagaaaaagtcgcggtgtcaacgacgaagaagaggaagcgcaagggaacctcttctgaaacggtcgaaggattcaatgtgttcagaagttcaacgtctgtggtccagtcgaatgatgaagtccgagtcattgaggagtccgttcgggacgcaatatttagaaagcaacacaacattcatgtctgtggttataacgtgccatctccgcttcaacacaacattcatgtctgtgattataacgtgtcgtctccgcttcaacacaacataccagagaagagccaaggtcctggcaacaataattcataa

SEQ ID NO: 106847 - DNA, 1167 bp, Glycine max
  Peptide Sequence Number=SeqID_223625
atggtttacatggcagcatctcgaggaggggttcataaacttgtatccttctctcagattgaaaaactagtttcctttgtacattgcaaacaatatctgccaccattgcttgagactgtgcgccattttagctttaccgatgattgcagtggcagaagcaaacaacctgttggagaatccgatgacttttttcttcaacagtcagactcaagttttaaagataatggagaatctgatcagtctttgtcagaaccaattccaagtagacctttgagaagtaggaagccagttaatcagcctcctccacgtttccaagaatatgatagaggttcccattccttccctccgagattttatgacaaccatggtgggcctgatgaattggaccaaacgaataaatcttccaaaattgatcttgcatttcagaacacaaatgtggcaaaaacgaatagggatgctggccaatcaggagacagtttccttaataaattcaagcttggttttgatgataaaacagtgaatctgtcagaggttgcagcaagtaagcaatctgaagaagcaaagaggtcaaatcccaatcaaccggctcaagagtctatgcctcaagatgctgatgagatcttcaagaagatgaaggagactggccttatccccaatgctgtagctatgctcgatggtctatgtaaagatggtttggttcaggaagcattgaaactttttggtttgatgcgggagaagggaaccattccagagattgtcatatacacagcagtagtggagggatacacaaaggcccacaaggctgatgacgccaaaaggattttcaggaaaatgcagagtagtggtgtttcacccaatgctttcagttacatggtccttatacaaggactctacaagtgtagcagattacacgatgcttttgaattttgtgtggagatgttagaagcaggtcattctccaaatgtgacaacttttgttggcctagtggatggtttctgcaatgaaaaaggtgttgaagaagctaagagtgctatcaaaacattaacggataagggttttgttgttaatgagaaagctgttagacagtttttggacaagaaagcaccattttcaccctctgtttgggaggccatctttgggaagaaagccccacagcgaccattttaa

SEQ ID NO: 106848 - DNA, 1296 bp, Glycine max
  Peptide Sequence Number=SeqID_223626
atgaagacagaaaaagtttggcgtttaggcggcatgggtgatatgcagatactgcctgggtctcgccaccgtcctcccatgaagaagccgaagtggattattgtcttggtgttgtttgtctgtgtctttctaatctgtgcttatatctacccaccgcagaacagttcgacctgttatgtcttctcttccaaagggtgcaagggttttgttgattggcttccgcctatgcctgcaagagaatacaccgacgaggagattgcttcgcgtgttgtgattaaggatattttgaactcgccggcagttgtttcgaagaattctaaaattgccttcatgtttttgtcacctggctctctgccatttgaaagattgtgggacaagttttttcaaggtcacgaagggaagttctctgtttatgtccatgcatccaagacaaaaccggttcatgtgagccgttattttgttaatcgggatatacgcagtgacccggtgatttgggggaaaatttctatggttgatgcagagagacgactattggcaaatgcccttcaagatactgacaaccagcaatttgttctactgtctgatagctgtgtgcctctgtatgattttgagtatatctacgagtatctgatgtatacaaatatcagctttgtagactggtatgacttgcagtattacatgtgtctctctggctttaaggatcccggtcctcacggcaatggcaggtattcagatcacatgctacctgaagttgaggtgaaggactttagaaagggtgcacagcctggtttggaggggaagaattgcattgctgatgagcattacttgccaaccttcttccagatggttgatcctggtggcattgcaaactggtcactaactcatgttgattggtctgagagaaaatggcaccctaaatcatacagggctcaggatgttacttacgagcttttgaagaatatcacgggtaaacctctggcatcatcatcacatcccagtcttaatctgtttggatatctaaggatatgggtgaaatggaatggcgtgttggcaacacgtgcattcttagctattagaagaaacacttgcaatgctgtggtgttgtttagtaagcgtgctgcaactgtgtccattgatgttagcatgcacgtaaccagtgatgagaagaaagaagtgcaaagctggccttgcttatggaatgggattcagaagccatgttacctatttgctaggaaattcactcctgaaacactggatagtttgttgcgtctactggccaattattcaggaccttga

SEQ ID NO: 106849 - DNA, 1038 bp, Glycine max
  Peptide Sequence Number=SeqID_223627
atgctcgggacgggtcggaccctgcctgacaaattcacatacccggttgttatcaaggcttgtggtgacttgtctttgattgatgtgggcgttggaattcatgggcagacctttaagtttggctatgattccgacacatttgttcaaaacactttgttggcaatgtatatgaatgccggggagaaggaagcagcacaactggtttttgacttgatgctggaacggactgtgatttcttggaataccatgattaacgggtacttttggaataactgtgtagaagatgcagtaaaggtttatggtagaatgatggatgtgggtgtcgagcctaattgtgcaactgtggtttcggtgttgcctgcttgtgggcttttgaaaaatgtggagcttggcagagacgttcatgcattagttcaggagaaaggattttggggagatattgtagtttggagtgcattgccggacataagtgctttgatgctttgtcggatgaggcagtgtgaaggagtgaaaccaaattcggtaagcatagcttctttactatcagcatgtggcagtttggtttatttgaactatggcaagtgcctgcatgcatgggcaataaggcaaaagctcgagtctgaggtcattgtggaaactgccttgattgatatgtatgccaaatgtaatcatggcaacctcagttataaagtgtttatgggaacctctaagaagagaacggccccatggaatgctcttctatctgggttcatacaaaataagcttgcaagagaggcaatagaactctttaagcaaatgttagtgaaagatgtacaacctgaccatgtgagctttaatagtcttctccctgtatattctattcttgctgatctccaacaggcaatgaacatacattgttacgttataagatcaggttttctttacagacttgaagtagcaagtattctagttgatatatactcaaagggtggaagtttaggatatgctcaccagatttttaatataattcctctgaaggacaaggatattattatttga

SEQ ID NO: 106850 - DNA, 1299 bp, Glycine max
  Peptide Sequence Number=SeqID_223628
atgaaggacttgggcttacacgacgactccgccacccccgtattgaaaacttttctccaccccgacgacgacaacaacaacccatcatgcgacgacttcacacccttcgaccacgcgcttgaattcacctctctctccgacatctactccaaccaaaacctcgccttcgatttcaaccacttgcctcacgacttcaaccaccacctcaatggcttcgatttcatcgaagagctcatccgcgccgccgactgcttcgacaccaaacagttacacgtggcgcaggtgatattggagcggctcaatcaaaggctacgatctcctgtgggaaaacccctccagcgcgcagcgttttacttcaaagaagctctccagagtcttctctccggttcgaaccggaccccgaggatttcgtccctggtggaaatcgtgcacagtatcagaaccttcaaggccttttcgggaatttcgccgatcccaatgttctctatcttcaccaccaatcaaatagttctggatcacgctgcgtgctccttcatgcacgtcatcgacttcgatataggtcttgggatccaatacgcttctctcatgaaggagattgcggagaaggcggcggagtcgccggtgctccgaatcactgccgtcgttccggaagaatacgccgtcgagagcacgctcgtccacgacaacctcgcgcagttcgctctcgaactcaggatccgagtgcaggtcgagttcgtggcgcttcgaaccttcgagaatctctccttcaagtccgtgaagttcgtcgacggcgagaataccaccgtgctcttgtcgccggcgatttttggccacctcggcaacgccgccgcgttcctggcggacgtgcggaggatctcgcctagcatggtggttttcgtggacggtgagggatgggcggagactgccacggcatcggcggcgtcgttccggcgtggcgttgtgagcagtttggagtactactcgatgatgctggagtcgcttgacgcgtcgacggtgggaggaggaggggagtgggtgaggagaatcgagatgatgcaactggggccgaagattttggcggcggtggaaagcgcctggcggaagttgccgccgtggagggaggcgttttatggcgccggaatgaggccggtgcagttaagccagtttgcggattttcaagcggagtgcttgttagcgaagtcacaaatcagaggcttccacgtggcaagacgtcagaacgaactggtgcttttctggcatgatagggccatggttgccacgtcagcatggcgctgttag

SEQ ID NO: 106851 - DNA, 132 bp, Glycine max
  Peptide Sequence Number=SeqID_223629
atggatcaagcttacacgttaaagatgtgttgggacttgatgaggagtaagagaaaaactagattccctgttatgaagccaaaaggcctcttaagggcaatattactctactctggtatagggacaggataa

SEQ ID NO: 106852 - DNA, 894 bp, Glycine max
  Peptide Sequence Number=SeqID_223630
atggctctccttggatcaaacataacaagcgaggttggactccgtttgctcctttgtcctcttggttccaacgttgtaattagaacagcatgctgtactgtgggagttgctttgcctgtgtactctacgttcaaggcaatagaaagtaaagatcaagatgctcagcataagtgtcttctctactgggcaggttggttgaaatcaagtttcaacattggaatggaaggcgggtgtagaatcattgatcgtatcatgaattgtaagtttaaacaaatgaaaaacaacattgaaacacgtgcgcaaatacacacatgcataaaacattacctagataagaaacctaataacacagcacgcagcagcaacctagtaacacagcacacagaagtaacacaaccaaagaagaaaaaagagacaggggcaatagtgtgctattggaatgaaagaagcacaagggaagagacagaagcagaaacagtgaacaaagagggaatattgcgctcctatggttcattcagtctcgctgaagtgttcacggacaagcttatttcttggtgtcctatctactatcacctgaagtttgcatttcttgtttggcttcaacttccatctaccagtggtgcaaaacaaatatatgcaaaccacttgcgccccttcttgttgaggcatcaagcacgagttgatcaagtcttgggttttgcatattgtgaagtgataaaactcgtgagttcataccaagcagagatccagtttgtcaggagcatggtagtaaagataactggatcagcggatcaaatgttgagaggcggtgctgaatcagatagatcgccgcaacatatttcagccgaagaccccgcctctgatgctgaatctgaccaaaaccacaatcactga

SEQ ID NO: 106853 - DNA, 204 bp, Glycine max
  Peptide Sequence Number=SeqID_223631
atggtcgtccaggtcgagaacggcgtgatcgttggtgggcttttcggtgcccgggctcgggctcgggctccggcacaggtcgaggacagaagtgggctcgtagcacaagctcgtggtggtggtggtggtggtggtgttgaggttgggaagggcaatggtacggactacgttattggtgggttttgggttggcctgtggggatga

SEQ ID NO: 106854 - DNA, 141 bp, Glycine max
  Peptide Sequence Number=SeqID_223632
atggcagaaacaggatataaattcttctgcaacactctactgaaagaatatcaaaccctgaagccacaattctgtcttcgcatccgtgaggaaaaactgcttctagtgatttttttaatggcatatagagaagtgaagtag

SEQ ID NO: 106855 - DNA, 321 bp, Glycine max
  Peptide Sequence Number=SeqID_223633
atggctagagtcaagggcaagccacaagggttctctgtttcaattctcatagcaactgcagtaatgtcatctttgatgaacatagcccctcaaaaagcagtcatagctgaaaccggagaggttgtggatgctgatgaggtgaaaataaacaccgttttagaagttaaagcaggcgaggtgatacccattgatggtgttgtgatagatggaatctgtgaagttgatgagaaaaaattgactggggaatcattccctgtggcaaaacaaaaggattctactgtatgggctggcaccatcaatttaaatggtaaaaattcttag

SEQ ID NO: 106856 - DNA, 1575 bp, Glycine max
  Peptide Sequence Number=SeqID_223634
atggcaaagcttgttgaagaagctcaaaacagcaaaaccaacatccagagattgattgacaagtttgcccagttttataccccaggcgttgtaatcatatcagctcttgtagcggtgattccacttgcgctaaaacaacataaccataaactttggcttcagttttcgctggttgttttagtaagtgcatgtccatgtgcactcatcctttcaacgccagttgcaactttttgtgcttacaccaaagcagccacatcaggtcttctcatcaaagggggtgatcatcttgaaacacttgccaaaattaaggtcatggcctttgacaaaacgggtaccataacgaagggtgaatttgtggtcacacattttcaatctctttcagatgacattgatttcaacacattggcttactgggtgtcaagcatagagagcaagtcaagccatccatcggcagcagcaattgttgattatggaaggtctctctccgttgaaccagagccagaaaaggtgacagaatttgaaattttccctggcgaaggaatatgtgggaaaattgaaggcagagttatttacattggaaataaaagaattgccgcaagagctgggtttgaaacagttcctatcttacaaggtgaagttgaaagaggaaagaccacgggatacatatacttgggagcaatcccaattggatttttctctctttcagatgcttgcagattaagagttcaggaggcaataggacagttgaagtcattgggaatcaaaaccgctatgctcactggagataatcaatctgctgcgatgcaagtacaggatgagctggggcattctcttgagttagttcatgcagaacttttgccagaggacaaggtgaaaatcatctcagaatttaagaaggaaggtccaacagccatggttggggacggcctaaacgacgcgccggcattggctgcagctgatattggaatctcgatgggcatttcaggttctgcattggcaagtgagacgggcaatataattcttatgtccaatgacattatgaagataccagaagccattaagcttgcaagaaaagctagtaggaaagtggtagaaaacattgttttttcaatcatgactaaggctgcgattcttgatttggccattggtggtcatccacttgtttgggcagcagttgtggctgatgttggaacatgcctattggtcatctttaacagcatgttacttctgcgaaaaggacacaaccatggaggaaaatgttgtagatcttctactaaaccgcataaccacaaaaatggatgtggtggctctcatgataattcctctcatcatcaccatcatcatgagcatgatcaacatcaacatgaagatcatagccacaaacgttgttgctcagaaaagacaaaaaaattgttcccacctcagaaatgtggtggtgctcatggtagttcctctcatcatcatcatcaccaccgtcaacatcaacatgaataccataaccatgaccaacacgatcaacatcatcagaagtgtgcctcacaaacaagtttctcaacatgtccaccctgctcttga

SEQ ID NO: 106857 - DNA, 165 bp, Glycine max
  Peptide Sequence Number=SeqID_223635
atgacggttcgtgatggaacgatgactgaaacctctttgattcctgcagaggaagagaagcggttaagactaagagaaaaaggaaaaacaacttcttctaacaacagagataaggaatttggtggtgatgatgccgatggttggaagcggtgcaagagagcttaa

SEQ ID NO: 106858 - DNA, 217 bp, Glycine max
  Peptide Sequence Number=SeqID_223636
atggctcctgacactgttgacgaattcctcatacactttctagctttcaggacatggttcattgaatccaccctagttaacgagttgtcaagtgtagcggctacaacttgtgtagggggaataacgaatcggaggatgagacagttattggccagggaagaagaggaatggacagacactagagaaaatatgaaaatgctaatgggtgtctttactg

SEQ ID NO: 106859 - DNA, 240 bp, Glycine max
  Peptide Sequence Number=SeqID_223637
atgaaggaagagcatgtgtacaagttgggggtgtatgaattgaaggtggtaattccacgagggttatccataatgatggctggtggggtgcaagtgcaatcgcatgatttgctgtgtggtaggagactttggcacacgaattgcacaacgcatcccgcacttaaaaataaaatagaaaatggatgcaatgtatataccgttataaataggttgttggaatggattccatcgtctccttag

SEQ ID NO: 106860 - DNA, 486 bp, Glycine max
  Peptide Sequence Number=SeqID_223638
atggacctgaacgaatcccgccgcctctaccagcaactcgccagcgaactcaagcagcgcatcgaagcgggcagttatgccgtgggggcaaagttaccggcagagcggatgattgcggaatcgcaccaggtgagccgcaccgtggtaagggaagcgatcatcatgctggaggtggaaggctacgtggaggtgcgcaaagggtcgggcattcatgtgatcagcgaccagccacaaccgcgcgacagcgccgccgatcagctggagtttgccagctatggcccctttgaactgctgcaggcgcgccagttgattgagagcaatgtcgccgaatttgccgccacgcagatccgtccacaggacatcgtggcgctgctggcaattcaggaaaaagcccggcaggaagatcacgcgcgcgattcgacatgggatatggagtttcacgtgcacattgcccaggccacccaaaacagcgcgctggccgccatc

SEQ ID NO: 106861 - DNA, 305 bp, Glycine max
  Peptide Sequence Number=SeqID_223639
atgtcgcaaagcgctgaagctgttataccatctggcaagttaagaacctgcgcgcctgctcagttcggcgaaggcaactttttacgtgcctttatcgactggcagctcgactggctcaatgaacatcagggcaccgatgccggcgtggtggtggtgcgaccgcgcaaccggatgcagacggagacgctcaatcagcaggatggcctctataccacgctgctgcgcgggctaaatgacgccggggaaccgctcagcgaaacccggctgatccgcaggctcaatcgtgacattcagccttatcagca

SEQ ID NO: 106862 - DNA, 470 bp, Glycine max
  Peptide Sequence Number=SeqID_223640
gtgcttatccattggtaccttcccgaaaagagaaagagcgtcatttggccagatttcttgacatttttaagaagctggaaattactttgccttttggagaagctctccaacaaatgccattctatgccaaattcttgaaggagatgctaacaaagaagaaccggtacattcatagtgacagaattgtagtggaaggaaattgtagtgcggtcattcaacgcttccttccacccaagcacaaggatcctggagttgtcacaataccgtattcaattggtgaggtagctgtggataaagctctcatggacttgggagctactgactttgttgttatggaaatagaagaggacgctgatattcctcttattcttggtcgcccattcatgtctactatgagctgcatgggtcctcctgaccaaaacgtctgtctgaaggtgcatgtaatggaggagaggagacgtgagaagaag

SEQ ID NO: 106863 - DNA, 528 bp, Glycine max
  Peptide Sequence Number=SeqID_223641
atgggtgaaatagaggaggtgcaagagcagatgaaggccgacatggaggccatgaaagagcaaatggccacaatgatggaggccatgatgagcatgaagaagataatggaagccaatgtggttgcagttgccgctactagcgctgttgctaaggtgaacccgttgcccccatctgatctcaaccaaatgaatcatccaacctcaaatatggtgggcaaagatttgggaagtacggacggccccatgatgtgcaaattcaaaacgagcacgccttcccgccatatggcttgcctccgaactatacaccacccaatgtggcgtacactccccaatgaggatgtcaataactccactcccatactcattgagagccgacaacctcatcatgttcatgtctctcaacccatgagggagacacatgaaattccccaccacaatctagccgacttcgagccttgcctcggatatgccactgaagggcaaagcagttggtggtatacccctgcaaaaccctttggaaggccctaa

SEQ ID NO: 106864 - DNA, 597 bp, Glycine max
  Peptide Sequence Number=SeqID_223642
atgagggagtggttttcttataggctacaatgcatatcaaatgaatctataactttgttgaattctaagagactattccaaaaatttgttgttgacggctatactatggttgacaagttttgtagcttacaacattcattggataatggaagtaggagaggcctaaataaaggtaaaagagtcattttgccttcaacttttgttggcagtccgcgctatatggatcaactttattttgatggtatggtcatatgtagccatgtgggcttcccaaatctgtttattactttaacctgcaatcaaaactggcctgaaatccatagattgctgagtccgttgaatctgaaagcagtagataggtcagacataatctccagagtcttcaaactaaagtatgaaaaaatgcttattgacctgacaaagaatcacatgctaggcaaagttattgcatatatgtatacaatagaatttcaaaaacgagggctacctcatgtccatttgttgctttttttacatcctgataacaaatacccatcctcagctgaaattgatcaaattatatcagcagagataccttcacagcaagatgatccataa

SEQ ID NO: 106865 - DNA, 282 bp, Glycine max
  Peptide Sequence Number=SeqID_223643
atgcccagtgggcccgaagaattccaacagggccctggggtttccagctctggttgcaggcctctgtcagtcctacagggtgcccgttcccccagcgaggaatcgctcccacaaagacacccagtggacccggagaagtccaacagggccctggggtttccagctctggttatgggcctctgtagtcctacagggtgcccgttccccccggcaagcaagggcatcaggccccctactaatcgagctttcatcaagaagtactgcgtccccaggcaggcatag

SEQ ID NO: 106866 - DNA, 287 bp, Glycine max
  Peptide Sequence Number=SeqID_223644
tgacttcttttggataccataaggatcgaaatggtcaatggctaaagaaagatgcacttcctcctcaagatgagcgtacgccttctcctcctcctcagcgagatgattcagccctcatgactgaagttctttccgagttacgaggtcttcgtacttatgttggcgaacattttgattctctggatactcgctttgccggcatggatattcgtctcacacagcttgaagaagatgtgggttatattcatcagagcttcgaccttccaccaccacctccaccttcttag

SEQ ID NO: 106867 - DNA, 954 bp, Glycine max
  Peptide Sequence Number=SeqID_223645
tgtccttaccttcagagggatacacgtcctcgcctttagaggactgaacatcctcaccttcagaggactacacatcctcgcctttagaggactgcacgtcctcgccttcataggtctgcacgccctcgccgtcagaaggctacatgtcctcaccttcaaagggatacacgtactcgccttcagaggactgcatgtcctcaccttcagagggctacacgccctcgccttcagagagctacacgccttcacctttagagggctacacgtccttgccttcagaggactacatgtccttgccttcaaaggactacacgtcctcacctacagaaggctacatgccctcgccttcatagggctatacgccctcgccttcagaggactacacgtcctcgcattcagagggctgcacatcctcgccttcagatggctccacgccctcgccttcatagggctacatgcctttgcctttagaaaactacacgccctcgcttgtagaggactacacgtcctcgccttcagagggctacatgccctcgcctacagaggactacacatcctcgccatcagaggaccacacgtcctcgcctttagagggcaacatgccctcaccttcagaggactacacgccctcgcattcagaggactacacgccctctccttcagaggattacacgtcctcactttcagaggaccacacatccttgcctttagaggactacacgtccttacctttagaggactacacgtcctcgccttcaaaggctccgcgtcttcacctacaaaaaactacacgtcctcgcctatagaggactacatgtccgcaccttcagagcactacacgccctcacctatagagggctgcacgccctcacctttagaggactacacgtcctcgcctttagaggactacacgtcctcgccttcagaggactacacgtcctcgccttcagaagg

SEQ ID NO: 106868 - DNA, 315 bp, Glycine max
  Peptide Sequence Number=SeqID_223646
atgtgttcccttgattgtgtggtcgctttacacagagcaaaggatgaacacaacgcctatggtagtgctcaccgtcgaccacatgatcaagcgaacatcattcgtcaccctctcaagcatcgtaccagatcaagatcgagatctaaaaccaaatctaaaatgcacaatatcgagatttgtgtggttcgcggttggttatggtggggtagagtcacgacttggtcacatgagagcggtgatgtgaaggtttgtggttggtggttttgggtggtagctggtcgtggtgttggacttgttggttcaatgatgttgatg

SEQ ID NO: 106869 - DNA, 207 bp, Glycine max
  Peptide Sequence Number=SeqID_223647
atgtcaaaggttcaaggtttcaagtataaggaacttagaacacagagaattgtagacaatcaagcaaaaatagaagctttagggttgtccaaattggccaccattttcaaggataaaattcaaaaggttaagaaaaaggataaaaagaaggtcaatgacaatgatgaagactatgtacggacgacttggatcaaattcttcaagtga

SEQ ID NO: 106870 - DNA, 171 bp, Glycine max
  Peptide Sequence Number=SeqID_223648
atggcatacgacagtgaagaatgtcttgttaaacttatggaatggctagatgggttcctaagtgtgttgttaagaatgaaaatgaacctgtattaccatattggtctgatgtacagtgcatacatgacattgcatatgggtagtcattgttggggttttcatggtggctaa

SEQ ID NO: 106871 - DNA, 294 bp, Glycine max
  Peptide Sequence Number=SeqID_223649
atggagggtacggttattgaggtggaggaaacaggaaaagagtggcaaagtgaatgctgggtagtgagacttcgtgatataaggatgtatgacaggttgcaagatctggtttttttgaaccataaatgtgagattagactcaggtacttgggagacaacctgatccttatatctggcctggatgagagtggggttactgagaagatcaacaacgaggatgaaagtttcttatcggtctttcataatgtacagagatggaacccaaacgttagaacacaaaataggattgtttag

SEQ ID NO: 106872 - DNA, 891 bp, Glycine max
  Peptide Sequence Number=SeqID_223650
atggcatgctgctgggtcctttggacagaaaaaaatgatgaagctcaagcgagagggggaggcatgatggatatgacaatacgccaggcatgccgttttgctggaattttgttacttgtcaactcctgttgcttctatgctcaagcaatagatcatattattaactctgccgcaaaatcaaactacatgtctgctgggcaaatatcggtacctattgtctttagaggacccaatggtgctgctgctggggttggtgctcagcattctcaatgttatgcatcttggtatggctcatgccctgggttgaaagtcttgtcaccatattcatctgaagatgctcgtggtttgcttaaagctgctataagggaccctgatcctgttgttttccttgaaaatgaattgttatatggtgagtcattccctgtttcggccgaagttcttgattccagtttttgccttcccataggaaaagcaaagattgagagggaagggaaagatgtgactattacagcctattcaaaaatggttggctatgctctcaaggctgctgagacactggcaaaggaaggaatcagtgctgaggtcattaatttgcgttcaatccgaccgcttgatcggtccacaatcaatacttctgtcaggaaaaccaacaggctggtgacagttgaagaagggtttcctcagcatggcgttggcgctgaaatctgcacatctgtcattgaggagagttttggttatctagatgcaccggttgagagaattgctggggctgatgttcccatgccttatgcagcaaatctggaaagaatggctgtcccacaggttgaagatattgttcgtgctgcaaagagaacatgctacagatccgtgcctttggctgcatccgcttga

SEQ ID NO: 106873 - DNA, 216 bp, Glycine max
  Peptide Sequence Number=SeqID_223651
atgtgtgtgaaagagagtgagatggaagaagaaccaattcatcaattatactcaaagacgttcttgacgcttatggctttatttaatcgggatatggacaatcatgactttcacgattctctgtttcacggcttccacattatgatttacatgattatggcttcttggtctaattcaggggtcgtggctagaaacaaggataaatatgaaacataa

SEQ ID NO: 106874 - DNA, 327 bp, Glycine max
  Peptide Sequence Number=SeqID_223652
atgttgcttcttctgcattctaagcctatccctcttaagattattgaggctacaaggtccaacacttccttctccattcagttgtcattcatcttcaagaagcaaaggactccattgatgaagaagatccaaggcctacgagctccacatgggagctacatcataaaggtggcaggacctcaccacactttactcaggatagaacctgtaacaagagtcgaagctctgataccagatgatgtaattcttacaaagagcggatcgcttgatacaggtcacagagtttggatgatgccacttcgagagagggaagataagtcaaggtag

SEQ ID NO: 106875 - DNA, 321 bp, Glycine max
  Peptide Sequence Number=SeqID_223653
atgaattctttagcattgtgttccctttgcctgtttctcattgctcagtctccttggttaacaaatgctacagtgtttggtgatggttccgacctaattggccagatttgcaatgaaaacccagagaagaagattgaatgcacgaatattctaagagcagatcctacagtcctggatgttccggccattgcaaattgtgcactttattatgaaagaacgattgaagactttacgaattctttgaatgcgttgaaacgccaagatcctcaaacggctaactatttggccgacattgctggtgatggaccatcgtcatgttag

SEQ ID NO: 106876 - DNA, 468 bp, Glycine max
  Peptide Sequence Number=SeqID_223654
tctccttggttaacaaatgctacagtgtttggtgatggttccgacctaattggccagatttgcaatgaaaacccagagaagaagattgaatgcacgaatattctaagagcagatcctacagtcctgggtgcaaaaaatcttcttcaactttcggaggcaatcttgaacttggccgtgaataagacagaaaaagctgaagattttctaaagggattggcgaacacaacagatgttccggccattgcaaattgtgcactttattatgaaaatgcggttgaacgctttatgaattctttgcaaaagttgaaatgccaagatcttaaagtggctaactatttggccgccattgctggtgatgaaccatcgtcatgtgagacagaattgagtgctgcacatattgttaaccatgcaatttctgctggaaactgtcttagtgctctagcatcttctttgcgggagagtgattaa

SEQ ID NO: 106877 - DNA, 987 bp, Glycine max
  misc_feature (22)..(22): n is a, c, g, or t
  Peptide Sequence Number=SeqID_223655
atgaatatatacttggtgttgnccgtatcatttcttggtggtaccatattagctgaaagtggagattgcggtgggaaggacatttcaaccacaattactgttggtggtagacagggcaattttacatttggatcaattcaagctgcaattaattcaatcaaaaccaacaatgatcgatggataaagattcacatagaagctggcttatatataggaaagatttatattccccaagaaaagccctgcatcattttagaaggagagggaagccgaaaaacaatcataactttctgggaccatataggaattgacactagcgctacattcacttctgagccccctaatgtggttgctactgacattggtttcatgaacacatataacagcatcaatagaagaattgaaattaaacccgccttggcagcaagaatatatggagacaagtcatttttccttagatgtaatttcattagttatcaagacaccttgttcgatgcaacggggcgtcattactttaagaattgttatatagaaggtgaaatagactttatatggggttatggacaatctttttatgagaattgttcaatcaatgctgtaggaataaatagtactggaccagactttgttacagctcaaggacgagagtcaccaactgatccaagcggttttgtgtttgaaggaggttctcttgtcggagatggaaaggtaaatttaggaagagcttggcgtgcttactcgagggtaatatttcatggaacatatctttcttctgtggtgactcccgaaggatggaacccatggaattatactggtagcgagagtaactttacttatgctgaagttgattgcaaaggaccaggagctgatacttcaaaacgtgttaagtggataaagacattaaatcaatcgcaacttaatgaattttctttgacttctttcattaataaggatgggtggattgataatctaccaatcattttctag

SEQ ID NO: 106878 - DNA, 531 bp, Glycine max
  Peptide Sequence Number=SeqID_223656
atgaattctttagcattgtgttccctttgcctgtttctcattgctcagtctccttggttaacaaatgctacagtgtttggtgatggttccgacctaattggccagatttgcaatgaaaacccagagaagaagattgaatgcacgaatattctaagagcagatcctacagtcctgggtgcaaaaaatcttcttcaactttcggaggcaatcttgaacttggccgtgaataagacagaaaaagctgaagattttctaaagggattggcgaacacaacagatgttccggccattgcaaattgtgcactttattatgaaaatgcggttgaacgctttatgaattctttgcaaaagttgaaatgccaagatcttaaagtggctaactatttggccgccattgctggtgatgaaccatcgtcatgtgagacagaattgagtgctgcacatattgttaaccatgcaatttctgctgttaaccaccaaacaagtttgcttagctatattgcattcgtagccacagggaaactgtcttag

SEQ ID NO: 106879 - DNA, 144 bp, Glycine max
  Peptide Sequence Number=SeqID_223657
atgatgaggacctctgtctatatgcttggtgttattgaccatgacgtggttgagctgaataatatgcataggcaggttatccacacggaagcatatgttggtaagccaaaagtgaaatctgccgctgctgcttgtggctcgtag

SEQ ID NO: 106880 - DNA, 2667 bp, Glycine max
  Peptide Sequence Number=SeqID_223658
atggatctggaggtggcagggcggcacgcgatgctgttcgacgacgacggcatggcggcgttcgtgaactcagcggaagctctggtcgaatggaactctctttccatcgaccgctacgatgtccgccatcttctctccgctcccctccccccgcgcctcaagcgccgccctcctccgcccgaacccgacctcgatcaccagcgctatctcgatctcccttcctcttctgccgacgatgaacaacaagattatggttcagatccagtgagttcaactggctttcatgctgtcgccttttcgtatggaaattctaatgtgtccacggagacaaaggacaacgataccaagtctagttttgatcctaaattcccagtaccagaaagcctactcaataacctgcctccaaatgagaaagtacatcagattatttcacggactgcaacatttgtcagcaaacatggaagccagtcagaaattattctgagggtgaaacaaggagacaatccaacttttggattcctgatgcccaatcatcatcttcatgcgtattttaggtttcttgttgatcaccaagaacttctgaaagttgacaaagatgatggaagctcaactgaggacatgaataggactcaggggcttgatcaatcaggtggtgcattgtctttgcttggatctgtctatggatccggagaggacgaggatggtacaactgagaatacttgtgatgttgagaaaaaagaatgtgagggagctgttgatgctgttagtaattatacttctccaggaatagatcaggcagaatcttattcagatgtggccaagaatgatggagacatttctaaaaatccagtaccctctttgaaagaaaaagttcctgtcataaagcggaatcattctatcagtactgttaagactgctaccacagctagagcaaaaggtgatggcttggattcagtttctaatgcacagaacaagtcacagacttctgtgacgagtactgctaagattgaactcccagttgttaaacctccatctgatttaaagagagctatagagaagatagttgagttcatcttaaaaaatggaaaacaatttgaggctgttctggcagaacaggatcgacctcatggaaggttcccgtttcttctgccatctaatcgatatcatacttactatctgaaagttcttcaaactgctgaagagtctaagttactaggcaagggccaccagaagcacaatccagcaggtcgtacaggggacaataatactgctgtacatgaagatagagacaatctttcacatggatctatggcttctgatctaccatatgacatggaccgaaaagaaaagttccagatgattattggcaagtctaagaaggatggtcaagatccaattccaaaagagcaagctcaaaacacaattagcatggatgcagcagcaactgcagctattcttcaggctgccactaggggtattaaaaaccccaatttggaagctcttaccaagacatcaagtggtagtggtcaaggccttggaagtgatggtgggtgtttgtccagctctgggactggtagtctgtattcatttcaaccacaaggttttgttgaaaatcaaaacctgaatgtaaaggcaaaggctagtgcttctgccccttttgccaaggctattgcagaaaaagtagctattgcagcagcaggtgaggcggactcctctgaagcacacatgactaaagagcaaaagcttaaggcagagagattgaaacgagcaaagatgttttcagccatgctaaaaagtggtgttggagcaagtgaactgccacgagctttatcagtcgagccaccaggctctggagtttcaggttcagatgctgagactgggaatcttgtgggtaaagaaagggaaggaagttctgttccatttgatgttgataattcagataaaagtcaaaagtctgaggacaagctttctattgataataattcagataaaagtcagaaatctgaggagaaacttactgatgataatgaacgccggtcaaaaagaaagtaccgttcaagatctagtagacatgaagaggaggaagaagaaaacaaagataggagggatcacaaaagatccaggaaaaaacatcactctcatcgcgcttcacaccacaatcgggacaggcataagcacaagagaagacattcctcctccaaagacaaatattcttacagggggaccaagcacgatagctcctctgatgatgaacatcatcgctcaaggcatcatcgtcataaatatgatagctcctcctctgatgatgagcaccactcttccaaacaacgacatagggatgataacttgtcagaccatgagcatagacattctcgccattctaatgaagattatagttcatctgatgatgagcataggcatcgaagcagaagcagaagtgtaaggcataagagcaaatctcatgctgaaagagaaacagagctggaggatggggagataattatgaaatcggaaaagtcagtagtaagtggtgaagttggacgtgctagtagggaggcttctgagggattatctaatgcaagggcacaatctcaagcacctgaaataactgatgtttcttatgagcttagagccaaaattcgagccatgttgatggctaacttgtaa

SEQ ID NO: 106881 - DNA, 387 bp, Glycine max
  Peptide Sequence Number=SeqID_223659
atgtctgattgcattttctctccatattttcctgccaatgatcctgaaagatttgctcgtgttcacagaatctatggtggcagcaatgttggaaaaatgcttcagcaaataccatcatacttacgggaacaagctgcaaattctttgtattttgaagcacaatgtaggattcaagaccctgtttatggatgtgctgggattatctctaaattatatgaacaaatcaacagtacagaaattgcacttgcccatgtccaaactcaaattgcttgtcaaaagcttcaagtcccacaggcaaaagctgaatcaaacttcaatgtctttccagcacaaaacagtagcacagcagaatttcaatgggaaagtcaagttccttggtttaattaa

SEQ ID NO: 106882 - DNA, 246 bp, Glycine max
  Peptide Sequence Number=SeqID_223660
atggtgcacggattttccaggggtgctatcgtggacgagggaggaagagaagagagtgttgaggcgttgatgaccatggaagatcttgcgttgccacttaccacaactttggagttttttcgcggcttgttgctaaacttcgagtgtcagcacctccagaagaagaagaaagctaagggaagggactatgctatttctcattcattccatgtccatgctgttattacatattcctatttatactaa

SEQ ID NO: 106883 - DNA, 1503 bp, Glycine max
  Peptide Sequence Number=SeqID_223661
atgagtgctgcttctttgctattctcctgctctatgcatgtgggtgtatctcatcccaaggtggctgcaaaaccctctccatgctgtttgctcaatcagccatggaatcatttaaagtcaaaaacaccatttgggcattcaggagtctttgaaaaatctaaactttcgcataaaggtgatgagattctgtggagggcgggggcccttcaagttgaaagtgcaccctccttctctatgggccaaaaatttcaccttcatgatgtgattgaggctcagcaatttgacagagagactctcaatgccatatttgaagttgcaaggagcatggagagcattgaaagcaagtcatcaaggagccaaatgctaaagggttacctcatggctactttgttttatgagccatccactagaactaggctttcatttgagtctgccatgaaaagattaggtggggatgttctcacaactgagaatgcaagggagttttcgtctgctgctaaaggagagacgcttgaagatactataagaacggttgaaggttacactgatataattgtgatgaggcactttgaaagtggtgctgccaaaagagcagcaacaactgctagcattcctgtaatcaatgcaggggatggccctggacagcatcccacccaggcactgctagatgtttataccattgaaagagagataggaaaactggacggaattagagttgggcttgtgggagaccttgctaatgggagaacagttcgctcacttgcatacttactagccaagtatcaggatgtgaaaatttattttgtctctccaaacgtggttaaaatgaaggatgacataaaagactatctgacatcaaagggagtagagtgggaagaaagtgctgatttgttggaagttgcttctaagtgcgatgtggtttatcaaactcgcattcagaaagaaagatttagagagaaaattgaactttatgaggaggcaagaggcaagtatattgtaaatcaagatgttctagatgcgatgcaaaaacatgctgtggttatgcacccacttccaagacttgacgagatcacagtggaagttgatagagatccaagagctgcttactttaggcaggcaaagaatggtctatatattaggatggctctcttaaaggcaatcttgaacttggccgtgaataagacagaaaaagctgaagattttctaaagggattggcgaacacaacagatgttccggccattgcaaattgtgcactttattatgaaaatgcggttgaacgctttatgagttctttgcaagtgttgaaacaccaagatcttgaagtggctaactatttggccgccattgctggtgatgaaccatcgtcatgtgagacagaattgagtgctgcacatattgttaaccatgcaatttcttctgttaaccaccaaacaagtttgcttagctatattgcattcgtagccacagggaaacttctaacagtcgttgcacctttaatctaa

SEQ ID NO: 106884 - DNA, 897 bp, Glycine max
  Peptide Sequence Number=SeqID_223662
atgaaagatgatgatggccaagtggcatgttcaatagctcgctttgtgcacatggtagattatggaacagagatggaacaccatttagcatttctggttgattgccgaggagcttttggtagattaaatgagcttaaggaaactcttgttcactctagcaattctttagcaattcaagctttgaaatgtgctaagaaacatctgaattttgtcaaatcctgtgttacatttagtgaagtcacaataccttctatttctgctcacaggcagtttgatctttttctagaaactgcagaggttgcattcttagggggcttggtttctcattcagatggattgattgattcagcaatcagctgtttgcataccttagacataattgatggcttccgaactccaactgatgttgaaggactagtttcatctattagaaagctatgtggcttcttaattatggttccaggtactcttagtttaccagtcacctatttcccaaatagcttatttacattgatcagctcccggtcttggtttgaaccaaaaatgagggcacaaattttttctgctatcatattattattgacaactttatcacaaaagagactgccatatcatgcaaattcacagattccaggcaatgacatgttatactacggggattcatcgtacaaccaagagcttgtttctttgtctaaacttgttcttgagaacctgcttagtgccgttcaacaagaaccttcccaggctgctcgaggaattatggcacttgaagcttgcaattgcattgcttcttctttcatggcaatatgctttttttgtttcactattgccgccctggcagcccacccaaccaacctaccccactccctcactaatagacacccaactaactactaa

SEQ ID NO: 106885 - DNA, 285 bp, Glycine max
  Peptide Sequence Number=SeqID_223663
atggaggagtactacaaggagatggagatggcactagtgagagtcaacattgaagaggaaattgaggacacattggctcattttctaagtggcctaaatccttaccttagagatgttgttgaattacaggagtatgtggaattggatgacttgctgcataaggtagatggaaaaatcaccagtgaatctaaaattagtgaagaagaagtggaggaagagcttgaggaggaagctatgcagagtgatatgctaatggtgagaaggctcttgggaagtcagatgtag

SEQ ID NO: 106886 - DNA, 475 bp, Glycine max
  Peptide Sequence Number=SeqID_223664
atgtcattacccaagatgctgattgcccgttatgtggtcaagtacaggaggaagcgggtcacctattctttaattgccaaaggacactgcccctatggtgggaatccatgtcatggctacagagctaatgtaaaccatagcagatggtatgggtggtgggtggctctaactaataccatttggcaacacaggaataacctcatctttcaagggaaccaattcgactcttcgaaagtcatggaagaggccatggcaattatcgtggcagaggttccagaggttcttggaatggagcaaatgattctaaacatgagtattacagtcttgttttcaactttaaagaagcagtcaagaccgggttgtctcatcaacgagaactccattagccatcttccagcggtcaatgacatgttctgcatgcaaggggactggagaaatttgaacagcttgcaatacatgttatggggatggtcgg

SEQ ID NO: 106887 - DNA, 361 bp, Glycine max
  Peptide Sequence Number=SeqID_223665
gatcatggccacagatccgacgtctcccccgcagtccgatggtcaatcagaggcgacttccaagaggagtagaacaacgacacggttgagaacattgacattaagaaccgtggatcagcccagaccggcagtttatgtggatcccgctaccgggagagcatcgggaccgatgcgtgaaaagttccacagctacctaggcgtagtggcgcgagaaaaggttcccattatccacaataattggaaagacgtacctgaaacgctaaaagacatagtgtggaatgacattctatggtccaaacatccactactagcggtggaacatgttgagataagtctgggaaggaagaatagcaccttctaa

SEQ ID NO: 106888 - DNA, 465 bp, Glycine max
  Peptide Sequence Number=SeqID_223666
atgcttcctcgtgaaatatgttttgattatcatgaaattatcaagtggtggggttatgtacgaggcaatatcaattgctcaaagggttatgcctataaaaagaaattatcaattgataattgtggtgggattgtaattaagcggagcagtgactttcaagaaatcacgtcgtctagtctcgttgagggtcagtggatgcaacaagaaattagggaatttcaaaggaaaaagaagtgtgatgccacacatcaggaagcaataaggctacagttcccaaccaagaatacactactacaaaaagcagattctacatcggtcaaactaagctatctacgtcgggcctcccaccgtctttgttacagatgtcgttgtaagtcgacaacaacgacatcggtcagcccaaccaccgtctttgtaatgtcagaagacgacgtcagtgcgcaattaacaatagtcgttatataa

SEQ ID NO: 106889 - DNA, 474 bp, Glycine max
  Peptide Sequence Number=SeqID_223667
atggagattagtgataatgatgctaatgtaactactccatcaaaaggcttaaatgatcacgtgtacacattacaaagatgggttcccaagtgtgatcaacaactcaagcctgtagttggcaacgtgtttgatactttagaagagggcaacaacttttatacaacgtatgcacttgaagttggtttcaatatatgcagatcaattgaagtgaaatataaggatggggaaataaagtttaaatattatgtttgctcaagacaaggcttcaaagaagaaaatagaaggactataagtgtgatgcttgttgatgaaaaaagaatgccaaaaaccagacggagaaaagaaacaagggaagagtgtaatgcaaagattgttttcaagaggacaacagtagaaaatataaagtttttcgattttatgaaggttgatgatgagaggctaaaatatgtgtttttaggaggagggtcttcgtaa

SEQ ID NO: 106890 - DNA, 179 bp, Glycine max
  Peptide Sequence Number=SeqID_223668
atgtgtcctcctccagaaagggtgaaaacaaaaggtgctcagaagaaatcaatgaccaaagatcaacaaagtgtgatccgtcttactatgagtatgttgatgcattacattttgtgcaaaatggttatcatggataagtggatgaatatatccaacatgggatatgtgattgcatcaag

SEQ ID NO: 106891 - DNA, 195 bp, Glycine max
  Peptide Sequence Number=SeqID_223669
atgaaactcagttttgctattgccatgaatttttctaatgcgattgaaccagaggcaaggtctcatggacaagttttcaagtacaatcccacatcaaatgagactgttattttcctcgataatgttgcctttgccaatggggttgcactctccaaggacgaagattatcttgtggtatgtgaaacttggaagtaa

SEQ ID NO: 106892 - DNA, 576 bp, Glycine max
  Peptide Sequence Number=SeqID_223670
atgaaggctggtgcaaagttatatggctttcatgagcaacaaccaaagaaggtgatcaatggtccacgtccttcccctttgatgatcaacaaagattctcacatgatacgcaaagaaaccaaactccaaaggccacagaggattaatcccatcatcatttacaccgaatcgcccaagattatccacaccaaggccaaagatttcatggctcttgttcaaagactcacgggtaggtcatcaagcaccaatgataatttgtccactgcttcacttcctcaagagggttcagagaattttggatcatctttgtctgatgggtccaactacaatagcaatgaaacaagttcagctcttaggagagttggtgagaatttggttgagagtggtgcaattgttcaacatggtccctctaatctggattttgctgatatgccacttttcactccaaattcctcagatttcttttgctcttctggatcatcagtgtataaatattctgattccccatatggggttttgggaagtttgatatctccttccgggttggaattcatgaaagagctacctgaatattga

SEQ ID NO: 106893 - DNA, 312 bp, Glycine max
  Peptide Sequence Number=SeqID_223671
ctcaatgtgcttagcgagtttcatccgctaagcgaggcatcaacgcgcttagcggataggaggaatctggaagggaatctgtcatgcaggcacgcactcaacgcatcatcagctcgctcagcgagtcgtttgtcactttccaagcttagcgcgagtttggcgttgagcgaaaattcacttactcgcgctaagcgcgacatcgagaaaagaaaggggcactgggagatagaaaagagagcgctgaatagccataagagcttcaagagtgaaatacacagaggcaaagaacagagcaaagaagccaacttttga

SEQ ID NO: 106894 - DNA, 240 bp, Glycine max
  Peptide Sequence Number=SeqID_223672
atgctgccatactattttcagattccattaggagtgattttagccattcttgatcctgtgcacattgttgtttggaaaagtggtcctgcggtcattgttggaaagtcaattgtgctgaagcctccaactcaaggatctaacttgtctaccattaaaaacgtgttgacattcaatcgcatgcagccatgtatcaaccctcttctaaactaccccgtcaactgcatctcttacaagttgtga

SEQ ID NO: 106895 - DNA, 321 bp, Glycine max
  Peptide Sequence Number=SeqID_223673
atgggggaggcacataaaatgccccaccacaatctagccgacttcgagccttgcctcggatatgccactaaagggcaagcagttggtgatatacccctgcaaaacactttggagggccctcagtatcacccacaaccacacccctcacattctacagcgattaaaaaccctcatgctatggctgaaaagggaaagttggatcatatagaggaaaggctcaaggacattgaaggaggcgaggattatgcctttgctaacctagaagagttgttactagtacccaaacatggtcattcccaagttcaaggtgtcggacattga

SEQ ID NO: 106896 - DNA, 315 bp, Glycine max
  Peptide Sequence Number=SeqID_223674
atggagagttgggggtttcggttcgaaggttataaaatgcggtgcgggttcatctctctcgaccagttcaggttcaagggaagggtgatcgaggggacccagacttttgatctctttcttctgcgggaggtttctttcgtatcaagagtgtggtggggaggccagggaaagacggattggatcgagaggcgatgcctactctactcgttaccactaaacgacgaagccaagagcggaaggagggacttgaaccctcaacctcagccttggcaaggctatgctctaccattaagctatttccgccagcaacggtag

SEQ ID NO: 106897 - DNA, 981 bp, Glycine max
  Peptide Sequence Number=SeqID_223675
atggaacacctaccttttaggaaattcaaatttgttgatttttccactgtcattgctggtcattttcaaactggactcttggttgacgttattggcgtggttaatgaagtggtattccgatatgtctcatcaaaaaatatgagggttgttttcaaattaaaggatttgagtgggcaggttgaagatgaaaggtccatcattaatcttttgacacatgccaggatcaagaaaggccagggatcatatccactgtcaatcagtaattctttcaaggcgtctaaactcatgatcaacaagcttgtgttggaaattcaagaattcagagagaggcttttagatttatggattgaggttagatcagttttgacgcctattggacaagggagttcacaggtttcagggtcatctcaattatcatcaaaagatgcgtttctgtcaaaggcagaagcaaaaaatatctctcagattaatgtcatttccaaggtgatgtatatagttgaagtgatggttaatcacaagggcgaacataccaaatttttgctctgggaccatgaatgtgcagagttaattggtcaatcagcggatgaagtcaataggctcaaaatagaagatggcaatgctgatttaaatgtctctcctcaagcactagataggctattgggttgtttccttgcattcaaagtcaagccatgttgcaagatcgagagttcaatacttgactcaaccgaccctatagagcttgaatatcaatcagcgtttgttatcaccgatgataaccgttcaatgcttgactcgactgagcctacagagcttgaatctcaatctgtgtttgttaccgcggatcatgaccctcttctcaggattccattaataccaactaagtgtgtatcttctgatgagttggatgatgaacccaaaaactttgagatttcacatgtgaaagtttcctcaaataaaatagccaagcattgtcaggcttaa

SEQ ID NO: 106898 - DNA, 510 bp, Glycine max
  Peptide Sequence Number=SeqID_223676
atggagccatctacgaaatacaggaaagatttgaaaatctacgagtcaaccaccattaacttttttgcctgtgaccatcactgcgtatttgacatacatttcataccaccactggagcgacaaacttgtggcaggcagaggcattcatccagaaagcatatctggactgttcgatttactcaggaaatgctggatgctcctgaacccctgaaactcccgtgttatacagaagttcctcttaaagcttgtggtcaccacatgacagtcttaaggcgatctggtcctccattgcaatggaaagttgaaaccctgaatcctgctattggtggaaaaggcgttgttcaaccatggtatgattttcttgaagaaatggactttgatgaaggagatgaaatctctatttactatagatattatgaaaaaatttgggatattgtaattagaaaaaggaggattgggacgatagtgacaccgattaaactgctttttagttccaacaaaatctattaa

SEQ ID NO: 106899 - DNA, 384 bp, Glycine max
  Peptide Sequence Number=SeqID_223677
atggccaccacaacatcatgtgatttctcttcgttggaatctattcaacaataccttcttgaacttaaacacgatatattccaacactcacgagtgtttccaaccatgaaatatgttattccaacactatcccaacactattcgaaccctgatctcaactccgagagtgttactgacacgaataaatgttggcatgcaaaagggaacaccataaggtggcgcatgaagttcacgctccttcggaaccggggcgtgagcgacggagataagagatccaaagaagaatggtgcaagggctctcacgcgccttcgaagcctgtgaaagtgatgatgaaagcttcaaaccaaagcttagcttggaaaggatttgatctcaaattctga

SEQ ID NO: 106900 - DNA, 452 bp, Glycine max
  Peptide Sequence Number=SeqID_223678
atgaacaatttcaacaccactcttgaatccgatgatttctctcttctagaatccattcaacgttacctccttgatgataacgaagatttcaacgctctaacggaggttttagcaacacccaataatgtcgatgccgttaactctccattatctttgtcagaacatgcaacaacgactgccacggcggcgcgtggggcttcagtttcggtggcgcgtgctagccacgcccgtagccaaaattataagggggtgaggcgtaggccttggggcaagtttgcagctgagataagggacccgaataagaacgtgagagtgtggcttgggacttacgagtcggctgaggatgcggctctggcttatgatcgagccgcttttgaaatgcgtggctcgaaagctaagctcaattttcctcatttaattgggtgcaatgatgccgagccgagccaaagaca

SEQ ID NO: 106901 - DNA, 213 bp, Glycine max
  Peptide Sequence Number=SeqID_223679
atgaagaagtggaacactgtctgcgatgacagaggacaggcatggaagactacggagtggcctggggttcacggagggcatgatgcgacgatgtcactggagcggcagctagctagggctttttgtcgcgtgggttcaagtcaccaacctctcaatgatggtgaatgtttctacattactttaggtttttctagagttttcatgatagattag

SEQ ID NO: 106902 - DNA, 651 bp, Glycine max
  Peptide Sequence Number=SeqID_223680
atgatgagagcttcagagctattccacttcagaaggcatcgattgggacgaagtgctctcgatctagggcttgacaccgaactcaagccgctgattctctccgccgcctctgagcatgcatctgatagaattgttagagatatggatttacagcttttgcaggcacatgtgtctgtgcagctgtactcaccatttcgaccagctgttgacatagcagaagtatttctttggatgatggcagttcttacaatattgtgtgcatcatattggtcagctaggacaacccgagaagcagttattgaacaggataagctactaaaggatgctttagatgaaatcccaaacactaaatatgctagtgttagtggagttgtaaacatgaatgtgaaagctgcagtgctttttgttgtatttgctttgtgtttcctgtttatgctttacaaactgatgtcgtcatggttcattgacgttttggttgttctcttctgtattggtggtattgaggatcagcatgctttaataccttgtactggtgaaaatcatgtcataaggtggttcaagcatgctgaaaagtcatacatcaaagatagtcactgtccgtttaatcataatttctttttcattggttgttccaacagggaattgcactga

SEQ ID NO: 106903 - DNA, 675 bp, Glycine max
  Peptide Sequence Number=SeqID_223681
atgaatcccattggaaaggttcctgtcttggaaacgcccgatggtccagtctttgagagcaatgccattgctcgttacgttgctcgactcaagggtgacaacgctttgttctcatcttctgccattgataatgtaaactacacacttccattatcttttccatgcatcaaacatactaaatcacataaaaaacttctcttctacatcggttctgcctacacaaccgatgtagaaacactccccttctacatcggtcctcccttcacaactgatgtagaaaactcctcttctacatcggtcgttcaaccgatgttaaagggcttaggcttttcaacgacacctactaccaccacgggtcataagcgatgtagaaaggccttcagaaccaatgtagaaggccttttttctagtagtggtagtttgttaggtaacacaggcaaggcgggtttcagtggaatcctttgtgacaaccttggtcaatggctctcaagtttttcagaattacatgccttatttcatggcctctctctcacttggaactccggctacaagagcgtcgagtgtgattcagattcattgctagcccttcagttagttgcaaagggtgttacaacctatcatccgtatgcatccattatcaaccgtatttgtactttcaagacaaagcagtggtag

SEQ ID NO: 106904 - DNA, 396 bp, Glycine max
  Peptide Sequence Number=SeqID_223682
atggtagaagaaacgaacaaagctagccaatggaggatgccaatagctgtggaggagaagaagggaaccaaatttgaaatcgataagcaaatgaagggcgcggaggaagaacgaaagaagacgaaggaagaagacgaacctttttggaaggagaagaacgaaagcgcggaagaagaagcttgctgggagggagattgttgggtgcacgagagaagaaggaaagcgcggaagaagaaaatatcaatggcaacaagagcaaaacaaaaacaaaaaggctacactcgtagggaaaacattccaagagcatcagccaacgacatagggaataaagaaactggacaagaaaccaaagtaggcataggttctctagaggatgaacccttctttgaaagctaa

SEQ ID NO: 106905 - DNA, 138 bp, Glycine max
  Peptide Sequence Number=SeqID_223683
atgactccaagagtggaagggatacaaatagaggtatatgagttgcagatgagaaaaaggacccattcatgtgaatcagcgtacttaagtccatccaagactgcgaagcaagcaaaaagatgtgagcaaaacaagtga

SEQ ID NO: 106906 - DNA, 240 bp, Glycine max
  Peptide Sequence Number=SeqID_223684
atgtcgcggaacttcacggattgcctaacgatgggtgtcaagtacctcaaagtggtcaagcgagggtcgcatcacaataaacagatgacacgatcgcctcaagatggcgaaaaggtgtgcgaaatgaccataatttgtctccacccaccacttgactcactgtcgctgaatgacaaagagcgcagaatgaccataatttgtctccgcgcgtttatcactcgactcgctgttcctgaatga

SEQ ID NO: 106907 - DNA, 982 bp, Glycine max
  Peptide Sequence Number=SeqID_223685
atgccagcccagataggccgcgaacagggcatagaagccgcccaccgccgacaaggccggcacgctcatgccggcgcgacggaaacgcagccacagcaggctgatggacagcatggtgaacaggccggcggccagcagcgggccatcgagcagccagggcgtcaggaagatgccgagcgcgctgggaatggtggcctggatcatcatggcgcccgagatgttggccagcgccaggcgttccttgccctggcgcacccagatcagcgcgttcatgatttccggcagttcggtggccacgggcgccagcagcagcgcggccacgtgcggcgaggcgcccatggcgatgcccagcagttcgatctggttgacgaacacgtgcgaggcgccggcaatcacgaccagggccagcagcgtctgggtcgcggcccagaacatcgacggattgtcgtcgcgcgggcgcagcttgagcggttccaggtcctcgcaatcgatgcagtcctcgtcgttgctcagttcgcgcttgatgtacaggccgtaggtggccaggaacaggatgccgagccagggtttccaggcgaaggccagcaggcccaggccgaccttgaagacgaagatgcccatgaaccaggcctggtcgcgggccagccggcgctggtccgcgttgatacagttggcttgcgcgggctggccgcggcgcgcgcgccacaaggccaggccgaccacggcataggccagcgtcgccagcaccagcgggccgcccatggccgcgccgacgccgatgtccttctgttcgggcgtgtcgccgaacaccacggccatgaaggtcacggcgctttccggcaaggcggtgccgaaggcggccagcaccgtgccggtcgcggtggcgccgagctggaagcgatgtccgacccattcaacgccattgacgaagaattcgcaggcgagatagatcactgccgcggacaggaaaaacaggaacagg

SEQ ID NO: 106908 - DNA, 207 bp, Glycine max
  Peptide Sequence Number=SeqID_223686
atgggttgtgctggatcttcacaatccaagcctgatggtgagccaccccttcttttcaatcctctcaaaacctcttctttgcattcccttttcgttaaatctttaccgatttcatcatgggtcgctgtcaaaatcccttctttcttcttcttgtttcatggtattcgtgaacaagcattttttaagggggagagaatcaggaaataa

SEQ ID NO: 106909 - DNA, 909 bp, Glycine max
  Peptide Sequence Number=SeqID_223687
atgcatgaactggcggcaggcatcaccggcgcgtcgtcgctgagcggctttacccataatgcctggcagcatggccgttctccgggaggttcaagcagcggttcagccgtggcggtggccgcaggcttcgtgccgctggcgataggcagtgataccgccggttcggtgcgcattccggccgcgtttaatggcctgttcggcttacgtatgacgcggggtgcactgagcagcgctggcatcgtgccgctgtcgcctacccaggatatccccggaccgctggtgcgctacgcggctgatttgcggctgatcagtgaaatactaacgggccagcgctttccccgtcccgaccggccgttgcgcatcggcatctggcaggaaggatttgccgcagaggaaacggagattaaccaggcggtgcagaacgctgtggcaccgtttcagccgcgcatgctgagctggccgcagctggagacgctggcggcggaagccaatattattgcctatgaatttgctgacgcgctggccgcctggctggcggataaacccgaggcaccgctgcgcacgctggcggcgattgctgcctcagggcgctatcatccccagctggaggccaccttcaaaatccgcgcgcagcatcccggcatgaagagtgacggctatcgcgaggtgcagctgcgccagcagaggctgtatcagcagctggcgcagttttttcagcagcagcagatcgacctgctcgcttatccggtagtccgccatccgccggtgaagcatggcgagttacagccaggcagcaacgcgctgatctcagccgtcaccggcgcaccggcaatcagcattccggtcggcctgagtacggaagggttacccatcggcctggagcttctggcgctgcgcgaccgggaagat

SEQ ID NO: 106910 - DNA, 351 bp, Glycine max
  Peptide Sequence Number=SeqID_223688
atgggattcacaatttggggcatgcatgcattcatgaggatgatgtatcgtgctcgctacgatgatgatgcagttctccctgcttggtccattgatgatgatgatggtgctggtgtcttcccattgaagcagaagtaccacgtcattggggtctgtaagggattggtctgtttgatcgctaaaactcgtgaagactctacgactttctcggtccgattttacaatccggctacaaggttaagatccaaaaaatcgccacgcataaaaataggttctaagaatgtaatgggctttggctatgatgattcgagtgacacttacaaagtggtggcaattccgaacttgaaataa

SEQ ID NO: 106911 - DNA, 564 bp, Glycine max
  Peptide Sequence Number=SeqID_223689
atggacgggcacattgatatggccctggtcaaggagttttactcgaacctatggacatggacgtgggtttcctcatttcacactagatctcacagatggcccagtccaactcctccaggcttggcacgggctcgaggatctgagggtccatcttcaactactcctcctgcacctattcccactactccagctccttctacttcagcaccaccacttcctcatgctcattctcattcaccagctccctctgctccatcatcatcattccagtgccgatgctccgagagtatgcatgactcggctcagcatatgtcttttatcagcatggatgagttcatggcacaagtggcctggccaggagtccagccttctcctttggggggaggtgaggcttccgcaacccaagagtcccagccagagccagaggttactcgtgaggccactccagaggtgacccaacaggtttcacatgctacttcacctgtcgtggaggtctctgagggtgaaaaaggcaccaaggacactgattatgcagcagatctacaggcagtgcagagtacctag

SEQ ID NO: 106912 - DNA, 651 bp, Glycine max
  Peptide Sequence Number=SeqID_223690
atggtgtcaccacaagggcgaaacacatgcacaattgatgatctcgtgccttatgtggaaaagttagcgattttatcccaagagcaagagaggatcactgagcctgtggcacatggtccagcatcagaacgtcgatttcccccacaacagtttcacatgattcagtcaagtgttgaaactcgaggttttgacagacgaagggagattgttcaagcggaagatttttcccaacaaatggagcagcgtggccatggaatgtattacatgccaccaacattttctcagtatccttcgcaaatgtatcagtatcctttcgaaggtcatgacactgatatgtctgcaagcgaatattcatttggtggtgttgcggaaacacatcctcatttttcatggccgaccatgaccccttcgcagcaacatgatgccctaatggcaacacctaatgccccattagcttcgcaatgggatgtacccggagcaatacctgatatgggtgacttattaggtgttgatttgcgtcacgagttttctacagaggctgagcaacaagggcagagacagcgcgcaagaagaaatcaagatcgtctagcccgaaggtgggatcgaccatgtggcacatcctcacgccatcacggacaccataatgactga

SEQ ID NO: 106913 - DNA, 924 bp, Glycine max
  Peptide Sequence Number=SeqID_223691
tgcgagtcttccggaattcttccggatgaaccacttcttccggaaagttcccggaagaggttttccggaagtcttccggaagaagtgttcttccggaagacgtttggttacttccggaagaacacttcttccggaaactttccggaacaggttcttccggaacttccggaagaacccctaacgggtcttccggaagacgccgtcgtcagccttttgcgccattttttccggcgtcctctcgtcttctcccctctcgtcttctaccctaaggttactatcctaagggtagggagggagaagactaacctgttcgcggagaagaagaagaaaaccttgccttgggcgcgcctcgcggagaagaaggaactcgcggagaagaaggaagttcacgaagaagaaagaagaaccaggttcacggaagaggaagagaagacgaagctgttcgttcgaacaaacagtgtcttccgggagaatccggttaagcctaaaaaaccatgcaattcagtgatgtttgttggtgtggcccgcacaatgatgacctcaatcttttctgggttaggctggacaccatgctggtgcctttatgagaccaaagggcatcaccaacaattcgtagtgaccttcaaagtaaaggtattttatggtcatgagcccgaggtgggggtaaaccatgagaatgtaaaggggattcaaaagaaagcaaatggaaggcagcgatggtgtcacgacttaccatggaacaaaattgctgaaatgaggcatatgttgggccatcccgctaagcacaccgcttcagttcatccgctgagtgagaaaagccgcgctaagccaaaattcactaatgtgcgcaaagcgattaagaagtgcactaagcgcacgagcacaaacaaagccacctatttaagcctaaaatcagatttttga

SEQ ID NO: 106914 - DNA, 264 bp, Glycine max
  Peptide Sequence Number=SeqID_223692
atggttctggatggggaaattagcatcattggcaggtggaaaagaggtgttggcatggaaatttgggtgtcgtcatgcggaatggaaatgaagggttggcattggtgtataagcaggtcgaggggttggtataggcatgatattatggatggtgatgtcagaagagatggccccaaaatgatcattaaaggcctacaagattttctagagtatctcaggtctgggaggcatggtagcatgatgaaagcaccaatggtagtgtga

SEQ ID NO: 106915 - DNA, 554 bp, Glycine max
  Peptide Sequence Number=SeqID_223693
ggagagaatgtcaatccttaccctcggaagcggaaagaatagaagggaaatttccaatcaaagaaaaggaaagaaggaagatttccaatcaaagagaaagcaaaaaagaaaagaaggaaaattccccaatcaaagagtgggagaaagcaaaaagaaaagaaagaaaattcccaatcaaagaatgggagaaagtaaaaaaggaagaagaagaaggaaagaaagctcctgatcagggatcgaaggaaaacagaagaaatgtgcagaaaggtctttggaccggacaatatctgaacaatacagaattgtcccaaatttgggggagtttgttgggtgacaacaattgtggtaagaagatgacagcacacacagcaaaatcaataagcaacaaggtagcagctggtgtctcgctaagcgaggcctatgcgcttagcgagagtcatgtgctaagcgaggtactcagcccgcttagcgagttgggagaatttggaggagaatctgagaagcacatgcgtgctcagctcgctcagcgaggcgttggtctcttcatgttctaa

SEQ ID NO: 106916 - DNA, 1407 bp, Glycine max
  misc_feature (1388)..(1388): n is a, c, g, or t
  Peptide Sequence Number=SeqID_223694
atggtaacatcaaaggctcatgcagcacttgtagccagccccggcatggggcacctcattcccatgctggagctaggcaaacgcctcctcactcaccattccttccacgtcaccatcttcatcgtcaccaccgattccgcaaccacaacctctcacatactccaacaaacatccaatctcaacatcgtccttgtccctcccatcgatgtctcccacaagctaccacccaacccgcccttagcagcacgaattatgttaaccatgatcgactccataccctttttgcggtcttccattctatccaccaacctccctcctccttcggcactcattgtcgacatgttcggtcttgcagcttttcccattgcacgtgacctcggcatgcttacctacgtttacttcgccaccagcgcctggttctctgcggtttccgtatacgttcccgctatggacaagaaaatgattgaacgccatgcggaacaccacgaaccgcttgtgattcccggttgcgaagcggttcggttcgaggacacgctggaaccgtttttatcgcctataggggagatgtacgaaggttacctcgcagcggcaaaggaaatagtaaccgcagacggaattttgatgaacacgtggcaagatctggagcccgctgcgacgaaggcggtgagagaggacgggatattgggccggtttacgaagggagcggtgtatccggttggaccgctagttagaaccgtggagaaaaaagcggaggatgcggttttaagttggatggacgtgcaaccggctgagacggtcgtctacgtgtctttcgggagcggtggaaccatgtcagaggttcaaatgagggaagtggcgttggggttggagctgagtcagcagaggtttgtttgggtggtgcggccaccgtgcgagggtgacacgagtggctcgtttttcgaagtatcgaaaaatggcagtggtgatgtggtgcttgattacttgccgaaggggtttgtgaaaagaacggaaggggtgggggttgtggtccccatgtgggccccgcaggcggagatcctgggacatcctgcgacgggttgtttcgtgacgcactgtggttggaattccgtcttggagagcgtgctcaacggggttcccatggtggcgtggccgctatacgcggagcagaaaatgaacgcgtttatgctgtcggaggagcttggggtggcggtgcgcgtggcgggggagggaggaggaggagttgtgggaagagaagagatagcggagctggtgagaagagtgatggtggataaagaaggagttggtatgaggaagaaggttaaggagctgaaagtgagtggagagaaagccttgtctaagtttggatcctctcatcattggctttgtcnaatgaaccaggactgtcaa

SEQ ID NO: 106917 - DNA, 291 bp, Glycine max
  Peptide Sequence Number=SeqID_223695
atgtatcccctccctctccctcgccaaaatatattagaggagttaagagaagttaagacttcctctggtaaagatatcgtgggaagtttaggtggctggtatttggctacatttggtgagtcgtcggggttgctaacatattccaaaagcgatggaagtttttggcaatacaaggcttggaacagagacatgttgatggcagagtgctctgatatgttgtaccaaagttcaacccaatgtaggaaaaagaaccattttgacaaaaagtctcccccaaaacactgcaagtag

SEQ ID NO: 106918 - DNA, 410 bp, Glycine max
  Peptide Sequence Number=SeqID_223696
aagccttgggagggagggaaggggttgaggatgacggaggcggagtgaggggtggaaacgaagacgtcgttatggagattggaatagacgagggcggcgtggagggagcagagggcgaggaggaggaggggggcgacggaggggagggtggagaggacctcgtcgccgagggagacggcggcgatgcgggtggaggggtggtaggcggcgacgtttctgcggatccaagaggtggcggtggtgttggaggaggcgatggcgaggagctggttgttggggacgctgatggtgacgtggatgtgggtacccgacagggcgcggaggatgtcggggttggggtcgtagaggccgatgtgggtgatcttctggtgcatgaggaagttgaccaggtgcgacatcgaagccattga

SEQ ID NO: 106919 - DNA, 399 bp, Glycine max
  Peptide Sequence Number=SeqID_223697
atggatccaccacggccagttaccaagccaccgtgctggagaagccttggctccatttcaggaatctcacttccttcaaaccccttcgttcttagatccatactttctctctctctctttctctgttatcaactacacattctcatagcctgggcaattgcccagggtagccgggccttgaaaccgcctatgcatacgtaccaacaaggagagaagggatcagtgtgtaatacagtggggctttggaagtgcaatgtggaggaaagttattttgagattcagaaccgaacaggagcgggtatgatcattcgtgatgatcaagggagctttatagtggcaaggacagcatggagagagccttgtatgcacgttcaagaaggagatcgctgtcagcgttga

SEQ ID NO: 106920 - DNA, 333 bp, Glycine max
  Peptide Sequence Number=SeqID_223698
atgttgtctctgagaaggattacagcctttgatgttatcgtccaggatttcctttcgagtaactttctcgaagatggaggtttcagaccgcgcataagggcttcatccaaaggacacatgtttctggtatatgaatatttaccaacattagatctaagtccttatggatttgattttgctctagatttggtccaggtggatctagaactcgtcgaggaggggctccttattgtcgaagttggtggggtcgccacctcccacgacaggggtagggtatccgaggagatggatgtggcgacaaaggctatgttgaaggacatgaaaggatgttag

SEQ ID NO: 106921 - DNA, 285 bp, Glycine max
  Peptide Sequence Number=SeqID_223699
atggtggcaccatgtaactcatctaacaactcatccacaattggtataagaactcgatctttaatggctatgactgggaactatgagaccctcatagagcatttcggaaatgagtttagtcatagcttcttttttagtgtgaaggcttggggttatgttaggcttaaattcttagtttggcctccactagcttggccataccaatggcatgatggatggaaaaagggtttgaggacggccaattctcgacaaatgtcaggagagaggcctgaaaggaacaattga

SEQ ID NO: 106922 - DNA, 177 bp, Glycine max
  Peptide Sequence Number=SeqID_223700
atgccccaaccacatgggatcaacatgggcttaaaggagcactcaaaccgagtatctttacccccaaggcctagactccgaagaatccgtttgggcctcaccttcctgattcagccaattcaattatccaacaatccctacacctatgaatttcatgacaagaaatcacccacgtga

SEQ ID NO: 106923 - DNA, 240 bp, Glycine max
  Peptide Sequence Number=SeqID_223701
atggagcagctggtgctggaacacttccaccactgccaggaatgggaacctcataaccaggatttggcacaaaagtgtcatcaccactgccaggatttgggaacctcatcctccatttccatagccaccaggaaatggattttgaggtccaaggaggaggatattggaagtgagaacaagtgcaaggaaaaaggaagctttggaagccatttttcagataagaaaaatgctgaaacttga

SEQ ID NO: 106924 - DNA, 1329 bp, Glycine max
  Peptide Sequence Number=SeqID_223702
atgggttgttgtgtctcaacaagcagtaggagtacttgtagcagcaagagcaatggagacatggtgtctccatcttgcttagaaactggatgctgtgggcaaaagagaacaaggagaacattctctgatcatggccgcaagggtattaatcaggatgcaatgattgtgtgggaggatttcatgtctgaagatactatcttttgtggtgtctttgatggccatggtccacatggtcatctagttgcgcgcaaagtgagggatgccttgccaactaagctagtttcatctttgcattctaatgaatcgaagcgaaatgggtcaggtaaaacttgcttcaaagggaatgtaaaacctgatagtggagactctgagaaggattgctctgcggaggataaactgaactcgacatggagggaagctttcatgaaggcatacaaggctatggacaaagagctcaggtctcatccgaatctggattgcttctgtagtgggagcactgctgtgactatagtgaagcagggttcgaatctgttcatgggctatatcggggattctcgagcaatcatgggatccaaggatagcaatgactccattgtggctattcagttgactgttgatttgaagcctgatttgccaagggaagcagagagaattaagaagtgcaaaggtagggtatttgctttgcaagatgagcctgaagtgcctagggtgtggttgccctttgatgatgcaccaggattagccatggctagagcatttggagatttctgcttgaaggagtatggtgtgatttctatacctgaattttctcaccggcagcttacggacagagatcagttcattattcttgcctcagatggggtatgggatgttttaagcaacgaggaggtggttgagatagtatcatcagcgccaacgcgatcatcagcggcaagaattctggtagattctgctgctagggagtggaaactcaaataccctacatcaaagatggatgactgtgctgtagtatgcttatttttggatgggaaaatggactcagaatctgattatgaggaacaaggcttttcttctgcaaccatccagagcaaccattcgggtaaccccattgagtcagatgatggacaaaagtctgagccatcattgcaaaggaacttcactgtgagatcctcagaagaaaatgagacaaatggagcactatctgttgatgttgttgaagatgcaacatcatcagctgatgatcaaaactggtcaggtttggaaggggtcactcgtgtaaactcactagtccaacttcctagattttccgaagaagggccaaactcttga

SEQ ID NO: 106925 - DNA, 258 bp, Glycine max
  Peptide Sequence Number=SeqID_223703
atgaggttcccaaatcctggcagtggtgatgacacttttgtgccaaatcctggttatgaggttcccattcctggcagtggtggaagtggcgctttcagcgcgaaaacaagcactggcgctaagcgaggaagaggcccgctaaacacgaatacaggcactcatgctaagcgagcagcactcgataagtgcgaatacagcactggcgctaagcaagcaaagcgcgagtatgctgaccctaatccattccagcaactataa

SEQ ID NO: 106926 - DNA, 324 bp, Glycine max
  Peptide Sequence Number=SeqID_223704
atggtagaagtagaagattcatcacctttctcagaatgcagaaagttaaggttgtggaacagagaagatgagagttggagtgagagggagaatagaaagagaaagggagtgaaagatagagaagcaagccaagcagcaacaaacaaaccaaggctacctgacaactatagctcgagtttattcatttatcagggtcgatgtgagacttggatattttccaatatcaaccattactcatttttgtttcacctcaactggtataatctggtacaagtgggaactattggactagaaccaagaggtttgggcaccaccactttatga

SEQ ID NO: 106927 - DNA, 684 bp, Glycine max
  Peptide Sequence Number=SeqID_223705
tggtggatccatccccaggtgtacggagagtctgtggagaccctggacaatgatttgttggccctggtggatggcggctggcggcgtgcgaaaggtggtggaggtggttgcgctagaggcggggtatctagtgttgcggctctggctcaagctcgacggggccccgagaaggtgatggatgggtcaatggggttccaacaattcttccttatgtatgccaagttaatcatagggcttagtgactcaaaggtgtgcatagggttgtcgagatggcttgatgattcgggtacgtgtgaagatactaggagtacgccggatattcttcttcgcaagcaaggaagaccgggtgtcaagggagccgttgatctagaattccttgaccagagcaacgtcaatctgcttctctgggagtttagtgagtacccggtgtcactgccttcattggagctctccgtaaaattcatcaatgttgtcttgatacctgtgccaagctatctctatagcgaagcaagaggaatcccaggtggattccccgccttgagtgggcaccgatcttcatttcctcacttagcgccttgtcccgagtctctgggattagcattgcaatctcgcttagcgcaagctaggcgccaagcgagttcatcccaattcataagtgcgctaagcgcattgatgctcgcttag

SEQ ID NO: 106928 - DNA, 669 bp, Glycine max
  Peptide Sequence Number=SeqID_223706
atggcaggagcagaggtagaggcagccatgtctgacaggtcggaccaattgttacaagcagtgtgcttttgccttgtattcgaggacaaggtaacctcctgggatatcaacaacgtgaaagtcgagagggttgggtttgtgacctacgccgcagagcagacaagaagagctatgaacgtcgaagtttcggttctggctttggtggtcgtggacgtggaggcaacatgggacaagggcaatgcagggaagggaaaatccggagtagacctgcgtcaccatggtgggggtggaggcagtggcttcagtggatacaaccgcaatggcggtggatatggtggtgggggtgacgacgagaatgtcgggtccaacaaagatcgtgatagagatagagacaaagagcatgaccacgaatgttcctctggtcgtcacaccaaagttggtgctcttcttgatgttcatagtggtggtgaaagaaaaggtagtggatccatgaataggggtgatttgggagaagatagagtgggtgcaagagtggataatcagtcaaggatgacgtctagtttagcggccatctccagagtcttggtggtcatggcagataggggtttcggcaaaggaagagacaggtctagcgggtggtgtgttttgacatggcaggagcagaggtag

SEQ ID NO: 106929 - DNA, 447 bp, Glycine max
  Peptide Sequence Number=SeqID_223707
atggcacagattttggctccctctacgcaatggcagatgagaatctcaaaatcctctcccaatgcaactcccattacatcaaacatgtggggttctttattgtggaaacaaaataagaaagtttcacttaccagttctgctaaatttagagtgctggcaattaagtctgacaatagcaccatcaacaggctcgagggattgagggggataggaattgatgtgcgcagtaaatcaagaacaatatcaaagcctgttgaagatccctctaagctccctagatggaactatgatggatctagcactggacaggcacagggtgataatagtgaagtcatttacgattcttacaccccacaaggagagcctatccctagttccctacaaacaagagacactgaaattttcagtaacccaaaggtccaagctgaagttccatggtatatataa

SEQ ID NO: 106930 - DNA, 231 bp, Glycine max
  Peptide Sequence Number=SeqID_223708
atgaaagagaagaaagaattccctaagagagagttctcagactttagttgctggagtggattagggtcagtgtactcgtgcttagcgcattttgcttgcttagcgctagtgcctgtattcgcgcttagtgcgtgttgcttgcttagcgtgggtgtctgtattcatgctcagcgcgcctcttcctcgcttagcactagtgcttattttcgcgctgagcgcaccttgggctag

SEQ ID NO: 106931 - DNA, 192 bp, Glycine max
  Peptide Sequence Number=SeqID_223709
atgtcaaaatgccctaggtgtggggcgtcacgatacaaggtgaaggatgatgaggacatgaatttgaagaaatgtcaaaatgcccgaggtgtggaccctccagcgaagcatatgggaatcccagcggttacagtgttaagggtcatcatgcatgccccatctgtgaagaagacacaagctacatacaactga

SEQ ID NO: 106932 - DNA, 237 bp, Glycine max
  Peptide Sequence Number=SeqID_223710
atgtgtttccctttctttcttccctttatctcaggaggggaggggacaaggaggtgcgcgatggttgttggatttgggtgtatgtggggcacagtgattgttgggtttaaaggtagggtgtggtggtgttgggttgatggccaaggttgtgcaagtgagggaaggggtgctgactatcacaaaaagaagggtgcaggaagcaaaaatgtgaatccaaaaggtaattctcgaaagtga

SEQ ID NO: 106933 - DNA, 1146 bp, Glycine max
  Peptide Sequence Number=SeqID_223711
atggggggtcaatccagtaagatacctagcagtagtgatgttccaacacccatcaaaatgggtacccattctctgtatgcggctgatttgagttcttatgaggcggcatgtgttgaagatccaaacttgcaatccttagatgctacaattcaggagcgcaccaacagggtgatcacctcgcttgcccaagggattgaggttcattccatatcgattgagtcactaggggaagtgactggtagtttgcttgaaatgaatcaggatgttgccaaagtcattctagagtgtaagcaagatatatggaacaagaaggacagggagctcttctccttggtggaggacttctttgaaaatagcctccagacattggaattctgcaatgctcttgataaatgcttgaatcgagcacgcgaaaggcatgttatagttaagtctgcaattacctgttttgaggaagaggtgcaaaatggggttgaagggtccacttatttgaagacattgcaagagcttaagggtttcaaggaagccggggaccccttcaccgaagagttttattccttgtttcagtcagtttatcaacagcaggcatcaatgctgaagaaattgcaaatcagaaagcaaaagcttgataagaaactgaagtccctgaagacattgaagagggtgtcaaatgccattttcgtggctgcttttgtgtctgttttgattttctcggtggtggcagctgcaattgctgcaccacctgttgtaactgctttggctggtgcattggctgttcctataggctcagtggggaaatggtgtaactctctttttaagcgatatgagacagctttaaagggccaaagagaattaatcatttcgatgcaggttggcacttacattacattggtggacttgaagcacattcaggtgcgcattgaccaattggaaataaacatagagtccatgttgcagagttctgattttgctcttagaaatgaggatgctgtaaagtttgcgattgatgagattaagaagaatatagacacttttgcagagaccattgaggctttgagtaagcaagctgatgaatgtagtcggcagataaggagagcaaggacaatggttgtgaaaaagattattaattacacaaacactagctga

SEQ ID NO: 106934 - DNA, 1210 bp, Glycine max
  Peptide Sequence Number=SeqID_223712
acgaaaaccttcttcatctgtctacaaagaagttagtgaaacatttaatgccggaccatctgatttgggttacctcacattcataaggaactttgttcaggtattatcatctcctctagttggtatacttgttatcaactacgaccacccgacaattcttgctatgggcactttctgctgggctttatctacagctgctgtgggcgtttgccacgattttctgcaggttgcattctggagagcaataaatgggtttggtttggcaattgtgattccagcactccagtctttcatcgctgatagctacaaggatggagtgagaggaactgggtttggattgctgagtctcattggtaacttgggaggcataggaggtggtgttttggctactgtcatggctggccaacagttttggggcatacaaggatggcgatgccccttcattttgatggcaactttgagcgcattaattggattccttgttttactatacgttgttgactcaagaaaaagatttcccaccactcctgatgctagtgagagttcagacaggggtgactctatctataaaggcaatgctagtgcaacatcagtttggatggactcttgggcagccacgaaagctgtgatcaaagtgaaaacatttcaaataattggcttacaagtcattattgggtcactgccgtggactgccatggtgttcttcacaatgtggttcgaactgattggttttgataacaatacttcagcaaccctcttgagtctctttgctattggatgtgcaatggggtccttcagtgttggatcaatagctgataaactatcgcaagtgatccctccgccagtaagtagttttcctaccttttctgtcaccctctttgtaatgggtctaactacaagctggaacggtgcggctgcaaatgctcctatgtttgctgaggttgtccccgtgcttgactataattcaaagtctgttgatcccatcaaaggatcttcaccagaggctcttgccttgtcgaagggccttctgtccacgatggctgttccatttggtttgtgttgtttatgctatacccctctatattacatatttaggcgggaccgtgaaaatgctagaatgcttgccctgaaagaggaggagatgataatccaggttaaccatgcaatcatggttccgtcatggctaggctgcttattacccgaggattga

SEQ ID NO: 106935 - DNA, 975 bp, Glycine max
  Peptide Sequence Number=SeqID_223713
atggcgttcaggaaagctctcgctcaaggactccttaacatcaccaaagtgtcatcacaatccctcaccaattgtcggatttcctcttcctccgtcatcggaaaagtttccccacgcgccgccgagcccgttgatcccggagaaaatggccgcttccgttcgccgcaactcgccggaagaaacctcctcgacaagctcaggacgatgggtgttgcccacaaccggatccggttggatgggttgacgccgccgcagattaaaatggtggacacagtgaccatcgaggatgccagaaaattgctaaaggtggcgcaggtggaaatgttgaaagcgaaactaagacagacccgaaagagttgcataacgttctcggagttcattgcgatctgcgctgagcattgttcggatcaggatcaagcggtggagattgcaaagatgttggatgattctgcggctgtgattgtgttgggagatgtcgtgtttctcagacccgaacaggtagcgaaagccatccaaggtcttctccctgtaccaggagccaaggttcccgagtcaataagaagagaattcgaagaaatggagaaaaagaggttagccattgacgagagagcagacaccatggttcggcgtgagctctggggagggttgggttttatgatggtgcaaacaatggcattcatgaggcttacattttgggaactctcctgggatgtgatggaacccatatgtttctatttgacctcaatgtactgcatggcttgctacaccttcttcctaaggacctcaaaagaaccttcctttgaaggcttctaccaagcccgtttcagctccaagcagaagcgactcatgaagcttcacaattttgacattgaaaagtataatcaactcagggctgcttgctctcccaccaccatgcctcctaagtttgatccctccatggctctcccatttgacaattcttccattcatcaatga

SEQ ID NO: 106936 - DNA, 1119 bp, Glycine max
  Peptide Sequence Number=SeqID_223714
atgccaatgctaccatcgtactgcgtgaaggagagtaaaccctgtgtgggttgggttgagaaatacttgggtgattgtctctgcaatttgaaagatgaaatttcctttggctttggcttcataagtctcatatgttggggagtagcagaaattcctcagataataaccaactttcgcgctaagtccagccatggtgtctccttagcctttctcctcacttgggtcgcgggcgacatattcaacctcgttggttgccatctggagccagccacgctttacacaatcactacgatcgtgttagtacttcaaagtttctattatgattacatctataaatggggcaagcgtcatgggaagatcaacaccgatgaggcttataaagaagaagagaaaaaacctttgagaccgaaaccaggccgcgaccactctgggattccaatacaaaatgacggacccaaagaaacgcctcgacgggattactactataggtcagcgagatctttggctgctaatgatactccaccatttggtacatacttgagagctgctaaaagtgtcccttcagccattgtaatgaacgacgattcatcttctgatgatgatgaggctcatccactttcttctaagaagcctgtaacacagcctagacccatcccccgttctgtccctgccacttatggaacttttctagtagcatctatgaactttccccggcagggtaatgccttgatggagggatacaatagattcaatggaagaaaactactcttgcaagagcacaacagcatgcacactgctttgggtcaatggttaggatggctcatggctgttatctacatgggtggccggcttcctcaaatatggttgaatggcttaaatcctcttatgttcgtctttgcattaatcgccaatgccacttacgtgggaagtatgccaactacagataccttgggaagaaaactggaagtgatgatgctgattatggagactactgagaagccagcaaaaattttgtgtcttgatttgtgggactgtaagacacatgtagagctgcccaatattgaaccacttcaattccaccatgacattcagctattagttaggaaacgcttctattag

SEQ ID NO: 106937 - DNA, 980 bp, Glycine max
  misc_feature (73)..(73): n is a, c, g, or t
  Peptide Sequence Number=SeqID_223715
gttggagactgaatcctgaatggaggaggcatcgacctcaattagcaacatgttcggtgggctacaccggcanagatgacaaacaatacattggtaaagacctcatccattatattgttatagaccctagtgatgatcctataaaccctaaacgtggcaccttgaggtatggagcttctgtaattcaaggtaaagtgtggatcacattccaaagagacatgcacattaaacttgagagaccccttcttattagtagtttcaccgcaattgatggtcgaggggttaatgtccacattgctaataatgcatgcttaatgatctttaaggctaccaacataatcatccatggcattcgagttcatcattgcaaacctcaagccccaggggtcgtgatggggcctgaaggaaaagtgattcctttgggccacgtagatggggatgcaattagattggttactgcttcaaagatttggattgaccataatacactatataattgtcaagatggtctacttgatgtaacacgaggatccactgatgtgactatatccaataattggtttagagaccaagataaggttatgcttcttggacatgatgatggatatgtgagagaccagaatatgaaggttactgttgtgtacaatcactttgggcctaattgtaatcagcgcatgccaaggattcgccatgggtatgcacatgtagcaaacaatctttacttaggatgggtgcaatatgccattggtggaagcatgggacctagcctcaaaagtgaagctaacctctttatagcacctacaatagggagtaaggaggtgacatggagaaagagtaatcataacaatggggatacatgggaatttcattcagtgaaagatgcttttgaaaatggagcctcatttacaaatagaaaaaaggaccttgaagtgcagtttgcatcacttgggattgaaacctatcaaatgacgaggagttaa

SEQ ID NO: 106938 - DNA, 1905 bp, Glycine max
  Peptide Sequence Number=SeqID_223716
atgcatctctttcccttcatccccataatcattttcacactattgatccacaacttctctctgattctggggcagcaaccttatattggtttaggcacagtagcgtgtccaagaaggggtaacaaaaattctatccgaggttacacttgcaatggtgcaaaccatagctgccaaagttacctcaccttcagatctcaacccatttacaactctgtcaagacaatatcaactttgttgggttctgacccatcccagcttgctaaaataaactcagtttccatgaatgacacctttgagacaaacaagttggtgattgttccggtcaactgttcctgttcaggtgagtattatcaaacaaacacatcctatgtgttccagaattcagaaacttacttgttgattgctaacaacacttttgagggcctcacaacatgtcaagctttggagaaccaaaaccacaaccctgcaaacatataccccggtagaagacttttagtgcctctcagatgtgcttgtcccacaaagaaccaaaccaagaaaggcatcaggtacctcttgagttacttggtgaactggggtgattctgtttcattcattagtgagaaatttggtgtcaactttatgtctactcttgaagctaatacccttactctcacacaagccatgatctatccctttacgacaattttagttccccttcatgacaagccctcaagttctcaaaccgtttcgccaactcaacgcattagtccaccaccctcacctccctcttctgatcatagctcaaacaaaacatgggtgtatgtagttgttggggttgttgtgggagctattgccttaacatcggttctctgtgctgtcattttcttcaaacgctatcgcaaaaatagaaacaaagatgactcattggtggcagtgcctaagagttttgaggcaattgaggaaaaacctcaagtgaaagtgaatgaaaaattgtcagagaacatatctggcatagctcagtctttcaaagtgtataactttgaggaactacagcgtgcaacagataactttagtcctagcagctggatcaaagggtctgtttatcgcggtgtgattaatggtgatttggctgcaattaaaaagatagaaggagatgtgtcaaaagagatagagatactgaacaaaatcaaccataccaacgttatacgcctttctggagttagcttccatgagggtcgttggtaccttgtttatgtgtatgctactaatggggacttgagtgaatggatctacttcaacaacgtggacgggaagtttttgagttggactcaaagaatgcaaattgcattggatgtggcaacaggacttgactatcttcacagtttcacttctcctcctcacatccacaaggatattaacagcagtaacattcttctggatggtgatttcaggggaaaggtcgcgaatttaagccttgctaggtgtttggaaggaggggatgatcaatttcccacgacgaggcacattgttgggacaagaggctacatggctccagagtatttggaaaatggtcttgtgtccacaaagcttgacgtatatgcatttggggtactgatgctggaaatggtcactggaaaagaggtcgctgctattttaactgaagatgagacaaaattgtcacatgttttaagtggcatacctggtgagagaagtggcaaggagtggttgaaggagtttgtggatccctctttgggagagaattgtccattggaacttgctatgtttgtgattgaaatgattgatgattgcataaagacagatccagcaagtcgccctagtgtgcatgagattgtgcaatctctttcaagaacagtgaactcttcactgagttgggaaaggtcaatgaatgtcccacgaaattaa

SEQ ID NO: 106939 - DNA, 2322 bp, Glycine max
  Peptide Sequence Number=SeqID_223717
atgacgacgctgttctgcggcgcggtttccctgacgcaaatgtacttgtccgattccatggtgacatgcgtgaaagtgatgaattgcgggttgattccgacacttgccaactgcaaaaacgacgagcgtatcggagagtcagaaaacgacgagagaatgggcaatgcggcaaggcattgcggggaaaacgacgagagagtggcgaaatacggaccgttaagatctgaagaagaagcagcagcaaagggcaacaaagcgggagaagaagaaggaaaacagccgttctttcgcgaggctaacctgttaaacgggttaacctcgcgagtgcaagcccgttcctatgctcgtcgtcgcgaaccgtttcccaccaaagtttctcactacctccaccgtgcaaaactcattgactccattagacttactctacgctccaacacccccaacccctcccttccctctctcataaaccaccgtcttatggactctttcgtggccactcatgcacttcgctctgccccttctgctgattccgctctctccttcgtccgtgccctcgaaaaaagttctcatttttcccacacccaccacacactccattcacttgccactgttcttgccaagtctggtcgaagctctgagctcaaatccctcgttgatgatatccgagccaaccggttcggctctgttcagatcagtttcatgaatctcatgcagtggcatgctgcagttagggaccttgacactgttcttcaggtgtgggaacagtatgcacttgagaatgaccatctatgtactgaatcttacaacattgttatgactctttatgctcaaatgggaaaggactttgaggctgttcgagtttttcgcaggatgattgatgaagggtctcttccgaattgcagaagctatactgtgataatcgagcaccttgtgaagtcgcgcaagttatcggaagcattggaggtttttaacctgttgccttcaatgaggatcaaacgcaccttgagacagtactctgttctgcttgagggttttgtaggtagcaaacagtttgacgaagtgagaattttagttgaggaaatgcaggttgatggaatattgcctagtagaggcatgggtctgttgctgcagcagatgaaggaggaaggaattcttgaaggcaaggagcaattgttgagaggaattttgccagatgagacaatcaggagtgtaagttattctattgatagtggtgatgaggatgaaaatgagaatgaggaccaagatgagaatataagtgatgctggtcaatgtaatcatgttgatggaattcatttaaaaccgtggatggacccacgggctttggtcagtgccttgcggaattggagtcctgatgaggtagcagcactagagagtgcaaactttgtatggacaacaaggttggtttgcaagatgcttaggaatttcaaaacaccagaagctgcatggagtttcttctgttgggctgccaatcagcgtggatttactcatgacatatacacggtacaaagaatcactacccttctagcacgtcatggacgtactgacttggttgatagactcatctccaagatcagaatggagagaatgagactaccattcagcaccatcaggatgatcattgacttctatgggatttcaaaaaaagctgatgctgctctgaaggttttcaatgatgatcgaatactttgcggtcccatatcaaatgttaacttgatgcttctttattcctctcttctaagaacattgacaaagtgtggaagaaattctgatgccctggatatgcttgatgacatgattttaaatggtatttgcccagatatccagacattttcaggcctaatgtactatttttcacagcttggagatataaaaacagtgcagaagctctttgcaatggttaggcagagcggtttagagccagatgcttatttgtttaaggcattaatccaaggttattgcaagtcagaaagagctgcactagcatggagactatttgaagacatgaagaattcaggtttggtgcctgactctgccaccaaagagttgctagtaaagagcctctggaaagaagggagacggagagaggctgctgcagtggaagaaagttatgaggaaataaatacggtccttccacttgcattgcagggtcatcacacatattacaagggaaaaacaatcaaggttttaagaaaacgatttacaattgcaattattgccaggaccacaactgcggccgcatctgcatttttccgtaatatcaaggattgtgatgactgcaatcatcctaatttaaaaccttga

SEQ ID NO: 106940 - DNA, 549 bp, Glycine max
  Peptide Sequence Number=SeqID_223718
atggaatcggacaagtacatttgcgtcagggaaaccgcgccgcagaacagcgtcgtcatgattgacatgaccatgccaatgcagcctctccgacgccctatcactgccgattccgctcttatgaaccctaacaccagaattctcgcgcttaaaggtgaccaaaccattcgcgcttcctattcattgcgttatatgattccaattcgatcacccgcccaatgttttgtttcgtttcttctccgtgcagctcaagttccaggcagtactcaggatcatttgcaagtttttaacattgaatccaaagcgaagatgaaatcgtatcaaatgagccaacaggtggtgttttggaagtggataacaccaaagacactaggcatagtgactcagtcatctgtgtaccattggtcaattgaaggtgatggtgagccggttaaggtgtttgaccgaacagctaatttggcgaataatcagattatcaactatcgttgtgatcctactgaaaagtggttgctacttcaaggccttgcacttggagttattgacaaatag

SEQ ID NO: 106941 - DNA, 1113 bp, Glycine max
  Peptide Sequence Number=SeqID_223719
ccaaaaaccaccatcacttacaaactaccaccgggaccaaagaagctacctctcataggtaacttgcatcaactagcaatagctggttcacttccatatcttgctcttcgagaccttgcccttaaatatggacctctcatgcatctccaacttggtgaaatttcaatcctggttgtatcctcccccaacatggccaaggagataatgaaaacccatgatcttgctttcaagacgagacagatgcaacagcaggttgacaagatcgcatataacattctccaagagcatcaagaaaagcgcgatagggcactacaagaaagtagggttgacctagaggaagaagaccttgttgatgttcttttgagaatccaacaaagtgacactatcaagatcaaaattactaccacaaacatcaacgctgttacattggtcgtatttaccgctggaatggatacttcagcaacaacacttgaatgggctatggcagaaataatgagaaacccaatagtgaggaagaaagcacagaccgaagtaagacaagcattgggggaattgaaaataatccatgaaacagatgtagaggaacttacatacttaaagttggtgatcaaagaaacattagggttgcgcactccttctcttttattgcttcctagagaatgctctgagcgaaccatcattgatgggtatgaaatacctatcaagactaaagtcatggtaaacgtgtgggcaattgcaagagatccccaatattggactgatgctgagagatttgtcctagaaaggtttgatgatagctttatcgatttcaaaggaaataactttgagtatctttcttttgaagcaagaaggagaatgtgtccagacatgacatttggattagtcaacattatgcttccactctatcacttcaactgggaacttccaaatgagttgaaacccgaggatatggatatgtctgaaaactttggactgacaatttatattggaaggaaaagccagctgtgtttgatgatgtgtcaagcacgaggagaatttctatctgggaattcaagcgcacaaagtgatagcagaacaccctgcactgatttgggaaattcaagtgtaatgtga

SEQ ID NO: 106942 - DNA, 4605 bp, Glycine max
  Peptide Sequence Number=SeqID_223720
atgttgccatttttttggggaggtcgaaatagttttaggagaccgcaacttgtaaaaggaaatatgcaactcttctctgtggatcaacagaggagccaggctcttgaagcacatgctgcctcatttgccacatttagggttgctggcaatgataaggattcaactcttatttgttttgcatcaaaaagcatcaatgctggacaggttacgtcaaagatgcatgtcatcgaacttggtgcccagccaggcaagccatcattttcaaaaaagcaagcagatctcttcttccctccagactttgctgatgactttcctgtatcaatgcagatttcaaataagtatggcttgatatatgttatcacaaaacttgggcttttatttgtgtatgatctagagactgccactgcagtttacagaaatcgaatcagtcccgatcctgtatttttgaccacagaagcatcttcagatgggggcttttatgctataaatagacgtggccaggtgttgctcgctactgtgaatgaagcaaccattgtaccttttgttagtggccagttaaataatttggaacttgctgttagtcttgctaaaagaggaaacctccctggtgcagaagaattggttgttaagcgttttcaagaattatttgctcagaccaagtataaggaagctgcagagcttgctgcacaatcaccacaaggagtacttcgtactcctgacactgttgctaaatttcagagtgtacctgtgcaagctgggcaaacgccaccgttattgcaatactttggaactctgttaaccatgggaaaactcaatgcttttgagtcactggaactgtcacggcttgttgtaaatcagaacaaaaagaatctcttggaaaattggctagctgaggataaacttgaatgcagtgaggagcttggtgaccttgtgaagacagtggataatgaccttgcattgaaaatttatattaaagctagagccacaccaaaagttgttgcagcttttgcggagaggagggaatttgataagatcctgatatattctaagcaggttggatacacacctgattatatgttccttctccaaacaattttacgaacagacccccagggagctgtaaattttgctctgatgatggctcaaatggaaggaggatgccccattgactacaacacaataactgatctctttcttcagaggaatttgatccgtgaggcaacagcctttttgttggatgtgctgaagccaaatcttcctgaacatggatatcttcaaacaaaggttctggaaattaatcttgtgacctttccaaatgttgctgatgctatattggccaatggcatgttcagtcattatgattgcccacgtattggacaactatgtgaaaaggcgggcctgttcatacgggctcttcagcattatactgagttgcctgacatcaaacgtgtcattgtgaatacacatgccattgagccacaggctttagttgagttctttggaaccctttctcgagaatgggcactcgagtgtatgaaagatcttttacttgtcaatcttaggggcaatcttcaaataattgtgcagactgctaaggaatattctgagcagttgggtgttgatgcatgcattaaactctttgagcaattcaaatcctatgaaggactatactttttcttgggtgcatacttgagctccagtgaggatcctgatattcacttcaagtacattgaggccgctgctaaaactggacaaattaaggaggtagagcgtgtaactagagaatcaaacttttatgatgcggagaagacaaagaattttcttatggaggctaagcttccggatgcacgtccattgattaatgtgtgtgatcgttttggctttgttccggatctcacccattatctttatactagcaacatgcttcgctatattgaaggttatgttcaaaaggtcaatcctggaaatgctcctctagttgtaggacagttgttagatgatgaatgccctgaagattttatcaaaggtcttatactttcagttcgctctctcctgccagttgagcctttagttgaagaatgtgaaaagaggaatcgtctccgattgcttactcaattcttggagcatcttgtaagtgaaggaagccaggatgtacatgtacataatgccctgggtaaaatcattattgacagcaacaacaatcctgagcattttctcacaaccaatccatactatgattctcgtgttgtcggtaaatattgtgaaaagcgggatccaacccttgctgttgttgcttaccgaagagggcaatgtgatgatgagcttgttaatgttactaataaaaactccttgttcaaactccaagcaagatatgttgtgcaaaggatggactctgacctctgggagaaagttcttaatcctgagaatgagtttaggcgacagttgattgatcaagtggtgtctactgctttgcctgaaagcaagagtcctgatcaagtttcagctgcagtgaaagcttttatgactgctgatcttcctcatgagttgattgagcttcttgaaaagattgtgctacaaaattctgcttttagtggaaacttcaatcttcaaaatttgctgatccttactgcaatcaaggcagatccttctagagttatggattacataaataggttggacaactttgatgggcctgcagtaggggaggtggctgtggaagcacaactatatgaagaggcattttctattttcaagaaatttaatttgaatgttcaggctgttaatgtcctactggataaccttcagactattgatcgcgctgtggagtttgctttccgggttgaagaagatgctgtttggagccaggtggctaaagcacaacttagggaaggcttagtgagtgatggaattgagtcattcattcgtgcagatgattcaactcatttcttagaggttataaaggctgctgaagatgcagatgtataccatgacctggtaaagtatcttctcatggttaggcagaataccaaagagcccaaggtggacagtgagctcatctatgcttatgctaagattgaatgccttggagaaattgaagaatttatactgatgccaaatgttgccaatttaccaaatgttggcgaccgcttgtatgatgaggctttgtatgaggctgccaaaattatatttgcttttatttctaactgggctaagttggcagtcacattggtgaagcttaaacagttccaaggtgctgttgatgctgccaggaaagcaaacagttcaaaaacatggaaggaagtttgtttcgcctgtgttgatgctgaggaattccgcttagctcagatttgtggtctcaatgtcatcattcaggtggatgatttggaggaggttagcgagtattatcaaaacagaggatgcttcaatgaactcatatctctaatggagagtgggttaggattggagcgtgcacatatgggtatctttactgagttgggagttctgtatgcgagatatcgtcctgagaagctaatggaacacattaagttattctcaactcggcttaacattccaaagcttattcgagcatgtgatgaacagcagcattggaaagagcttacttacctatacatccaatatgatgagttcgataatactgcaaccaccataatgaatcactctccagaagcatgggaccacatgcaattcaaagatgtgatagttaaagttgcaagtgtggagctgtactataaggctgttcacttctacttgaaagaacatccagatataataaatgatatgttaaatgtgattgctcttcgtgtggaccatactcgtgtagtagatattatgcagaaggctggccacctcagattagttaagccgtacatggttgcagttcaaagcaacaatgtgtctgctgtcaatgaggctttgaatgaaatttatgctgaggaagaagactatgacagactccgtgaatcaatagatctgcatgataacttcgatcagataggtcttgcacagaagattgagaagcatgaacttcttgagatgaggcgtgttgctgcctacatttacaagaaagcaggaagatggaagcaatccattgctttgtcaaagaaagacaatctttacaaggactgtatggaaacatgctctcaatctggtgaccgtgaactctcggaagatttgcttgtctactttattgagcagggaaagaaagagtgttttgcatcatgcctctttgtctgttatgatattatatggccagatgttgctcttgagctagcttggatgaacaatatgattgattttgcttttccatatctcttgcagtttattcgagagtatacaggcaagatagatgagcttatcaaggacaaaattgaagcacaaaatgaggagaaagctaaggaaaaggaggagaaggaagtacttgctcagcagaatatgtatgcccagttgctaccgcttgctttgccagcacctcctatgcaaggaatggggggaggttatgccccttccccaccaccacccatgggcggaatggggatgccaccaatgcctccttttggtatgcctccaatgggtgggggctactga

SEQ ID NO: 106943 - DNA, 189 bp, Glycine max
  Peptide Sequence Number=SeqID_223721
atgggtggtttagcctctcattgtcatgagagacttactaatacaaaaagaaagcaagaggtgtggaagaaaatggaggaaggggtccccaagctaagccgcagatgcgcgctaagccgcaaggtgcaggctaagccgcagatgcacgctaagccgcagatgcacgctaagccaccagatgcatgctaa

SEQ ID NO: 106944 - DNA, 339 bp, Glycine max
  Peptide Sequence Number=SeqID_223722
atgggggatacacatgaagtaccccaagaccacactctagctgactccgagccttgcctcggatatgctactgaggggcaagcatttggtggcatacccctgccaaacactttggggggccctcagtatcacccacaaccacaagccttgcattttgcggtgggaagagtccctcctgctatggtggaaatgcccgacatcattatccctccaaagttcaaggtaccggattttgataagtacaaggggactacttgccccaagaatcacctgaagatgtacagaaggaaaatgggggcatactcgaaagatgaaaaattattgatgcatttcttctag

SEQ ID NO: 106945 - DNA, 294 bp, Glycine max
  Peptide Sequence Number=SeqID_223723
atgtcgctaaatataaaattgggttcttttttaaatgtggtgtacttagatcaacttggaatagcatcttgctacaacactaaagtctattgcagacagactttaattggagggaactatgaccttctcaataccactacctttgctcccaatcctaactactacagtgcacttttgtggcatcggttaatgggaaagaaggttcttgcggtctcaagtgatgttcatattaaagacttttacctacagttaggaaatacaagtggtctcagatatcttaagaaggggggttga

SEQ ID NO: 106946 - DNA, 1326 bp, Glycine max
  Peptide Sequence Number=SeqID_223724
atggagcctcgcaaagcttcaccattatcgtgggtcttgatcttcttccttaccatttccttgtggggagttaaggtatcaagtgaagagcaccaccaccatggcaaatctaaagagggacctgtggtggaaagggatcaaaggaggacattacttgtcactgaatttggagagatcactgccattgacatcaaggaaggacaaaaggaactaccctaccatcttcagttcatcacattggagccaaactcgctatttctccctgtgcttctccaagcagacatggtcttttatgttcatacagggagtggaaagctgacttgggcaaatgatgatggtactagtacgattcgtttacgcgaaggagatgtctgcagtctcaatgaaggatctgttttctatatacagagcaacttagaggctgagagaaggaaacttaggatttatgcaatgtttaccaacacagacgacaatacttacgatccatcaatcggtgcttactcaaggatcaatgaactggtcaaaggctttgataagaaaatcatgcaagcagctttgaaggtgccggaagatttgatcgaagcaatcattaacaagacggagactccagctatagtgcatgcggttccagagaagcgaaatattgtccaggagctggaggcttcgtttcttaaaaactttttaggcgttgggtccaactccaagaaactcgaaacatacaacatctttgagcatgaccctgacttcaaaaatcccattggttggagcacagcagtgaccaaaaagcaactaaagtcattgaagcggaccaacattggatttctgatggtgaatttgaacatgggatcaatattggggcctcattggaatgcaaaggcaacagagttgacagtgggagtggatggggaaggcatggtccgagtagtatgtggaagcggcaatgaaaatgagacagaatgccaaaacatgaggtttaaggttaaggaaggtgatgcttttctggtgcctaggtttcatccaatggctcagatgtcattcaacaatggaccatttgtttttctcggcttcagcacttcagcaaagaaaaaccaccctcagtttttggcgggaaagggatcagtgcttcatattctagacaaaaagatactggccaggtctttgggtatgcagttcctgcgcagaggaagaggagaagataatgaaggaggaggaggaggaagaggagagcaagaaagaagaagaagagaggaagaaaaaagaagaggaggaggaggaagaggagaaaaagaaaaaagaggagaggaagagagaggaagaggaagctaa

SEQ ID NO: 106947 - DNA, 231 bp, Glycine max
  Peptide Sequence Number=SeqID_223725
atggcagtggattggagaaggaggaaaggtgattggagatgccacttcaaggagcagatgagtcaagagcaaggtgctttaaaatacaagggccaaaatcctacattactagggtactctaaacttgtgggggcattggatagaagactccaagaagattgggccagagatgcaaaagaaggccctagggttcttatgagctttagggtagatttcgggcccatgggctaa

SEQ ID NO: 106948 - DNA, 147 bp, Glycine max
  Peptide Sequence Number=SeqID_223726
atgtatgtttggagctttgtggatttggttgttagtttcttgggacttcactggactaatgatcttcttggagcaatgagacagttggcgttgaagcccgaaggcttatttttggcggctattcttagggtagaaacattgaagtga

SEQ ID NO: 106949 - DNA, 429 bp, Glycine max
  Peptide Sequence Number=SeqID_223727
atgcacagataccttatggttatgcacatcttttgtcagctagaggaaagcgagcccgttgacacgcagagacaaacgtcatcatctgcacctttgtcatccagagacggcgagtccaatgacatgcggagataccttatagttatccgcaccttttgtcaactacaggcaagcgagcccgttgacacgcagagactaacgtcgtcatctgctcctttttcatccagagacggcgagtccgatgacatacagagataccttatggttatccacaccttttgtcagccagaggcaagcgagcccgttaacatgcaaagactaatgtcatcatctacacctttttcatccagagacggcgagtccgatgacatgcgaagatacccgagtggttatccatacaaacacacttctgttaatcctgacccatga

SEQ ID NO: 106950 - DNA, 360 bp, Glycine max
  Peptide Sequence Number=SeqID_223728
atgttgaatgccagttacagtgtgaaacaaatggtcattcaatgttttgacagagaatgcgaaaaataccaaaaaaaaggggtccaaggctcagaagtggagagaattgagagaagagagaaagaagaagaagaaagaaggggaaacgaagtcgaggtgctgccgaatcacgactatgaccaatccctacatcgttccttgttcggtgttcttcgtgcaaccatcggttttgatggttgtttgttagatccagaaaccaagttaaaaggaaaggcaaaatggtcacttttccaagatttcaaacatccattcacccaggctagcagctcgcctgggctaatcaagtttcttcaggcataa

SEQ ID NO: 106951 - DNA, 375 bp, Glycine max
  Peptide Sequence Number=SeqID_223729
atgtttaccctaaaaatgagggcactgttgcctacgaatacacctagtctgcgccgatttgttggggttccatgcagaaaggtcggtggaataagatttacgatcaacggttttcgttacttcaacttggttctaatcaccaacgtggcgggtgcaggggatatcgcgcgcgtgagcgttaaaggttccaaaaccgggtggaacagcatgagcagaaactgggggcaaaattggcaatcaaacgcgaatttagtgggccaggccctttccttcagagtcacgggcagtgacagacgcacctcaacctcttggaacgtggcaccttctcattggaagttcggccagaccttcacgggcaagaatttccgcgtctga

SEQ ID NO: 106952 - DNA, 435 bp, Glycine max
  Peptide Sequence Number=SeqID_223730
atggacgaagctgcagattatattctgatagggtttcgtttgtttgtttgccaagaaaacaaggaatttgggaagagaacaatcaacatgaaaaaacttcaacctcatcttctctgcaagttcgttttgctatactcaccggcggtaactgacgggcacgatgccggctttatactgagcgatcttgaggaacatgggcatggcgaggtcgaagtggggccgaggagggttgcaccagccgccgttgtcgctgggaagggcaaagttgggagggcaaaaattcgtggcggtgatgacgatggaagggcttcccgggttgcaccacctcggatcttggtcgcactttatctcgaagcacgcgccgcagctcaacccgttgttgaacagcgccgtgctcaaggccgcggtgttcacgccatacccttggctgtatag

SEQ ID NO: 106953 - DNA, 384 bp, Glycine max
  Peptide Sequence Number=SeqID_223731
atggtgtcctatgagcagtctaccaccaaaagaaagaacatgaagcagattcgcctaagtatgtttgataggttggaacctcaaatagagggcacctttaatgagccaacatatcaaattacttgtcctaagttagctaatatgcgaagagccatgaggaggaaggaagaatccatgaagtataagaaattgaggcagcaaatccaagacaacatggagttgactcacgtgtcagaaattgatgatagcccaatcccacggagcaaaaaaaggatggctaaattcaatgtcgagataagaatgaaaaccttgcgaataactattgacaacaagggaaggagtacaaccaggatgattaaaccatttacaaaagcgagaatatga

SEQ ID NO: 106954 - DNA, 258 bp, Glycine max
  Peptide Sequence Number=SeqID_223732
atggtgctcaaatttcacgacgatccaacggtgaatgactccgagatcgtcatttttctaagacaggttaggtggcctacgggaaaaagagagggttttgggagaagagagaaaaaacgaaattgtgagggagaggaggccgaggagaaacacctctccatcatgtttgcccagttttgtattgaatttgatggtaaatttgaataccaagtaaaagctacacttgtcagagaaaggggaaaaagctgcaaccattga

SEQ ID NO: 106955 - DNA, 225 bp, Glycine max
  Peptide Sequence Number=SeqID_223733
atgtcgaaaaacctttcggattgcacgacaactagtgttaagcagctcaattcggctagcaagaatcaaaatggtgctaagaagacccccaacctagtgttggaggttgtcgtggaggctaaagctgaatgtgccaatagaatggatgggtggggatgcacttgggttaatcgctcaaaggtgaaactccatggagtcgagtttgtctttgaggtcaatgattga

SEQ ID NO: 106956 - DNA, 159 bp, Glycine max
  Peptide Sequence Number=SeqID_223734
atgttggagaacaacctattcagtggtgttgtccacgaagatcctatgcaacacctaaggaagtttatcatgttgaccaacacagtgagacaataccatgtaccaacaaaagggaacaagagagtctacctgaagcttgggaaagtttgcaagagataa

SEQ ID NO: 106957 - DNA, 198 bp, Glycine max
  Peptide Sequence Number=SeqID_223735
atgatggtcacgatccatcctaacggtgttgtttgtgctcttcagctcttaaaagcgctcaaggtacactatggccatggtgaatccaccacggccgtggtcaaaagtgacatggaagccttgggccattatgaattgactatggctctcttagttgaccacgaccctcatgaatttaccatggctctcattaattga

SEQ ID NO: 106958 - DNA, 369 bp, Glycine max
  Peptide Sequence Number=SeqID_223736
atggaccaggcacctaggaaagttgaggttcctactaatagaaatctagtggcaagcaaagaaggggtgagaaggaggttgggtgataaggaggaagtgtttaaagtgtttgatccggcaattaactcctcttcctcccctacatgtaattttgtgcaagccaccaacaagatgaagactattgtggctaagccccacccaagtgtggggaaagatgaccttccaaggaagaaagtcattccaaaataccctagatggagtaagaaaaagggagataggatcaccattcaagctcttgattatggagtagatgattatattggaggatcagtgcaaaaagggaaaatcaccttgtttgagggtgattga

SEQ ID NO: 106959 - DNA, 1029 bp, Glycine max
  Peptide Sequence Number=SeqID_223737
ggcgcttatctgcacaaggcgctacgcgacgtgctgggggagcttccgcacgtcggtgatacgcgcggccgcggcctgtttgccggtgtggagctggtgcgtgataaagccacaaaatccccgttcgatccggcggtgaaacttcacgcagccatcaaggccaactgtatggcgcgcggtttgctggtctatccgatgggcggcacgctggacgggcaatatggcgaccatattttaatcgccccaccgtttattgtcaccccgcaacaactggattttgtcgtggatacgctgaacaccgactgggatgagcagcaacgtccgctcgcggaagagattatcaacgggccgcgcggtgcgctgctgcccccgtttgagccgctgctgcgcagccccgagttaatggcacatgcacagcgtatgggggaatttctgcgctatcgcagtgcgctgggccagcggttatcggaactggcgattttaatgacggcaaggcactggtcacagccggtagagtgggcaatccatgcgccgatagcgcgcgaaaaggggatttctgctgcagcggtgcaggccatcaatgaaaaacgtcagcccgcggatttgcagcctgatgagtgggtgatttatcagttttgccagcagttacatcagcaacagaaaatcagtgatgccacctggcagcaagccatcgaattatggggcgagaagggcgtggtggatttgataggcattaacggctattacagttttctctcgatggtcatgaacggcgcacagacgccggataaattaaccgtcggggttgatacggcttttgttccttttgaatttaagcaaggtgataaatacgtcggctttgacattgatttatgggatgccatcgcgaagaaaatgcatgtcagctatgaattacacccaatggactttggtggcctgattccggggctgcaatcacggaatctggatgtcgcgatggcaggcattactattaccgatgcgcgtaagcaggtggtggattcagcaacg

SEQ ID NO: 106960 - DNA, 238 bp, Glycine max
  Peptide Sequence Number=SeqID_223738
tcccgaacccgtcggctgtcggtggactgcgcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaaggtagccaaatgcctcgtcatctaa

SEQ ID NO: 106961 - DNA, 857 bp, Glycine max
  Peptide Sequence Number=SeqID_223739
gggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacgctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctcgttaa

SEQ ID NO: 106962 - DNA, 777 bp, Glycine max
  Peptide Sequence Number=SeqID_223740
atgcctaaatttgccgccaatttatcgatgatgtttaacgaagtgccgttcctcgagcgcttcgccgccgctgccaaacaaggcttcaacgcggtggagttcctgttcccttacgagcatcccgccgagctgttggcggaaaaactgcgcaaacacggcctgcaacaggtgctgttcaacaccgggcccggcgatgtcggcgccggcgaatgggggctggcggcgctgccgggccgcgagcaggatgctcgcgccgatatcgatcgcgcgctggcctacgccatcgccctcgcctgcccctgcgtgcacctgatggccggcgtggtgcccgcgggcgcggaccggcagcgttatctcgacacctttatcgccaatgcgcgctatgccgccgacgccttcgccccgcacggcgtcaaggtgctgatcgaagcgctcagcccaccggtcaaacccgactacctgttcgccagtcaacatcaggcggcggaggcagtggcggctatcgagagaccgaacgtgttcattcagttcgactttttccacgcgcagttagtggacggcaatatcagcgggctgctggaaacgctggccgggcgctacgcgcatatccagatagcctcggtgccggatcgccatgagccggatgacggcgaactgaattacccgtggctgttcgacaggctggatgcgctcggttatcaaggctgggtaggttgcgaataccggccgcgcggcgacaccgccgccgggctcggctggctgaaaccttaccgctaa

SEQ ID NO: 106963 - DNA, 738 bp, Glycine max
  Peptide Sequence Number=SeqID_223741
atggctgaaggctttctacaacagcctcatggagagaaaccaatggaattagctggcgcagaatgctttgatgaattattatttagatctttaattgaaaaagacaagactaaagcaaaggagaagttcagaatgcataacctcatttatgatttagctaaactagtatctggaaaatgttattgctactttgaaagtggtgaaatcccaggaactgttcgccatttagcatttcttacaaagtggtgtgatgtctctagaagatttgagggtttgtatgacatgaactctctgaggacctttcgaccccaaccccgatatccagattttgaaagttacttgaccaagatggtatcacatatatggttgccaaaactaagatgtttgcgaatattgtcattgtgtcaatacaccaatatcactgagctgcctgattcaataggctatttggtgcttttgcagtatcttgacctttcctatacttctatcaaaaggttgcctgatgcaactttcaagctttacaaattgcagactctgaaattaacaaattgtaaatttcttactcatcttcctagacagataggaaatttggtcaatttacgccaccttgatattagtggcacaactttggtggaaatgcatagcaaccagaggaagaaattgaggaatcttaggaacttgctagagatgccgctattgctttcggaagacatgagtccgcttagaggtaagggatga

SEQ ID NO: 106964 - DNA, 312 bp, Glycine max
  Peptide Sequence Number=SeqID_223742
atggagtcgcgagtgcggtcacgcaccggaaccttgtcctccctccctcacctccgcaagccaccgcgggaggcagctacgcccaaagctctgctcgccagcgctgaagaaggaggccttcctcctccagccatgcctcgtcatcgccggccgagggcagtgattccgttgggtgagagaagcaaaggttgctccggcgggttttttcgagaagtatccggctctggtgactggattcttcttcttcacgtgctatgtcacgagtcgggactctgttctgtgtctcttacgttccctaagcttaacttttaa

SEQ ID NO: 106965 - DNA, 1395 bp, Glycine max
  Peptide Sequence Number=SeqID_223743
ggaattaaccccggactttattggcgaatgatgaaaattaacgtcgtcggcaccagcggcagcggtaaaagcaccctggcgtgtcaactggcggaacggcttgacgttccctatatcgagatggacaggctctattggcggcccgagtggcaggggacgcccgatgatgcgtttctggcgcggcttgagcagacgctggccgaagcgggaggaggctgggtgctggacggcaactacagccgcacgcaggcgatcaagtggcgcgaggtcgattatatcctgtggctggactacggcttctgccgcacgctgtggcaggccccgcgagtcgatcgtgctgtggacgatccgcacttactcgaagaaccggcgaaaatacctggcggagatggcccgtaccgatgcagggcgccgtttcaagcgcttgcgctctccccgccaggccgccgattttctacggacgctgccgcaggttcacagcagcaggcggtgatggatcctcactaccgctttcttgatgtgctgcggccgctgccacaggcagccggttttgtgcgcttccatctggaaaaagatcgcgaacatgccgtgcgtcatgtgcagcgtttgcgggtggcgtttgatgtccagcagcagaaggtcgctattttccgcgtggggatgttcgcggtgccagtcgcccgccaggccgtattcgatgcgttcttcgccgctgatcagcagatgcagcgcgatgtactcctgatgcatttcggcgcgcttttccgccgccggcacggtggtcagcgtcatcacgtccataaagatgttgtcgccgtcgatcgggtgatggcccagcgccagttcgggcaggctgttgtgaatcactgttattctccatgtgagcgaaagtccaaagagcctgcgatacaggctaaggggaagtatgccgatttgtcacgaggaaaacagttaacccgcctgcattccgacgttgcggtcggcaggcgagtcaggcgatcaggaaaggctttcgaggcgcggcttggggcgaatggtcagggcggagcccatggaggcggcgataatcgccgccagcgccagccattgcacgccgctcagcgcgatgatctccagcgaatatggcagcgcggtggagaggatcgccaccgccagcgccaccggcagaatatcgaggttgaacagcacgctgccggtttgccaggcgccgatcgggcagaacaccagcgcggcgatcaaggagccgagcgccaccgtaccggggccgtgatcgccgccggccttctggccgaagatgatatagaccgcccagcaggcgccggcgccgagcgcacaggcggcaccgaacggatcgatcccgcccacgccgtggccgagcggcaacaggaaccataa

SEQ ID NO: 106966 - DNA, 111 bp, Glycine max
  Peptide Sequence Number=SeqID_223744
atggcgaaaatctgtctgagaaaagcgcgcatcgcggtgaaatccgccgatcctcggatgagatgcggcggatttggtcaaaaaaaagccgtagaatacggccgaaaatag

SEQ ID NO: 106967 - DNA, 339 bp, Glycine max
  Peptide Sequence Number=SeqID_223745
atgggtgttaagtgtctcaaagtgatcaaccaaggtccacacgccgacaacaattgtcccaggacaaaattacggtatgacaatactttaacacaatttatgcaggataatgatgagaaaaagaataaagaaggagttgaaaaagaaaatgagaaaaatgatgaagtggtgactagcgaaaaagtggtaagggaagaagagttaaagaaatcaaatgaacaaacgctgataaaggcgttagagcagatgccaacatatgctaaattcatgaaggattttcttatgaagaggaaaagaattatggatgatgaaatagtgaagccttggccacaacaatga

SEQ ID NO: 106968 - DNA, 207 bp, Glycine max
  Peptide Sequence Number=SeqID_223746
atgtttgtttggcggttgccggtttgggagattcctgagtggatggctcaggtagatgacccagccttggttggtgacccagaagaatctgaggatgattttttagtggacaactctggaagagccagcctagatccttttcctgtacctcgacctcctcacagggaggctcccgatgccttaggaggcattatcgcttttctgtaa

SEQ ID NO: 106969 - DNA, 471 bp, Glycine max
  Peptide Sequence Number=SeqID_223747
atgcctaaatatgaccctgaagttgtcatggaattttatgcaaatgcctggcctactgaggaaggtgttatggataagcgctccaaagtatggggccaatggattccttatgacacagatgccatcaaccaattttcagggaatccattgatcttagaggatgggcaacaatgcgaatacacgacaagaagagatgctatccatcagtttgttggtactgaacctcctaggcacctagtggaccaagaaaagtccaataaggcactgggttttcctgccttaattacaggtctttgccaattctatggagtaccggtacaacaactagagcaggatcaggaaaatcaaccagtagcagatgcaccaccatcacctccacatcagccaccatccttggagtccatcttagcccatttgcagaggatgaagctcctgatgcacacatacatgcgtcatttggctgaccaatag

SEQ ID NO: 106970 - DNA, 162 bp, Glycine max
  Peptide Sequence Number=SeqID_223748
atgaaacctgtcaaaagaaggagtgtaagaggcatcagacaaaagacattgaagtctttggaaaataaagaggcagatgaccttgatggcctccgcaagccaacagacttgatagtcttggaggcaaagaagactacgatagtcttggtcgaaagacgttga

SEQ ID NO: 106971 - DNA, 604 bp, Glycine max
  Peptide Sequence Number=SeqID_223749
tatggctaactgtgctaaagagacaagtcaatgaagttttatcagagtttggattgatgaagaatcaacaggatttggggagtgtttcatgtgtttcaatcattcttcatcatttactgaaggaactccctatagaagtagttagttccaatgttgtgcagatccttcatctcattgaatttagcaaggataattcctttgatcagcatatgaattacagattgcttggattcaggctgtacgaaagaaaatcccctgttgatattgttgatgctgtgttagataaagttattcaggttattgctctgtatgatagccttgacgaatacctgaaggttgtagatgcttatactgatcttattcttcagaatcagatggataaccatttgaaaatcattttggaaggcatttcaaagcgtacttggaataaaggagttacagaggatgaaatgccgagcttgcaatctcttgtggtgaagcttctgtctcattttaagcatctggaagatgtgttttctctggatcagtttcctgaaatcttggatgtaatgtatggcaagtcacaggatgttgtctttttgcatatccttaatatggcgacaag

SEQ ID NO: 106972 - DNA, 1770 bp, Glycine max
  Peptide Sequence Number=SeqID_223750
atggcatcttcaaaaccgcatggtgtagaaaacgttggaagttgtttgagaaacaccaaaggcttcaccctccaagtccttaccggttgttggttcatggagttctcctcattcatgatcatgtcagtgtcaggagcaagctacatgtttagtctttactcaagggatatcaagtcagttttggggtatgaccaatccaccctcaatttcttaagcttcttcaaagacttggggtccaacataggcatcatttcaggcctaatcaacgaggtaacacccccttgggtggtcctaacaattggtggggttctcaatttttttgggtatttcataatttggcttgcagtggccagaaaaattgctaagccccaagtttggaacatgtgcttgtacatcttcattggagccaattctcactgttccaccaacactggagtcattgtcaccagtgtaaagaacttccctggcacaaggggcattgtaattggcctcttgagtgggtatcttggcttgagtgcagctatcatcactcagatatactatgccttctatggaaatgattccaagtttctaattttgctcatggcatggctaccaactgctgtaactttcgttttcttaccagttatcaggcaccacaggggagttcaacagccaaatgattccaaggctttctataatttcctctacaccactcttgtccttgcagggttcctcatggtggtgatcatattgcaaaaaagtttcacctttacaaagagtgagtattatatcactactagtcttatgcttctcttgctcatcctgccacttgctgttgttatggttgaagaaaaaaagatatggaagaggaaacaagaacatatcaacagtgaaaaccctcttaaggctttgaatataaccacagagatgccaaatctggagaagtctacacaggctccacaaaagcaagcttcctgttggaaaagcatgttcaggccaccaagtagaggtgatgattacacaatacttcaagcccttttcagccttgacatggtgattcttttcttagccacaatttgtggacttggtggtaccctcactgtgtcaaataacttaagccagattggcacatctttagggtattcggcacatagtataaccacatttgtgtcccttatggccatttggatctatatgggtaagattgtacagggagtggtctcagaaattatcatagcaaaattcaaagtccctaggcctatgatattcacattaattcttgtattaccttgtgctggttaccttctaattgctttcgatgtcccaaatggtctctatgcggcctcaattataattgggttctgctttggggctaactggccactactatttaccatcatatctgaactttttggtcttaaattttactcaactttgtacaatgttgggtcagtggcaagtccaattgggtcataccttttcagtgtaaggcttgcagggtatttgtatgacaaggaagccactaggcaaatggcagcattaggactaaagaggaggcctggggaggagttgaattgcaatgggagtgagtgttacaaaatggctttcattataatcactgcagttagcttgtttggggcacttgtgtctctcatcctggtgttaaggactagagagttctataaaggtgatatatacaagaagttcagagaggaagctagaactgctgaagctgaattttgtccaactcagaacaagaatggacaaactgctgcatatgaaggctag

SEQ ID NO: 106973 - DNA, 786 bp, Glycine max
  Peptide Sequence Number=SeqID_223751
atggagttcagacatcgaaattacagtgccgagcttgaatctcacgcgctccctcgcctacgcgccggagctcatcctctctctgctccacctccacctccacctctctcccaggttgatgccatagattgtgggaacactgatttctatgatccactgagaggaactaataatgatgcaaatgccgcccctcctgatcatgacaacttgaatgaagctgctgatcatcagccaacaaaggagtggacctctttcaggagattactaacgcagaggtttcctgtctccaaaatggtttccgttgcttcaatgcccgatgttttaacgagaagtggaaaattacttgagaaatcttcaacaaatatgcacttggaggaattggaggatccacaaaaattcgcagacgagggtgtcaagacgattacgtggcaggagtatgtttctcgactacatgaactcaaagatgaaattactcgttcctggcttgctgaagatcgagtgacatccttaaagttatccataaaggttgctaagcttctgatggatacgtcagtatttgagttttatcctacactttttgttcttgtcacagatatcatggatatgcttgggaacctggtttggcaacgcataaagcggaaagctgagttttccgaagatggagctttacgctgcaacttagcagaaaactttcaagcaagggatatttgtgctgatgccaaagaaacttgctataactggttcaacaaaattggtgctgtgcaagagcttcttccacgcatgtga

SEQ ID NO: 106974 - DNA, 159 bp, Glycine max
  Peptide Sequence Number=SeqID_223752
gcagcttctgagcacagtgagccatataaagacggcaatatgcagatgctactggatctcctaatcctcttatcatcattaccaagcgtcggaggctgtctaaaggttgctcaagcaaaaaccgccagcaaggcaatattgccagctccaagtaactag

SEQ ID NO: 106975 - DNA, 420 bp, Glycine max
  Peptide Sequence Number=SeqID_223753
atggcgaacttgccccaatccatctccacaagcggcgcgacgtcgtttggagcttcttctgccaccgccaaggatcgcagcaggatagcgtctgtggaacacctcgttctccaactcaacaaccccgatctccgagaaaacgctctccatgaactctccaaggaaatagtttcaatattccctgttatttcacctccaaaccttactccagcacaatcaactcgagtgtgcaatgctcttgctctttttcagtggaatagaacggtgctaaggttccgttgctgctccaatacggttctattgtggttaggtggcagcagatgcgttgcggaatttcgtgtgatagaaattgacactgcaattgccgactgttgcggttgcggacagcactgcaacagcaatatttcggctgcaatttag

SEQ ID NO: 106976 - DNA, 963 bp, Glycine max
  Peptide Sequence Number=SeqID_223754
atgcagtcagagagtgtcaatggaagtgtctttgctggaggaagtagagaatattctaagcgtctcgagttcgtgggagaccccgttctgattctcggcaccactaactacttgtttctcgcttaccctgatctagatcccggccagctctccgccctccgcgccgccaacgtcagcaccgagaagctcgcccgtgtcgctgtccgcattggcctccaccgctttgtccgccacagcgcccctccccttgtcgacaaggtcgagcgcttcgtcgacgccgtcaagctcgagattaaccccgttgctcacggcggatccgtcaaggcgcccaaggtcctcgccgacgtcgtcgagtccgtcgccgccgcgatttacgtggacgtcaattttgaccttcagacactatgggtggtactgtacctttttatcagaattcatcatcaagtttacgtttttcgtatggaatgccatactttaacccaaaagcaaaagcttaaggttcaggtggataggtcttatcttcactcaattttttcacttctaatcgatataatgaggggtgttttggagccaatagtgacaccggatgctttggagaaacagcctcaaccagtgactatgttgtatgagatgtgccaaaagaaggggaagcaggttgatataaaaccgtcaagggaaggagatttaagtgttgctaaggtgtttgttgatggagagtttgttgcctctgcttcctcttctcaaaaggatcatgcaaagcttgaagctgccaagattgccttgggtaaactagcacatttggtgccttccaccgataagaagtctgccactaacatgaagctcaactttgctgccgatgaaaatggtacctgggttgttgaagcacccaaaaataaacttcgtgagttatgtgcggttaaaaaatggcctataccagagtacatgtactgttctttaacatga

SEQ ID NO: 106977 - DNA, 1203 bp, Glycine max
  Peptide Sequence Number=SeqID_223755
atgtcatcttcactcatcttaccattaaccattttgacagtactgtcttttctctccttggccattggccaccgtgctcaaccctgcagtgaagaattcctcaagctagcccaacaaaagaacctctcagactgcaagacactgcgcactctgggggcagagtttgcttggtcctaccacaatgtcacgaataaatccatagaactagaaattatgttccgtgccacactccccaccccacaagggtggatggcgtggggtgtgaacccgggaaaaaggcctgagatgattggaaccaaagccatcatagccattaaacatggcgacggaacgtggaaaatagacacatacaacgtcactaaggagaccagaaacggttgcagccttcttccgtcgaaaatcgcgtttgtgaccaacatgtcagttgagcaaaaggtcgctaataggaacaccatgtatgctacattggtccttccttctgaagtgtacaacgttacgaagctgaaccatgtgtggcaagttgggtatgacattgaagatggacatccccttggacatccaaccactcttcggaacgtcgacagcacagaggtcatagacttgactgacaacggtcgcagcactggacagtaccggagttatcttagatcggtacatggagttctgaacattattgggtggggaacactgttgccgattggaattattactgcaaggtactttcgggtgtttcctttcaaatgggagccaatgtggtttaacctgcacattggttgccaattaactggttttctcgttggcatcactggatgggctattggattaagtctcgggcattcttctagatactacaccttccacgctcatcgaaactatggcattctcattttcacccttagcacagtccagatgttggcttttcgcttgaagccaaaggtgacggatgattaccggaaatattggaatatgtaccatcattttcttggttatgggttgctggctatcatattcataaacatattcaaaggaattaccattttggaagggggagttgcatggaagtggggatacattgggaatcttgctttgttgggtaccatcgcatttggtttggaggttttcacgtggattcgcttcttcatgttgaagcacaagcagggacacaaagccaataagaaccaaccagagccagaagcaaattaa

SEQ ID NO: 106978 - DNA, 548 bp, Glycine max
  Peptide Sequence Number=SeqID_223756
tcatgaacaaattcaacaaatctgaacttcttgtgctctttgtccttactcttctccttgcgatcacacccttgttaccttcctctctgagaccaacctacctttacttcatctttaacgttctcatcattgcacttgcagctgaagcgggtgttctctcagtttcttctaagcctttagaagacaaaaaacaacatgtttctgttacccagaaacctgtaatgcccccagaagtgtatgaacctgaggaaagggtggaagtgggtgcctcagaacatgatgaaaagaagcctaaggttgttgaaaagcctgcttctgatgagaagattgttggtgtcactgaggtgaaaaagtttccttcaatgccaaatcttttgctcataggaggtggagaaagtgaaggagaagtcatggatgaggagattgaagctgaagatgaggttgggggagttaatgggcaagagctgtttgcaaaagctgaggccttcattgggaacttctacaaccagttaaagaaggatagagatcgagaattcttggctttatga

SEQ ID NO: 106979 - DNA, 363 bp, Glycine max
  Peptide Sequence Number=SeqID_223757
atggtcgcacacaacaccggcgcgacacacaggagacaggttcgatggccgctgagtgcgaggatgaagtttgagcaaggggtgagagacgtgcgagcgatattgaggttgaccgaggttgaacgagggcacaccttcgacgacgttcctttagacgaagccgttgttgtctacgttcatcataattacacaaatgccacaatcctacgttctaagacggtcgaacaagatcgtcttagaatgcgtgttcgagaatctgacattggagatttgggacatgtgactgtggcggcaaaagcccacgatggtggtggagtgagggcacactacggatcaacattgacaaagacaaagaggacatga

SEQ ID NO: 106980 - DNA, 651 bp, Glycine max
  Peptide Sequence Number=SeqID_223758
atgaagttgatattggattactattgtcattctcttccttattggtctgctcttaatgataggactaatttgatgaagctccgttctgattataaggatgcttttgttgaaaagcatggagtcaaattggggcttatgtctggctttgtgaaagctgctgttaatgcactccaacatcagccgattgtcaatgcagtcattgatggtgatgatattatatacagagattatatagatatcagcatagctgttggtacttcgaagggccttgttgtaccggttatccgcaatgctgataccatgaactttgctgatatagaaaagcagattaatgcttttgcaaagaaggcaaatgatggaactttatcaattgatgagatggctggaggcactcttacaatatcaaatggtggtgtttatggaagccttttgagtacccctattatcaaccctcctcagtctgcaatcttgggtatgcattccatagtgagccgtccaacggttgttggaggaaatattgtcccaagaccattgatgtacgtggctctaacatatgaccacagaattattgatggaagagaggctgtgttctttctgcgacgcatcaaagatattgtggaggatcctcgtaggcttctgctcgacatatga

SEQ ID NO: 106981 - DNA, 643 bp, Glycine max
  Peptide Sequence Number=SeqID_223759
atgttaccaaatcctaagaacaagagggatgaaagagacaacacagagaccactatggatatccaaggcggcgatctcctttgtctccgttccatcgtcaaccctacctttcgatctgcgtttggcgttcagttgcttggtcagtcagttcagaacattcggtctggcccatcagtttctgctagagcttcttccattgcgggaaaagagattgcatttccttcaggcggatgtggatttgtccgaaacttcagtcatataacccttggaagctggattaattcaaagcctatgagggtggtcattcatccagaggcaaccgttcaaactttggggcgtctattttcttcagaaagtggagatacggttgatgttgtggttcctcctttggctgaatctatctctgatggaactctggcacaatttttgaagagacctggtgacagggttaatgctgatgaaccaattgctcaaattgaaacagacaaggtgacaattgatgtttcaagtcctgagtcaggcgtgattctaaagcttctagccaacgaaggtgatactgctgagccaggtaacaagatagcaatcatttcaaggtctgctgatgcaactcacgttgccccatctgagactacatctgagaaag

SEQ ID NO: 106982 - DNA, 1638 bp, Glycine max
  Peptide Sequence Number=SeqID_223760
atgaaagatttaatagcttcatcaggagtttcttcacctgctagagagagggcaggcttaagtttctcggcagttaaggctttagtgctacgtgaaaaggaggacaacttacatctgagtttactagcaatgagaaagtggcttgctgataacgtaattatgttaaagaatgttttaatgcttgtcctcattttccttaacccgttatctgttatgatctttcacttccgttgtaatatttgcaagatattcgcagaaggagatttccttagaagaaagatcgactctaatctggaggaaactgctatgacatctttgccaagagatattcatggtgcgcctcccgaaagccttgttgttaagctagctgaaatccttggaaactacaagactcttcgaaaaatggctcttttctggtgcagggttgttgctgaactaaggaaactttggttcgaggaacaatacttaccaggagtcccccaggatgagattcctgatctgaagtcatgtcttctatatcaacaatttcaagtaattaattgctgcatctctcggaaaaggttccgtattattgccactgaatctttagactctatgatgatgcaagctaattcagacataaaagaatcaactgattgtagcgctgaagcttctgcaagccctgttctatatgctagattgaatagtggggagcttgttcttcgacttggtgctgatcatcctgctggagatatgacattgttggaaactggcgagcctgtgtattctccaatcactcaggaaggacctttgcttacagaagatctaatcagggaaacagaggagtttgtgctgcggacagggagtgttggtgctgggtgctctcaattgctctcagatatgcaggctttcaaggctgcaaatcctggatgtattttggaggattttgtaagatggcactctcctcctgattggacagataatgaagcaagtacagaggatagtgatgtttttgatagtggtgagccattgtctgccagaggtaatttatggcgtgaattgtgggaaacatccaaaccagtacctgctgttaagcaggcgcctctgtttgatgaggatttggcagtggagggcatcctcaatgcatttgaagaaatgcatccatctgatctttttggacagctgtttgtttctttacttggtttaggatttggaattgccgaacctatgctgtctggtaacagtgacttctcgaagttattctatgactgcaaggagtacataattactgcttgtcaaaacaacaaattgaatgagaaagttgatggtctcgtccaggtatatgaaacagtggagaaaatgttattgaatcctgaagaagctctaaaaatgattaagcagacagaggaatcaactacagttaccggtgaaccaaggagcccgtttaagaggcttagccttatctttggaggcaaagataaactattgaggaagtctgtctcaaaagatcagacaaacgacgaagaaaagtcaggtcggcaatcattctccagtttctttgacagcaagtcatctttgtttggaaagaagcctcccaagtctggatccccatctccttctgagaaatcttctatcgatactggttggccagttgtttag

SEQ ID NO: 106983 - DNA, 441 bp, Glycine max
  Peptide Sequence Number=SeqID_223761
atgggacccttcagaaaggatgacatgtttgctaaaatatctccactcaccctgaaacataagcttatcccaatatcccaagcaccaacacacagtgaacaatatggggtgcctccacctccaaccttcactgcttccttttcctttgcatgcaaaattcaaaccgcagttacatcatatgaggcacaccaccaaactattttggcttactactcaccaacctccacgtggccagcacttaccttcagcaagtccactaagtaccaaggcacttccacatttagtggttgttgccccagcccaatccgtgcagtgcttctatcggcatacttcatagcaaattttgtcgtgccaggtttctttaccaactctttcggatatgataagtcatcaaacgaagagcagaaggttgacgatgtaaatgcaatagaagatgaatag

SEQ ID NO: 106984 - DNA, 147 bp, Glycine max
  Peptide Sequence Number=SeqID_223762
atggaggacatggacgagatcgatgccgttcctcagtcatcggtggtcggaggcatgaccttgtctgcaccgttttatggtgcttctctctgccggttactagaaagaacaagtttaggcagaacgagtttcaatttcatgacgtga

SEQ ID NO: 106985 - DNA, 363 bp, Glycine max
  Peptide Sequence Number=SeqID_223763
atggagagggcgatcaccagagacttgttttcacgtatattgttgttccaaacccatttgataaaggtggcaacttttgcagctgaactggactgctttttgtcaatggcattggttgcacggcagaacaattatgtcaggccgtcgttgactgaagaaaatttgcttgatataaaaaatggaaggcatgttttgcaggaaatgactgtagacacatttattcctaatgacactaagattcttcatgatgggagaattaatatcatcactggtcctaatttttctggaaaaagtatctatctaaagcaggattttgatcatactgttttaaatagcaattatgttgaaaaggtcattctatga

SEQ ID NO: 106986 - DNA, 1017 bp, Glycine max
  Peptide Sequence Number=SeqID_223764
atgactgtctttggcttcaataactggtgcagtgaaatatcaagcaaaccctttgatggagcagctgagtctcctatagtaaagcttgtgaaaagttcaatattcagctatgagcaagcatggcatagattagtttacctgcgagtggcggggatggatgatggattgaatgtgaaggagaggatttactatctgagttccatgatgaacatgggaagtgaagtacaagttcgtgctagcggtggccttcttgcaatattagagaatgaaaggattgtagatactcttgagcaaaaagaatctggaaatacatcaattacaatagattctttagcagaaatttcactattttgtcctttactatggagatacagaaataactttctcaaacttgatacagctgctcatgaagcattacaaatattccaaatagacaagcacccaagccacatgggaattggtagagcaaaagaagggttttcagtatttggaatgatgaataagtgcgtgactccaatgggtagacgtcttttgagatttaatcaatcattaaagaaatttgactctccaagctctatatgcactagctttgattggacagctcttctgaagagtatttgtgccatgttgcatgtaaacaagatttttgaagttggaatttccgaaggtcttcgagaagaattgaagtatttaaacttggatattgttgagaaggccagttcacacataacagcagaacttggttatgtctatgaactggtaattggtgttatagatgtaaatagaactaaagagaagggatatgcgacagtggtgaaagaaggtttctgtgatgagttggatgagctgaggcaaatatacgaggaactgccggaatttctggaagaggtggctgttggtgtttcatcattggaattagcacaacttcccgttctatgcaaggacaagcgcattccttgtattgtttatatacagcaaataggtacttctgactctgaattacacgtgtatccataa

SEQ ID NO: 106987 - DNA, 348 bp, Glycine max
  Peptide Sequence Number=SeqID_223765
atggcagcagggcagtgccaccatgccaaggcgtggaagaaatccagcaaatcactgtgtgggacacttggagttgaggattccttgtggtggcaaatggaaacttttgttatgtccgagaaatcagagaagggatatctaaaaagcccagcatcttccggcggtttcctctggcaatttacggttccttcttcagcaacttgctggcaactggaccctcacctcaggctctgcatgttcatgtctctgattttccaagtcttaggttttgcctttgtcactgttctctattctctgtttttgtctactatgttccctgcgttccctcactgttttcactgtccttga

SEQ ID NO: 106988 - DNA, 522 bp, Glycine max
  Peptide Sequence Number=SeqID_223766
atggaggaggagcagcagacttttgtgtccaaagcgagaaccgcctttcattccgccgcggccaaagcggagcgcgttctcttggatttcaaatccgatcgagcattgactcaatttgttgaccgtgaagaagatcacgataaacaatcgtcgcccaacaccttcaccggccaacaaccagaagctgaatctcctcacaccgacgaaaacgactccaagcttcatagtgaatcgaagcatataaagtggaggcctccacatttaggaattaagcaggattggcaagataaaataaagaacatccggagagggagaaaagaagttgaagatacagataaagttggggatgcaagcatggcaattccattttatgatgataatttgtacctcctgaatgtaaagaatgatctcgaggccaaggcttcagaagcaatgccctcagttgaaggcctcactgctgcaactaaagatcccattcctccatcatctgtgctaaagcaattggctatagctgttgagtaa

SEQ ID NO: 106989 - DNA, 381 bp, Glycine max
  Peptide Sequence Number=SeqID_223767
atggctaaattcaatctggaggtagtcatggagttctacgctaatgcatggcctaccaaggagggggtccgtgatatgcgctcctgggaggctattgcccagctgctatgcataccggggcaagacttcacccagaccgccgcagggagacgggtgcagatcatgcgcaccagtattgcacccacgagacaccctgtggacccggagaagtccgatagggccctggggtttcctgctttgatcacgggcctctactacactgtagcagccggaggaggaccaatagctagctgcaaatgcaccaccgccgcctcaagaggaggtactatctctgaggtccatctccgattgcctgcagaggatagagctccagatgcacag

SEQ ID NO: 106990 - DNA, 213 bp, Glycine max
  Peptide Sequence Number=SeqID_223768
atggaaaagatcggaggcaaacagaataattcaagatcaatgagagaaaaagatcagagaaccttccgaccagataaattttcggcaagattgccattcaaggtcgttctcgactggcgatatcccaccccacatgaacaaagaggaaaagaccgaaacacccagcttcctctccaaaaacactaccctcgagaaaatcctattggtccgtga

SEQ ID NO: 106991 - DNA, 429 bp, Glycine max
  Peptide Sequence Number=SeqID_223769
atggaggccatgaaagagcaaatggccacaatgatggaggccatgatgagcatgaagaagataatggaagccaatacggttgcagttgccgcgaccagcgctattgctaaggtgaacccgatgcccccatctggcctcagtcaaatgaatcatccagcctcagctagggtaggcaaagatttgggaagtacgagcggcccctattgtgtgcaatttcaaaacaagaacgccttcccgccatatggcttgcctcccaactatacaccacccaatgtggcgtacactcccaatgaggatgtcaataactccactcccatactcattgagagccaacaacctcaatctgatcatgcacatgtctctcgatccatgggggagacacatgaaatgccccaccataatttagccgacttcgagccttgcctctga

SEQ ID NO: 106992 - DNA, 375 bp, Glycine max
  Peptide Sequence Number=SeqID_223770
atgccaactttcaggtctgcaaaagattttccagatatgcatgctctcattatgcacacatacaacccagataatgctgattcacgtgttgatcatttgggattacacaaagctctgtgtgtcttaatgggttggaactactcaaagcctcctgataactcaaaggcatatcagtttttacctgctgatgaagcagcagcaaatcaggatgatctgatcatgtggccacctttggtgatcattcataacacaaataccggaaaaaatagagatggtcgtatggagggtttgggaaacaaaacaatggataataaaattagaggatttcccattaacatcaaattagaagctgggacattagagactcatccataa

SEQ ID NO: 106993 - DNA, 477 bp, Glycine max
  Peptide Sequence Number=SeqID_223771
atgaccagttcttgtctaaccgaaccattgcacaatctgtgtcagttctcaaccatgaacaatacagccttgccttcatgcccatttcacctccttggagggaactcagaaaaatatgcaacactcaattatttgcccacaagtctctcgatgcaacaactagtcactgatattcatgaaaggggccaaatgggtgaagtggtggatgttggaacagcagcatttaagactaccataaatcttttatcaaacaccattttctctgtggatttgattcactctacagtgttgaagatggttgatccacagggcatcaaaagatggctgagtaagaccgtgaagaaggtgatagaaatgtttgacagcttggatatatttgttgcggaaacagatacaacagcatccacacttgaatgggcaatgactgagttagtccgcaacccacatgtaatgtcaaaagcaaaacaagagctttag

SEQ ID NO: 106994 - DNA, 861 bp, Glycine max
  Peptide Sequence Number=SeqID_223772
atggcagttgaaaagtctggaattgccaaagatggtacagagttgatcggcaaaaccccattagtatatctgaataaaatcgcagatggttctgctgcgcgggttgctgccaaactggagttgatggagccatgctctagtgtaaaagacaggattgcctatagtatgattgctgatgcagaggagaagggacttatcacacctggacagagtatccttattgagccaacaagtggtaataatgggattggattagccatcctggcagcagccaaaggttacaagcttataatcacaatgcctgcttcaatgagtcttgaaagaagaaccattcttctgtcttttggagctgagttggtacattatgaaaccactggtccagagatatgggaaggcacaggagggaaagttgatgcacttgttagtggtataggtactggtggtaccataacgggtgtagggaaatttcttaaagagaagaatcctaatataaagctctatagtgtggaaccagttgaaagtccagtactctctggaggaaaacctggtccacacaagattcaagggattggtgctggttttgtccctggagtattggaagttagccttgtagatgaagtagttcaaatatcaagtgatgaagctatagaaactgcaaaacttcttgcacttaaagaaggcctatttgttggaatatcatctggagctgcagcttcagctgccattaagatagcgaaaagatcagaaaatgctggaaagcttattgtagttattttcccaagctttggtgagtggtatctgtcctctgtgctgtttgagtcaatcagacaggaagctgaaagtcttacttttgaatcctga

SEQ ID NO: 106995 - DNA, 549 bp, Glycine max
  Peptide Sequence Number=SeqID_223773
atgagttacaacattgactacctcaacaaggaagatgaggaccaggaagaggatgagaagaggcacaacaagaagttaaagctcgtggtgaagttcaacaacaatgaagaaaaagacaaggatgaggatgactccatgccaagtcacagaggggagcgtggggtgcatgcatcgtatgaaaatgaggtagaaaaagaagaacaagaagaaaaagaagaagaagggaatgaggaagcgaagaagtatgaagaagagcgtgaggtaaaaggcaaaaaagtggattctaaagggctctactctacttcagtgttaggaactccatcaaagcttccacctgggattccgttgcctgacaagagaaccttggagtttatcctttacaagcttcaaaagaaggatacatatggtgtgtatgcagagccagtggattcgaaagagcttcctgattatcacaaagtgattaagcatccaatggactttgctacagtgagaaaaaagttggaaaatggatcttatcctaccttggaacaatttgaggtgtgtaaatga

SEQ ID NO: 106996 - DNA, 441 bp, Glycine max
  Peptide Sequence Number=SeqID_223774
atgggtaaaagagctttccttattgtccatgccttcttcgtcttattcagctttggttcctcaaaggctgaaatggtttctgccgtttatgtgtttggagactcacttgttgatgtgggcaacaacaattacttgactctttccattgctaaggcaaatcatcgtcactatggtgttgattttcctacacacaaaccaacagggagatttagcaacggcaagaatgctgcagattttgttgctgagaaattgggttttccaacttcaccaccttacctgtcccttataacatcaaaggccaacaaaaacaatgcatccttcatggatggtgttagctttgcctctgcaggtgctggaatatttgatggtacagacgaacgttatggttatgggaatctgacccaagatgaccccggatgtctacatccatctttgaactaa

SEQ ID NO: 106997 - DNA, 768 bp, Glycine max
  Peptide Sequence Number=SeqID_223775
atgtgggtgtgtgggttggggcatgctacttcgcgttctctgtgtctagtggatgaatttggtaaaggcactcttacagaagatggaattggtctacttgctgggaccataaatcactttgtcacgactgatgaacctccaaaggtttttgtgtgcactcatctcatggatttattgcatgggcattccttgaccaagtctgagcagattaagttttacacaatgagtatactgaggcccgacggaaattccacgcatattgaagacattgtatttttatacaggcttgtccctgggcatgcgcatcatagctatgggctgcactgtgcactgcttgctggtgtaccagaggaaatcataaaaagagcaacagctgtgttggataccgtttcaaataataaacatgttgagcggttatccaatgagaacatctctgctcaagatcgtcaatacaaggatgccatggagaagttgttggaatttgatattgacaaaggcgacttaaaaattttctttgaggatcatactgacccaaacgttgcgacatctactttagggtcgataccacctgggttaggttggatcaaagttaatgttgatgcggctgttagaatgtctgataatgaggctgtttgcggaggagttctgcgtgatcattatggtgtctttttgcatggttttatggcaaactttggaacttgttatatcttagaagccaaactttgggctatcctcaatggcctccagctagctttggatagaggctga

SEQ ID NO: 106998 - DNA, 864 bp, Glycine max
  Peptide Sequence Number=SeqID_223776
atggttagactatgttctctgaaactctcttctaaaagagctaagaagaccactataggagaacgatctagtacaactccacttgtagaaatcgattttgatggacatcgctttcaaaaaattgctaggaggcattggacacaactggcagagcctatgactaaatatgatcttgaagtagtcatggagttttatgcaaatgcctggcctactaaagaaggcgtcatggataagcgttccagaattagaattcatgtggcacaactcatctcagatgccatccatcagtgtgtaggcattgcacctcctaggttcccagtggacccagaaaagtccaacaaagcattgggatttcctacattgattacaggtctctgccaattctacggagaaccggtcatgccgaagaagctcatctggcctcccattaacaggtcatttattgaaaaatattgcatgccaaggcaggtacaacagttggggcatgatcagcagcaacaagcgacaataggcgcaccaccgctgcctccacatcagcccacatgcaaaggatggaactccaaaatgcacaaatacatgcaacatttggttgatcagcagacatttaatcataggggccagaagcagttaaatgacaacttctaccattatacactacaccaacatcaccaggatcctaacccttacccttggcctactcctgagcagtttagagccattgttgcatgggctggacacaggcctaattttcaagtggaggcaagacttgcagatgctcaaggagctgcccaaggagatgaaggtggagctgaggatgatggagacatgacagatatgcttgactacttcattggaggaggctga

SEQ ID NO: 106999 - DNA, 261 bp, Glycine max
  Peptide Sequence Number=SeqID_223777
atgaagaattttgatgaaaagaaagtggcttgggagaatttagggagaagggggcaaggtcctcgtaaaaaagaaagaatgagggatgaaggtgaaggtggggtgaaatctgatttcaccccttcccccccttttttttcagcgtgcactcgcccaagcgagctaaccactcacccaggcgacacccccaccgaacgtgttgaatgtgcaacttctgatcgggcagacttggcaattggctctggagtgcaggtcatgtga

SEQ ID NO: 107000 - DNA, 327 bp, Glycine max
  Peptide Sequence Number=SeqID_223778
atggagaagtcttacaagaaatttttcaaagacaagaaagcaaagaaatcttacatcacttgggaagataacgatatggattcattaagagatttagaaaatgaatttgtgaatctgagtttcgtggccaaaaactatgttagcaaagaagagaggggcaaaagggttttttcattgagtttccttgaccctagcttgcccgggcccccaaattacttcggggtgaaggaatcagctcgctttggagagctagttacttcacgagtaagcatcaacttgcctgggcgagctgtcattgccccaagtgcccattttccttataaatag

SEQ ID NO: 107001 - DNA, 156 bp, Glycine max
  Peptide Sequence Number=SeqID_223779
atggatgcaaacttcacaaagagatgtctacctaggagcctacttgaatcgtatttcactgatcaaagaccattggaaccagagagaatgaaggtcattcgcattcaatgggaaagatattatttgaaagttaaaaatcaaacattaggactctaa

SEQ ID NO: 107002 - DNA, 1098 bp, Glycine max
  Peptide Sequence Number=SeqID_223780
atggataaaggtaaaggtgccaaggcattagcgacctctttgcaaaatctcgatttgaatcctccatccaacgtcaaatccaagtcctccatttcaatcacccaccctcaatttcccggattactgcctatgaagacaaagcctccgagtttggtcagcctttgcattggagttcttggaagacatttggaggatattattgcagatttgagtgaaattgctatcaacttgccagctgatataaagatagcagtggcagctattgctagaagaagaaaattgttgaatgatgatatcctgatcgcattagctgatacttcctgggaaatccttgatgtctctggctcagatgtctctgattttggcttgataaaagcagctgaagtatgtagattcattaaagctctagatataagccggtgcaccaaaattactgctaatggtatatctgagcttgtgaagcactgccacttattggagacattgagatgcggagggtgtccaaggactgacaacactgcacgaagatgcttgggtatatttaaaccaaagtttgatgattatgtggaggaggattcttgggaggagcttgatacaaaagaaattgctagtggggcacaatcactcagcattggttgctgtagagacacatatgctgcacttcctccagccaatggggatggaccaaacattgataaaaattctttagaggacttttccactgagtgcccacgtgttgtagtaaatcctaagtcatcaccctttgggtttaagggaactgaggttcctcgggaagcattacaaaatatcatattggatgatgaagttgtcaaggacattgatcccagaacatggacaatgcatgggtttgcattgaagcccatctctccatcttcaagttccactgaattatcagtagccgaaaaattcagacttgcatttgtggaaagggataaccgattagctccgaagcgagctaaaaatgcccggcaacatcagcgtcgtgcagtgagggaattgatgctgatgagcacaagagccaaggcaatggtcttagcctcacaagcaagcaagtcccttcatggccgaagctcatag

SEQ ID NO: 107003 - DNA, 438 bp, Glycine max
  Peptide Sequence Number=SeqID_223781
atgatttatgactgtcgcaacctgcccttcggcggaagggtgacgcgagggctcacgggtgtgtcttccaagataagaaaatgcgcggagtcaccaccaacatttattcaaggaaaacatcagaaaaaccggaaaaggcatggtctacaaaatttaagtgtgaaaggttcgggagttgtatttacgcacggggaaggttttcagaaattttacggaagcattacggaagccacggaagccccagaaatcatttttcaaaaacgtggaggagcttgccggccagttgcttcctccttaagcaacccaacttccaaagtgttccagaagggcctagactcgaattgctatttacacccctatcttgataagttcaccccaccttctttcgtaatttacgaaaaaagttatggaagccttatggaagcatatatgagttaa

SEQ ID NO: 107004 - DNA, 621 bp, Glycine max
  Peptide Sequence Number=SeqID_223782
atgctgaagaaattccaataccctggtcaatcagacgcacccaagaccaagaggaggagggaaagtacaagtgatggtggtgcttccggtggtgaagctagcaacactcgctctgagaaccgcgtgcaaaccaatcgccaacaggctcaagaaggaggccggttaccaccccaagttccgaaatttcatcatcagcattgcccaggtcaggccaatcatagattgacgacgagagtgcagagacgaatttacagtcatgccactgatgttgcaatccgccctttgaacgaggagaaggctgtgcaagctgctgctgatctgcttggagaactctttgttttctcggtcggcttcaagtccaaagggctcttgcgtgtgagggttgcaggagctgccatcatctttgaggtgcaaagaagttcaagatcagaagcaagaaaagaagaactacgtacacaggagattgaggaaataaagactaagaatgaagaattggctagagaaattgcacttcttgcacaaaagcttgaagagctggaacaactttccaggggacgaggactacttggcactcttaatatcaaacacagtcgtgtctctcaagatagaaaatctaattga

SEQ ID NO: 107005 - DNA, 883 bp, Glycine max
  Peptide Sequence Number=SeqID_223783
gtaccctgactcatcaatcaagctccatgctcatgaggctcgtgcctttgctgcgaaaagaaaggacacgtttgggagcaatgttcttttctacgatcgccaattcattgcattgaatgaagccgatgtgttggcatacagaacatgcagagaaatcgaagggccatatcttgattacattgaaaagcagttcaacaagcctgtgctagcaaccgggccagttattctagacccaccaacttcagatttggaggagaaattttccacatggcttggagggtttgagcctggctcagtggtctattgttgctttggaagtgagtgcactttggggccaaaccagttccaagagctggtgcttggtcttgagctaactggcatgccattcttggcagcagtgaaggccccattagggtttgagacagtggaatcagcaatgcctgaggggtttgaagaaagggtgaaagggagagggtttgtgtatggtgggtgggttctgcagcagttgattctggcacacccttctgtggggtgcttcatcacacactgtgggtcagggtccttgtctgaggcattggtgaacaagtgtcagttggtgctgttgcctaatgttggtgaccagatccttaatgcaaggatgatggggaacaacttggaggttggtgtggaagtggagaagggtgatgaggatggaatgtacaccagagagagtgtgtgcaaagctgtgagcattgtgatggatggtgagaatgaaaccagcaaaagggtgaggggtaatcatgctaggatcagagagttgctgcttaacaaagatttggagtcctcttatgttgacagtttctgtatgaggcttcaagagattgttgagggaatagacttgtag

SEQ ID NO: 107006 - DNA, 177 bp, Glycine max
  Peptide Sequence Number=SeqID_223784
ggtgctgatctggacaccattatcttggctggagcagactacggaacaggaatctctcaagattgggctgccaagggtcctttactagaggtgaaaggagttattgctttgagagaattcaccgtggtggagctggcataccttgatcatggtgccattctttcctatctaatctga

SEQ ID NO: 107007 - DNA, 783 bp, Glycine max
  Peptide Sequence Number=SeqID_223785
atgcagcaattacaagctcttccggcccgggtggagatgattaacatcactaaaacctacggctcaattcgttctctgcgcggcgtcaatctgcaactggcccccggggaagtgctcggtctggtgggcgacaacggcgccggcaaatcgacgctgaccaaagtgctgtccggcgcggtgatccctaccagcggcgcgatccgcattgatggcgaacagcagcacttcagcaatccggcggattcgcgccgttgccatatcgaaatggtttatcaggatctgtcgctgtgcgacacggtcgatgtggccggtaacctgttcatgggccgcgaaccgaccagacgcatcctcggcgtgccgtttctcgatcaggccacaatgcatgcgcaggcgcgtgagatgcttaaaggtctgggcatctcgattcccgatacccgtctgctggtgcgtaacctctccggcgggcagcgccaggcgattgctatcgcccgtgccgccgcgttcgatcctaaagtgctgattatggatgaacccactgccgcgctggcggtagcggaagtcgaagcggtgctggaactgattcgccgcgtgtcggcgcgcggcgtcagcgtgatcctcatcacccatcggctgcaggatctgttcctggtgtgcgatcgcatcatggtgatgtacgagggcaccaacgtggccgaccgccgtgtggcggacaccagcctgagcgatatcgtcaacctgatcgtaggtgagaaatttaccgcgcagtccgcggcagcacactga

SEQ ID NO: 107008 - DNA, 228 bp, Glycine max
  Peptide Sequence Number=SeqID_223786
gcaccggcggcgctgtcgctggtcggctttgatgacgccaactacagcgatctgacccagccgcggatctccaccatccgccagccagcgcgccagctgggccacaccgcggtgagcatcatgctgcgcctgctcaacaacgacagcagcatcccgatggagacacggttaccggtggaatggattggtcgcgattcggtgggatttgttagcgatgtcccaaaatga

SEQ ID NO: 107009 - DNA, 1032 bp, Glycine max
  Peptide Sequence Number=SeqID_223787
atgtactatccgattgcggtcggcggtaaagtcagccacaccgtggaagccctggtggcggattttgaaaaacagcaccctgagatcagcattcagccggtctacaccggcgattacgccaccaccgtgaccaaagcgctgacggcgtttcgcggcggtaacgcaccgcagctggcggtgatgggagatattgaagcctggtcgctgatggatgccggtgccatcgtcgccgccagcgatttagccacgggtgaagagggcaaacagtggatcgacagcttctatccggcctttttgcgtcgcattgagggcaaagtgtggggcgtgccttttcagcgctcaactgtggtgatgtactggaacaaacaggcatttgagaaagccggtctcgatccgaatacaccacccgccacctggcagcaggtggtggcattcagcaaaaaactgacgctgaaacaggccagcggcgtcagccagtggggcattgaaatccctaccacgccgaacggctactggaatttccaggggctggcagccaccaatggcggacggctggataacggcaagggcaacgccgtgtatttcaacacgccgggcaacgtggaaaccctgcaatggctgaccgatctcggccaaaaagaggaagtctcgccgaagggtgcgattgcctggggcaccacgccgcaggatttcatcagcggcaaaacggccatgatggtcaccaccaccggcaacctgaccaacgtgcacgacaacgcgaccttcccgtttggcgtcgccatgctgccggagaaaacccagcgcggcagcccgaccggtggcggcaacctctacgtgttcaaaagcgcctcaccggcgcagcagcaggcggcgatgcgcttcatccgctgggtcaccgcaccggaacaggccgcgcgctggagtatcgctaccggctatgttgccacctcgccggcagcgtgggacacagcggcaatgaaagcctatgtgcagcaggtgcctcaggcactggcgtggcgcgtgagcagctga

SEQ ID NO: 107010 - DNA, 1473 bp, Glycine max
  Peptide Sequence Number=SeqID_223788
atggacagtgcaagttgtgcactgctcattgtcttgacatgcgccatggttcatgctcttgttggttcattccttgctatggccacaaaagcaaaccataagcttccaccaggaccatccagttttcccatcatagggaacctccttgaattgggtgaaaagcctcacaagtcattggcaaagcttgctaagattcatggcccaataataagcctaaagctgggacaaataacaactgttgttgtgtcttcagcacaaatggccaaagaagtgcttctaaccaatgaccagtttttgtcaaaccgaaccattccacaatctgtgtcagttctcaaccatgaacaatacagccttgccttcatgcccatttcacctctttggagggaactcagaaaaatatgcaacactcaattatttgcccacaagtctcttgatgctagccaagacgttaggcgtaagatagtgcaacaactagtcactgatattcatgaaagcagccagatgggtgaagcagtggatattggaacagcagcattcaagactaccataaatcttttatcgaacactattttctctgtggatttgattcactctacaggtaaagcagaagagttcaaagacttggtgactaatatcacaaagctggttggatcaccaaacttggcagattttttcccagtgttgaagctgcttgatccacagagcgtcagaagacgacagagtaagaactcaaaaaaggtgttggacatgtttgacaacttggttagccaacggttgaagcagagggaggaagggaaagtccacaatgacatgttagatgccatgctcaacatttcaaaagaaaacaagtatatggacaagaatatgattgagcatctctcgcatgatatatttgttgcgggaacagatacaacagcatccacccttgaatgggcaatgactgaattagtccgccacccacatgtaatgtcaaaagcaaaacaagagcttgagcaaatcactagtaaaggtaatcctattgaggaaggggatattggtaaactcccatacttgcaagcaatagtaaaagagacattaaggttgtaccccccagttccatttttactaccacgaaaagctgatagggatgtggacataggtggctacaccatcccaaaagatgcaaaagtgctagttaatatgtggactatttgcagggatcccacattatgggataatccaactatgttttctccagacaggttcctaggatctgatattgatgtcaaaggacggaactttgagctagcaccatatggtgctgggcgcagaatatgccctggcttgtcattggccaataggatgttactgttgatgttaggttctcttatcaactcctttgattggaagcttggacatgacatagaaacacaagatatggacatggatgataaatttggaattaccttgcaaaaagctcagccccttcgaatt

SEQ ID NO: 107011 - DNA, 1650 bp, Glycine max
  Peptide Sequence Number=SeqID_223789
atggatattttgcttatccaaatcggttatctcctcaaccgatgcaaaatagcaaaatactcagctatctttttatttataccttttttcgtaaaaaatctcgggaaaagggttcgtgcgttcttcctccaaagccattcatggagttcgtggcactctctaacgctacccaacttgggagcttcaacccccttagaaccaaccttcaaagttcaacacaacaccctcttcctttttcttatgtttctttcccttcttcctctcgcagaggttgctcttgcaaagccatcctcagcactcacacacccacccacctctacccacaacatttttggacctcattccgctgattttgagctctctgctttgacggctctatccccattggatggtcgttattggggaaaagttaaggaactgtctccttttctgagagaatatggcttaatatgctttcggctgtctcagattcctgaaattgttgaggttcccagtttcagtgaaggtgctacaatatttttacaaggcttgattgatgactttagtgttgatgatgccttggaggttaagaacattgagagggtgcttgagtttttccactttgcttgcacatctgaggatataaataatcttgcacatgccttgatgctgaaggaaacaatgaattctgtcatggataaaataatcaaagctttgtgtgacatatctgaagataatgctcatgtcccgatgctttctcgcactcatggacagcttcaccaactactttgggaaaagaaatgcaatatttgctatgagattaagcagagaaaggaaggaactgtctcagttggaaattacaatgcacatgttgtttcatatcctgaagttaactggcctcacattgcagaacagtttgtacaatctcttggattaagttttaatccttatgttgctcagattgaaactcatgactacatggcaaagctttttcatttgctcatccagttcaataatatattgattgaatttgatagagatgtatggggctatatatctttgggttactttaaccagaccactaaggctggggaggttgggtcttcaactatgcctcacaaagtgaatcctattgattttgagaacagcgaaggtaatctaggtgtagctaatggagagggacttgacagattcaactgtcttaaggaacatgggtgtaggcatagggcattctcttcttgcctacaaaagcacacttcgagaaatagggaagcttcaggatgcatatacaaagttcctgtcactgactatttgcataacttcagagcaagtttcttaagttttctgttaaatctagagaaaatacagcaggttaatgaagctcgcttgagtgaagacttgaaccagtgctgggaggtgcttgctgaaccaatacagactgttatgcgaagatatggtgtttccgaaccttatgagaagttaaaagaactaaccagagggagagcagttacccaaaagagcataagagacttcattgaaggcttatatattccagaagaagcaaagatgaatctgttaaagttaacacctgatacttatgttggagcagcagttgaattggctagaacagtgaaaaatgtcgtgaatactgtgtatggaagaaagatctag

SEQ ID NO: 107012 - DNA, 312 bp, Glycine max
  Peptide Sequence Number=SeqID_223790
atggattcagattccacgaccactactaaaaattacttttttacgaagcacattctaagacggttatacgtaaccgtcttagaatgtcatgcggtgacagttttctcagtgccactcaaggaccacaaagttaagatcccaagcttccatggcttgaggtatgagaaggttgagaacataggcgaaggaacatacggtgtcgtttacaagggtcgcgattgcgtctccaacgaaaccaccgtgttgaagaagattcacaggggttgttatcctaacacaaatgttttagtgataaaagcattagacagttaa

SEQ ID NO: 107013 - DNA, 198 bp, Glycine max
  Peptide Sequence Number=SeqID_223791
atgaagactataagcattcttcttccgttaaataacgatacacatggtgaagtgactcagcggttgactagtgcaaaagagtcatcaagtaaacctgcattgcagagtcacgaggatcttgcaaagaaacttcagaatcgtgaacctaatgcagacttgctaagtgagagtgcttacagaattaaagctcttatttaa

SEQ ID NO: 107014 - DNA, 1110 bp, Glycine max
  Peptide Sequence Number=SeqID_223792
atggattatcgggcattgaatgcgatcaccattaaggattatttcccaatgcctacaatagatgaactgttggatgaaattggcaccgtgtcgtggttttcgaagctcgacctccggcagggcttccaccagattcaaatgcatgaagaagacatccccaagaccgcgtttcgtacccaccacggccattatgagtttaaggtcatgccatttggcttgacaaacaccccacccaccttccaagacaccatgaacgacgctctccggccgttcttacgcaaattcgcatcggtcttctttgacgatattctcgtctatagctcctctttttcgacacacatcgagcacctggaagctgtctttcatgctctgagtgatggttccttctaccttcgtcggacgaaatgctcctttgctgaacgtatcgccccagacccggagaaaatccaggtgatgcttgactggcctgttccatcttctccttccgaccttcgtggttttctgggtctcacaggcttttatcgaaaatttattcgcgcctgtgccgccactgcttcgcctttaatggcgctactgtgcaaagataagttccagtggaaccctgaagctcagtcagccttcgagcgcctgaaatctctcatgacgcaagctcctattcttgccccgccagacttcaccataccattttatcttgagactaacgcttctggcaccgccattggtgcaatattgctccaaaattcacgaccgatagctttcttcagcaagcacctgtgcccccgtatgcaacgagcttcgacatatgtccacgagctccatgcgatcatgtccgcagtgcgcaaatggcgccactatttacttggccaccatttttttatcctgactgaccaccagagcttgaaagagctcatgtctcagattctgcagagcccgacagatcatcccggaaactcaatcaagcaagacctgatattgttcaaaaacaaaataaggctcccacctggccatgatttctcacaggtcctgttggacgaattccaccgcactccgacaggcggccatatggggatagcaaagacactccgccgtatccagcaacaattctactag

SEQ ID NO: 107015 - DNA, 186 bp, Glycine max
  Peptide Sequence Number=SeqID_223793
atgactgatgtagtaaccttggttctgctctttgaagaaagcaatgatgttgaatatgggaacttctacatcagtggtgatgtaggcactgatgtagtaagttgcgctttctacatcgttttccaaaaagcaacgatgttgaatatgggaacttctacatcagtggtgacgtatgcactgatgtag

SEQ ID NO: 107016 - DNA, 739 bp, Glycine max
  Peptide Sequence Number=SeqID_223794
gttggaaacttggagacgagctctagaaacacatggctttcgcctaagcagaagcaaatcggagatgatggggaaattgaaggggatgtgaatcatcgcattcaagcaggatggatgaaatggagaaaagcatcgggggtgttatgtgatgcaaaggtaccgatcaagctaaagggaaagttttatcggactgcggtaagaccggcgattttgtacggaacagaatgttgggcggtcaagagccaacatgagaataaagtaggtgtagcggagatgaggatgttgcggtggatgtgtggtaagactcgacaggataaaattagaaacgaagctattagagagagggttggagtagcgcctattgtagagaagatggtggaaaatagacttagggagaaaataatgacaactccaaggaaagagaaaaagagagaggctcgaagagaagagaaggctgaaaaagcagctttgttagaaaagtctattgaaaaagagctattggaacgccttcaaaaaggagtttatcaacaaagtgatatatacaattatcctcttgaagagtacaataaagttcttgatatggagaaacttcaaattgctgatgaagaagaggatgaagaagaaccagaagtagaatatgtagaaggttatgatgaacttgaagaggaagaagacatggaggattttggtggttttgcaactcttaagtctcagggtgattatgacaatgatgaaaatg

SEQ ID NO: 107017 - DNA, 150 bp, Glycine max
  Peptide Sequence Number=SeqID_223795
atgggtgtcgtttggttgcggagtgagaaaactagaggcgccgctgtgaacgatgaaagggaagggcttactttcagagacgacggtggcctccgtgaaaaagcgttaaggataattcaaaaaggaaaaaaaattactatcaatacataa

SEQ ID NO: 107018 - DNA, 444 bp, Glycine max
  Peptide Sequence Number=SeqID_223796
atgcagcacgacgaggtcatatggcaagttatcaggcacaaccattgcagttacatggccaaaattgcgacggggaatttttgtagaaacccttacaacgtgactggggtttgtaaccgaagctcgtgccctttggctaatagtcgctatgccaccattcgcgacgacaatggagtgttttacctttacatgaaaactattgaaagagctcatatgccgaaagatttgtgggaaagagtaaagcttcctaggaattacgagaaggcacttgaaatcatagataaacatctggtactgtggatcatgattggttgtgtgcttgaactttctgcattggcagatgtattggcccaaacttcttatacacaagataaagcaacgtttgaccaaaatgacacagatgcggatacgtatgaggaaacttgctttgaagacaaggtttga

SEQ ID NO: 107019 - DNA, 705 bp, Glycine max
  Peptide Sequence Number=SeqID_223797
atgatgtttccttcttcaaaggaggaatctcgccctgtgaagtctcaaccttctcgcgcttcttcgcgagacaattccgtgtctccttcgccttctttctcatcggaatctcctgcgaagaacacagaggattcggtgaggaagaagggcttctacaagtcttgtcctccaccacctccgccaccgccaccaacaatgtttcagaaatcagtgttcatgaagccaaggttcggtggttcatccaacgaagcaccttgcttcaataaagagttgaagagaagcttcacaagtgagagaaccacaccagtgggaaagaaaagtgatgaagaaaataaatccatgcaacccacattgtttagaagtaacaagttcatagggcatgcaagcgtgcctcttgtgtcacagccagctgagaaagaaagccttcttgtggaatctgacgatgatgatgacgacgatgacacagaaatcgaggaccaagacgttgaaggaggaagaaccgttgctaagaacaatgacagtggaaagagtccacctgttattggtggagaaagttcaaaaacagatggtgatgaaggaccagatgtggataagaaggctgatgagttcattgctaagtttagagagcaaataaggcttcagagaattgagtcaatcaagaggagtacacgcagtgcaagaaacgcttcaagcttaaggttgtaa

SEQ ID NO: 107020 - DNA, 474 bp, Glycine max
  Peptide Sequence Number=SeqID_223798
atggctaaactaccccttcccctgctgctcctgcatttcgtcttgtcgatgaacagtgtcgccatgaatatttggttcggtgaacagttaggttctgtgaaggtgaaggcgttgcggtggtcggctgcggcatacgagatggacgaggatcagtggatgtatgaaggtataatgcatgaagaagtggatatggattatgaaaatgaagaagaatgtggtgtgaatgaaccacatgttgattgtttagatacgttcaatacttctcaggatgttctgcgatgggctcgatccgttgcttatgaaaatggatttgtggcggtgattgtaaggtctgacacaaacacaggagtagcgagtataggtgtaggaagaaagaattcgttagaagagacactgagactaggaaatgtgggtgtcccttcaagctttgtggcaagtcagtggttgggggacaaggctggacggcgaagttga

SEQ ID NO: 107021 - DNA, 1707 bp, Glycine max
  Peptide Sequence Number=SeqID_223799
atgaagcctacaacaagaatcacccttggggaactgctcaagatgaaagctgaggaaggtgtcaaggttcttatgcttgtttgggatgacagaacctctgtgccagatttcaagaaagatggcttgatggcaactcatgatcaagaaactgctgattacttcaaaaacacaaaggtgaaatgtgttttgtgtccacggaacccagatgatgggaaaagcatagtgcaaggttttgaaacttcaacaatgttcactcatcaccaaaagactatagttgttgacacccaagttgctatgggacaacaaggacaaaagagaacaatagtaagctttgtaggtggcattgatctttgtgatgggagatatgatactcaggaacatcctctattttcaactttggacacagtgcataaagatgatttccatcagccaaatttccctggtgcttccatcaagaaaggtggtccaagagagccatggcatgacattcattgcaagttagaagggtctgttgcttgggatgttttgtacaattttcaacaaaggtgggagaagcaggttggaaatcagctcctattctcttcaagcaagcttgatgagtactttgtccctcgatccacggtggtgacaacaaatgaaaatgagacatggaatgttcagttgttcagatccattgatggtggtgctgcttctggctttccccctgacccagaagaagcggctgagttaggccttgttagtggaaaagataacatcattgatagaagcattcaagatgcttatataagcgctattcggcgagccaaaaactttatctacattgaaaaccagtatttcctagggagttcatatggttggcaagcatctgatattgtggttgaggatattggtgctttgcatcttataccaaaggagctgtcattgaagattgttagcaagattgaagcaggggagaggttttcagtgtatgttgttataccaatgtggccagaaggcatacctgagagtggttcagttcaggcaatattagactggcaaaggagaacaatggagatgatgtatgctgatatagccaaagccattcagagaaaaagaattcaagccaatccaagggactacttgacctttttctgccttggaaaccgtgagggtaagaaggatatggaatatactcctactgaggcaccagagcctgatactgattatgctagagcacaaaaggctaggcgattcatgatctatgttcatgccaagatgatgatagttgatgatgaatacattataattggatctgccaacataaaccagagatcaatggatggagaaagagacactgagattgcaatgggtgcattccaaccacgtcatatagcatataatggggcacccagaggacaaatatatggatttaggcgtgcactatggtgtgagcaccttggggatcatggggatacaaacatcttcgacaatccagaaagtgtggactgcatcaggcttgtgaatcatcttgctgaaaccaattgggacatatactctaaggaaacttttgatgagtatagagaatttcaccacctcatgcgctaccccatagaagtaaccaacaatggagcaataacgatccttcaagggctagaacattttcctgacaccaaggctaagattttgggctcccaatcagtttaccttcgtccaattctcaccacctag

SEQ ID NO: 107022 - DNA, 769 bp, Glycine max
  Peptide Sequence Number=SeqID_223800
aggactacacgtcctcgccataagagaactatacatcctcacctttagaaggctacacgccctcaccttcagagggctgcacgccctcgccgtcagaggactacacgtccttgcctttagagggattcacgtcctcctcttcagaggactacacgccctcgccttcagaggactacacatcctcgccattagagggctgcacgccctcaccttcagaggactacacgtccttgccattagagggctgcacgccttcacctttagaggactacacgtccttgccatcagagggctgcacgccctcacctttagaggactacacgtcctcgccatcagagggctgcatgccctcaccttcagaggactatacgtcctcgccataagagggctgcacgctctcaccgtcggagggctacacgccctcgccttcagaggactacacgtcctcacctttagagggctacacgccctcgcctttagaggcctacacgtcctcgccttcagagggctgcacgccctcgcctttagaggactacacgtcctcctctttagaggactggacgtcctcacctttagagggctacacgccctccccttgagagaactacatgtcctcgccttcagaggcctgcacgctgtcgccttcagagacctgcacgccgtcgtcttcaaagggcgacacgtcctcgacttcgaagggctgcacgccccttcgcctttagagggctacgcgtcctcattttcagtgggctccatatccacaccttaa

SEQ ID NO: 107023 - DNA, 243 bp, Glycine max
  Peptide Sequence Number=SeqID_223801
atgccgatctccccctgcggaaggatcgtgcccacaagacacccagtggacccggagaagcccaacagggccttggggtttccagctctggttatgggcctctatcagtcctacagggtgcccatccccccagcaaggtcatgccatcgtgacatagggatcgcgcccgcaagacaccaagtggactcggagaagtccaacagggtcttggggtttctagctctgattactggcctctgttag

SEQ ID NO: 107024 - DNA, 306 bp, Glycine max
  Peptide Sequence Number=SeqID_223802
atgcggcgatacccaagtggttatccgtacaaacgatttcttttaatctggacccgtgaagtcaggtgggaggcgaagatacccaagtggttatctgcacacactcatttgctattcctcagactcagagtccggtcgtatgcagatactaacatcgtcatcttcaccttttgtcaaccagaggcaagcaagcccgttgacacgcagagcctaacgtcgtcttctgctcctttgtcatccagagacggcgagtccgttgacatgcggtggtggcaggcggagatacccgagtggttatccgtataa

SEQ ID NO: 107025 - DNA, 726 bp, Glycine max
  Peptide Sequence Number=SeqID_223803
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctggtttgttgggtgatttggaggggagggacgaatcaaagcgacaagggctgaatctcagtggatcgtggcagcaagggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 107026 - DNA, 1029 bp, Glycine max
  Peptide Sequence Number=SeqID_223804
atgagcaaacccgaacaagtttgggaccaaacttggcattggatggctgatgacattgtctataattataaaaaatcatcaacaagtccagaactcttcaaaatttggtcttgcttgaaattgaacaactgctgcaagcaaatcaaagatcgttttagagattatccttcaatgccatatccagaggatgcgaattgtccaacttatctagacaatagccttatattagctgaactgaactacaacaatgaagaacttagatcagagtttgaacatctattttctcagatgacagatgaacaagcttcaatttacaaccagattgttgaagctgttaataaagataaatgtgcctctagcggcatagcttctctgctattgcctggaggtagaactgcacattcaaaatttaaaattccagttctagtttttgaagactcaacttgcaatatccatcaaggaactcaatcagctgagctattaaatcagacaagtctaatcatttgggatgaagcacccatggctcacaaattctgttttgaggcacttgatcacagtcttagagatatcatcaaacacaactcaaaggacaataaaatctttggaggtaaagtcatggtctttggtggagatttccggcagatcctgccagtcattccaagagggagccgctctgatattgttaacgcaaccattaattcctcttatctatgggatcactgtcagatcttgagactgacaaaaaacatgcgtttacaaaacaacatgcaagcaacagatcaagaagaaactgcagcttttgcacaatggattatagatattggtgatggtattattggagatgaaaatgatggctatgctactattgaaattccacaagaactattaatcacagaatataatgatcctattcatagtataattagctctacattcccagatctatctcatcatcacaatgatcgtgaatacttccaaaccagagcaatattagcttctacaaatgaaacaatgcaacaagttaaatga

SEQ ID NO: 107027 - DNA, 560 bp, Glycine max
  Peptide Sequence Number=SeqID_223805
agggttacacacccttgcctttagagggctgcacgccctcgccttcagagggctacacttcctcgccttcaaagggctacacaccctcgccttttgaggattgcacttcctcgccttcaaaggactgtacgtctttgccttcagagggctacatgtccttgccttcagagtgctgcacgtcgtgcccttcagagggctacatctcatcgccttcagagggttgcacgccttcaccttcagaggactacgtgtccttgccttcagagggctacatgccctcgccttcagaggactacacgtcctctccttcagagggctacacgccctcgcctttagagggctacatgtcctcgccttcaggggactatacgtctttgcctttagagggcttcacgtcctcgcctacagagggctacacatcttccccttcagagggctgcacatcctcgccttccgaggactgcatgccctcccctttagtgggctacacgtcctcgcttttagagtgctccacatccacgcctttagggaactcaaggtcctcttctcttaatgcttaa

SEQ ID NO: 107028 - DNA, 156 bp, Glycine max
  Peptide Sequence Number=SeqID_223806
atgacgttgctacttagtaacattctgcccagtgaccgcagtgccgatctccccctgtggaagggtagcgcccacaagacacccagtggactcgaaggagcccaacagggccctagggtttctagctctgattacgggcctctatcagacctatag

SEQ ID NO: 107029 - DNA, 393 bp, Glycine max
  Peptide Sequence Number=SeqID_223807
atgagaccagtgggaaacaacagttctagctctagttcgagttcaagggtacttaggctgttcggggtcgacatggaatgccaacccgaacatgatgattctggtccctccacaccccaatgctcctacaatagtaacaacatgttgccatcaacacagggcacagatcattcccatcacaatttctaccaacagcaaccttctaattccaatccttcccctcatcacatgatggttattgagaatctttctttgtcttggtcaattcgggagatgcatgcaagtgcaatttggtttgtttatttttatggggtccttgaattgaatgatgttctcttcaaccccactcaccatcggtttaaggcgcgaatggcagaagggacattttcttga

SEQ ID NO: 107030 - DNA, 3468 bp, Glycine max
  Peptide Sequence Number=SeqID_223808
atgggaaaacattggtctttcttccatattacgggtacccttttccttttgtgcaaagtctgtctagctgggagtcaatattctggacgtgtcttacccggggtattaaatggttctcaaatgaattggattgacagagatggcaagttccttgtctcaaaaaaggttcagtttgcctttggctttgtcaccacaacgaatgacaccaccaagtttctacttgcaatcatccatgtggccactaccagggtaatttggaccgccaatagagcagttcctgttgctaactcggacaattttgtgtttgatgaaaagggcaacgctttcttacagaaagatggaaccttggtttggtcaacaagcacaagtaacaaaggggtttcttcaatggaattgcttgacacagggaatttggttttgcttggaattgataatagcacagtgatttggcaaagttttagccatccaacagatactttgttgccaactcaagagttcactgagggaatgaaactcatcagtgatcctagctcaaacaacttgacccatgttcttgagatcaagtctggtaatgttgttctcactgcaggttttcgaaccccgcagccttattggactatgcagaaggacaaccgcagagtcatcaacaagggcggtgatgcggtggcttcagcaaacattagtggaaattcatggaggttctatgacaaaagcaaatctttgttgtggcaattcattttctctgcagatcaaggcacaaatgcgacttggattgctgttttggggagtgatggcttcatcactttctcgaacctcaacgatggagggtcaaatgctgcttctccaacaacaataccccaagattcttgtgctacaccggaaccttgtgatgcatacaccatatgcacaggtgaccaaagaaggtgtagttgcccttctgttattcctagttgcaaacctggttttgattctccctgtggtggtgactcagaaaagtccattcagttggttaaagctgatgatgggcttgattactttgcgcttcaattccttcaacctttttcgaaaaccgatttggctggttgccaatcttcttgccgcggaaactgctcgtgccttgctttgttcttccacagaagttcaggggactgtttccttttggacagtgtaggtagctttcagaaacctgattctgattctggttatgtttcttacattaaggtctcgacagatggaggcgctggcacgggttctgggggcggcggaggtgtccataagcacaccatagttgttgtggtcattgtcataatagccttggttgtcatttgtggtctggtctttgggggagttagataccacagaagaaagcaaaggttgcctgagtctcctagagaaggttcagaagaggacaatttcttggagaatttgactggcatgccaatccgttacagctacaaggaccttgaggcggccactaataacttctctgtgaagcttgggcaagggggttttgggtcagtgtacaaaggagttctacccgatgggactcagttagcagtgaagaagttggaaggtattggacaagggaagaaagagttcagggctgaagttagcatcattggtagcattcatcatcttcatttggttaggcttaagggattctgtgctgatggaactcataggctccttgcttatgaatacctgtctaatggctccttggataaatggatattcaagaaaaacaaaggtgagtttcagttggattgggatactaggttcaatatagctctgggaacagcaaaaggacttgcttatctgcatgaagattgtgactcaaagattgttcattgtgacatcaagccggaaaacgtgcttctggatgaccacttcatggccaaggtttcggattttgggctggctaagctcatgaaccgagaacaaagccatgttttcacaacactgaggggcaccaggggatatcttgcaccggagtggataacaaactatgccatatcagagaaaagtgatgtctatagctatggtatggtgctactagagatcattgggggaaggaaaaactatgatcccagtaagtcttcagagaagtcccatttcccaacttatgcttataagatgatggaagaagggaagctgagagatatttttgactcggagttgaaaattgatgagaatgatgataggtttcaatgtgctataaaagttgcattgtggtgcatacaggaagacatgtcaatgaggccatctatgaccagagttgtccaaatgttggagggtatttgtattgttcctaacccaccaaccagttcttcgttgggttctcgcctttatgccactgtgttcaaatcctccagtgaaggggccacctcttctggtccctcagactgtaacagtgatgcttatctctccgcgcagagctactctggattgtgtgggctttgcatgcttccagctcttgtacattttgttcaagtagagataatgagattaggtgtgagtgtgagtgtgcggtgctcaatcggcaccgcttcaggcaacacccaaaccgattatcccgccaaattccaacggtcatctttctcaactgccaacttcctccccgacaacgcttcttcagtttcaatttcgagtagtagcagcaggagagggctaatacgcatagccacgttgccatgtcttcttcccctcataggttgcctcccagccaacgccatgcagccaggttcaaaggaatatcttctcattaaagaagaggtgaggaaggtcttgtccaagggaaaggctgctggcgtgcttcgattggtattccatgatgccggaacctttgacatcgatgacagtacaggtggtatgaatggttctatagtctatgaacttgaaagacctgaaaatgctggcctgaaaaaatcagtaaaggcatgctctgtctcacttttttctcattccccttctaccacttctatttctattactatttggagaattccacatgatagtgaggttctgcaaaaagcaaagactcagatagatgctatccaaccagtatcttgggcggacatgattgctgtggctggagctgaagcagttgaagtatgtggaggtccacctattcaagtttcactgggcagattagatacactggtgcctgatccagaagggagacttcctgaggaatctctcaatgcttctggtttgaagaaatgtttccagagcaaaggcttttcaacacaagaacttgtggctttgtctggagcccacactattggaagtaaaggttttggaagcccaatttcttttgacaattcatattataaggttcttttggagaagccgtggacgtcttcaggtggtatgccgagtatgattgggcttccttcagatcacgctcttgttgaggatgatgaatgcttaaggttctttatctttgacaacctcttatgctactcttaa

SEQ ID NO: 107031 - DNA, 324 bp, Glycine max
  Peptide Sequence Number=SeqID_223809
atgaagaatcctgaaatcacacgtaagaaaatggataggggcatgagcagattgaaaatgaaggagtatattaattgtgaaacggaggggttgatacggttagtttgtggttgtggagatgagaagggaagagagaagcagttgtgggaaaagtcaacaaagacaactgggcaaagtactcttcatttgaccacgagtctatctgcgtggcacgtgaaaggagatcaaagatgcaaaaggaaagaggtggaagaagaagcgcgttctaactcaggtcttggagccgtgaaacgcattaagggaggtatcttcctccttttttaa

SEQ ID NO: 107032 - DNA, 1428 bp, Glycine max
  Peptide Sequence Number=SeqID_223810
atggatccaagcaaccttttgccagctgatggacttgaagaagtccaccaaaatggtgttcatgatgaactgtctatttttggaaaggatggtattgcttccaatgtagaccctggtgttaccaaaattatagaaactgcagctacaaatggaaatcttgaaaatttcatccagtatgatagcactgcaactgattattcgtccaaggaagaaatcaaggaaggatcaaacgataatatatatatgaacaatgtcaccatttctaaggaagaggaagcagaaatcatagatcggacagagcaattaaaagtaggaaaaggtcctgcaaagaataagaatgcaaagccaccaagccccagaggcagtcatgcaagttcagttaaaaagaacaaagatggaaaagatgaagaggtagcatcttctgtttcaaatggtacttttgcttcagactctcacccaagacagcctattaaaaacagatcattgagtgacaagcaggctcgattgtccaagcaccctggaaagtctaacgcagcacattctgaagaatcaatggagaagactagaccacaattatcgaagaaagatccccatgataatcttcaaggagaagcagaatcttcttcgtatccttttttttcctggttgagcattgtttatggtgttgtaagtcctactgcagaagatgccaaacctcgcagggtgggggcgctcccaaaatatggattcagtttcaagtgtgatgagcgagctgagagaagaaaagagttctacactaagcttgaggaaaagattcacgcaaaggaagtggaggagagtaacttgcaagcaaaaaccaaggagaaccaagaagccgagattaagatgcttagaaaaagtctaggatttaaagcaactccaatgccaagcttctaccaggagcctcctcctcctagggcggagttaagaaagatgccaactaccagagctaaatctcccaagcttggtcgcaagaagagttcaataaattcagagccagaaggaaacactagcaacagtgctcgacaaggtcgtttaagtctggatgagaaaatgtctcagactaaccccactaatggcattagtcctgttcatccaaagaagccacaacgaaagtctcttcctccacgactggcttctgaaaagatcagttcatccaattcagcgtctgtgagaacctcatctaaggcagtgaatggtggcaaaacctccttatcaagtgtaacggctgaagttaccttatccaatgcaagagggaaagagaaagttcaaatagctgcagcagccactgaagagaacaatgccttattgaatgagacaagtaaagttcttcctgtgaatggtgatttagtcgttgaagagaaaccacagctcaacttggcacaagaacccatagcagcggagcactaa

SEQ ID NO: 107033 - DNA, 414 bp, Glycine max
  Peptide Sequence Number=SeqID_223811
atgccagattcagattttaaggagatgaaatcacttcagaaagcaattaacaattgtagattaagtgatggcagccatggttgggcacccagtggctggcagatcactagccctattaaaaaggttcaaaatcacaaaggatatacattgtctaatactccagtggacagaggtttggggaagagaagaatccattggaatgaatttagagataaggttttaggattggatgaggcgcaacgaaagggttttaaagtctctctctcttacgctatggggagaagctttagaaaacctaatttgaggaagaagaagcaagtaaaggaaaaacaagaggcatgcggggagggggggctaccccaaaaggggcccacaaaatcaattcacaaggatttcctaatgtgggcccactga

SEQ ID NO: 107034 - DNA, 1596 bp, Glycine max
  Peptide Sequence Number=SeqID_223812
atgaacgcactaagcgcgcctgctgtgcttagccagttcattgcatatgatgaatattttgatttgcagatgatcgcgctaagcccgaccctgaagatcttgcttgagagaaatgtcatgatttaccatacagaatttgatgaattcaagactgagcttgagagaaggaattggcacaaggagctaatcaatttcatggatgggagcatcgatgttgccattgctaaggagttctatgctaacctttatgatcctaaggataaatcacctaagcaggcgagggtgagaggccacttaattaagtttgatgaagacaccctcaacacctttctgaagacccccgtgatcataaaggaaatggagaacctacctgcttactccaaattttgttgtttgaggccaaatccacaggaactggcatcccgactatacatccctgggaggggatttgagcttaatgctgatgggctgccattgaagatcttgtggaagaatctgaccacgctcgctcagacatggagcgttttatcattctccaacctagcccctacttctcacacgtctaacatcacactagacagggccaggctgggtttccctgccctcatcactactttatgcaaagcccggggagtcacttttgattcattgacttttgagagtctcagtccagccattaatttggcttatgtgaagaaaaactgttggaaccttgatgacctctcggctccaccatcttctgctctccctaccccagctccttctacttctactgcagctccatctgctcttgtttcatctttaccagctccagtttcagctccttcgacttctatagcagctcattctaccccaactttatccactcctttgccagttcctgctccatgcttacaaagctcaggcctgcaacctatcatgaacgtggataagttcattagccgggtggcttggccaggagtccggccttctccttcgggagggggtgaggcctccgcaacccaagaacctatgccagaggaggatgagcccatccctcctgagccatttgtttatgagactgatgcatctagtgctcaggaggaggtagcatcaccagagcccgttcctcagtcatctctagctacagttcttgatgatatgccagagccatctacaccaacatcagtgcctgaccagtctatttctcaggacccactatctgcaccgtcattagaagagaaagagcatgaaactaggattatgactgaaaatgttagtcggtttgccagattgattgtgaaggaatgcgttaaccgtaacccgatggttgtcatcatcaaaaagggggagaatgtgaatcatgtaggttttgatgatgccaaaagtgtttatttgatgatgtcgcaacatgcccttttgcgggcgagcgaggcgtggctcacgggtgcgctttccaaaggaggaaagatgcgcggagtcgccaccaacgaaggtattagcacctctcacgtcgacaaaagcggggctcttgctcctacgtaccctctatcgaagaggaaatcagacctacgtagttctttcttatacgtgaatcaagtgattctttttacttga

SEQ ID NO: 107035 - DNA, 294 bp, Glycine max
  Peptide Sequence Number=SeqID_223813
atgatccagactctagaagaaagtctgagcttggccattaagactagcgaaactttcactgttgaaaaactaagggaagaagtagcatgtcttactaaagactttgggaagttcttggaaaattcaaagactgtcaccattcttctgaaattccatcaacatcctcatgacaagtctggcctaggctttgaaaatggaacatcatcctccaagtcacagtctgtctcaaacaaatatggcttctatggtcagaatgcagaagaaacaacaattaaattaatcaatgttctttaa

SEQ ID NO: 107036 - DNA, 1869 bp, Glycine max
  Peptide Sequence Number=SeqID_223814
atgtcgccgatgaagttctgggttacgcagcccaacaaacaacacgccgtgaagctgacccaattgaagctcgaattaggcctcttcggagccaggctcggcgccgcaaacgacaaggtcgcatttgaaataacagggattgcaaccaagaaagaaaaatcaaagccaaaaacgacacctctcccactcgttcccttctcaaaacgacgacacactcactgtcacaccacatgctcccgtagattcctcagttccaaatcaccctctctcgtatgggacgcacgcgacctctgcggttttcatctcctcctcaaagaccactccctcgatgtttgcgacatcgcatttcatgtcttatatggagagggagaatcgaaagcgaaaatgacggcggtcggaaaagtcgaaatgagcgttgcggttgcggagttgattgtgagagaggagaagaagacgcagtccaattctcatcatcaatttcaaagaaggcttccaatcaagttgagggtcaatggtttatgcatagaagctacccttttggtctctctgagattattgaagttgagggattctaatggtggtgactcatcaggaccctctgaaaacttggtccagtcagagccagagaagaaacgcggtattatagagaaagtgaagcatttgactagcttgggaaagaaaaacaatgccaagttagatgaattggaacaaacgagtccttatgactcggatagatcccccgtgtttgactcggatgactcgtacgattccaccacaagcagtggcagcagtagcaacagcggtggaattcacaacccacggtcaacactctcaaacgggtctgagaggtttacaacctcggacacagcaaagactcgtttgtcccacttgccacggaatataagcctcaatggttggaactataagacacccacaaacgaacaacgaactcaaacctcgtatcctggtccaatcacgaaatcagataaactttctccacaattatgccataaaggcagtgcaagaagctgggaatacaaggacttttcaagtagagatggacaaacaaagctgaaaaccaatgtgttttttgcttcctttgaccaaatgagtgaacgagcctctggtgagagtgcgtgcacggttttagttgcactcatagcacactggctccacaccaaccatggcatgccaacaagagcacaattcgaaagactcatcacacaaggttcatctgaatggagaaagctatgcaacggtgattactactcaaagctcttcccggataagcattttgatctagagacaatcatagaagccaatctgagacctcttgttgttctccctcagaaatcatacacaggttttttctcccctgagaagttccaatgcttgaaaggagccatgtcctttgatgaaatttgggacgagataaagagcaatgtgggtgataaggagccaagagtttacatagtgagttggaacgatcatttctttgtgttgaaggtagaagcagatgcttactacatcattgactcattgggggagagactttatgaggggtgtcaacaagcattcatactcaagtttgatgatttgagtgtgatgtatgggaaaacagacaaagcaaaagaggttccaattaatcgtgcaagaagtggggaaagccgtgagaaaatttgccgcggaaaagagtgttgtaaagagttcatcaaacggtttctagctgctataccactttggcaactagagaaggaggagaagaaatggagtgtttccagtccctatcttcaccggcaattgcagattgatttccattatagctcttcatcatcatcatctgcttcagctgattctttgtggtcttaa

SEQ ID NO: 107037 - DNA, 141 bp, Glycine max
  Peptide Sequence Number=SeqID_223815
atggatcttaaaacacttttggagagaacaaatgatgctattgatacaataattcgacgtgatgagcacacagaaactggagagtatttgtgcccttgcatcgaagcactgactggtggatgtgcactttgtagtcggtag

SEQ ID NO: 107038 - DNA, 147 bp, Glycine max
  Peptide Sequence Number=SeqID_223816
atgaggtttgctgatgagttcatgttcatgttgagtgatggactacttgagattgtggggatcttgttcatgactaccaaaactattaagcgataccatcgtagctcttttactcctcaagaggaacacgttgaatgtgaaactcag

SEQ ID NO: 107039 - DNA, 177 bp, Glycine max
  Peptide Sequence Number=SeqID_223817
atggcggtgaccggtggcgcatttgtcatcggcggtttgctcttcggcgtaggagcttatttctcgtttgttaacgtggctcctggacaagagcgccttaagtctcctaatggtggggttcaagaaaaccaaggaaatttagtagtaagagtatcaggatcttcacgaattttgtga

SEQ ID NO: 107040 - DNA, 973 bp, Glycine max
  Peptide Sequence Number=SeqID_223818
ggcaagtgactactccagacccagtgactattcaagatggggttcatctgatgatgacaatggccttggagactcgccaagcacagtctcaccactgtcttatggtggacctgcctctactgaagatggatatggaatgccagggcgttccaggtactgccttcttgcaagtaagcaaatggtaggaatatttctaaccatatgggtgagaagtgaattgaaagatcatgtgcgaaacatgaaagtatcctgtgttggcagaggattgatgggctatcttggaaataagggatccatctcaattagcatgtctctacatgaaacaagcttttgcttcatttgtagccacttaacctcaggacaaaaggagggtgatgaattaagaagaaattctgatgtgatggagattcttaagaagacaaggtttctacgtgtacatgatgctgacaatgagaagtctcccgagacaatcctcgagcatgagtatgaatttacttgcatacatcttagtataactaatactcttaacattcgaattatatggcttggagacttgaattatcggattgccctctcctaccgttttgctaaggcacttgttgagatgcaaaactggagagcattgttggagaatgaccatttgagaatagagcagaagagaggccgtgcatttgtgggatggaatgaagggaaggtttatttccctccaacatacaagtattcaactaattcagataggtatgcaggagatgatatgcacccaaaggagaaaaggcgaacacctgcttgcgatgtagaaagtgcggtttcaacatcggtgctgacatcagcatcgatgttgaaatactaccatacaaagacgttcctctatttccagcgatgtagaaagcgtggtttcaacatcggtgctgatgccagcaccgatgttgaaatgctaactttcaaagacgttcttggaaatgcagcgatgtag

SEQ ID NO: 107041 - DNA, 684 bp, Glycine max
  Peptide Sequence Number=SeqID_223819
atggaacttgagtcgggtcttgctctccccactcacaattccgttgaggaattcaagcttaacaagtcgaaacagatagtgagtttagagttatggagacccagttgcggttcagatagcgaaaagcgtgtcaaacacaataagcgcagcttcgaagagtcctttggacaatttttgaaaccttttcctttactagtatggagtggacagccaaatgaagaagaagaccgtaatgaaaaggtgcaaagaaacattcacacaccaaacaagaacggtgatgaagaaaaccatttggtggggtggccaccagttaaatcatggaggaggaaagagctccatcggcagcagtatcctgcgagaggccaaattaggaacgataggattcaagctaatgagaatcaaagtagaagaccaaactctttatatgtaaaggttaacatggaaggggtagccataggaaggaaaatcaatttgaggcttttcaattcttatcagacacttacaagcagcttgatcagcatgtttgctaaataccaaaaatttgaggaagttggagaaagttacacactcaactttcaaaacgaacaaggggattggctgcaagtaggacatgttccatggcaatccttcattggtactgtgcggcgtttggtgatactgaggaatggaagtgaaactatttga

SEQ ID NO: 107042 - DNA, 156 bp, Glycine max
  Peptide Sequence Number=SeqID_223820
atgacagacggtttacctgtgttcactccccattttgacaaccatattgttaatgctgaaaaggtaagaaaagggaaaatggccagattaaaaacccagcaacttactaatatatctaactccaccctaagggaaccacttcccgagtacctatag

SEQ ID NO: 107043 - DNA, 132 bp, Glycine max
  Peptide Sequence Number=SeqID_223821
atgtcactctcgaatcttgatggtggaaagatatgcaaagcaaagcgtggcaaggttctgttctctagtttaatggatggcccacttcaaggaagcgatatgcatcaacgcactatgactttagtaacatga

SEQ ID NO: 107044 - DNA, 1926 bp, Glycine max
  Peptide Sequence Number=SeqID_223822
atggctccgacgacgatccggaaggcgattggggtggtgaaggaccagaccagcataggaatagccaaggtcgcaagcaacatggcgccggagatggaggtcgcgattgtgaaggcgacgagccacgatgacgaccctgccagcgacaagtacataagggagatcttgaacctcatgtctcactctcgcggctacgtccacgcgtgtgtcaccgccgtgtccaagcggttgggtaagacgcgcgactggattgtggccctcaaggcgctgatgctcgtgcacaggctcatgaacgatggtccgccgctcttccaggaggagatcctctacgccacccgcaggggaaccaggctcctcaacatgtctgatttcagagacgaggctcactctagctcctgggatcactccgcttttgtcaggacctatgctttgtatctcgatcagaggcttgaattgatgctgttcgatagaaaaggcacagtctccgccgccaatggtggcggtgatgataggtttggcggaagagacaatttccagtcaccgccgtatgagtacggcggtggtgaatttagaggggaaggcgcttatgggaatgggatgaggaagacaagatcgtatggggacatgagtgaatcggtggggagaggggaagaaaagagggttgtgagtgtgactccgttgagggatatgacgccggagagggtattcgggaagatgggtcatttgcagaggctgttggatcggtttttggcttgtaggcctactgggttggctaagaatagtaggatggttttgattgcgttgtatcctgttgtcaaggagagttttcagttgtatgctgatatatgtgaggttttggctgtgttgcttgacaagttctttgatatggagtatgctgattgtgtgaaggcttttgatgcttacgccagtgcagcaaagcagattgatgagctggttgctttttacaattggtgtaaggatactggtgtggcgaggtcctcagagtatcctgaggttcagaagattaccagcaagttgcttgagacgttggaggaatttgtgagggatagggccaagaggccaaagagtcccgagagaaaagaggaggctccaccagtggagaaggtagaggaggagccagcaccagatatgaatgaaatcaaggcactgcctccgccggagaattatactccgcctcctccgcctgagccggagcccaagccacagccacaggttacggaggatttggtgaatctgagagacgacgcagtcactgcagatgatcagggaaataaatttgctttagcactctttgctggtgcacctgctaataatgcaaatggatcatgggaagccttcccgtcaaatggacagccagaagtgacttcagcctggcaaaccccggcagcagagcctgggaaagctgattgggaattggcattggtagagactgctagcaatttgtcaaagcagaaggcagctttaggtggtgggttggatcctctattgttgactggtatgtatgatcaaggaatggtgaggcagcatgtcagcactacccaactgagtggtgggagtgcaagcagtgtggcattgccgggaccagggaagactccggttttggctctccccgccccagatggatctgtgcagccggttaatcaggatccatttgctgcatcgctgagtgttccaccaccatcctatgtgcaaatggctgatatggagaagaagcagcacttgcttgtgcaggagcagcaggtgtggcatcagtatgcaagggatgggatgcaaggtcaatctagcttggccaaactgaatggcgctggatactatgccggaggtcctatgcccatgatgccttatgggatgcccccagttaatggaatgggacctccaaccgggtattatcacactccttactga

SEQ ID NO: 107045 - DNA, 1497 bp, Glycine max
  Peptide Sequence Number=SeqID_223823
atgaagatcttcattatctttagtatcaccttcacatgtggtatttttggaaatgttaattcaaatgtcaatcctctcccgtatgaagctattttcaattttggtgactctataagtgatacaggaaatgctgctgcctatcaccatgttcccaaggatggtaaaagcccttacggctcaacatacttcaaacatccatcgggacctgaggcatatgggttgccaatgttgcccgcctatctagatctcaccaaaggtcaagacattaggcatggagtaaattttgcatttgctggtgctggtgcacttgatatgaactatttcacaaacaatagactcaaggcaccagcaacaaataattcattaagtgttcaacttgattggtttaagaagctcaaaccttccctgtgcaaaaataaaaaagagtgcaataactacttcaaaaaatcattgtttatagtaggagaaattggtggaaatgatattaatgcgcctatctcgtataacaatatttctaaacttcgtgaaatagttcccccaatgattgaagaaattaccaaggccaccattgcattaatagaagaaggagctgtagaggtagtggtgccaggaaactttccaattgggtgtaattctggtgtcttgacagtggtgaatagtggcaacaaagatgactatgatcaatttgggtgcttagcagcttacaatgttttcattaaatattataattggcggcttaatcaagccatagaggcactaagacaacaaaaaaaccatgttaagataatatattttgattattatggtgatgccagacgtttatttcaagcaccacaaaaatatggcttttcatctagtaagaatgagactttcagagcatgttgtggaacaggcgagccttacaatgttgatgaacatgcaccttgcggaagtttgacttcaacaatttgctctgatccttcaaaacatataaattgggatggagctcactttactgaagaagcttataaactaatagcaaaggggctagttgaggcgttatcttcttccttcgttgttggttggtatgtgtcgcgttgccactgttcggtgcttccattgccagattttaggaccaccatgtcgtttccaccgtcgagttacttgaaatcagtggagatgaagctagagctgagacaatacattgtcatggggcatatgtacgcctatcatggctacgagagatttatcatagcaaatgtgagagacctcagtcaaagtagaaactacgcatggggagctgccgccctagtgtatatgtatggtaatttgaatgatgcttgtaagagcgatgtgttggattatgaatattttccatatattgttgaggcttttacggatcaagactatgatgaaaggtcaccacgtgcatgccactggacctctatgaaggcctctacaaaggcattaccagcatcgacatatcggaagcgtctaaatcaactgaagactgttgat

SEQ ID NO: 107046 - DNA, 132 bp, Glycine max
  Peptide Sequence Number=SeqID_223824
atgaggccgatgtactaccgaattgcgactgtgattgacttctacatctgtcgcaacctaccctttgacgggagggtgatgggaggctcacagagcggggctcttgctcttacgtatcctcaattgcgatga

SEQ ID NO: 107047 - DNA, 174 bp, Glycine max
  Peptide Sequence Number=SeqID_223825
atggaaaatacctgcgaggtgaaggatcgaaaggaaggttacaaggtaggggaaggggttagggttacggttctgcaaagtaaattgttagatgaaaaaccaatttggggaaaagaaactgagagagcgaaacctccacgggatgagcgagtagcagtccctttcttattatag

SEQ ID NO: 107048 - DNA, 396 bp, Glycine max
  Peptide Sequence Number=SeqID_223826
atgacgttgctgcttagcaacattctccccagcaaccataacttggacctccccctactgaagtgtcaattggtttacgccatcctgactcaggtgagtgtccacgtcgcccagctaatctttgatgctatttaccaggccttcatccggaaatactacatgccagaggaggaccagcaacagcctattgcagatgcaccaccaccgcctctaggggagagtcaggaccccaatcctttgccttggcctacccccgagcagttcgaggccacggtggcctggcctggggacgagaccgattttgagacacgagcaggacctgcaggagctccgggggatgacgaaggagctcaggaggatgatgacatggctgacgtgttggacttcttcacttga

SEQ ID NO: 107049 - DNA, 805 bp, Glycine max
  Peptide Sequence Number=SeqID_223827
atgatggaaaaccgcaataaagaatatgctgctcggtttgagaccttagaaacaacactggagatgacactcaaggataaaactagagatcctgggagtatatcactggctatgaacaatcacccttttaaggttgtgccctggtaccaaatgatgactcgtgaaaattcattcaaaacatggattgcttttatgcgagccttagagacagaatttggcccatcaccgtgtgaatgtcctagatctcagttgtttaaactcactcaaattggttcagttcagtcatattacgtgcagttcacggctttagctaatcgagtacaaggaattacacaagaagctctattggattgctttgtgggaggattaaaacctaatatcagaatggatgtcattgcgcaatcacctacatcactcctcagaacagtttcgttggccaaactctatgaagagaaatatacacctaaactcaaacctttttcttcgagtttttcttccaaaacacaaacctcaaacacaaactcaaacctaaacacaaaccaaaacagccctcaatccctaaaatccacaagcttacccccactattacccacaccatacaccaaacctatcaatgttaagaaaatgacatcggcagaaatgcagttgagaagggaaaggggcctaagctttacttgtgatgacaagttttcccctagccatcgttgtcctaataagcaacattttgttctacagtgggaagaagaggatgatcctgcattacaaccagatccactagacgaggttgagacagttggtgacccca

SEQ ID NO: 107050 - DNA, 141 bp, Glycine max
  Peptide Sequence Number=SeqID_223828
atgaggcttctcaggaattctagggatgcagcctcagttgaacagtttaaacactgccaagaaaagttagggacacttcttcttcaagaggagtgtttctggttaagggatggggatttcaacactcgctatttctacgcg

SEQ ID NO: 107051 - DNA, 639 bp, Glycine max
  Peptide Sequence Number=SeqID_223829
atgattttgttcttagcagatgttgaagttgcaaatgcagcaactgttgcagaacttaagcaggcggtggaggcagttttctctcacgtgcctcagaagggcccggggaaaatattatggccacttgtttggcggcaattttgcttatgctatcaaggacagaaattagtatcagaaatggattatattagagattatggcatcaaggatggtgaccaacttcattttgtgtaccatgtatctgacacttgcagtttcgagagaaagcagtccaagaaacgagttgtcaatttgaaacagcacatgaggtcatcatcaaaagtgaatagatatcaacagaaagaacataacgatgacaaagacattgatttggatgatatagtcatagagaatgcgaggatccagcattgcaataatgcagaagaaaatggaggaggaaagcgaagcttagctggcattttagcagggttgttctcacacagtcggttggcagttgtgagcagagctagaattgagagcaggatttgctgctcaatgatggctagatttatagtgagcagttttaggaaaattagaagaattttacgctattgcaggaggcagcattactctcggagacccacatgggcagaatattga

SEQ ID NO: 107052 - DNA, 407 bp, Glycine max
  Peptide Sequence Number=SeqID_223830
atgacttcccttggcaagatcgagtctaccgccatgctcctccactccctcacctacctcccccgcgcctcccaatgccacctttgttccaaccacctcatcctctgccttgggcttgttgattgcatcatcaactttgccctcgccattgacctcggcttttgccttgtccacatcgacactccacatgccaaggagatcgtgaacactgtcatggcaatgataaggaggggtggcaatggaaggacgaagaagatgaactggcatggatggtggtggaaggacgaagaagatgaactgggtgaggcaatggggccacgggtgacggcgggaacattattggtagtgatggcagcagcgatcgcgatggagagcgacgacgacgttggacaaggcaagggaagtag

SEQ ID NO: 107053 - DNA, 1836 bp, Glycine max
  Peptide Sequence Number=SeqID_223831
atggcacaagatactgctactccaccagttccttttgatttcgaactcttggttggtgatcaccttagaactgtctcagcctcatccagcagcagcagggcagacccatggattgaacctgaaaggttgaaactcagacacaggattggtcggggaccctttggtgatgtttggttagcaactcatcatcaatcaactgaagattatgatgagtatcatgaagtagctgccaagatgttacctccaatcagagaggaacatatgaaaactgcattagagaaattttgtgaattatatttccggtgccaaggagtgggtaggatatgcatcattatgaatttttatgagggttcagtcggtgacaagatggctagactcagagagggaaggatttcattgcctggcgttctgaggtatggtatcgatctggctgaaggtattctggaacttcactcaaaagggatcctagttctcaaccttaaaccatcgaatgtgcttcttgatgatactgatcaagcaatactgggagatattggtattccaaatcttctgtttggttcctcattcctaagctcagatatggctaacaggattggtactccaaactacatggctccagaacaatggcagccagaagtcagaggccctatatcctttgaaacagattcatggggatttgggtgcactattgtggaaatgttgactggtaatcaacctttgtatgggtctcctgttggtgaaatctaccaatcggttgttgaaaagtatgaaaaaccccagattcctagtggccttccttcttcagttgaaaatatcctcagtggttgctttgaatatgatttgaggaatcgcccttctgtggtagatattctggccgtctttagaagcttactgaatgcagtagccaatgatggaggatggatatatcttggaactaaaactatagcaaaatcaagtagcactggctacactcagtggtccctctcaaaggatcatcttcaggtgggtgatacagtgcgctctagaaagccttccaattcatgcaatcctcaaaacatggaggtcccgcaaggaaatgttgttggtttagaacgtaatgcagatcatggatttgttttagtgaggctccatggtgttcacgaccctgtaaggattcatgcatcaactcttgaacgtgtcaccaatggtttgggagctggggattgggtacacttgaaggaagaagatgagaagcactcgccagtgggtattcttcattctatcaatcgtgatggcagagtaactgttgggtttatcggtctgcaaactctttggaacggtaactcttcagaacttgaaatggcagaaccttattgcgtgggccagtttattaggctgaaaaccaatgttttgagtcctcgatttgaatggccacgtaaaagggaaggtgcctgggctactggtaagatttcttggatcctaccaaatggatgtctagttgtcaagtttccaggcatgttgaactttttggatgcaccaagcaccgtcttggctgatccctccgaggttgatgtcgttaattttaagaattgtccaaagatgatagagaagtatcaacatgtagaggatcaccactgggcagttagacctgtgctacttgcatttggccttcttactgctgtgaaactaggaatgtcaattggaaagaagtttgggaggaacattaatgttactgcaatggagagtgaaagtcattatacagatagccagaatgctagcactagcagccctacatggacatcttcagtagctagcatccttttcagagaaggtgttaacttgcccaatggtcactag

SEQ ID NO: 107054 - DNA, 378 bp, Glycine max
  Peptide Sequence Number=SeqID_223832
atgggaagggtgaggttgaagtcaaagagtgctgctttctcaatttcttctgcgagggagggtctggccaagaccagtggtgctatccctccaaggagggacagcatctggggctttgaaatcgggagtttcagtttcaaggttggggctttggggagtgaaatttggagaatggggactttgggtgtgggggaacgggaactggtgcagactggaaccagaggtttggtggaagccacaatcattctgagagggttggatttgagagcaaggctatctaaattctttgccacacaaattgatgaggttgtgttgtgttgtgtaatgttgagaccccaattgcagcaactaagtaacatcaaagcatgccatggatga

SEQ ID NO: 107055 - DNA, 807 bp, Glycine max
  Peptide Sequence Number=SeqID_223833
caggaagtccaggcggcggccgaccggctcgcgctgcttgagcacgcgtcggatctcgacgatgtggctgccgaggcggtccagctcctcatccacgtccagcttctgcagccacagcaccagctcctgttcggcacgaccagggtcgaccgggtgcggcaggtcagccaggcgggcggccagcttggcgcgctggccgtcgcgaatggccggaatcaaggtgcgcacttcggtggcaatgcgttcgatgccgtccacgcgctcactgatggccgccgacaacttgccgccttcgcgttcacgcgcctcgacgaagccgtccagtacctggtcgagcagggccagcgcctcgacctgcagggcggcggcatcggtggcctcgccacgggtcacgccgggcagctgcagcagctcggtgaaactgacctgcagattggggaaatcggaggtcaggcggtgcgccaagcggcccagctggcccagcagggcctcgtccacctgcaggttggcggcggcttccggcgcacgcaggcgcatcaccagatccagcttgccgcggctcaggcgcgcggcgatgcgctcgcgcagctgcggttcgagcgcccgcagttcctcgggcaggcgggtgccgacctccaggaagcggtggttgaccgagcgcagctcgcagcccagcgtgccccacggggtgacccgctcgccgccggcataggcggtcatgcttcgaatcatggattgtgtccggtgcgtgcaaagggggaatggtaccctagcgccctcatcagagcccccttgcccgccccgtga

SEQ ID NO: 107056 - DNA, 441 bp, Glycine max
  Peptide Sequence Number=SeqID_223834
atgacacttcaacacacccaaattaaagcatcttttgagacaagtacgaacgtggttggtcatgtgtttaaagttaccttgtacaaaaaactacttggcatggtatcaagacaaaaacccttcacgttgtggatgagtcatgaggactacccacggtcttccatgtatcaagggttatgtgaggctgaggtgaccataactgaggaaatggaaaccatgtctgtcgcaacctacccttttgcgggcgagcgaggcgaggctcacgggtgcgtcttccaaaggaggaaaatgcgcagagtcgccaccaacgttatttgtgaaaaacgttggaaaaatcgaagggaaccgatcatgaagaatattccagattcgggagttgtatttacgtttgaggaaggtattagcacctctcacgtttgtcccaaaggacaactgccttaa

SEQ ID NO: 107057 - DNA, 780 bp, Glycine max
  Peptide Sequence Number=SeqID_223835
atggaaccagggctccaatccatgccgagaggcagcggcgaagtcccatcgtgcctgtgcttcggaggacttcgtctctgcatcgtcgtcgtcacaaaccgccgaggactagggtttccgcgatcggatcggagaaggtggaatctgtggcgtggtgggtacggcggaggggcgcacgttaagagtagaagcggcaacgtggctaagaaaagccgcgagtgcacactaaggatcacgctgagcgtgacaggtacgttcaagtttattccaagcacattggccttaattgcggtgcataggcaaagtgcagcttccaaatctgccaaacccttaaccaatgcacagcattcgctcgaaggaggagttccaacagtaacgttaacaagtcctaagatgtcagcacaaacacctagctttaatgtgtccttggggcatgaagctttgggtggcgaaggaggagaaggtggaggacaaccagccttgggtgtgggtggtgtgggtggtgtgggtgtgggtgtgggtgtgggtggtgttggttttggagttggtggtgtgggtggtgtgggcttcggaggagaaggtggaggacaaccagccttgggtgtgggtggtgtgggtgtgggtgtgggtggtgtgggctttggagtgggtggtgttggttttggagttggtggcgtgggctttggagtgggaggtgttggttttggagttggtggtgtgggtggtgtgggcttcggagatggagatggagttggagtgggtggtgggcaattggcatga

SEQ ID NO: 107058 - DNA, 1977 bp, Glycine max
  Peptide Sequence Number=SeqID_223836
atggggaagggatattgtacgcagccttacccttgcatatgcaaagaggctgtttccggattgaaaaggatactcgtagaatttttgggacataaaaaatgtttcttaatattcatccataggttgttgggttacctaactgtaactgaatatctttcaatagctgttatctatatactactctggacaactggacagagaaggtgctctttggaggagtggatcgccaaactattgtctgacattgatatatcaagatgtactgcagtggcgtcatttctcgaactagaagcagctgctagatcttcattccaagatgcaaaccagcagaattctgaaacagacccagattccagcaacacagtttattctgtgcaatcacctctccagtcgagcttatcattagttgctggcagttcctctgttgcctcagattatggtagtgatactgcatatgagccatctgacctaggaacaccaagaattggacgggacgataattctgaagttggcacagatgatttaacattagatgaagatatgacgaatccaatagaaaagcttgtgaaatatggcataacaaatattgacgaaggtttgtttatgggtcagactattctagagcaattggaaggccttcctaggcataaagcaaatgccagatatgtgaactatgttgcagaaaaggacaaaaataatggtaatttatatgattcttcacttttagctaataataacatggagcttttctctgagcctgggcatgctaaggtgtttggtcatgttcgtaagctttcaaatgagagtgttgaaagcgatggaagctcaatacgaggtagtgacatgtctaattttgggattccaagttcatctggtgatggctctcatgaccttcctggatctgctttggtttcaagagagacagatattatgggccacacaaagtcgaagtctactggtgatactcaattagtccttccactagatcaacgcaataaattgaacaggattctttcaaccatgcagcgaaggctaggcactgcaaaaactgatatggaggaccttatagttagattaaatcaagaaatagctgcaaaggattttctcgcaacaaagctcaaggatttggaagtagaacttgaaactaccaaacagaaaaataaggagaacttgcagcaggctattctaattgagagagaaaggtttacccaaatgcagtgggatatggaggaacttagaagaaaatcattggaaatggagatgaaattaaagtctgaatcggggagaaattcttatcaggatttgactaaggaatcaattgttcagcagaatgatgtactgtatgagaatttagatgctactaaggagcagctggaaattttgtcaaaacagtatggagagctagaagcaaaatccaaagcagatgttaaagttctcgttaaagaggtcaaatctctccgtaattcccaaacaaagttaaagaaagaacttagtgagtcaataaaggaacacagtgaaactgagaaactacttctgcatgaaagagagaagagggaacaggcagaagctgctcggagaaaactgctggagaaatgcagggttcttttcaaccagcttcaagaatgcaatgtcagtcttccttatgaatacgaagataggacaatcgtgaattcatcatcatcaactgatgcttttaatcagttaacgacatctgatgaccaaatggacatcctactagcagaggtagaaaacttagagaaggactacggaagtgcggcttccaatgtagataaaaccaccaatgacataaaagatggtgtaatctgtgatgatgaagtgagaaagatcatagcagatttgttcatcgataatgttagattgagaaaacagacaaaccgcgtcacaaggcaggctctcaaattggatatgacagcaagtgatgattccccttcggtggagactctaacaagtatttag

SEQ ID NO: 107059 - DNA, 387 bp, Glycine max
  Peptide Sequence Number=SeqID_223837
atgggagttgaaaatcagttatcagaacgaggtgaagtaatttcagaaaaatatgctctagaatatggaactgattgcttggagttgcatgttggtgctgtccagcccggtgaacgggccataatcattgatgacttggtggccacaggtggaacaatgtcagcaggagtaaaacttctagaacgtgttggtgctgaagtggtggaatgtgcctgtgtcattggtgtgcctgatgtcaaggggcagtgcaggcgtattggaaagccactttatgttcttgttgagccgcgtaaagcagataaatgttacccagcccaggggccaatatgggtgccgcaacatggttgcttttaccacatggaaaagaaaaagtcctataggctatag

SEQ ID NO: 107060 - DNA, 261 bp, Glycine max
  Peptide Sequence Number=SeqID_223838
atgcctcgtggtcgaggtagctctggtggtgttaaccatgctccacgtccaactcctattcagagtgacaatcgtggatctctgtttaggaccgtaactgaaggaatagcttttggtgttggaattaatgggtctcctgctactgccactgcacccatggctaatagtctaggcggtgatacatgcaatgctcccacaaaggctttccaagatccttttaggcctgttttgatgattttagcttctgccatgggtggttaa

SEQ ID NO: 107061 - DNA, 2139 bp, Glycine max
  Peptide Sequence Number=SeqID_223839
atgaagcaagcttcttcggaggcagtaccgtcgctatcctcggcgccgtcgttcacggagacggcgacatcgtcgtcttggtccgcggcggcggcggaggacctgacggtggggtcgagggatggaggcggcggcgcgcaggagacggtggcggtggatcggcgaggcgagtactcagcgctgtgccgatggacggtgcacaatttccctcggataaaggctagggcactttggagcaagtactttgaggtaggcggttacgattgtcggttgctaatataccccaagggtgactcacaggcgctgccaggttacatctccatttacctccaaatcatggacccccgcggcacctcttcctccaaatgggactgtttcgccagctatcgcttggcaatcgtcaacctcgccgacgattccaaaaccatccaccgcgattcctggcaccgattctctagcaagaagaaatcacacggctggtgcgatttcacgccctccaacactgttttcgaccccaaattgggttacctcttcaacaccgattccgttctgatcaccgccgatatactcatcctcaacgagtccgtcaatttcacgcgcgacaacaatgaggtgcagtcctcgtcttcctcctcttccaatgccatgacttcctctgttgttgcgggtcccgtctctgatgtttccagtgggaagttcacttggaaagtgcataatttcagtctgttcaaggagatgatcaagacgcagaagataatgagccccgttttccctgcgggggagtgtaatttgaggattagtgtgtaccagagctccgttaatggggttgagtatttgtccatgtgtttggagagcaaggatacggataagactgtggtgttgtctgatagaagttgctggtgtttatttaggatgtctgtgttgaaccagaagcctggttccaatcacatgcacagggactcgtatgggaggtttgccgcggataacaagagtggtgacaataccagcctggggtggaatgattatatgaagatgtcggattttatcggcgcggattcagggttcttggtcgatgacactgcggtttttagcacctcgtttcatgtgatcaaggagtttagcagcttctccaagaatggggctgtgattgccgggaggagtgcgagtggtgctaggaagtctgatgggcatattggaaagttcacttggaggattgagaattttactaggttgaaggatttgctgaagaagaggaaaatcacgggcttgtgcatcaagagcaggaggtttcagattggcaatagggattgtcgacttattgtttaccctagagggcagtctcagccaccatgccacctttcagtgtttcttgaagttacagattcaagaaatacttccagtgattggagttgttttgtaagtcatcgtttgtcagttgtgaaccaaaggatggaggataaatctgtcaccaaggaatctcagaaccgctactctaaagctgcgaaggattggggttggcgtgaatttgtgacacttaccagtctctttgatcaagattcaggttttcttgtccaggacactgtcatattctctgctgaagttcttatattgaaagagacatcaacaatgcaggatattactgagaacgattccgagttaagcagcagtggctcccaggttgatggtaatgggaaaagaagttcattttcatggaaagtggagaatttcctttcttttaaggaaataatggagactcgaaaaattttcagtaaattctttcaggctggtggatgtgaacttcggattgagagtgaccaggctgttggtagtgacccggataaaaatttctgggtcagatacagaatggcagttgtgaatcaaaagaacccagccaagacagtgtggaaagaatcttctatctgcactaagacatggaataattcagttttgcaattcatgaaggtgtctgatatgttggaatcggatgcaggatttcttgtacgtgacactgttgtttttgtatgtgaaatactggattgctgcccttggtttgagttttcagatttagagggtgacctgttctggattttagatacaagactacctgtaaatcctgtctatgcatacctattgatttga

SEQ ID NO: 107062 - DNA, 105 bp, Glycine max
  Peptide Sequence Number=SeqID_223840
atggtggccaggagtttgttggaagccatagaaagttctcattccgcgggaagtgataacatttccaaggctggtcatgagaaacgccacagaatcacaaattga

SEQ ID NO: 107063 - DNA, 777 bp, Glycine max
  Peptide Sequence Number=SeqID_223841
atggctagaaccatcctctatgaaaactcacttcctaagcacttcttggcagaagcagtcaatacaacatgctatgttcataatagaatattgattataccattgataaaaaagactccttatgaattatggagaggaagaagacccaatatttcatattttcatccatttggatgtgtgtgctttattctgaatactaaagatcaacttgtaaagtttgattctaaagtggataaagggagattcttggcttttctgatcattgaagatcagactaaagaagtcaagattagatcatcattcaaaggtcttgcttcatgtgctcttgtgtctgaaatagaacccaagaccataaaaaagctcttacagatgatgactggatcatttccatggaagaagaacttcagtagtttaacaaaaacaacgtctgaactcttattcctaaacctaaaaacaaaagcatcattggaacaagatgggtacttagaaacaaactgtataacaagcaacagtgatagcaaaggaatctacatccaccaacaaaaatacactaaggaacttctaaagaagtttaaaatggaagatgttaagcctatgaaaacccatatgcatgcttccaatcctctgagcaaagatgaatcaggtaccactaaccaatgcttgttctataagaagaatcaagatttcaagttagtaggaaactgtgatgcagactgtgcaggagacaaagtagaaataaagagcacaagtggaggatgtcacactactagaaaatag

SEQ ID NO: 107064 - DNA, 1680 bp, Glycine max
  Peptide Sequence Number=SeqID_223842
atgggattcatcagcggcatgatcgttggtatcgccattggcatcgtattgatcgtcgctttcgctcgtcagggaagcgttcgatccaagcgtcgctccgatttggcaaagacgatagcacagtttgcgaggatgacagtggaagattccagaaaaattttgcctcctaagttctatccatcgtgggtgttaagttggcttaatagccaagtcgagaagatttggccattcgttaatgaggcagcttcagagttgataagaaccaatgtggaaccaattcttgaacaatataggccgattattttgtcttctctcaccttctccaagttgacccttggcactgtggctccacaatttacaggagttacaattgttgaagagaatagtgggcctgagggggtgactatggatcttgagatgcagtgggatggtaacccgaacatcgttcttgacattaaaacccgagttggtgttgtacttcctgtacaggtaaaaaatattggattcactggggttttcaggttgatcttcaagccactagtggatgagttccctgcttttggagctgtttgtttttccttgaaagaaaagaaagatctggattttactctcaaggttattggtggtgatttatcaactttaccggggatatctgatgctatagaggaaacaattagagatgccattgaagactctataacttggccagtacgcaaagttataccaattctacccggggattacagtaatctagagttgaaaccggttggaaaactagaagtaaaactagtgcaagcaaagaacttaacaaataaagatatagttgggaaatccgatccttatgctgtcatatttgtacgccccctccgtgacagaaccaaaaccagtaaaataatgaacaaccagttgaatccagtatggaatgagcactttgaattcattattgaagatgcgtcaacgcagcacttgacagtaagaattttcgatgatgaaggcgttcaggcttctgaacttattggctgtgcccaagtttccttgaaggatcttgaacctggtaaagtcaaggacgtatggcttaagctggttaaggatttggaggtccatagagataacaaatacaggggtgaggtgcacttggagctcttatactgcccatttggagtcgaaagtgccattagaaacccttttgaccctgatttctcattaaccacgttcgagaagaccctcaagagtggaacgggtgacgcagaggctgaagatcttatagggtcacgtaggagaaacaacgtgattgtaagaggggttctatctgtgacagtgatttcagctgaagatttgccagcagtggacttaatgggcaaggctgatccatttgttgtccttctgttgaaaaaaacagaaaaaaaactcaagaccagagttgtaaatgaatccctaaaccctgtttggaatcaaacatttgattttgttgtggaggatggcttacacgaaatgttaattcttgaagtctacgatcatgatacgtttggcaaggaaaaaattggaagagtgatcttgacactgactaaggtcatcttagaaggggaatacaatgaaacttatcctctagatggagcaaaatcgggaaatatttctttgcatttgaagtggactccacagcacaagtttcgggatccttag

SEQ ID NO: 107065 - DNA, 2726 bp, Glycine max
  Peptide Sequence Number=SeqID_223843
cgattgcggggtttctgactggacttcgagtttatcttgatgatcctgcaaaagttaagcgtctgcttctacctaccaagctctctggcagttgtgatgggaagaaggcctccaaagctgatgaatcttccccaagtttgatgaatttgctgatgggagttaaagtcttgcagcaagcaataattgatttactattggatataatggttgagtgttgccaaccttccgaagtgggtcctgttgctgattctgttgatgcatgctctaaaccttctccaaatggaagtggagctgcaagtccctttgagtgtgaaagagaaaatggagcaatggagtctgcacgagttcccgtttgtgagaggttggattctgttgttcaagaaagcagtaatgcatctgctgtgcagagctctgatttaaaaggcaatggtcttcaggagaaagcgcttcctggacagcccatttgtccaccagagacatctgccactgcttcagaaaatgcatcccttcgttcaaagaccaagtggcccgagcagtctgaggagctcttaggtttgattgtaaactcactaagagctttggacggggctgttccacaaggctgtccagaaccaagacggcgacctcagtctgcacaaaaaatttctcttgtattggacaaggctcctaagcatttacaagcagacctagttgctctggtgcccaaattggttgagcagtcagaacacccattggctgcctatgcacttcttgagcgacttcagaagccagatgcagaacctgctttacgaatacctgtttacggagctcttagtcaattggagtgtggtagtgaagtgtgggaacgcattctgtttcagtcatttgagcttttgacagactcaaatgacgaacccctaactgcaacaatagattttatattcaaagcggcatctcaatgtcaacacctccctgaagcagttagatctgttcgtgtcaggctgaaaaatctaggtcttgaggtgtcaccttgcgtccttgactttttgagtaagactataaatagttggggggatgttgctgaaaccatacttagggacattgattgtgacgatgactatggtgacagttgctcagctctgccatgtgggattttcttatttggtgaacatgacactgctcccagtggactgcatgtgattgatgagcaggcttatcatgctagtcgtcatttttcagatatttatatcctgttcgaaatgttatctattccttgccttgttgctgaagcttctcaaacatttgagagagctgtagctcgaggtgtaataagtgctcagtctgtagccctggtattgcaaagccgtctttcccaaagattgaacaataatggcagctatgtttctgaaaattgccaacattcagatgatgctacagagggagatgcctgcgagcaactgggagttcaaagggatgattacacttctgttcttggtcttgctgaaaatttggcactctctagagatccctgcgtgaaagaatttgtgaaacttctctacatgataatgtttagatggtttgccaatgaatcttatcgggggaggatgctgaagaggcttgttgactgtgccaccagcaatactgacaatggtcgcgaagtcgattttgatttggatatcttggttactttggtctgtgaggagcaggagtttatcaggcctgttttgagtatgatgcgtgaagttgctgaacttgctaatgttgatcgggctgctctatggcaccagttatgtgctagtgaagatgaaattatgcgcgttcgtgaagaaagcaaaactgagatttctaatatggctaaggaaaaatctatgatatcgcaaaagctgactgaatctgaggccacaagcaatcgattgaagtctgaaatgagggctgagatggatcggttttctcgggaaaagaaggaactagcagaacaaattcaagaagttgagagtcagcttgaatggatccgttcagaacgggatgatgaaattgcaaagctctcagcagagaagaaagctcttcatgaccgtttacatgatgcagagacacaactttctcaattgaagtccaggaaacgtgatgaattaaagaaagtagtcaaggagaaaaatgctcttgctgaaagattgaagaatgctgaagctgcacgcaagagatttgatgaagaactgaaaagatttgcaacagagaatgtgacccgggaagaaatccggcaatcactcgaagatgaagtccgtagattgactcaaacagttgggcaaactgaaggggaaaagcgggagaaggaagagcaggttgctaggtgtgaagcatatattgatggcatggaatcaaagttgcaagcttgccagcaatatattcacacacttgaggcctcactccaggaggaaatgtcaaggcatgcccctctgtatggtgctggtctggaggctttatcattgaaagagttggaaacactatcacgaattcatgaagatgggcttaggcagatccatgcccttcaacagcgtaaagggagtcctgctgggagccctcttgtgagtcctcatgctctccctcacagccatggattatatccaactgcatcgcccccaatggccgtgggactgcctccctcaatcatcccaaatggggtagggatccacagcaacggccatgtgaatggtggtggtggagttggaccctggtttaatcactcttga

SEQ ID NO: 107066 - DNA, 1188 bp, Glycine max
  Peptide Sequence Number=SeqID_223844
atgatcttagatgctgctcttgaatatgtggttttgcagtttatcccttacattcgttctggtagttttgatgacattgggccagaaagatacatggaagatgaacatataaggatggatgatttgtcatctcatctgggatcaatatacaactttcccaaaccaagtgccttttatggggtgtttgatggtcatggaggacctgaagctgcaacttatataaggaaaaacatgataaaatttttctttgaggatgtcaatttcctagggacatctgaagtcgataacatatttttggaagaggtggaggattcccttagaaaggcatttcttttggttgactcagctttggccaatgatcgcggtgtgaatagttcatcaggcaccatggcccttactgcttggatatttggaaggccagaaagagtcaacatcaaaggaattattgttgagactcagatagcgatgtctcctaccaccattattgttgcgtcaggatgtgctttagactgtctgactatgagcaaagactggaagaaggagataatccaagaaattgtggacaagctgctctatggaaagcctcacccaaatagagtcatgcctagggttggctcaagagactatgtcagcgacatatacaatttctgcatctacaagatcatgataggtgagaagatgcaagccttcaaggacaggttcaaccccaaggtgaagaagaaccctattccttatggaatgctcttcatcgagatcttgaggctggttaaagtggagggggagcaagtcaagcctagactacccagacacaagctagactactcaggatgtgctttagactgtctgactatgagcaaagactggaagaaggagataatccaagaaattgtggacaagctgctctatggaaagcctcacccaaatagagtcatgcctagggttggctcaagagactatgtcagcgacatatacaatttctgcatctacaagatcatgataggtgagaagatgcaagccttcaaggacaggttcaaccccaaggtgaagaagaaccctattccttatggaatgctcttcatcgagatcttgaggctggttaaagtggagtctataggaactcaagctaatcctttggatcttgagtctggagtgtcttctatagacgtagggggagcaagtcaagcctag

SEQ ID NO: 107067 - DNA, 156 bp, Glycine max
  Peptide Sequence Number=SeqID_223845
atggcaactgtcaatctttccagtgggcaggatgataacgtaggaggacaaggcttgcccatcatcccttactcacagctaccacactttcttccaaggggaggtgtacctcaacaagctaaaaagataaaaatcacatatcaaaacaacttctag

SEQ ID NO: 107068 - DNA, 763 bp, Glycine max
  Peptide Sequence Number=SeqID_223846
tgtgaatcgaaaagatagtgatttagaccgttcgacacttgcagaagtaaagccattagtagctaaatataatgataatactaatgtgctaaaggtggagagacaacttaatgggaaggaaattgctgcttatggattttacattgcacctatctggtttataacagagtatctatcaaatgcagcccttgcacgaacaagtgttgcaagtacaacagtattatcatcaacttcaggacttttcactcttttcattggtgcatttatgggtcaagactctttaaatgtagcaaaagtagttgctgtcttagtcagcatggctggggttgtcatgacaacgctggggaaaacttgggctgcagatgaatcacaattaagtgatgccagtggaaagcactctttagttggagatctttttggaattctctcagctatgtcatacggtctatttacagttcttcttaagaagttttctggtgaagaaggagaaagggttgatgtgcaaaagctgtttgggtatattggattgtttacacttgtagcactctggtggctcgtctggccattgatggccttaggaattgaacccaaaatttaccattcccccactctgctaaagtggatgaagtggttcttgcaaatggatttattggaaagcgtactttcagactacttctgggcactttgcgttgtatggactactcctcttgtggccactttgggcatgtcactcaccattcctcttgctatggtggctgacatg

SEQ ID NO: 107069 - DNA, 531 bp, Glycine max
  Peptide Sequence Number=SeqID_223847
atggcctcaaccagatcactcattctttgtctgttcattcaactgtgcttctaccttctacccctctcattcgctcaatcccccgccaccgggtctgccgaaggttacaccatttatggtcgagtgaagatccccagtgtgggaacaaaagattatattcttcctggaaaaatttcaaatgtcaaagtcatactcaatggtggtcaaagagtacgagttgatgtaagtgccagacaccatggcaaaattcaggcagcactgacagaaaataggaggggacttagtgagtttgtcttggagccattgaaggatgaacaatattatgaggttagggagccattctctattatgtccattgtgaaaagtccaatgggtctgatgatgggatttatgctgattgttgtcttcctcatgcccaaattaatggagaacatggatccagaagaaatgaggcgtgcacaagaagaaatgagaaatcaaggagttccatctttagcaagcctgttacctggtgctgcaagaagcaactag

SEQ ID NO: 107070 - DNA, 642 bp, Glycine max
  Peptide Sequence Number=SeqID_223848
atggtggtattagtattccaagttatgactcaatgtcctaatttgtgggtagcagatgttactgaggttctttgtgagctacaacttactataaagaaagtgaagtttatcctaacacacaaatttaagaaaaaggaaagtttctccgtgtgtttattcatatctttgcttagtccgcaagatgcaattataccttttcagattttaggaggtgaagctcaagtggttcagataatgtcgaagccccaagaaaaaatcatcgcaaggcctgaggggaataaagctgatctaggtgggagcaggaatgacaaagttacaacacagaaaaccccttccttcaaagagggatggaaggatgcgatgacattctggctacaagtggaaggatggcatgcacattgcttgttgccgaacaaccataagattcgcaccatcaccggaatagacctcaacgtcaagatgctggtagtgctcgaaaagaacatcttctgggtgaagcctgactgtgggctcaagactcgtaagtatgtggaagcaatgctttccaagtttattttgatgatgccaaagactcaagtcaagaatcaagagtcaagcaagtatcaagaatcaaagagtcgttcaatcaagattcaagattaa

SEQ ID NO: 107071 - DNA, 1173 bp, Glycine max
  Peptide Sequence Number=SeqID_223849
atgagcacggtgtctcttctcaagtgctacagaccctttttctctatgcttttccctcactctgccccacccagaccccacgcctccatcttcaggaggaaaaacttcccttctttttgcgccacctcatctccgccgccgttgacggcggagaagggttgcggcaaattcgactccgagggtctcgccttgccggaggtgtggctgcacaacaccatgagtaagacgaaggagctcttcaaacccaaagtggattccaaagtgggaatgtacgtgtgcggcgtcaccgcttacgatctcagccatattggacatgctcgcgtatacgtcaatttcgaccttctttacagatactttaagcatttgggatttcaagtctgttatgttcgcaattttactgacgtagatgacaagataattgctagagcaaaggagttaggagaagatccaatcagtttgagccggcgctattgtgaagagttctgtcaagacatggtaactcttaattgtctgtctccctctgtggaaccaaaggtctcagagcacatgccccaaatcattgatatgattgagaagattcttaataatgggtatgcctacattgttgatggggacgtatactttaatgtagaaaaatttccagaatatgggaaactatctagtcgagatctagaagataatcgagctggtgagagggttgcagtcgattcaaggaagaaaaatcctgctgattttgctctttggaagtttggaacttacttaaggtggatttccaatgctattctgcagtctgcaaagccgggggagccattttgggagagtcgctggggtcctggaagacctgggtggcatattgaatgcagtgccatgagtgcagcttatcttggttactcttttgatatccatggtggaggaatcgaccttgtgtttcctcaccatgaaaatgaaattgctcagagttgtgctgcatgtaagaaaagtgatataagtgtatggatgcacaatggttttgtcaccattgactctgtcaaaatgtcaaaatctttggggaattttttcacaatacgtcagacaaaaactattaagtctatcattaaggacccacagtttctatttgttgatgattaccattcaaagggttacattctgatgccacaaacattgttttactag

SEQ ID NO: 107072 - DNA, 621 bp, Glycine max
  Peptide Sequence Number=SeqID_223850
atgcctcctccttctgaggcaagtatgtttgagagagatatcagtggtgatcacaatgacaatgacggtggtggtagtagaggtggcaatgacaatgtggtgttggtagccaatggtaacgacattggtggtggtgatggatgtgatattagtggtggtggcagtggcaaagaagaaggtgatattagttgtggtggtggtagtagcaatgtcggtggtattgatggcgatggtggtagcaatgatagtggtgtggtggtggtgacaacaaatgatgacgatgatagtggttgcagcaacattggtggtgattttggtggcgatggtaggggtgatattgttggtaattgtggtggtggtggtggtggtgacaatgacagtgataatgacattgatggtggtggggcaaagatgatgacaataacagtggtgttgacggtaacaccaagtggtggcgacgatgaaagtggtggtagtgattgtgataatgatgataacaatgaaactaatggttttggtggtggtaatgctaatggtggtgacaacagtgatgatagtgacaatagtagtgataataacaattctagtgattgtagtggtgacaaccaaatgaacagctaa

SEQ ID NO: 107073 - DNA, 291 bp, Glycine max
  Peptide Sequence Number=SeqID_223851
atggcggagcgggttgcaatgtcgactttgagggcacgggagatgacggatgaaccagagtcacagctagctaggtcgcgactgaacgaaggacaatcacgtgctcaaatcactaatctaacaaagatggtttttgggattaaaccatctttgtatgatacttggccttcaagctccattaagagttgttgcaaccataacaacttagttgttgtggatccaattgtgcgatacttggcattcgttgaagaccatgcaaccgtggactttgtttgcaagactaggatatag

SEQ ID NO: 107074 - DNA, 216 bp, Glycine max
  Peptide Sequence Number=SeqID_223852
atggccgccgtttgcatttggcttctgggtggttccgttccgtcgttttgggaccgttccgttacccgtgacgccgttcactatctctccgttacgttcgtccagttgctttgcgtgtggtgtcagtttggttgtgcagctggactttggaattggaatattgaattcttgagttcgaaacttgcatacttaaatattaacaagaggcagaaataa

SEQ ID NO: 107075 - DNA, 312 bp, Glycine max
  Peptide Sequence Number=SeqID_223853
atggggaagcccacagggaagaagggtaccgttactccaggcgctgcatattcacacgccatgcccgggaaatcttcgaaagccttcgatgaagacacggcggtgttcatgaccatgtcacaagagttcagggaagaaggcaacaagttgtttcagaagaaggaccacgaaggcgccatgctcaagtacgagaaggcactgaagctgctcccgaacaaccacatcgatgttgcgcaccttcgcaccaacatggtcacgtgttacaagtggcatctttatgcaattttcatcagcattgtttttcaattctag

SEQ ID NO: 107076 - DNA, 747 bp, Glycine max
  Peptide Sequence Number=SeqID_223854
atggcttcatcctcttccagaacaaagtctagtggacccgttctacgctccctctcaccctccaccagattctgctcatacaccacttccaaaactcctttctcttctccttcatcggccttcgcttcctccacaagctctggcttttcgtcttcatccttcttcaaccagccacgtcagcatcacgctcacagccatcaccgtgcggcatcgcccacccgtgtcaatctatgcagccccgcccctctctcctctgccgtccggttctcaatcgatccacggtccatatctccgaaccggtccatctcgaaccagatcatcacgacgaagaacaaccgtccgatctctggccagaagaagacgtgtatgtgctcccctacgacgcaccctgggtcctttcgatgcagcctccacaagaacataggaagcagcaaccacaacgccgattcgtacccttcgaaccggctcaacatgcgtagatccgctatgaagaactcgctggtgagaatcggaggcgtggagggcgagtgggtgaaacgggccctgacagcactcattcgtcccagttcgcatcaacagaggaggagagcgggcttgcaggttgttcttgattttactggtttatattccataccacccctggcgcccttatctgccgccagagttggattccggcgaagcggctgggaggcagtggcgagtcctctccggcgagttttgatttcgtcgtctggagcagaatggtga

SEQ ID NO: 107077 - DNA, 261 bp, Glycine max
  Peptide Sequence Number=SeqID_223855
atgaaggagaagacaaatgcagagaagaagaaggaagaagcagcaacaacacaacacggtcaaagcgacaatagcagcagcagcggaaccacgaatggcaggtcacagaggcacggaacggaaggaggaaaagaaagggtgaagggcatttttgcccttccacccgggttattgggtgcccctaacaaaaatgctgggtgccccaagcaacaaccccttaatgggctattatctatacccatcggccataacccaacatga

SEQ ID NO: 107078 - DNA, 1188 bp, Glycine max
  Peptide Sequence Number=SeqID_223856
atgctcctcgcagttcttcaccgccattgtttgaaaaatcatcccttcctgaaagcacacatgatcacttgctttttggaggcaaatgcctacagaagcaaagttttcttcaactatgagaagcgcctacggttgcatagtccacccgaaaaggtttttgaatactttgcatcttgtcgtactctagaaggagaactactgatgaagccagtggacctaatgcgagcagttgttcctgttttccctccttcagaatccaaccttgtaagagagggatacttgaaaggtgaaagaaatcctggccatttattctgtcccccttcggagttttttatgctttttgatgtagacaacgatgggcttatatctttcaaagagtatatcttttttgtaactctactaagcatccaagaatcaagcttttctgcagcatttaaaatgtttgacaaggataatgacggggagatagataaggaagaattcaagaaagtgatgcaatcaatgcgatctcataccagacaaggtgttcaacacggggatggacgacgaactggcctaaaggccaatgcttctgtagaaaatggagggctggtggaatacttatttggtaaagatggaaagggacgcctcaaacatgataaattcgtgcagtttataagagacttgcatgatgaaattgtagggctggagtttgctcattatgattacaaatctcgaaaaactatatcggccaaggactttgcacactccattgttgcttctgctgacttgagtcatctgggcaggttgcttgaacgggttgatgaattgagcaatgatccacggtttaaggatgtatgcataacatttgaggagttcaaaaattttgcagagctgcggaaaaaattattaccattttcattggccattttcagttttgcagaagtgcaaggcctgttaacaagagatgattttcagcgagctgcatcacatgtttgtggcgtatctctctcagacaacgtggttgagattgttttccatttgtttgacgcaaatgaggatggaaatctgagtacggaggagtttgttagtgtgctacaacatcgagaaagagacattgctcaacctgtggagacaggaatcatgggtttcttgtcatgctgctggaaatgtacggacacctctccatcttctcggttgttttcctga

SEQ ID NO: 107079 - DNA, 3159 bp, Glycine max
  Peptide Sequence Number=SeqID_223857
atggagaagtctagtctgaataaagagcttgttttcttgattctacagtttcttgatgaggagggtttgaaggaaactgcacacaagcttgagcgtgaaagtgggatatactttgacatgaagtatttcgaggacatgctacttgctgggaaatgggatgatgctgagaggtacctttctggattcacaagtgttgatgacaacaggcactccaccaaagtatactttgaaatcaggaaacagaaattccttgaggcgttagacatggacgatcgtggcaaggctttggatatcctcatcaaggatctgaaagttttttcctcagggcatgaagaattgttcaatgaaatgactcagcttttgataattagcaatataagggagcatgcatcactttcaacatatggagatacagattctgtaaggaagattgtggcggatgatattaagaaagtcattgaggcaaatcctgtgttccatgaaaaattgaaatgtcccgtctttaaaagtcagaggttacgttatcttctgaaccaaagtttgaattggcagcatctactttgtaaagatccacttccagttcctggtataaaaactctcttggaggatcatgtttgcaaaccaagtttgaacctttcgtctctgcaatcagaagaaaatgaatcaattgaaaattctgatcctgataaacatttgtcaaacaataattctggcccatctacaataactgattctgtaccctttcccgccacactaacaaatccagtaatcattttaattattgcttatgacggtatattccatggcctttctgtagaaactgcaatggaggatcctagtgtaatatcactcaaaggaaggccatgccagacttccaatgaggtgacgtcagccatagcaaatgttcttcctgaaaatgttgtacagatattcaaagaggattcacttcctgttaccatggattttcatcctattgggcatacacttcttctagctggaacaaatattggcagtataggactttgggatgttaattctggtgagaaattgttctctgaaaattacagaatatggggtattggagcaagctccatcaatttcaaggaagctcaggaaaaggactttcgtgtttcagttaagaaaatcaagtggaaccctgagggttcactgtttggggttgcattttcaaaacatcttgttcaattatattcctatcatcatggcaatgacataattagccaacatttagaaattgatgctcatgatggcagtgtcaacgatctagcattttcttctcttaatgagcaattgttggtcataacatgtggagatgacaagaaaataaaggtctgggatactgttagtggtgtcagatgttatacttttgaaggtcacgatgctcctgtatgttctatttgtcctcatgtgaagcaacaaattcattttattttttcaacttcaaccgacggaaagattaaggcatggttatatgattctttgggagccagagttgattttgatgcccctggttatggctacactgcattggcttacagtgctgatgataaaaggcttttttcttgcggaactggtaaagatggggagccatatcttgtggaatgggatgaaagtgaaggatatataaaaagaacatacaagggacttaagaaaccatgtttttctgccatccattttgattcaactcagaaaggacttttggctgctggtgatggccacaaggttaaattttggaatatggacagtgttgagctctggacaagcactgatgttgatgctgaattactggaaaatccatgcattcgtttcaacaagaagggcacattactggctgttgctgcaaaagaaaacaaaataaaaattttagcaattgatgacattttgcagaaacagaatgaaattcgttcaattcatgtccccaataatcaacatgaaaccttaaagtgtacggaaagtccaattttggttgatgctggtgctggtgtagcagatgaaggcattgtcatgaatgggtgccaaaagggctcggaggatgggaggtctaattcaattgaagattcccataacaaatcaaagttttggaatgtctcggaaatttgcgagccatcccagtgccagttcttgcagcttccagttcatcccaaaataagcaagatagttagactggcttacaccaatgcgggatgtggcattttggcattggcatcaaatggtgatcatctactttggcaatggcctcgtgatagccttaacttggatggcaaggcaactgcacaattttcccctcacatctgccgatcaaggagtggcttgcaattgatgagcaataaactaacaagttcttacagtggaaacccagtttcctgtttttctttatcaaagaatgattcatatctcatgtcaacatctggggaggcaatctccttgttcaacatgttgacttttaagactgtgacgactatcatgactccaccccctatggcaacttgtctctccttctaccctcgtgataataatatacttgccattggtatggataattacagtataattatatacaatgtccgtacaaataagattataagcaagcttgagggccactccaaaagagttactgcccttgccttttcaagtagttttgatcttcttgtttctggtgatataaatgctcagatttttgtatggaacaccaatggatgggaaaaacagaaagatggatacttgcaaatacatggacagaaggtgccagaaatactatctgacactcacattcagtttcacccataccagaggcacttccttgcttgggttccagaagtttcaatggttatctcccaggcaactttctcatctgatggccaggctgtgtatgccagttttgttgatggaaccgtgggaatatttgataccttgaaacttcaaatgcattgtagggttaatccctcagcttatctttctacaactccaagttcaagcatctatccacttgccattgctgcacatccacagaagccaagccaatttgctgtggggctcacagatggtagggttattgtgtttgagcctcaaaagccaggagaagattggagcaagtttagccttgatgataatgaggtcatcaacacaggattgtgggagtga

SEQ ID NO: 107080 - DNA, 153 bp, Glycine max
  Peptide Sequence Number=SeqID_223858
atgggatgcgctcatggagcctcagagttggggtcaagcgacgtgactggggaattgtggcatgatgcaatggtgcgacgggaggagggcagtgctgcttgggtaatgatccttggtgtcttcaaattgggagttgccactttgtcagtataa

SEQ ID NO: 107081 - DNA, 984 bp, Glycine max
  Peptide Sequence Number=SeqID_223859
atgaagcttggattcctcaaacgtacaactgagcatggtgtttatataaagggcagcaatactactaacttgactgtagtgtgcctgtatgtagatggcttgcttgtgacaggaaataatgagactgaaattgccaactttaaaggagagatgatgagagaattcgaaatgactgatttggaccttatttcttattttcttggaattgaattcaagagaattgatgagggagtgatcatgcatcaagggaggtatgcaagagatgtactgaagaagttcagaatggttgactgcaattctgcagacacacccactgccattggtgtgaacttggtgaaagatcctaataaagaagaagtagatgtaactttgtatagacaaatggtgggctcactgagatatatggagaatcctaaactttctcacttccgtgctgccaagagaataatgaggtatgtgaaaggtactctcgattatggtattctgtttcccagtgctgccaaaaaatgtaatgttctgggatatagtgattctgattggtgtggagataagagtgataggaagagcacagcaggttatgtgttcttctatggtgatgccccaatctcgtggagttcaaagaaggaacaagtggtggctctttcctcatgtgaggcagaatacattgtagctgctatggaaacatgtcaagctcaatggcttgataatatttttggtgaactgaagatgaaggacaagggtgttattacactgatggtggacaacaaatctgccatcaatctagctaaacacccagttgctcatgggaggagcaaacacattgaaacacaatttcatttccttagagagcaagtgacaaaaggcaagctaagtgttaagtattgtccaactactgtgcaagtagcagacatattcactaaaccattgaagattgatcagttcaaagagttaaggagcagattgggagtgattcaagtgcagtga

SEQ ID NO: 107082 - DNA, 645 bp, Glycine max
  Peptide Sequence Number=SeqID_223860
gtcgactctagaggatcccacgccttccgaggactacgcgtcctcgccttaagagggaaacacgctctcgcctttagacggctacacgtactcgcatttagagagctgcacgccctcaccttcaaaggaatgcacgcccttgccttcagaggactacatgtcctcgccttcagagggctgcacaccgtcgccttcagggaactacacgtcctcaccttaagagggcaacacgctctcgcctttcgacggctacacaccctcgcctttagaggtccaaacgccttcgccttcagagggcagcacgtccaaaccttcagagggctacacgccctcgccttcagaggactgcacgccctcgccttcagaggaatacaggtcgtcgtcttcagagggctacacgccctcaccttcaaagggttgcacgccctcgcctttagaggactgcacgccctcgccttcagaggactacacgtcctcgccttcagagggatgcacattctcaccttcagaggactacacgtcctcaccgctgcacgtcctcaccttcagaaggctacatgtcctcgccttccaagggcgaaacgtccacgccttcaaagggctgcacgtcctcgccttcagatggttgcacgccttagcctttag

SEQ ID NO: 107083 - DNA, 162 bp, Glycine max
  Peptide Sequence Number=SeqID_223861
atgttgtttttcaatacatttgcattagcattactcaacagcatcaatattttaatgttccttgtattcaacagtgctttgaaaggacttgaggatactccacaacctaaatccaaggctggtgcttggtggattgttgttaaattaacgtttaatatctaa

SEQ ID NO: 107084 - DNA, 759 bp, Glycine max
  Peptide Sequence Number=SeqID_223862
atgacgcaggtgatgaccgcgccggacggtcagcgcaccttttttcacgcacgcggggccaatgcgcagctcgatgtggcgcacttcgctcacctcgccaccgcgcaccgcatcttccacctcggctatttgctgttactggataagctcgaccagcccgatgcgcagtacggtacccgcagcgcgcggctgctggcggagatgcaacagcgcggctatctcacctcgctcgatctggtttcgcgcgccggcgagtatcaggcgctggtgaagccggcactgcgctggctcgattatctggtgattaacgaactggaagcgcaggcgctcaccggcatcgagctgcgcagcagtggcacgctggcgtcaccggcggcttttgctgcggcggcacgctggctgctggcgcagggcgtgcgccagcgcgtggtaattcatgcaccggaaggcgcctggggccagcagtcagcgggcgacggcctgtggcagcccgcctggtgcttagcggcagaggagattgtcggcagcgttggggcgggcgacgccttctgcgccggcgtgctctacgccagccatcaaaactacaacctgcagcagacgttaaaactggcccatacctgcgccagctttaatctgcatgcggccaacgcgctggacggcatccggccactgagcgagatgcagcgctggatgaatcaggcgatttgcgtttcgcgcgccgcggcggacgggcgcatcacatcggcggaaaaaacatag

SEQ ID NO: 107085 - DNA, 210 bp, Glycine max
  Peptide Sequence Number=SeqID_223863
atggcgcggactggtgtgaatgcggccatggagctcacccgtacggggggtacacctggcgcagcgcctttccctgatagtacagccgttccggtggccagcgacattgtggccttgcaagcacaatatggcgttaccaataccttagacccaacggcgacggctgcaaccgcagcggcatatttaaaatcgtgtgggaccaatgggtag

SEQ ID NO: 107086 - DNA, 336 bp, Glycine max
  Peptide Sequence Number=SeqID_223864
atgtatcctttgaccaaacaggtacaacttgtcagcgacatgagcaaaggggccggtgcaaggctggctggaattgacattcctcaatatgcagacgatgaaaccagttttgacatgctatatgcgcgcatcgataaaaccatcatattcctgacaggcatcaagccagcacaacttgagggcgcggctactaaagaagtagtcttgactatccgcaaggtagacttaacctttagcgcgctggactatctggaaaaatgggccatgcctaatgtttacttccactcgaccacggcctataacatactgcgccaccttggcgtggctttggggtaa

SEQ ID NO: 107087 - DNA, 288 bp, Glycine max
  Peptide Sequence Number=SeqID_223865
atgaaaagcatggatgacatggggttgaatcaatttagatttttcaacatggttcatgacatcttggtcaaggtgaaactggaagtaacaaggacatcaacagtcctaaatgtgtttggcagtagacgaagtagtgatgtaactcgattcatcttttgccccaatttttgcaagatggttacttccatacttcaactgaacttttttcgaaaaagcatgagcttagttcaaccttataatccaaggaatggcaattttgatcaccaatacttcaacaaccggtcatag

SEQ ID NO: 107088 - DNA, 387 bp, Glycine max
  Peptide Sequence Number=SeqID_223866
atgatgaaaagagctgtatttgccagagaattaggcgttcctatcgtaatgcatgattatttaacggggggattcactgcaaatactagcttggctcattattgccgagataatggtctacttcttcatatacaccgtgcaatgcatgcagttatcgacagacaaaagaatcatggtatgcactttcgtgtactagctaaagcattacgtttgtctggtggagatcatgttcacgccggtaccgtagctcgaaatgaaggacgcgatcttgctcgtgaaggtaatgaaattatccgtgaggctagcaaatggagtcctgaattagctgctgcttgtgaagtatggaaggagatcaaatttgaattcgaagcaatggatactttgtaa

SEQ ID NO: 107089 - DNA, 341 bp, Glycine max
  Peptide Sequence Number=SeqID_223867
atggtttatccaagtggtactagacacgaatcccttaagattgtagtaaagggtttgaatcctgacgaatgcatatatggagaaaatcttgttgagagggagatcccacctatgagtgccaacaagtcccttggagtgccaacaattattgttgagaaaatattctataaaaaggttgaatatgtgcttgaagattgtaatgaggttctcgtcaaaatcaacaaatttttcgtcaacaaagaaggcttagtatgtgtggaaacattgtgtatgcctgttactataccagaaagatttgagttggatgcttttgagttagataaacctgaagatgctggcag

SEQ ID NO: 107090 - DNA, 623 bp, Glycine max
  Peptide Sequence Number=SeqID_223868
ctcatgtctcagactttggaacagccaagtttcttaatccagattcatccaattggacctcattcgtaggaacctttggatatgctgctccagaacttgcatacacaatggaggtgaatgagaaatgtgacgtgtatagttttggggtcctagcatgggaaatactttttgggaagcaccctggtgatgttatatcttctttattgggatcatctccatctactcttgtggcctcaacactcgatcacatggcattgatggataagttggaccaacgtctccctcatccaacaaagccaattggtaaggaagtggcatcaattgcaaagatagcaatggcctgcttgactgaaagtccacgatctcgccctaccatggagcagatgatacctgttgctgcaaatgatgttgctttctcgatccatgctgttctgctgacagcaattacattgttccagattgcaatctatgaacgtgggagtcagaaagtgtccaaggtttctattggaattgtctctgttgcatggcttgttgcagcagtttgtttctttattgctttgccgaataattcctggctttggcttctctccgtcttcaagtatgttgttgtccctgcttctttg

SEQ ID NO: 107091 - DNA, 216 bp, Glycine max
  Peptide Sequence Number=SeqID_223869
atgaatttcaaatcgctcaagcgttctcagttatcaattgtggtgtttctggtgctctctagaactcttcctccgatttctctgttagggttcccaaacgttggagagaaggagaagggtttgaagcctccattctatggtcctacatgcgatgcatctttctccctcaatagacattattttgcaaatcccaacggtgaaaacatgcagaaatga

SEQ ID NO: 107092 - DNA, 261 bp, Glycine max
  Peptide Sequence Number=SeqID_223870
atgagatcgatacgaaggtgtggtctagttgaaagtaatgagagaggctttgggaaacttattagtgcaacgccgaagaaaaccgttatcagtgtagcttcagataagaaagtgaaagagagaattctacttactcctaatgcaacgaaattacttccactttctagggaggcaattatttttatgaacgcagctaaggagaagagtaatgctccccctaagaaatccaccgtaggggtgagtaagatgggcactggataa

SEQ ID NO: 107093 - DNA, 654 bp, Glycine max
  Peptide Sequence Number=SeqID_223871
atgggaatgatgcctttccttgtatcggaatggctacctatagcacatggaacagcaccatcaaacttttctgcaatactaagtgccacaatgacgctaatgggggtttacggaatactaaaaattacaattttaacacaaactattccgattggattttcacttacaataatggccataggtgcatttaacatattctctggagcactttacggatacgtaaatgagaacactaagggaattttagcctttagtacaatagaaaataacggggcaatactagtagccttaagtctatacatgatctcaaagcaactaaacattacctcaatagagcacatttccttaatcactgtaattttatactcattcgcacactcagtagccaaaactggactattcctctcttctggcttacaagaaaaacagagcataacttattcaaaaaagataagaaacattgaaataggactaaccctattggcttcctccatgtctggactattgccgaatatagggggagtagcatcttggctattacttgaaaacctattcatgttctcatacgtacttcataacgtgatatctatcctcttcataatgactggagcaattatcgcaatgggagaagaatacaagagaacaattaagtaa

SEQ ID NO: 107094 - DNA, 477 bp, Glycine max
  Peptide Sequence Number=SeqID_223872
atgaggggagcaccgacagaagagagcctctctcctttccttgtgagagatttcgatgcacaaagtttcaagattatacaaagagtccataaggcgtgggaaagcccgttaaggaaagataaagaacttaggggcattcgtaatggcatcatcggtggttatcatgaatggttgaaagttcgtacacgagggttagattggctctctaagttaaagattatcgatgaagaaaacttcgaagctccagaagaggatgaagaagtccgggctctaaaaaccgaactaggaaaagcaagacttgccaaagaaaaattcaagttggtcgctacagacgtccgaaaagagtgtgccgggttacgagaagaaaatgcagctaccgtaagagcccttgaacaagaaaccaagagggaagcaacagtgagctcaagcttcgaagggaagagaaagaccaatcacgagcacatagcatggtcttga

SEQ ID NO: 107095 - DNA, 771 bp, Glycine max
  Peptide Sequence Number=SeqID_223873
atggccaatctgcgcaaggtgcgtcatgaattggctgcattttcacctgaatttttctctgtcacatttggtgcaggtgggtctacacgcgaccgtaccatggaaagtgtgctggaaatccaggccgaagggtttggcgctgcacctcatatctcatgtatctcctcaagcaaggaagaaatccgtgagctattacaagcgtaccaatccaaaggcattaaacggttggtaacgttgcgtggcgatatcccttcaggcgaagtgagtgctggggactttaaatatgcaaatgaacttgtgggctttatccgtgctgaaaccggtgactggtttcacctggaagtcgcagcgtatcccgagtttcacccggaagcgggttctgcacaaaaagacctggaaaacttcaaacgtaaaattgatgcgggcgcggattcagccattacacagtatttttacaatgtggatgcttacttccgctttgttgaagctgcgcaaaaactgggcgtcacagcgccgattatcccgggcattatgcccatctataattacacacagctagcacgtttttccaatgtgtgtggtgccgagattccacgctggttgcggttacgcctggaagcgtacggagatgacctggcgtcgttgcgtgcatttggcgtagatgtggtctcagagatttgcgccaaactgattacggcaggcgtagataaaatgcatttttatacactgaaccaggctggcattattggccagatcatccgccaactgtag

SEQ ID NO: 107096 - DNA, 723 bp, Glycine max
  Peptide Sequence Number=SeqID_223874
atggttacgagtattagtcatgcaaacaatgaccctaaaaatataagtggcgaagacgtgatacgcccacaagttcagacaagtgtcggcgaaatttctttgccacaaaataatgtagtgtcaaccacaaacacctcaccattttctagtacaagaccatggggaaatgctttggccattcccagaaaccaacctgggaatagacatataattcagatgcttcaaggacaaaatggcccaaacagaggcttaggcctcgaagcaattcagaatcctaagatcattcaaatgatggaacttgctttgaatatgtattgtttcggaataggaaatgcacaaccaccttactttgtttctgccttccttgattatattttagcatctgaattgccaagagtgagtgctcctttatctagagaggaggtcaaccaagccttggaagagttcaaaaaggaagaagagtttccacttgcagaggaatcattggtcgaatttctattgaagaaacaaaaagttgagaaagaggttatgctttgtctttgttgtaacgtcgtgtttgacaagtcgactgctaaagcatttgaagcttcaaaaaattcgaagagtttccagaaagtgcaagaagcaaatgttaaagaaaaggggaagcagagtataagcttgactgcgagccaagttcaaaggccctacaatttgtctcagaagaaatcttatgtcccttaa

SEQ ID NO: 107097 - DNA, 216 bp, Glycine max
  Peptide Sequence Number=SeqID_223875
gacaacgttcctaaaggaaaactctacaaggttccagaatttcaacaaacattgttgacagtaacgaaaatacgaatctggggatcccacggtcatgtggctccgcatgccaccggactcttgggtcacggtaacaaaaggtggggtggtcgacaaaagcagggcttttgctcctacgtatcctcaatttgtgatgaggaactcagacctacgtag

SEQ ID NO: 107098 - DNA, 582 bp, Glycine max
  Peptide Sequence Number=SeqID_223876
atggggttcaagactaggatctgggtcgttgacgccagacggtgcatggcaaggttaggttctggctgtttgacacctgacagtgctgggccaatcaatcaaaacaacatctctgtgcaaaaccagatatctaaggaagcaactcttgcagatacggacaatggacattcaagtaatgcaacattgattgatcacagagtttcatttgaattaaccggggaagatgttgcccgctgtcttgctaataaaaccggggtattgcttcgaaacatgtcagggtcttcacaaggtatactttccaaagaccctgttgacagagaaagggtgcaaaaagacactgatacatgtacagagaaaaccgatgataagcctgacaattctgtaggaggagagcaatgccttcacaagcaaaattctgtaaattcttccaaagaattcaattttgacaaccggaaaggtgatgtttctgttactgctggcagtggctctgagtggtggactaacaggaaggttgctgggaaggaaggtagatcagccaacagttgggctttcttcccaatgttacagtcagaaatgaactga

SEQ ID NO: 107099 - DNA, 587 bp, Glycine max
  Peptide Sequence Number=SeqID_223877
aaaccgttccgccgccgtccattcccgatctccggtaaccggaaaatgatccctttcgcgcatccgaatcccggcatggcaagccgcaacaactacaaccgcgccaccgccgagacggttttcgccgccgccaacgccatcgtcgccgccgaatccagagtccaacccaccgacgcgccgagcagtaaaagcagcaagcgaattggccatgctgtccttgttccagaacctgctgctccaacaggtccagcagctgctgctgctgcaccaaatccttcagccgccattgtaatgccgttcattgcccctccatcttctcctgcatcttttcttcaatctgatccaccatctggtattcaatcaccgcctggattactttcactctctgctcttgcggccaatgcttactcttctggtggtcctgcatccatgttcaccattggtccatatgcctatgagacccagttagtttctccacctgtattttcagccttcacaactgaaccgtccactgctccttatactcccccaccagaatctgtgcagcaaacgacaccttcatcccctgacgttccatttgctcagtt

SEQ ID NO: 107100 - DNA, 426 bp, Glycine max
  Peptide Sequence Number=SeqID_223878
atggcacgggagaggagaatgaatagtgactcgtacggacgagtcactactggcttttataagaaaggccatgcatggcgccagtggagatggcgccttcgacagggacgagccacgtggcatgtcgccactgtgactggcgacaaaggactgcatatcgcagctcttattggcgcgtccaaaggtgcatggaagcgctggtttgaccagcgacttcagcacctgcacttctgcaaccataggctgcagcacctgcagttgcagggtcctagctggaaggcgccactcgaggtggcgatttgggtgaaaaagaaggtggttgctgttgagagagaggtagctggtggttgcttgtgtgttgagagtggtgctgatcagtttgtcttcttccattttataaaagcttttttaggtagtataagataa

SEQ ID NO: 107101 - DNA, 138 bp, Glycine max
  Peptide Sequence Number=SeqID_223879
atgatcgttgtcaccaccgcccggagtaatagctgtggagatcgtgttggtggtgacgatagtggtcatggcgatgatggtgtggtgacgattgacggtggttgcgatgacaatcaattgagacagaagcgatcatga

SEQ ID NO: 107102 - DNA, 3906 bp, Glycine max
  Peptide Sequence Number=SeqID_223880
ggaagtgtggataattatatcacggagtttgagtatctcacggctcaaatccctaaattaccagagaagcaatttcaaggctactttctgcatggattaaaggaggagataaaagggaaggtggccagagcggtagagagggagacggtgcgtgatgggtcgggttttgccagatctagcaaaccgggtcaagggtcaagcagatttgggtcggttgggcccaataagggaggagcctcagattgggtattagtaaaggggggtaaggaagcaataaccaagccaactggacctggaccacgtaatgaaaggtttggtcagggagacagacgaagtggaccacgagatcggggcttcaaccacctttcttacaatgaggttatggaaagaaggaggaagaatcaatgtttcaaatgtgcgggcccttttagttcgacacaccaatgccctgataagcatttgaggttgctgattaccgacgatggcggaggagaggagagcgagttgttggccgtagaggggaccatccatgaggtaccagtagtgattttaattgatagtggggcgacccacaattttatttcacaacaattagccaagaaaatgaatttggtcaccacgaacacaccacctctaaacatcaggttaggtgatgggtcttgttctaaaactacaggggcgtgtaaaaaattggagattgacatagatgatttacatgtagtagtagatgttcagttgtttgagttgggaggaatggatgtagtattggggatagaatggcttcgtactctgggtgatatgataatcaattggaaacaacataccatgagtttttggtacaacaaaaggtgggtcactttacatggggtggatggtaatatgaagggcatggagactttacagagtattattagcaagccaaaaagaagtcaggaggtatgggggagagaggttggtagtaaggtggatggtggatcctttcatgccttagagttggagcaatcaagggaattggaacacttgttgaatttgtgtgcagatgtgtttcaagagcctaaagggttgccacccaaaaggaagaaagaacacgtgattaccttgaaggaaggggaagggccagtcaatgtgagaccatatacatatcctcatcatcacaaaaatgaaattgagagacaagtgaaagagatgttggagacaggaattatacgaccgagcaccagttcgttttctagccctgtcatacttgtcaagaagaaagatggatcatggagaatgtgtatagattatagagccttgaacaaagctactataccggataagttcccaataccggtgatagaggaattgttggatgagttacatggagctaagtttttctccaagctggacctaaaatctggttaccaccaggtgaggatcaaggaggaagacatacacaagacagcttttcgtacccacgagggccattacgagttcatggtaatgccttttggattgatgaatgccccttcaacttttcagagtttaatgaatgaagtgttcagaccttggttaagaaagtttgtattagttttctttgatgacatattggtctatagtaatgactggcagactcatttacaacacttagaggaagtgttgagacttttacaaacacatggcttggtggctaataaaaagaagtgtctatttggtcaaatgtcagtagaatatttgggccatttgatttctggagaaggagtagctgtggaccccagcaaggtaataagtgtgacaaattggcccatcccaaagaatgtgaagggagtgaaagggttcttagggctcacaggctattacagaaagttcataaaggattatgggaaaatagccaaacctttgactgaattcaccaagaaggatgcttttgtatggaattttgacaaagactttgtgattgagtgtgatgccgcaggtcatggaattggagctatccttatgcaagaaaagcgacccatagcttacttcagtaaggctttgggagttaggaaccttactaagtcagcatacgagaaggagttaatggcagtggtacttgccatacagcactggaggccctacttgctgggaagaaaatttattgtctctacggatcagaagagcttgaaacaattgctccaacaaagggtggttactgctgaacaacaaaactggtctgctaaactattgggctatgattttgagatagtttacaagccgggaaatcttaacagaggagcagatgcactttcaagggtgaatgaggaaggtggactatgtcagatacacactagaattcaatgggaacaggaagagatagtgaaaagggaggcggcaacagatcctcaacttcagcagataataaaagatttgcaaattgatgaaacatccaggcctgggtacgaatttagacaaggagtattattgtatgaagggaggttggtgctgtcaaaacattcaacattaagtcctagaatgttagaggaatttcataccactcctcaaggtgggcactccgggttttatagaacatacaggaggttggctgctaacttgtattggataggaatgaagaataccatccaagattttgtgaagggatgtgatgtgtgtcagcgacagaaatacatggccagttcaccaggagggttacttcaacccttgccaattccagaccgtatttgggaggatttatccatggatttcataactgggttgcctaagtctaaaggttatgaggcaatcttagtggtggtcgataggttatctaaatatgctcattttgttcccttaaagcatccgtacacagcaagagttattgcagaggtgtttgtcaaggaggtggtgagattacatggaatccctctatcaattgtgagtgatagagatcccatatttatgagcaatttttggcaagagttgttcaagcttcaggggactaaattgaaggttagtactgcttaccacccagagacagatgggcagacggaggtggtaaatcgttgcttagaaacatatctgagatgtttcattgctgaccaaccaaagacatggagtatgtggatggcttgggcagagtattggttcaatactagctttaatgttagcacaggtaaaactccttatgaagtagtatatggcagggtcccacctactcttacacgctgggtacaaggggagataagggtagaagcggtccaaagggagttactcgatcgtgatgaggcaataaagcagcttcgggaacagttgttgaaagcacaagacagaatgaaacagctggctgacagaaaaaggtgtgatagaagcttcgaggaaggggagtgggtatttgttaaattaagggctcaccggcagcaatctgtggttagtaggattcatgccaagctagcagctaggtattttgggccctaccccatcatagctcgtgtgggggcagtagcctataaactcaaattacctgatgggtctcgggtccacccggtgtttcatgtatctttattaaaaaaggcagtaggtaattaccatgaagaggacaaattgcccgagttggagggagaaggaggtgtgttgattgaacctgaagaagtacttgctagcaggattatacaagtgcaaggtgaaaaagtgaatcaggtactcataaggtggaaaggacagatggtagatgaagctacttgggaagacaagattgctatgagaagtcaattccctaatttctgccttgaggacaaggcagtactttctggagggagtattgatagaccccgtacacaaaaggaggagccaagtgaagccttagcccatcaccattccgctgtggaccctaaggtgtggtacgtttactctagaagaaagaagaatgttgccaatacaaatgacagttag

SEQ ID NO: 107103 - DNA, 303 bp, Glycine max
  Peptide Sequence Number=SeqID_223881
atggacgaacgaatcgctgcgttagaaggagaaatcaccggaattaaggcctccttgttgacgttggagcaaggtcaagcaactctcatagccatgtttgagaggagcttagacaagaagaaggaaggtgatgtcgtgttgatcgaaggaaccccggagtctggatcgggcccgagtaacgatgaggcgcaaatggagtttcgacaagccgttaaaaaagtcgagctacccatgttcgacggtggagatccggcgggatggatttctcgcgcaaaggtttatttcccgggtacaaggaacgag

SEQ ID NO: 107104 - DNA, 519 bp, Glycine max
  Peptide Sequence Number=SeqID_223882
atgacaccatttgaagtcacgtttggtcgtaaaccaccaacctttcctcaatacgtgacgggcacagccacggtggacgctgtggatgatctactcaatcaacgagaggtcatattcaccttgcttcgtcaaaagttactcaaggcccaaacacggatgaaggccattgtagacaggcatcgcagggatcacggatttcaaatagacgcagtggcagagcttcctcagttggcagtggacaatcaacttgtctccatgccattagctattttagctcataaaactatcccttcagagtcaggacccaagcatctcgtgttagttcagtggaaaggccttcatccggacgaaacttcttgggaagaatggacagccttccaagcaatacaccaccttgaggacaaggtattgtttgaaggtcgcgagaatgatatgaataggagagaaggggtgcatacagcaaggcccaagaggcaaagcatcacacatatgcacctaaaggattacgtgactacctaa

SEQ ID NO: 107105 - DNA, 3651 bp, Glycine max
  Peptide Sequence Number=SeqID_223883
atggcatatggaattgttagaaagctgttagtgcataggaggttccttgacctcgaactcaaggcattctctctctccactcaccgcaccaccacagacagattggaagaagccatttccatcctctccgagaagcattctgaactagctagcaaggtcaatgccatgtgcgaacgcttctcccacatgaataccgcgccacatccaccgtcgctgcactacgatcatcctcatcctccagtcaaacttgaagtccctcacttcgacgaccacgatccattaggttggatcttcaaaatttcccagtttttcgattaccagggaacgccggaagaagaccggatcactgtcgcctccttctaccttgacggagttgcactcaactggttccaatggatgttcaaaaatggtttcatcacatcgtggtcagctctccttcaagctatagagactcgttttgctccatcattttatgatgatccccgcggcacattattcaagctggttcaacgaggttctgtcactgagtacctcacggagtttgagaggttagcaaacagcatcgtcggtctctccccttccgtcttgttgagctattttatctctggtctcaacccggaaattcaccgtgaagacaagattaatgaccgccgaaaacactctcggacctcgtttccttccccacaacaaccagcttcagcaccatccactcaaacccaaacacctcgccctaagactcctttcatacagcgtactcaggaagagatgacctataggcgcgaaaagggcctctgctacaactatgatgagaaatggaacttatcacaccgtattaagggtcgagtcttgtttttcattgcagcctctaatgatctctccccctccgacatagctctgctggaaaactcaccacccctccctattgaaacccctccaccttttgaccccacacctcttcaccctcacatcagccttcatgcaatggctggcgtccctgcgactgacacgttccgtctttacggagttgtcaaccatgcttgcgtcacgattctggtggatagtggtagtacccacaacttcgtccaaccacgggttgcgaagtttctcaatataccaatggaatatatgatccccctccgagtaatggtgggcaatggttccgttctagactgccggcaggtctgctccgccaccaacttgctcatccaaggtcactcgttcaccgtgacattgcgcgtcttgccattaagtggcgccgatatcgtgttaggagtagaatggctacgtaccttgggcccaatcatcattgactatacttcctttaccatgcatttcactcacctgggccagcccgtcactcttcgtgccgatgttcagtccgatactgacccagtttcagcccaccaggtaaaacgtatgatccatactcattcaacttctgcactcttccatttgtcccttctaccagctcacaaaaccgaaccacccatagacctaccccatcccatttctgccattaatgagtttttactccgattcagctcgttattcgaacagctttcaacccttcccccacctcgccatcatgatcatcatatcaagctcgttccctccgctaatatcgttaatatccggccttatagatatcctcattttcagaaaactgaaatcgaaaaacaggttgattacagggcacttaaatccattacagtgagggatagatttccgcttctgaaaattgacgaacttcccaacgagctaggacgagcttcatggtactccaagctcgacttacgccaaggattccaccagatattaatggcggatgaaaagaagtttgcggcagtattctttgatgatatactcatctacaatgagtcccttccaaatcatcttcatcatttggaatgtgttttcaccttgttatcacaacctcaatattatcttaaacactttaaatgtctgtttggccagtgccaacttgattacttgggccacgtcgtctccaagaatggcgtacaacctgacccctctaagatacaagccattgtcgattggccaacaccacggtctttgagggatcttcgagcctttcttggccttacagggttctatcagaaatttgttaagggttacgcaacaatcgcagcacccttaacccgtttactttgtaaggatgcttttcaatgggtaccggaatcacaagatgccttcgccacgctgaagcatgcaatgacctccaccccaatgcttgctcttcctgacttctccctgccttttgcactggaaacaaatgcctcaggcaccgccatgggtgtttttcttcaacaacaaagtcaccctatcgcattctttagcaaaccattccgttcttgcatgcaacacgcttctacatacgtgcgcgagcttcatgctatcactgccgccatccacaagtggcgccagtatttgctcggccataagttcatcatcttcaccgatcatcgtagtctccacgacctcatgccccaggaccatccgcaattcacaattatcaacgaactcatctttttcaaagaagcaatttggatcaactcgtggaaccccttcattcccttattgttacatgaatatcatgccactcttctcagtggtcatttcggggtcaagaagaccttacatcgccttcgttctaatttccagtggtccaccatggtcacggacgttaagtccttcattcctcaattgcagcatctgtcaacaggtcaaacacatcacccgcaaagccgcaaggatctttcgatggattttatcacgcatctcccaagctctcacgggttcaccattatctttgttgtggtggacagattttctaagggtgtacatcttgatgcattacccactcagtttacggcattcaaagtggccaacttgttcctggatatcgtgtgtaagctccacggttttccccacaacatcatttcagattgtgacccagtgtttatcaactcattctggcatgaattattcaggctaagtggtacaaaatttcgtatgaccactacttaccatccacaatctaatggccagacgaaagtgatgaatcgcaccgttgaacaataccttcgatcgtttgtgcacaagaaacccgtggaatgctataagttcctcgccttagtagagtgggcgtataatacttcgcaacattctggcaccggcgtcaccccgtatgagatcacttacggcaagcctccaccctccattcccagttatatcttgggttcttctcgcaacgatgcggttgacacactattacgcacacgagcggatcttcccgatacctttcgacgtaagcttctcaaggcccatgataccatgaagcatttcgctgacaaaaagagaagagatgttcaatacgagattggacaaatgtggaacgcattggtagtgttgcatatcgtttacaactaccagagggatctcgaatccaccctatgttccattatggacctttcgactgacccaccaactcgacttgttctcgtacaatgggttggcctcgcccctgaggactctacgtgggaaaaatgggacgaagtttgtaatgctcatcaccttgaggacaaggaatatcacatgtctgaagcatctagaagactacgtgtaaactag

SEQ ID NO: 107106 - DNA, 1290 bp, Glycine max
  Peptide Sequence Number=SeqID_223884
atggacacatgtcaatggatgcggaaattaagggagaccggcaaagcatgcgaattaagaggccgaatgtgctatataaggattttgttaagaatgtacttcaacttcttactaatacaaaaagcctattatctcttcactaccgtagccttggtgatttcattgtcatcaatggctgagcacaacgaccgcacacgtcagtctcataccattggtggttcaaactcaaatggtggtactccaggttcatctaacgacattcctgttacttcaatcgcgacagtttctgcagttcgacacatttctttgggttttcctcactttgatggcaataccccagtcttggagtggatcttcaaagcagagaagttcttcaattatcataacactccaaatctggatcgagttgatattgcttcgattcatttcgagaaggatgtgattccctggtttcagatgttgcaacggatgcaagttgtgagcacctgggctgagttaacacgtgctttggaatcacaatttggtgcttcactgttcgattgtcccatggcagaattattcaaacttcaacaatctggtacaattgctgattattatttgaagtttatggcattagctaatagatctgaaggtttgactcctgaggctttgtgtaactattttattagtggattgaacaaagacattcgtagagatgttgttgctcaagctcctaataaattctcattcactcataagtgtcctaatagacaacttttattgctgcaaactgagagtgatgatgttgagcttgaatttcatgatagtaaagacataattgataatgtggctgataattcagaggtgattcttgaagatcatcacttatcactaaatgtattgaagggtggtaggggtgtaggcacaatcaggtttacggcctatattgataagcttccagttaaggttttggtggatggaggtagttcggacaattttttacagccgagagttgctaaattcctcaagttacttgtggaaccaacaccttcttttaaggtcatggtggggaatggaaattacatggttgccgaaggcgtggtcaacaagttgactatcaaggcccaaaatgccaagttccaattacctgtgtttttattacccatatcaggagttgatctcatcttgggatctagttggttgaaaactattggtcctcatattgcagactatgataagttgcaattgaagtttatgtatgatggtaagttcaccactttacaaggagaaactgacatgattcctgcctag

SEQ ID NO: 107107 - DNA, 543 bp, Glycine max
  Peptide Sequence Number=SeqID_223885
atgggtaagggctccttttccttctgtcactttgcctcccaccaccgacccaagaaaactgtcacactacccttgcttccatctccatcgcaacctctctatgcagctgaaatttttgtctcacctaacgacaataattgtctcttggttgctgctagcgcgttgacgaaagcaaagaaaaatattggtgacacccaattgtggataagatatgggtttgtgtgtggtgaagtgcaaagtagatctgggttcgtgaagtgcattgcaaatctaggtctttgtgtgtgtaatgaagtatctcatggaaaaccttccttggaatcacaagtgattattgaccaaaaaaggccagagattgagctcaacgaccttgacttgttgagttctgttgtgggtgaggaagatgtagatgtcggatggaaaagcttctatttgtccaacccaaccaagcacaacattgaaggtcttgcttttctcttttcgttgaaaacaactcttgttattatcttccatacttctgtttccaataacatagttgtatga

SEQ ID NO: 107108 - DNA, 783 bp, Glycine max
  Peptide Sequence Number=SeqID_223886
gacctcattgaagctcaaagatccagcctccatagaagccccacaagcaagcttccatcaaaagggctacacgtcctcgccttcagaggactacacgtcctcgccttcaaagggctacgcgccctcaccttcaaaggactatgcgccatctctttgagagggctacacgtcctcaccttcagagggctacacgtcctcaccttcatagggctacatgtcctcaccttcatagggctacacgccctcaccttcaaagggctgcacgccctcgtctttagaggactacgcatcctcactttcagagttctacacgtcctcaccttcatagggctacacgccctcaccttccgagggctgcacgccctcgcctttagaggactacacgtcctcacctttagagggctgcacgtcctcaccttcggaggactacacgtcctcaccttcagaggactatacgtcctcacctttagaggattacacgtcctcaccttcagagggctacacgccttcaccttaagagggctacacgccttcgccttcagagggctacatgctctcacctttagagcgctacacgccctcgccttcgtagggctacatgccctcgccttcaaaggactacatgtcctcgccttcaaagggctatacgccctcgccttcagaggactacacgtcctcgccttcagagggctgcacgccctcgccttcatagggttgcacgccctcaccttcataggactccacatgcacgcattcaaagaactcaagatccttcgcccttaa

SEQ ID NO: 107109 - DNA, 819 bp, Glycine max
  Peptide Sequence Number=SeqID_223887
atggcctcctctggacctgttttctccgggaccccaaccatcaccactgcaaagctgaactggaaaaactacccttcgtggtctgcttccgtggagttgtggttccttggtcaaggacaccatgaccacttggagaaaacctcagattctgtttcagatgataaaagacctgaatgggagaagcttgattatcaactgtgtgtcgtgttatggcaatcagttgagccggatatcttggaaatccttcgatcatttaaatcatgtcgttccttttggaagaaagcccaagaaatatttgccaatgatatccaaagtttgtttgatgcaaccgtgaaagttacagccctcaagcaaaccagtcatgacatgatcgctcatgtgggtaaggctcgagctgccgtggaagaactgagaaagttccttttagctgattcattagaagaagtgaataggaaacttgacaagttctacatggttcttattttgagaaacttgcattcagactttgatcatgtgcatgatcaagtacttgctggagacaagattccatcgatggattccctcatcactaggcttcttcgcgtgcctcatttattgaaggatgagaatcctactgatggagtggagacgtcagccatggttgcgtctcgaggaagaggaagtagccgcaacaatagaggaggtcgcagtggaaggggtgaacgtcctcattgcacttattgcaagaggatgggtcacacccaagaggaatttttattcgttgcatgggtttcccgacaaggtcgcacatgtctctcgttcagagaaagcagagtttag

SEQ ID NO: 107110 - DNA, 324 bp, Glycine max
  Peptide Sequence Number=SeqID_223888
atggctatggctgtttggagtgatggtcggaggcctggagatgctgaaattgtttatgcatcaacagagaaagcggaaagagaacttaattggaattatgctaagactcaagcctatatgcaatgtggtaccatgtcagtgaaaaacctcgtcgggcgcctaggagtacatgacaagacaaaccacacaatatgttttgcgagaatgctccaaccatatgtgatcaacataggcttaaaggagcactcaaaccgtgtgactcccaaggcctacactccgaagagtccgtcagggcctctccttcctgattcaggtccaacctag

SEQ ID NO: 107111 - DNA, 405 bp, Glycine max
  Peptide Sequence Number=SeqID_223889
atgccagagcataccactcgccagacatcacttgagcgtctcaaggaagctgttaataagctcacccaaagccaagccactttaactcaaaaccaccaaactctatcccaagcccacaatgccttgaacaacaaattagattcaatgttggatcgtcttgctactctcacctttgcccttttttctcctaaaccgcctccttctccaccaccattatcccctaccagaccacacatgaaactcgatgtatcacgttttgatgggcaagacccactgggttggatctttaaaatatcacaattctttgattaccagtgcattcccgacgccaagagactcactattgtttccttttacatggaaggccctaccctttgctggttccagtggatgtcgaggaactga

SEQ ID NO: 107112 - DNA, 486 bp, Glycine max
  Peptide Sequence Number=SeqID_223890
atgagacctgatgaagaagggttgttggatttcaaagttagaggaggagcagttcctaatggaggagtttgtgaaggcttcgatggtggtagttacactagtgatggtggaggttgtgaaggctttgttagtggtggtagcacaagtgagggtggagggtatgttaggagtggagaaggtgctaatgggcattgttatgtacagcagcctatcccatcgcccccccttgcaaacaactatggaaatgggaatatgagcatgcaacatttaggcgcttctttcgactcggctcagttcaaaagtgttcaaataatttttacctatgaaatggttatggaaatgaccaatgcattttctaatcaaaagcttattggggaaggagggtttgggtgtgtttacaaaggttgggtgccagatggaaaaacagttgcagtaaagcagcttaaggctggcagtggacagggagaaagggaattgaaggcttaa

SEQ ID NO: 107113 - DNA, 663 bp, Glycine max
  Peptide Sequence Number=SeqID_223891
atggagaagatggagtgtcatctccatgattaccagctccgcgacctcggccccgctgccaagatcctcaccctcaacctctcgtccaggaagaatgtatgtgttagcccgcgggttctcgccgctgagaatcgtgactccgtggacgtcgatgccggaaggtcgggtcatccgccgttctggctcttggggtttatacatcgcaaacgtggtcatggtggaccccatgggccctaccgtggtggcggcagcagacatggtcatcgtggaggttttagcaatggtgaagctggtgatgaaggacgtccaagaagagcatttaaactccacagtgggactggacgaggaaatgaattcaaacgggaagggtttggacgagggaactggggtacacagaatgatgacattgcagaggtgattgaggaagtggtaaatgaaactgaaaagattcttgctgatgagaagcgtataggagaggaagatgcagcagaaggaaacaaggacagtcctgctaatgaaaatgaagaaaaggagtctgaggacaaggctcagaaaactgaagcaagaaagttggacatcaaggaatttgcatccatgaagggatctgacaaggataagcacaaagatgctttggagaaggaggagaaatccaagaaagtgtga

SEQ ID NO: 107114 - DNA, 210 bp, Glycine max
  Peptide Sequence Number=SeqID_223892
atgtggtaccattttccagtgaaaaacctcgtcgggcgcctaggagtacatgacaggacatgcctcacaatggggagaccagtcagggtcacgctgttttgcgagaatgctccaaccatgtgggatcggcataggcttacaggagcactcaaaccggatgacccccaaggcctacactccgaagagtccgtcagggcctctccctcctga

SEQ ID NO: 107115 - DNA, 159 bp, Glycine max
  Peptide Sequence Number=SeqID_223893
atggataagtctctcataactgttgaactgaacaagctttggatgcataagttgctacaggaaatggatacgtacaccaggaatctcccaaggagcctggtatcaaagataggtgacagggggttcacaatagttcatgcaccctactcaaccaactaa

SEQ ID NO: 107116 - DNA, 495 bp, Glycine max
  Peptide Sequence Number=SeqID_223894
atgacacttctcaagtttacgaacttcaacgacatgttacttgcttgcgccaaagcggcatatgcccatgttgattgtgaggcacttcgacaagttgtcatgaccaccaatgacataaagcatgtcttcgaagctatcatagccaacaaaagtgttacatatcatccaactaacccattctctggtgagccttccactggttctccaaaatccactattggctctaaaacttgcaagttgattggatatccagattggtggcatgaacttcaagcttggaagaaacgagatacaactaatattggatggaatataagtcaagcaactttggtggttgttgaacctcatctttccttgatcccaccaaattgttcatccaaagaaagagactttgagttaggtaacattggcttcacccttgttaccttatctttagatagtgatcatggtgcttggctattggattatcgggccattaatcacatgacatttgat

SEQ ID NO: 107117 - DNA, 318 bp, Glycine max
  Peptide Sequence Number=SeqID_223895
atgacgtcgaagcggcacagtagatggcagagcaggctgcgatgtcaacacggagggcacaggagatggcggagtgggttgctagctagggcgcatacaagtcgttgttggggcactggcactggccaaccgtccatacgccgtcgtttgggtagacccctcccaaaattctccaccaatggcacggttgatgttagaattctgattaaattgacactcacgatcatccaccagatagatatgaaactcttgctaacggtgttccatatggtgcgccaccacgcaataccggatacagaccagggacgaaagtattaa

SEQ ID NO: 107118 - DNA, 3773 bp, Glycine max
  Peptide Sequence Number=SeqID_223896
atggaaggcataataatattaatgatgttgcaggttgttgtttctgctcaagaccatattatgtgcattcagactgagagggaagcactcctccaattcaaggctgcccttgtggatgactatggcatgctctcttcttggaccacttctgattgctgccaatggcaagggattcgctgctccaacctcaccggccatgttctaatgctcgaccttcacggtcagcttagattttcacatgccttcgctgatgatatcactgatattggctggcaacgttatatgagaggagacatccacaagtcgttgatggagttgcaacaattaaagtatttaaacctcagttggaattcttttcaaggcagaggaatcccagagtttcttggttctctcaccaacttgagataccttgatctggaatattgtcgttttggcggaaaaattccaactcagtttggctctctttctcatttgaaatacttaaatcttgctttgaattctctggagggttcaatccctcgtcaacttggaaatctctcccagttgcagcatcttgatctcagcgccaatcattttgaaggaaatataccctctcaaattggaaatctctcccagttgctgcatcttgatctcagctacaattcttttgaaggaagtataccgtcccaacttgggaacctttcaaatttgcagaagctttatcttggaggatcacattattatgatgatgcttatggtggtgctctcaaaattgacgatggagatcattgggtgtctaatctcatttctttaacccatctttccttggtcttcatatctaatctcaacacttctcatagcttcctccaaatgattgccaagctaccaacacttagagaactgagtttaagtgaatgtagcctttccgatcagtttatcctttcattgaggccctccaaattcaatttttctagttccctttccatccttgatctttcctggaacagcttcacgtcatcaatgatactccagtggctgtccaacgtcacttccaaccttgttgagcttcaccttagttataacctcttggagggttccacatcatcaaatcattttggcattgtcttgaattcacttcagcaccttgaccttagttataacctcttggagggttccacatcatcaaatcattttggcattgtcttgaattcacttcagcaccttgaccttagtcataacctcttggagggttccatatcaaaccattttggccgtgtaatgaattctcttgagcacctcgacctctcatataatatattcaagggtgaggatttcaaatccttcgcgaatatatgcaccttacattctttatacatgccagcaaaccttttgactgaagaccttccatcaatccttcataatttgtctagtggttgtgttagacactcattacaagatttggatttgtcagataatcaaatcaccggctctttacccgacctttcagtattctcatctctaagatcattgtttcttgatggaaataaattaagtggaaagatacctgaaggcatccgcttaccatttcatttgaaatctctgtcaatccaatcaaactctttagaaggtggaattcccaaatcatttgggaactcatgtgctttgagctcactggatatgtctggtaacaatttgaataaagagctttcggtgataattcatcaattgtctgggtgtgccagattctcgctgcaagaattgaacataggaggaaatcaaatcaatggtacgctttctgagctttcaatattctctgccttgaaaacattggatctttcagaaaatcaattaaatggaaaaattccagagagtaccaaattgccatctctgttagagtctttgtcaattggatcaaactctttagaaggtggaattcccaaatcatttggggatgcatgtgctttgtgctcattggacatgtctaataatagcttgagtgaagagtttccaatgataatccatcacttgtctggatgtgctagatattcattggaaagattagatctaggcatgaatcaaatcaacggcacactacccgacctctcaatattctcatctttaagagaattaaatcttgatggaaacaagctatatggagagattcctaaagattataaatttccacctcaactggagagactagatatgcaatcaaatttcttaaagggtgtgctcactgactatcatttcgctaatatgtcaaaattagacatattggagttatctgacaactctttagtgaccttggcatttagccaaaattgggtcccaccatttcagttgcgcttcataggattgcgatcctgccagctaggtccagtatttcccaaatggttgaagacacaaaatcaatttcagggtattgacatttcaaatgctggaatagcagatatggttccaaagtggttttgggataatttagcattccgagaatggatttcaatgaatatttcatacaataatctccatggtataattccaaattttccaataaggaatattcaacattccctaattcttggatcaaatcaatttgacggccctattccaccatttctgcgaggtttcctgtttcttgatttatccaaaaataaattctcagattctctttcatttttatgtgtgaatgttaaagttgaaactttgtaccaattagacctttcaaataatcgtttctctggaaaaattccggactgttggagccatttcaagtcattaatttatttggacttaagtcacaataatttttcaggaaggatacccacatccatgggatctcttcttcagcttcaagcattgctattgagaaacaacaacttaacagatgagatacctttctccttgaggagttgtacaaatctagtaatgctagatattgcagaaaacagattatcagggcttatccctgcttggattgggagcgaattacaagagttgcaatttttaagtttgggaagaaataatttccatggaagtttaccattgccaatttgctacctaagcgacattcaactcttggatgtctcactaaacagcatgtctgggcaaattcctaaatgcataaaaaattttacttcaatgactcaaaagacatcttcacaaggtcattcatattatgtcaatgacaatggcttgattactaatcaaacatatgatttgaatgcattcttgatgtggaaaggttcagaacaaatgttcaaaaataatgggttactacttctaaaaagcattgatctctcaagcaatcacttttctggagaaattccactggaaatagagaatttatttggattggtttcattgaatttatcaagaaaccatttgaccggagcgattccttcaaatattggaaagttaacatcacttgactttcttgatttgtcaagaaaccatctaattggttcaattccatggagtcttactcaaattgatcgactcggcgtgttagatttgtcacataacaatctatctggagaaattccaactggtacacaattacagggtttcaatgcctcatgttatgaagataatcttgatctttgtggaccgccactagagaaattgtgtattgatgggaagcctgcacaggaaccaattgttaaacttcctgaagatgaaaaattgctcttcacccgtgaattttacatgagcatggcaattggatttgttataagcttctggggcgtctttggctcaatcttaataaagcgttcttggagacatgcttatttcaa

SEQ ID NO: 107119 - DNA, 1551 bp, Glycine max
  Peptide Sequence Number=SeqID_223897
atgtcggcagtgaagaagtggcgccaatatctccttggccaccacttcactattattacagaccatcgtagcttgaaggaattagtgaatcaggctgcagatgccttgtctcgcttaccggaacaggaccacgtgactctcatggttctctctgtgctatgtctgacatttctcgatgaacttcgtgctcagatttttccacgtggcttgccactcgctaccacgctcctcactgaatttcatgctactcccacgggtgggcatgctggaattgcaaagacaactgctcgtttatcggaaaattttgcttggccgggccttcgagatgatgtcgcccaatatgtcagtcactgtgcagattgccaagttaccaaatatgaagctaagcgcctcgccggactcttatgtcctcttccggtcccattccgaccatgggaggacctgtcccttgactttattaccggcctttctcactatcgcggcaactctgtcattctcgtcatggtcgatcgtttctctaaggggattcatctgggcatgttgcccacatcccatactgcttcctcagtggcctccctctttgttgacattgtcgtgaagatccatggctttccacgcagcctcgtctcggacagagacccccttttcgtcagccaattctggcaggccttgtttcgcacgagtggcacccaactgcggctcagctccacctatcaccctcagagtgatggccagacagaaacgaccaggtcagtggggcaagctcctgccatgggtagaatggtcccacaattccagttggaatgcaggaacatgcttgatgttgttgattccatcttggtcgagagagatgtcgtcattcaagcaattcgcaggaaactcctgaaagcacaagaatgcatgaaaaggtacgcagaccagaagcgtagggacgtggattttaattgtggagagtgggtcctggtcaaactacgcccacatcggcagacttcggccaagggatctcaacatacctccggcaagctatccaaacgtttttatggtccatttcggatattggagaggattggtccagtggcgtatcgactgcacctaccggaaggggcttgcattcaccctgtctatcatgtttctgccttaaagcaattcaaagggccaccagacagggcaatcatggacttgctagacgactttgagggtgaccaaccactcatatttcccattgccattttgaactctcgtcgaaaggattcaactccgaatgctccctgggaggtgttaatgcaatggcgtggtttattgcctgaagagacatccagggagaattggtcccaattatgccaggactttcaccttgaggacaaggtgactctgcaaaggccaggggatgatacagaagcaggggtagaacagggaaaagggacagcaatagcaaatcaggagggaaacatagaagcagggagcaagcctagggatgaatcttgcttgaaggattggagctgtcgacctcagggaagcactgcaccaattctgttaggattgttaggataa

SEQ ID NO: 107120 - DNA, 514 bp, Glycine max
  Peptide Sequence Number=SeqID_223898
atgggtgaagtagaggaggcacaagagcagatgaaggccgacatggagggcatgaaagaggctgttgctaaggtgaatccgatgccctcatctggcctcaaccaaataaatcatccaacctcagctatggtaggcaaagatttgggaattggtggtatacccttgcaaaacactttggagggacctcagtatcacccacaaccacaccccttgcattccacaccgggtaaaaaccatcatgctatggcagaaatgggaaagatggatcatctaaaggaaaggctcagggccatcgaaggaggtgaagattatgcctttgctagcctagaagagttgttcctagtatccaatatcatcacccctcccaatttcaagatgccagactttgacaagtacaaagggaataattgccctaagagccatctaaagatgtgttgtcaaaagatgggggcatacgcaaaagatgaggaactgttgatacatttcttccaagaaagtcttactggagtagctg

SEQ ID NO: 107121 - DNA, 682 bp, Glycine max
  Peptide Sequence Number=SeqID_223899
cgcggaaccgacccagccagaggtgcaggattcggcggtggtgacgctcaggccggcggccaccgaattaaactgttaccgaagctcccggcgtttaccgctaagcttaaaattcaggacgaagaggaaataaccgtagcgataagatgtcagctaattaactgcaagaggaataacaccatgaagaaagatgagttagccagccgtgattatccggtgcaggaggatatgcgctggcaacgcagggagagcgttatacagcgtatcggtgaatacgtgctaatggtgattgtgatcctgggtgcctgcgggctgttttccaaaggcatattaagcgacgggcaggcgcagtcggctgatggttccgtcagcattcgctatgaacgttttggtcgcatcgacagcaatatgaacctgcggattcgcgtggcaccgcagagcggcgagcgtttcaccgtcacgctaggcagcggcgcgttagacgatttgcagatccagacgctacagccacagccacagcaggccatcacgcgggataacacgctgcagcttacttacgccagcgaggcggcagaagccgcaggcggcgggacgggttgcgctgagcgtgcacgtcaatcatcaggtaccggtaaaggtatcgcagtggatttacccataaaaggagagcgttatggaaacg

SEQ ID NO: 107122 - DNA, 276 bp, Glycine max
  Peptide Sequence Number=SeqID_223900
atggcaatagtcccccacactgagcccgttgatgtacaaatcggagatcgtatagaagacaagatacgcgatcttggacaagagggttttcgccaagcacatgcaccttattatgataatttacaaagtgattctaagcagtcattgtattcgggatgcacaaccttcacatggttatcggcggtgttagctttggtgaactcgaaggcaagatttggctggagtgacaaaagcttcattgaattgcttttttttattgaagaatatgcttcctaa

SEQ ID NO: 107123 - DNA, 327 bp, Glycine max
  Peptide Sequence Number=SeqID_223901
atggataccttagagccctacactagggcaatgaaagacaccatacgtgagcctcaggcgaacctaggggcagtacctattgcctttagagggctacacgccctcgccttcagaggactacacatcctcgccttcagagggctacacaccctcgcctttagagggctacaggtcctcaccttcggagggttacacgccctcgccttcagagggctgcatgctctcaccttcagagggttaacgtcctcgcctttagagggctgcaagcccttgccttcagagggctccacatccgcgcctttagaactcaaggtcttctgcccttaa

SEQ ID NO: 107124 - DNA, 135 bp, Glycine max
  Peptide Sequence Number=SeqID_223902
atgacgcatggtcaaccagcaggcgaccaagtccaaagccaaagtaggacacgcctagttgctcatgatcctaggaatttaaataaaacaagcacaagctcggaaggtagaaagataccttggatatgcatgtag

SEQ ID NO: 107125 - DNA, 1296 bp, Glycine max
  Peptide Sequence Number=SeqID_223903
atggaagaggatgaagagacgcagcaacgagtcactgactcgtccctctccaccgagtcacgcacttccactccttctgatggagcgccacccaactcggaaaccctagttcaccgctcctcgcttccgcatgaccttgccactcatatgcagggcagctctaccgcacataaaggtggaaaagctgagagtaaggtgtcagctcagcctcctgatgaggaaactattgaaaaagatgcagttgaggcacctcaaaaacagacagaaaatcaacttcagtctgtttgttcaacttcattatctgaactatcaccaacttctgtttcacattctttatcatctgcccttagtcccactgtatcacaacagagaccatctcctcccaaggctaatagtgtacaagtgtcgaaaggagacaaaggaacaccttctgatggtacaaccttatcttctgtttctgctgtaagggcatctgcatctgatggatacaactggcggaagtacggccagaagcaagtgaagaatcctatgggttctcgaagctattacaagtgtacccattcaaattgttgtgctaagaagattaaattttgtgaccattcaggacatgtgatagagattgtttataaaagtcaacataatcatgatcctccgcataaaattgataccaccaaggaaagtaagctcctgccttccagtgaacctaaagaagaaagcagtgttccaaagcagtctaccaaagttctgaataattctgatccatcatcttctccgaaagaacctttgcaagaagcaccctgcaatggtgataagaatctagaaaactcatctaatgttgagaatgtaaaacatggcaagaaaccaaagtttgttgtacatgcgacagaggatgtggggatatcaggtgatggataccggtggcgcaagtatggacaaaagttggtgaagggaaatccacatttcagaaactactacagatgcacttcttctggatgtcctgtccgaaagcacattgagactgctgtggataattcaaaagctctcatcataacatacaagggagtgcatgatcatgacatgcctgtacccaagaaacgacatggcccgcctagtgcttcacttgtggctgcggcagcacctgcttcaatgaacaatgtgcagttcaaaaaaactggcttgctgcaaagccaggaaactgaagctcaatgttcagaggacacagaaggagaattgatgggggaagcgatggaccttgaggcagttatatttgcttgtacacatgttcagcttgtctga

SEQ ID NO: 107126 - DNA, 846 bp, Glycine max
  Peptide Sequence Number=SeqID_223904
atggaacatttcttagtctcaattatgcaaaggactcatctagttttgataattctttatcaaatctcagatgattcaactaaaagtgtccacaacaaggttatcactcagatcacaaggtcatatactgcactgatctcagaagtggaaccaaaacacatagacgaggccatgcaagacgataattgggtgaaggatatgcaagaggagctcaaccaattccaaaagaatgatgttgggaaagttagtagagctaccaaaggacaagaagactattggaaccaagtggtcttcctaacaagttggatgagaatgatatggttcgcattcctcaatggactcatccaagaggaagtttatgttgaacaacctactgggtttgagagtgacactcttccttaccatcaaacaagcaatggaatttacattcaccaaaccaagtatgtgaaaaaacttctaaagaagttcaacatggacaatgaaaaagagatgaagacacctatgcatccaaccacataccttggattggacaaagaatctaaaaaggaggacgggacccaatacaaagcaatgattggatcactgctataccttacaacatccaaacctgatttaatattcggtgtttgcttatgtgcaaggttccaaaaagaaccaagggaagttcatttatcttctactaaatgcatttttagatatcttattggaacttctaaccttggtctatgctttaagagaaggacaatttcagactcacaagttactgtggtgctgactatgtgggagataagcttgaaaggaagagaactagtggaagttgtcacttcattggtggcaacttggtaa

SEQ ID NO: 107127 - DNA, 345 bp, Glycine max
  Peptide Sequence Number=SeqID_223905
atggatgacaacattgttaatgaggaatctgcgtccaagcaattagaaacctcacatgaagctacacccaatgaaaaggatgtgcctgatgtagtgatcatctactccacaagcttaagtcacacgcctatcaactatgcacctccaaacattgggaccaaaggtcaagttcaagagatgattggtcaagcaatggacacgtttgttgaacgccaaagacaagagaatgagaaactcaaactctatgcaaaacactatcaacactcaactcaccaatcttggtgctgcattgattcagaacttgcaacaagctcagtgtatgataacaaagatataaattcttga

SEQ ID NO: 107128 - DNA, 777 bp, Glycine max
  Peptide Sequence Number=SeqID_223906
atgattgaaaagttagcctcagcactagtaaatgcatcgagacggctccaacaatacttccaagggaaccaagtggtggtgcacacagattacccaatagccaaagttttgcgaaaacccaagttggctagaagaatggtggcatggccaatagaactatcaaagttcagcatcggatatgaaccaagggggcctatcaaagctcaatggctgaccaacttcataagtgagctacacccgttgactctaatcacaaaactatctgggcagtgggctagagtcatactagaaggactaggagagctcaaacatatcgtgagtgattacaattccaaggatgatgaactcactaagctagcaagcaccaagaaaccaaggcaacaccatactatcattaagcacaccttcttagacttgagtattagtggaaaagagtgcaaggaagtaacaatagaacaagctgagtggatggcacccattttagcttacctaaaagaaggcatattgctggagaacaaaaaagaagcacaaaaattaaaaatccaggaagcaaggtacactaccattgctggggagttgtataggaagggattctcggcaacccttttaagttccttgcaaaggcataatcaaaatacatcttggaggagatccaaaaggtatatgtgggatgcatttaggagggagatcaatggcaactcgtgtcctataggccaggtactattggccaacacacttcctattttccttaggatcataagaatcaagattcagtag

SEQ ID NO: 107129 - DNA, 510 bp, Glycine max
  Peptide Sequence Number=SeqID_223907
atgtgtttcacggatatttcacccgaggaactcgtttctcatcgcaatcacgatctttgttactactgtgatgagtgtttcaccaccggccaccactacgaaggtcgttttcttgttctcttagccaacaaagataacacctgtgatgactttgtccctctacttacttcccatgctgaacctggtcccatgatcatcgaggacaccaccactagtcctatcattagctttaatgctatttacaacatgcctgcatcggagaccttccgtttatatggccatatcgtcagttctagggttaccatcttggtcgacagtgagagtactcataatttcgttcaaaccaagtggcaaaatatctcaaccttcccacgatggcaaccaatacccttcaagtcatggtcattgaattcaatcactgttaaggactactttccaatgcccaccatcgataagctattggatgatcttggtggtgcctcttggttctctaagcttgacctccgataa

SEQ ID NO: 107130 - DNA, 225 bp, Glycine max
  Peptide Sequence Number=SeqID_223908
atgactgggccccttagtaatcctcgtgggcctagtgtgctaggctgtgttgctaccaatttcctcctctgggagatacaccttgtcctcaaggtgaaaaccaaagttaatgtcatctcatttctcccaactggtgtcttgagaattgctaaaggttcgaccaaaggattatcatttgatgaagtaggaagaaaagaatacaaaaaggatggcaagggtccttga

SEQ ID NO: 107131 - DNA, 300 bp, Glycine max
  Peptide Sequence Number=SeqID_223909
atggcaatcaattcatggggctccgaacaagatttgatggtggaggatgcacgaacagcgctaggcaatcaattcgtggggctcggacttgatggtggaggatgcatgaatggcaatcaattcatggggatccgaataagatttgatggtggaggacacacgaacaatgctaggaaatcaattcgtggggctccagactcgatggcaatcaattcgtggggctccggactcgatgggggaggatgcatgaatggaaatcaattcatgggactccaaacaacatttgatggtggaggatga

SEQ ID NO: 107132 - DNA, 252 bp, Glycine max
  Peptide Sequence Number=SeqID_223910
atgcctatctataggcaaagggtcacttttgggcagtcacaactcgcccaggtcgacaaaagcggggctcttgctcctacgtaccctccatcaaagaggaaatcagacctacgtagttctttccaaaggggcgaatcaagtgattcttttttacttggaaggtggtcattaaaggcgttggaccttaaaatgatccatttttacttggtgagaaaagctgaggcgttggatctcaaaacgttttttcagtga

SEQ ID NO: 107133 - DNA, 156 bp, Glycine max
  Peptide Sequence Number=SeqID_223911
atggcttctatgaaaatttgcattctggcagagcatcagcaacaaagtcgcgcgctaagcgcgagatcacttctacacactcgtacagaacaaccagggcacagaattccagagcaaccgcaggcctatttcaggaaaagagccctagaagcataa

SEQ ID NO: 107134 - DNA, 186 bp, Glycine max
  Peptide Sequence Number=SeqID_223912
atgaagcaaaggagggtaaagcgcaagaaggcgcgcttagcaatgacagtagctctgattggtctgcaaaatgcgcttagcctacgaagttgggcttaccgtgcaactaggcttccacttataaagagtgacccaggcttagtgcctctacatgcgctaagcgcacttccaatggtttcaaaatag

SEQ ID NO: 107135 - DNA, 1059 bp, Glycine max
  Peptide Sequence Number=SeqID_223913
atggattttgtgagccaaaggcacctactgcattctatgcaacaagctcattccccgtgcacaactccccttagtgatgtgactaatccttctccatataattattccttcttagtaatccttgtgattggaatgatgtttacagctttcttccttataggctactacatattagttgtcaagtgctgcctcaattggccccatgttgatcatgtaagaattttttctctatctaggtctcatgaagacccatctgcaccatactcaacagcatctgagcctagagggctagaggaagcagtgatcaaattaattccagtgattcaatttaagccagaagaaggtgaaagaagctttagtgagtgttcagtttgcttgagtgagtttcagcaagacgagaagctgagggttataccaaactgtagccatgtctttcacattgattgcatagatgtttggcttcagaacaatgcttattgccctctttgtagaagaactgtttccttgacaagccaagtccaccatcatgtagaccaagtcaaccttcttctcactccaaggctttcccctcaaggtcaaagccaaaacaatgaaaacctcattggtgctgctgaggatgaaggaggttttgttgtgattgatttggatggtgaacatgatagagaccaaaacttgcaagaaagacaagagttaccaacatgtcgtattattagtctttcttcacaaatgaagctattggaggagaagaaagcaaggaagcttcaaaaagtgacaagtttgggagatgagtgtataggtgttagatccaaagatgaaaggttatcagttcaagccatgagaaggtccttttccatggactcatcggtggatagaaagttttatgaggcagttcaagaggctttacaacaaccacaacaacaaaatgggaatgttcttgaggtcagcacaattgaagcttgtgatggtagtggtagagttaagagatcattcttttcttttggacatggaagcagatcaagaagtgctgtactacctgagacccctgatttttttatttaa

SEQ ID NO: 107136 - DNA, 969 bp, Glycine max
  Peptide Sequence Number=SeqID_223914
atgtgtgacgtaagcgattacgcagttggtgttgttttggggcaacagaaggagaaagtatttcactccatatactatgcgagtaaagtcctgaatggtgcacagttgaactatgccaccatagaaaaagagttacttgctattgtatatgctctggaaaaatttagatcctatttggtgggatctcgaatggttgtattcaatgatcatgcagccataaaataccttatcacaaaggaagactccaaaccaagactcatcagatggatactactactccaagagtttgacctcgtgattaaagctaagaaagggtcagagaatttagtggctgatcacttgtcaaggttgattaatgaagaagtgactcgagaaaagctggaaatccgtgatgattccctgatgagatctgaattggcattagagaaaaaaaattccttcatgatgcacatttttaagattggagcagacaacttgttgaggaggtgcatgaccagagaagaggccagaagtatattgtggcactgttataattctccctatggaggtcattacagtggggataaaacaactgcaaagcgaaccagaggtatatcccgaagaaatgagatgccccttcagaatataatcaaagtggaagtttttgactgctggggtattgacttcatcgatccccttccatcatcttataggaatgaatatattctggtggttgtggattacgtctctaaatgggtggaggctgtagctacttctaagaatgatgccaagatggctcatacttttgcaatgtccaattgcagaaggtattggggcattataatgtcactcacaaggtggcttcaccttatcatccctaaaccaatggtcaggattgtctcctttccagatggtctatcagaaggcttgtcatctgttagtagagatagagcacaaggcttattaggcacggagattcctgaattttga

SEQ ID NO: 107137 - DNA, 339 bp, Glycine max
  Peptide Sequence Number=SeqID_223915
atgaaatatgtgttcttggaagagaatgaagcaaagccagcggtgattagcaatgacttgtcctctaatgaaaagttcaggctggtcgaagttctcaagaagcacaaggcagccattggatggcatatcttaggcctcaagggaattagcccttcgtattgcatgcataaaattatgatggaaactgactataagcatgcttgggtgagctcagtgcaggtaatccccaagaaaggtgggatgattgtgaaaagaccatgtccctctaccattcatggaccagatgctcaagaggaggatgccatttgggctatgcaacgctccagccacattttagag

SEQ ID NO: 107138 - DNA, 720 bp, Glycine max
  Peptide Sequence Number=SeqID_223916
atggaaagatcagtggttcatgtggatcctacccctgggaaaattgatggtccccatagaaagaaattaaggacgtatttgggaattgtcgctcgagacaaggctaaatttgatattctagaagcgtttgaccaaaggaccaagaagaaaatccttaaggcgagtcagtatcacgatcaaacaatactttggaccgacttcaaaaagctcccagacatctatgcctatcactcccaaagagctggagcaactgacacaaaaatcagggaccaactggaggagtcgataactgaaaaaggactcgtactgcctcctgagtctgaggttggtccttctgttgcccgtgtcaacataaagggaggttgtgttgatccctcaaggaaagatccaaacatgggtgaattagacaatttaaaggggttaacaactgtctacaacatccttttgggaaatgatcaagtgaaggtcggtgttgaggaagggactgagggaccaacgaaacctgtagataggctggaacctgatgatgatcccctataccagatgacattgacgatctcagagcttttcctcaagcctatgcaggtgtcgtgggattcaactgggtttggggtttataatgatggcatccccttgtacataaagcatgaagatttttctgaaatagcacacaatggtcaatgtctcaacatctctatgatacaaatgtggattctataa

SEQ ID NO: 107139 - DNA, 495 bp, Glycine max
  Peptide Sequence Number=SeqID_223917
atgtcatttaggacttatgagaaagcttggattgtgctagagagaaagacaaatgaccaaagtgaacaaagagccatttctagggcaaatttgggtgttgaagagtcaaattttgattcggaattgatttgggcaagattggatgagaggaagggtgcagcagaatcttggcttgtgcagaaaagtgcttatgtgtggttggctgtggaaagagtagtgcagaatgagttctggatgattgctagtagatcccaacggtcacaatgtaggcttatgtactatagacctccacttgtgctgtttgaatgttgttttgcttggatgttgtggaagcttgggaggattgatggggacccggtattgagagaaacgaggatatgggctacgtgggagtacgtgagctcagatggaggtgggcaacaggggatggtgggtttatgcgcgcattgtggatgtggaaaacttgttgtgcaccatcgcccgaccgccacctag

SEQ ID NO: 107140 - DNA, 405 bp, Glycine max
  Peptide Sequence Number=SeqID_223918
atgtcaactcaaagggaaatcacagagagcggagctatgaggaaacgaatgaaacctgaggtggtagaaaaggtaggagatgaaacaaaatcaaagactatagaggaggaagaatttgaggcgaacattgctggatctgaagaaatggaactcagtatctctcttattcttgagaagattgagaattatactcagatggtatatgagctcctagaatcaggaaaaacaatgttgaaggagctaaccaatgcatttgaagggaaactgattatgattcacaaggagcaagtggaaaaatggcaagaagaaatcagagaattgtgtgcactcgatgcctcaaatgaagaagccaatgctcttctgcttaatgctcgatatcttcttcagcccacttgtgatcattag

SEQ ID NO: 107141 - DNA, 624 bp, Glycine max
  Peptide Sequence Number=SeqID_223919
atggctatagagaggagatcagatcaaggcaagatagtcattgataagcttgttctgtatcagaagaccaattgctacaaaggcaaggagttgctgattgaagatgatgaagatgcttcaccaatcagatttgaatgctgctttagtttaaaacctgatgagaagccacttgcagatgcggttcaccatgaagttggacaatactatcagaccctgaaccatacttgtttcacccaagaaacatcattcaacatgtctcctttgcctacaaatgctagagctcatggtcgtgacatgattggccaaaaattgcacaagggaatagaagggcagaattttcttaagggattggtgaaggcaaaatcttctccggccattgctttatgtgcaaactttgttatatataatggggtggttaacggtttcaaagttgccatggtcgagctgaaacatgatcctatgatggctaactatgatgccggtgttattagtgatgaacctgcaacctgtgagagagcattagctgatgaacgtactgttgaccctgcaatctctgctgttaacaatcatataacgttgcttagcgccgttgcaccctacgccatagataaagttactgcgtag

SEQ ID NO: 107142 - DNA, 234 bp, Glycine max
  Peptide Sequence Number=SeqID_223920
atgatatggttcagagatcctgctattctagtagttgtcgccaaagttagggtgcaggaggtgcttggcgacgatgatggagtggacctcggtaccaaagccctaagcctacttctaacaacaatccatgagcatgatgttggggaagtcgaggaagttcttgacacgatcacaagtagaatgctaagcagggggaaggggaaaggcttgggttgggcctacctatcccgatag

SEQ ID NO: 107143 - DNA, 267 bp, Glycine max
  Peptide Sequence Number=SeqID_223921
atgagtccagcgaactctaaattcttgtgctctggacttcttgatttagcgaacagatattactcctccttcaacagttatgtaccatatttgccccccaatgtcagagctagcctcctgtctgactcaaggatgcgttgttttgcctatgagccagaagtttgcaaactagtgtattgttacatagatgaccaagctcaggtcttgcatccatccatgcagcaaatttcatgttcgcaggagaggtgcagtaaagataagatctga

SEQ ID NO: 107144 - DNA, 2912 bp, Glycine max
  Peptide Sequence Number=SeqID_223922
atgttggatttatccaaatacatgatagggattccaagaagcaattcagttggtagagtttctcaatgcttgactaatgttgctgactatatacctaattcagaggaggcaattcgaaggggagaatatacagtcataagaagcttgattcgggtgttagagggtggtgttgaggggaaaagacaagtggacaaagtcattgataagtgtgcctcaatgcagaacttgcgtgaagcaattggcacctaccgtaatagcattctgcggcaaccagatgagatgaaaaaagaggcatcactttctttttttgtggagtacttggagagatactactttctaatatgttttgctgtatacatacattcagaaatggctacactctgttcttgttctgcggatcatagtagttttactgactggatgaggaacaggccagagctctacagcattattcgcaggttgctgaggagaaatccaatgggtgcacttggatattccagtttgaagccatctttaaagaagatagctgaatctactgatggtcgcccttctgagatgagtgtggttgctgccttgagaaatggcgaagttcttggcagtcaaactgttctgaaaagtgatcactgtcctggatgtcaacatccaagattaccagagagagtggagggggcacctaatttcagagaagtttctgggtttccagtttatggggtggcaaatccaactattgatggtattcgatctgtcatttgtaggattggtagctccaaaggtggaagcccagtactttggcataatatgagagaagaacctgttatttacatcaatggaaaaccatttgttcttcgtgaagttgaaagaccatacaaaaacatgctggagtacacgggaattggtcgtgaaagggtggagaaaatggaggctcgattgaaagaagatatcctacgagaagctgaacagtatggcaatgcaataatggttattcatgaaacagatgatgggcatatatacgatgcatgggagcacgtcacttctgaaatgattcaaaccccacttgaagtttttaaaagcctggaggctgatggatttccgattaagtatgcacgtgttcccatcaccgatggaaaagctcctaaaagctctgactttgacactgtggctttcaatattgcttctgctgctaaggacactgcttttgttttcaattgtcagatgggtaggggcaggacaaccactggcactgtcatagcatgccttgtgaaacttcgaattgattatggaagacctattaaaatactgagagatgatatgacctgtgaagaagcagacgggggtttctcaagtggagatgaagttgggggctatgttactgcattaacccccaatactttgcaaataaagcctgacgagaaacaaagccatgcttttggtataaatgacattctcttgttatggaagataacaacattttttgataatggagtggagtgccgggaggccttagatgctattattgatagatgttctgcacttcaaaacattcgccaagctgttttggaatacagaaaagtattcaatcagcaacatgttgagcctagggtaaggagggtagcattatatcgtggtgctgagtacttggaacggtacttccgtcttattgcttttgcagcatatcttggaagtgaagcatttgatgggttttgtggacaaggggaatacaaaatggcatttaagaattggatgcatgagaggccagaggtgcaggctatgaaatggagcatcagattgagaccagggcgatttttcactgtccctgaagagttgagagcaccacgagagtctcagcatggagatgcagtaatggaggcttttgtcaaagcccggagtggttctgttcttggaaaaggctacatactgaaaatgtatttctttcctggtcagagaacttctagctacatgcaaattcatggtgcaccacacatttacaaggttgatgaataccctgtgtatagcatggcaactccaaccatctctggtgcgaaggagatgctatcctatttgggtgctaagcctaaagcaaatgtctcatcatctcaaaaagtgatattgacagatctgagagaggaagcagttgtctatatcaaaggcactccctttgtcctgagggagttgaacaaacctgttgatacactcaagcatgtgggaatcactggtcttgcggtggaacacatggaagcacgattgaaagaagatatactagctgagattagacagtctggtgggctgatgctgtttcaccgtgaagaatataatccttcaacaaatcagtccagtgtggttggatactgggaaaatgttttggcagatgatgtgaaaacacctgcagaagtttattccaccctgaaagatgagggatatgatattatctatttgaggataccattaacaagggagagagatgctttggcctctgatattgacacaatacagtattgtaaagatgactctgcagagagttacctttttgtatcacacacaggttttggtggagttgcatatgcaatggccataatctgtgttagactaggtgcagaggcaaactttgcatccaaagtcccacagccattgtttggtcctcaccaatgggcagcaactgaagagaacttgccctctcgagcttctaatgaagcagcactcaagatgggtgactatcgtgacattttgagccttacaagagtcctcatacgcggtccccaaagcaaatcagatgttgatattgttattgaaagatgtgcaggtgcagggcatctacgagatgatattctttattatcataaagaatttgagaagtttacagatggtgatgatgaggaacgagcgtatcttatggatatgggtgtcaaggctttgag

SEQ ID NO: 107145 - DNA, 486 bp, Glycine max
  Peptide Sequence Number=SeqID_223923
atgaagcgcatttgtgatagtatcagttgcaagaaggaagggcaaaccaggaaaggacgacaagaaagagtagtgggttttcaaggggtgcctcaatgtacagaggagttacaagggttaaatccacctttaatgttatgcaggcaccaccaacatggcaggtggcaagcaaggataggcagagttgtaggaaataaggacctttatcttgggacatttatttgtattattcttagccagggaacttataacaaggaactaaaatttattgctcaaaaggcaaaaaggatatttgtaggtttaagatgtactcttgctgatttttctaggcatagaacaacattggtgactttaaggaactatatgtatctaatctgtttagggttcttggcttatgagtgggagagaaaagagggtctgcttgcaaagaagcttcatccagacagaaacaaagatgatcttgaggccgaaaagaagtttcaatag

SEQ ID NO: 107146 - DNA, 262 bp, Glycine max
  Peptide Sequence Number=SeqID_223924
ggaaggtacaccattgaaggaacatcttgatgagttaaactatgttctgatggagctacatgacattgatgtcgagatggaagacaaagatttgtcaatgattctattagcctttcttcctccctcctatgagaattttgtaagttctcttagtgtagagcttgagaaaaatcttgtatctgtaggtgtcatggattcaaaaggtttttcttgttgggttgaaagtggagttatgcatatgagagggaaaggggagtctgtg

SEQ ID NO: 107147 - DNA, 225 bp, Glycine max
  Peptide Sequence Number=SeqID_223925
atgtcaccacaaaatttactcaaaaaacaaagcaaacaacacattacgtcaaactcaaaaagaaaatatattgtcttcttcgagattgctgccagaatcgaaggtttgaggattgagagaaggctcagtggcggagttagggttggagagaacgccgaaggaggagtagttgttgttaacggtgccttagtcgtcccattggggctcttcggcaagggttcataa

SEQ ID NO: 107148 - DNA, 1335 bp, Glycine max
  Peptide Sequence Number=SeqID_223926
atggagaaagcaattcaaagacagagagttctgcttgaacatcttcaacccatttcttcaagttcaaatttttcctctcaaacccatcaatctacggatctctcagcttcattatgttttgctgggaattcttcgcatggtcaaacaggtggatcagatgatgacgtggtgattgtagcctataatttctcttcaataaccagtgcatatcgtactgccatctgcaaagcaaagcgtgggggctttaaggatacccttccagatgaccttcttgccacagttctgaaggctgtaatagagaaaacaaatgtggacctgcggaagttggagatattgtcgtgggcacagtactggcacctggatcagatagaggaattgagtgcagaatggctgccttttatgcaggtttcccagtgttcatctggacttcaggcggtttctgacgtagctgcctatataaaagccgggttctatgacattggtattggggctggactggagtctatgacagtagatcgtgtgaataggcttcccaacattaacccaaaggtagagacctttgcagaagcccgggattgtcttcttccaatgggaatcacttctgagaatgtagcacaacgttatggtgtgacaaggctagagcaagatcaggctgctgttgagtctcacaagcgagctgcagctgcaacagcagctggcaagttcaaagaagaaatcattccagtttctacaaagtttgtggaccctaaaactggagtggagaagaaaattattgtttctgtcgatgatggtatccggccaaacacaaatttagcagatttggcaaagctgaagcctgcattccagaaagatggaaccacgacagcagggaatgctagccaaattagtgatggtgcagcagctgtgctcctcatgaagagaagagtggctgtgcaaaaggggcttcctattcttggaatcttcaggagttttgctgctgttggagtagatcctgcagtcatgggtgttggccctgctgttgctatcccagctgcagtgaaatctgctggtcttgaacttggcaacattgacttatttgaaatcaatgaggcatttgcatcgcagtatgtttattgcctcaagaaattgggacttgatcccagaaaggtcaatgtcaatggtggtgccattgctcttggacatcctttgggcgttacaggtgcacgttgtgttgcaactttgttgaatgagatgaaacgcggtggcaaggattgtcgctttggtgtaatctcaatgtgcataggtgatttcttcttttggtctctctccatctcacatataccagtaaaaagttga

SEQ ID NO: 107149 - DNA, 396 bp, Glycine max
  Peptide Sequence Number=SeqID_223927
ttcttccggaaactttccggaagaaggggtcttctggaaagtgctttcggaagcactgaaaggtcatccggaagaacccttcttccggaaattttccggaagaactacttcttctggaagaggtgttccggaagctttccgaaagacgtttcattacttccggaagaacccttcttctggaaatcttccggaacacgttcttccggaagttccggaagaacctgaaacggatctttcggaaggcacctacctcgaatgcaaatgggtccaagggaaaaacaagcagcgggctcgcggagaaggctcgcggagaagaagaccaccaccaccgaggctcatcgcggaagagagaagagaagaagttagaatgcttttgcggaagagagaagtgaagaa

SEQ ID NO: 107150 - DNA, 660 bp, Glycine max
  Peptide Sequence Number=SeqID_223928
atgcatcttgttatattgtttcccatcttggtttgtcaggttgctgagccccaagttagcagactctgcgtggaggctgaagaattcattgttatgggaaagtggttggagctagcatcattgatgattacctctgctgaattgattttctcgaaggtttctgaaaaagatatagagtccatcttcactatcatctgcaatcttgttacaaagaccgaaaatccagatgaagtgatggagattgtaaaagttataactacaaaaatactccagcagccaaatgaaaagcctgctgtgcgattgaagattatgatcagcctgtacaaccttttggagactccatactgccagttttatgtctacatgaagttactgaatttagctgttgatgggaaagtcacagaacacattataccttcattcaataagattgataacttcttgaaagactggaaaattgggataccagaacagagagagctctttcttgctgtctctaatattttgaaggaaaataaaagcatgtcaaaggatgcttttaagttcctgaccagttatctggcaactttttcgggagatgactcacatgttttgagtgaagccaaggaggaggctgcacgtgcaattgtggaatttgtgagggcacctgacgtatttcag

SEQ ID NO: 107151 - DNA, 2292 bp, Glycine max
  Peptide Sequence Number=SeqID_223929
atggcttccaccgtaggtatctcttcttccatctccatatgcaaaaacccctcttttcaactcctcagaagaccaaccgccacaaccacctctgttttcttcaacacccttccccgtaaccgtaacgccacactctcttcccttccttccgccattgccacccccacctcatccattctcacagaacaacccttcaagggtttaactttagacgacgctagtaatagcaaccaatttggctatgactacgaacctgacaccaatgtgagcgaccacgaactcgacatttccaagttgggtttaccttcgcccctcgttcactccctacaacaacgtgggatcaccagtcttttccccattcagagagctgtgttagtgcctgcactagaaggtaaagatatcattgctcgtgcaaagaccggaactggcaagacattagcattcggaattccaattcttaagggcctcactgatgatgatgaacaaagttctcacaggaggtctgggaggcttcctaaagcattggtccttgcacctaccagggagttagcaaagcaagtcgagaaagagatacaagaatctgcaccttatctcaaaacagtttgtgtttatggtggtgtttcttatgtaacccagcagggtgcgctttcccacggtgttgatgtggtggttggaacgccgggtaggataattgacctggtgaatggaaacagccttaaactgagtgaggttcagtatttggtgcttgatgaagctgatcggatgcttgctgttgggtttgaggaggatgtggaggtcattttagataaggtcccagctcagcgccagaccatgcttttttctgcgaccatgcctggttgggtgaagaaactgtcaagaaagtatttgaataaccctttgacgattgatttggttggtgaacaagaagagaagcttgctgaagggatcaaactttatgctttatcagcgactgcctcttcaaaacggacagttctttctgatcttataactgtttatgcaaagggtgggaagactattgtttttacgcagacaaaaaaggatgctgatgaagtatcaatggcattaacaagtagtatagcttccgaagcactgcatggtgatatatctcagcatcagagagagagaacattgaatggttttcggcaagggaaattcacagtgcttgttgccactgatgttgcagctcgtggacttgatattcccaatgttgatttggttatacattatgaacttcccaatgatgctgagacttttgtacatcgttctggtcgtactgggcgtgcaggaaaagagggtactgccattctgatgtacaccagtagccagaggagaacagttagatcccttgagcgtgatgtaggctgcaaatttgaatttgttagtccaccagctatggaagagatcttggagtcatctgctgagcaagttgttgctacacttaatagagttcatcctgagtctgttgattttttcattgcaactgcacaaaaactggttgaagaacaaggtgcaagggcccttgcagctgctctagcacagatgagtggattctctcaacctccttcatgccggtctcttatcaatcatgaacagggatggactacattgcaactgactcgagatccagatacttctgcaagatatttttctgcaagatctgtcactgggtttctttcagatgtttattctccagctgctgatgaagttggaaaaatacatttaattgcagatgagaggattcttgtcaggaacttcagtattattaagataatcaccacactgttcaatttattccaatgttggtactgcctgtatcaggttcaaggagctgtttttgatcttccagaggaaatagctaaagagttactcactaaggatctgccatctggaaacactatttccaaaatcactaagttacctcctttgcaagatgatgaacctgcaagtgatttctatgggaagttttctgacagagatcgaagtaaccgaagaggttctagggatcagagaggttttagaagttcacgaggatgggaaggaggccaagactctgatgatgagtttggacaaggtggtagaagtttcagatctggcaacaagtttcgaatgggtaaaagcagcggggatgactggctaattggaggcagtagtagatcaagcaggttttcatcatccaacagaagcggcgggcatggaggggcctgctttaattgtggaaaacctggccatcgggcatcagattgtaccaccaaaaaacgagtctttttctag

SEQ ID NO: 107152 - DNA, 489 bp, Glycine max
  Peptide Sequence Number=SeqID_223930
atgtttggaagattccaggttctcctaaatgatatagaagctcttggaaatgtgtactcaaaggctcaagttaatctaaagattctagacaaccttctcaaggttcatatgaaaaatagagatcaactacctcataaagatttcgctgcccttaaatctagagaaagaatctccaataaagaggaaaataagagccctaccaaagccctcaaagtcagaataattgagtctgaagcatcggatgatagctcaattaaatccatagacgatgagaaagtcgggacacatgacggcttaatgtcccaggctcaacaaaaacaagtactatggtgggcgaggcgaaatgtcaaaggtgcgtcttccaaaagggaaaacgcgtgggagtctccaccaacatttttcaagaaaaatgttagaaaaaccaaaaagaggtctgtgaattttgaaaagaagggttcgggagttgtttacggatggggaaggtattaa

SEQ ID NO: 107153 - DNA, 189 bp, Glycine max
  Peptide Sequence Number=SeqID_223931
atgggggagaagccttggagtagaggttggacctcaggtggaaatatggtgaagtcgaggtttggtttaggtgtggattgtgggtttgggtttggggataggcatggtcccattttcgttacacaagggctcaaccaccaggtttgggtcaacgccatcatcaactaccaaaagcctaaggaattttga

SEQ ID NO: 107154 - DNA, 228 bp, Glycine max
  Peptide Sequence Number=SeqID_223932
atggcggcgatgatggaatcggaaggggagacaaagtacccaatttctcgctttctttttccttctattcttcccagtgggaacatgcacaacgggcataggattatcccccacatcgggggcgcattcctacaacaatccacctcctcctggcggtgcttgtattgcactaacgacccattgagcgcaaggctatccaaacttcggttaatcccttttgatggttaa

SEQ ID NO: 107155 - DNA, 770 bp, Glycine max
  Peptide Sequence Number=SeqID_223933
gaagggaacataatagcagaaacaagggtgcaagcaataagagccaaaagaagaattatcaaaccttcatacctcaacgagtatgtgtgaggaagaagtttgctgagctagcaggcactggccctcgaagccagcagcagctctttccctctttcgtatcaacttttggtgctctcgttgtcattatgcctaaccctgagaaggatctaggctcctctgatcaattggaggatgccctgctccgcctcataaaccagaacatgtaccttggagaatctggttggatctttaagatcaaccaattttttgagtaccatggtactccagagcaagacagacttaccgtggcttcgttttacatggaaggtcgcgcactcgcttggtatcagtggatgaatgcgaatggacatgtcacctcttggtcatcttttcttcaagccatgcatgctcacttcgctccaacgccgtacgatgatcccaccagtgccttgtttaagctcacacagaagggtactgtggcccaatatctaactgagtttgaagatcttgctacccatgttgttggcatttcccatcctcttttgttgagttgctttatatcgggccttttcctcgagattcatcgagaggtccaagcccatcagccactttctatggtgcaggctgccgagcttgcgcgattacaggaggagaaggtcctcgaccaacgaccattaccacgaccaccaaccccaagcccctttccctcccaacctcgccctaacccttag

SEQ ID NO: 107156 - DNA, 1326 bp, Glycine max
  Peptide Sequence Number=SeqID_223934
atgcagggtctcaccttcaccattgatttatatgttttacctatctcgggcgcgaatatcattttgggtgttcagtggctcagaaccttggaacctgtcctcacggactatgccaaattgagtatgcagttcttttatgatgatcaattggtgacattacaaggagacaaggatgttaaccttggaatgttatcttccccacaattccagcgacttttctgcaaacagggtcctggcctctatttccacattacggtccttacggcaaatcccacccctgatcctagtgttgacttaccggcagacattcgaacattactcattaagtttggtgccctgtttcatcccctccatgccatgcctccgactagagaaactgaccaccatatccatttgctgcctcaggctacacccgtaaacgtgagaccatatcagtacccacactttcaaaaacaagaaattgaagcacaagttgcctctatgctgcaaaatggcttgatccaacccagtaccagtccgttctcgcccccgattttgctcgtgaagaagcatgatggatcctggcgcttctgcatcgattacagagccttaaacacaatcacaatcaaagataggttcctgatacctacgattgatgagcttctcaatgaattaggcgatgctcaatgcttctctaagctcgacctgctacaaggctaccaccaaatacgcatgcactttggtgacattccaaaaacaaattttcggactcatcacagtcactatgagttcaaggccaccatgaacctcattttccggccttatctccgttgctttgtcatcgtcttcttagacgatattttgatttatagttcctccttctctgatcatttgcgacatctagagctcaccctccaggtggaatatttgggccacttagtttcctcccatggagttgaacatgttgcttccaaggtcgccgtcgtagcccagtggccggtacctcggtccactagagctttgcaaagttttttgggcttggctagtttctacagatgctttataaaggggtatgccattattgcagaccccctggtcaaggccaccataattgagcccttccaatggtctcctcaggctcagacaacatttgatcgtctcaagcatgccctgtccacagctcttatcctcgccttacctaactttcaccaaccattcactatcgagacagatgcttctggtatcggaatgggggaggtgttgtcacaacaagggcaccccattgcctatttcagcaagcctttcactgcaaagcttcttcgatcttcaacttatgtgcgcgaatag

SEQ ID NO: 107157 - DNA, 2904 bp, Glycine max
  Peptide Sequence Number=SeqID_223935
gacgaccttgttccattgaatctggagattgaagcaacttgtagaaaaaaaactacaacaagagggagggagcaacaggaggtgcaagctaatcaaggagatagaggtgcctcatcctctgtatcatcctcttcattttttgtgatctttgaggaaccaacgatgaccaactcacaaccaatttttgaagaacccattatggtaaaagaccagccaccgagggggaatagtttgcagacatgggaagaggtggtggagaagttcctgaagaagtgtttttcagagtctaagaccgctgaggggaaggcggagatctctttattccaccaaatccataatgaatcattgagtgaagctcttgaccgcttccatggtttactccgaaatagctccttgatgcttccatgcactactagctcaaaacaagctcctggccaagcaaataaaaaccctcatggagactctgaacaagcatcctcacagttgcatgttgtgctacctgcttcatcttcaataatgcaagttgggggatgcaacatttgtggtggatcccatgagtcaggcatggtaccatcaaggaggaaatttctctcaaaatcaaggccaaggttggagatcccaatacttgtggccaatacaaagaagaaccctaaggagaagtgtaaggcggttctcactaggagccaaaggaaggagattgttgagaaggagaagagagttgagggagcaatggaggataagttcaaagacccaggaagtgtgatcatcccatgctttattgggactgtgtcagtgggtaaagctctcattgatctggtggcgagcatcaattttatgcctctttctatgtgtcggagaattgagaacccgaggatagctcccactataatgactcttcaactagttcgccaattcacctttccgatggattttgtgataatggacatagacgaggattctgatattcccttgatattgggccgaccattcatgcttaccgcaaaatgtgttttggacatggggaatgataacttagaaatgagtgtggaggaccaaaaggttaccttaagcttgtttgaggtgataaagcaccccactaatagcaaaaattgcttcaaggtggaagcaattgaacaagaagctgactgtcttgtgcaatgcctgacttttcactccatattggaaaaggccttaatgaattttgttgattgcttgaccaatgaggaggagaaggatcttagggcctgtctagaggacttagacagattgaaggagatttcctcagaggaatatgcctttgaagaattgaagaaagacaacacaacagagaagcccaaagtggagttaaaagtcttgtgtgctcacctgatgtatgtgtttttggaagaaaatgatgccaagccggtaatgatcaacaatgatttatcttcagatgaagagacacagttggtggaagtgctcaaaaagcacaaggcagctattgggtggcatattttttatcttaagggaattagcccttcctactgcatgcacaagatcatgatggaggctaattataagcaaaaagaagtcctcaagttacttgaggatggacttatctaccccatttctggtagtgcttggactgtcattggatggaggatgtgcatagattaccgcaagctcaatgatgccacaagaaaggatcaatttcctttaccattcatggatcagatgttggagcgactaactggaaagtctttttattgtttcttggatggctatttggggtataatcagattgtagtagaccccaaggaccaagaaaagactgcttttatgtgcccttttggtgtctttgcctatagaaggatgtcattcgggttacataatgcaccagccatctttcagcggtgtatgctagtcatttttgctaacacggaaggaataatgttgggccataagatctcaacttgggggatagaggtggacaaagccaaaattgatgtcattgagaagctgcctccaccaatcaatgtaaaaggcattaagagttttcttggacatgacagacttgtgtatgctccagtgatggtggcccctgattggagtaaagaatttgagctcatgtgtgacgccagtgattatgcagttggtgtagttctaagacagcaaaaggataagtggaagaagtttctccatgatgcatgtttctatgtctggggtgatccgcatttgttcaaaactggagtggataatttgttgagaaggataaaacagctacgaaggtattacaagctggatttttttggccttcaatcttcaaggacgcccatgatcattgaagtgaaggtagaagctgtggcggccccagagaatgatgccaagactttcatcaagaaagcttgtcacttgctggtggagatagagaacatggtttattgggccctcaaatttctcaattttgatgagtctctatctgatgagaagcgaaaactgcagcttgtaaagctggaggaaatgaggctcaatgcctatgaatcctctaagatttataagcagaagatgaaggcgtaccacgatcagaagttgcaaaagaagaacttccagcccagacagcaatctaagtggtctggtcccttcacaatcaaagatgtaaagccttatagagtgattgagtttatgggtcctaccttaattgaccttgagcaaagctggattgttaatggtcaaaggttgaagatctacaatggatgtaaagccttcacaatcgaagatgtaaagccttatagagtgattgagcttatggttcctacattaactgaccctgagtggagctggattatcaatggtcaaaggttgaagatctacaatggtgacaatattgagagactgaccaccatcatccatatccaggacccatga

SEQ ID NO: 107158 - DNA, 324 bp, Glycine max
  Peptide Sequence Number=SeqID_223936
atgaggagggcatgcaggaaaatatggcgatcggtgccttgcacgagcaggaaaagcttgcgaaatgactctaggaaggacatggaggagattctgagggctaagctttcaactattaaggaagagccagaattgtgtgatgagaacttagcatcaccaagacatgtgtgtatggccaagaaacaagggaagaaggttcaaggaaaagataaaacaggacggtgtttagtaccacatgatttgcatccaaaggtgcctttgctgggtttcttcaacgctaacttgtacctccttagtccttactctattccaataagaacatga

SEQ ID NO: 107159 - DNA, 486 bp, Glycine max
  Peptide Sequence Number=SeqID_223937
atggttgtcgaagacctagagcagctgacacaaaagatcaaagaccaattggaggagtcgatcacacaaaacgtgactcaacaattaatgatgtccttcagccatatgcagtcccagatgcaatcgcagggattcgcattgcctcttgagattgaggttggtccttctgctgctcatgtcagcacaaaggaaatttctgtcgatcccccggggcaagacctaaaaatgggtgactcagacaaatttgggttgtatgtcgatgacagtcctccccgactcgttgcttttggaagtgtttatgaggagtcaacaaccttccacaatgttcctttgggcaatgatcaagtgaaggttggtgttgaggaagtccgagatgctgatgttcgcattcttgataagcaggtagctgagggaccgacgaaacctgtagatatggcggatcctgacatcgatccgatgtacctgatgacattgaccattccataa

SEQ ID NO: 107160 - DNA, 435 bp, Glycine max
  Peptide Sequence Number=SeqID_223938
atgattcatgttgatcttgtcactagaaaagtcgatggtccccacagaaagaaattaagaacatatttggggattgtcactcgcgacaaggtggatgttatatatgataattgggaacaagtctttgttgctcaaaaggatctaatctgggaggatattcagactgaatttgatatccctgaatcattcgatttgaggacaaagaaaaaaaatacttcagatcgtaggagagcggtggagagatccttcatgggaggatgtttgagagaaggcacaggccattcagaaacaaaacactaccctcacatgttgtctcatgggggatatgattttctagaaaaaaagttgatggagaagcaaaagaaacaattggaggaagcagcccaatccgagagcactgacacagttgttgatccttcatctcccatcaaatga

SEQ ID NO: 107161 - DNA, 318 bp, Glycine max
  Peptide Sequence Number=SeqID_223939
atgccttcttcttttcctccttttgcgatttccatcttcttcaacaaatctaaaggtagtgtgatggctaacatttttgttccatttccatcttctccttcgcacaaatgcaacattaagttgtggagcatttttgcagcaatgactaggcaagtctgggcagtcatggttaagcaagctctatgggttacctttgggtactacttatggattttaaatttcttccacttgagaggaaaattaccatgtgaaagaaactcacacttgacgagaagattcttaaagtacaagtgtgaggtgaagtctcacatcgtataa

SEQ ID NO: 107162 - DNA, 1137 bp, Glycine max
  Peptide Sequence Number=SeqID_223940
atggaaggaaaagaaactgagggaatgttgaagatgacgacagataagagacaacagaagcgaagcagaagtgacagagaagaggaaagggacaggctgagtgagttgcctgactgtgttgtgctccacataatggaatttatggacacaaaatatgctgtacaaacttgtgtcttgtctaaaagatggaaggacctttggaagcgtctaacttatcttggattcaatacaaccctctttaacaatgttgtcaaattcaacaaatttgtgtctcgcgttctgtctggccgagatggttcagtttccctgctaaatcttgaattcacgcgtcgcggtatggcagagcccaagctcttcaataggcttatgaaatatgctgtgctgcacaatgttcagcagtttacagtatctctaaatttaagcttcagacagagtttcgagtttcgcccctacatcttttcctgtgagtccttgacatttctgaagctttcatttaattcttttgacacctcgattgtagcacttccaggatctctgaacatgccagcattaaaaagcttgcaacttgaggctgtctcttttactgcaagggacaatgactatgctgagccgttttctacctgtaatgtgctgaatactttgatacttgatggttgttcgttgcataaagatgcaaaattcctctctatatcaaattctagcctctctagtttgaccataagtggtagttttgaaggaggagcttacaaaattgtgctttctactccaaaccttagttctctcacagtcacgggtcataataatcacacaatctcctccgcatgcaatctttctttccttgaagaagtaaccattgacacccttggttatacactttttccgaatacagacttactcatcataagctggctgcaagttctcaccaatgtaaagatactgaggctctattcgggtacccttctgacaatactacgggatatatcaaatcctgcttcggtgagtactcagcctccctgctgtgttcaattgaagtcattgattttggagaaccaaccatctgcagatatatcttttgagcaactaaagagggcagtggagtacctacttcaaaactctccacaacgtagaattgattaa

SEQ ID NO: 107163 - DNA, 3372 bp, Glycine max
  Peptide Sequence Number=SeqID_223941
atgtctacctcaaggcctagccaatcatccagcaattcggggagatcaagacgtagtgctagggctatggctctggcaactgtagatgcaaaactccatgcaacttttgaggagtctggtagttcctttgactactccagttcggtgcgcatctctggtacagctgatggagtcaatcaaccaaggcatgacaaagttacaacagcttacctccaccacatgcagaaaggcaagatgattcagccttttgggtgcttgttggccttagatgagaaaacatgcaaggtcattgcatacagtgagaacgcacccgaaatgctgaccatggtgagccatgctgtccccagtgttggtgaccaccctgcccttggtattggcactgacataaaaactctattcactgcaccaagtgcttctgcattgcagaaggctctaggatttgcagaggttttgcttcttaaccctgtccttatccattgcaagacctctgggaagcccttttatgcgattatccatcgtgtcactggtagtatgatcattgactttgagccagtcaagccgtatgaagttcccatgactgcagcaggtgccttgcaatcttacaagcttgctgccaaagcaattacccgattgcaatcgttgcctagtgggagcatggaaagactatgtgatactatggttcaagaagtttttgaactcacaggttatgatagggtgatggcttataaatttcacgaggatgatcatggagaggtgattgctgagataacaaagccaggtcttgagccatatctgggtttgcactatccagccaccgatattccccaggcttcacgctttttatttatgaagaacaaggttcgtatgatagttgattgtcatgcaaaacacgtgagggttcttcaagatgaaaaactcccatttgatttgactttgtgtggttccaccttaagagctcctcatagctgccacgcacagtacatggcgaacatggattcaattgcttccctggttatggcagttgtagtcaatgacaatgaagaagatggggacactgatgctattcagccacaaaagaggaagagactttggggattggtagtttgccataacactactcccaggtttgttccctttcctctaaggtatgcttgtgagtttctggctcaagtatttgccatccatgttaacaaagaaatagagttggaatatcagattattgagaagaatatcctgcgcacccagacactcttgtgtgatctggtgatgcgagatgcacccctgggaattgtgtcagagagccccaatataatggatcttgtgaaatgtgatggagctgccctcatatataagaacaaggtatggagattaggagtaacaccaagtgaatcccagataagagagatagctttttggttgtctgagtaccatatggattccacaggcttcagtacagatagcttgtctgatgcagggttcccatcggctctttctctgggtgatgttgtttgtggaatggcagcagttagagtaactgcaaaagacgtagtattttggtttcggtcacacactgctgcagaaatccgatggggtggtgcaaagcatgaagctggagaaaaagatgatggtaggaggatgcatccaagatcatcattcaaggttttccttgatgttgtgaaggcaaggagcttaccatggaaggaatatgaaatagatgctatgcattccttgcagttaatactgagaaatgcattcaaagataccgagagtatggatttaaacacaaaagcaattaatacaagactaagcgatttgaagattgaggggatgcaggaactggaagcagtgacaagtgagattgttaggttgattgaaacagcaacagtgcctattttggcagttgatgttgatgggctggtcaatgggtggaacataaaaattgctgagttgacaggtcttccagttggtgaagctatgggaaagcatttactcacacttgttgaggattcttcaactgatagagtcaagaagatgcttaacttagcactgctaggtgaagaagagaagaatgtccaatttgagatcaaaacacatgggtctaagatggattctggtcctattagtttagtagtaaatgcttgcgcaagcagggatcttcgagataatgttgttggggtttgttttgtggcccatgatataactgctcagaagaatgtcatggacaaatttacgcgtattgaaggtgattacaaggcaattgtacagaaccgcaatccattaatccctcctatatttggcacagatgaatttggctggtgttgtgagtggaatccagctatgacgaagttaactggatggaagcgagaggaggtgatggataaaatgcttttgggagagctttttggcacccatatggctgcttgtcgcctaaagaatcaagaagcttttgttaatttgggtgttgtacttaataaagccatgactggtttggaaacagagaaggttccttttggtttctttgctcggaatggcaagtatgtggaatgcctgctttctgtgagtaagaaattggacgtagagggcctagttactggggtcttctgcttcttacagctagctagcccagagctccaacaagcattacatattcagcgcctatccgagcaaactgccttgaagagattaaatgcattaagttacatgaaaaggcaaatcaggaatcctttgtgtggaattatattttcccggaaaatgttggagggtactgccttgggaacagagcagaaacaacttctacgcactagtgctcagtgccagcagcagcttagtaaaattcttgatgactcagatcttgatagtatcatagatggttacttggatcttgaaatggctgagttcactctgcatgaagttctggttacctcacttagtcaggtcatgacaaaaagtaatggaaagagtatccgaatagtcaatgatgttgcagagcagattgtgatggaaactttatatggtgatagtcttaggcttcagcaggtattggctgactttttacttatttccatcaatttcactccaaatggaggtcaggttgttgtagcaggcactctaaccaaagaacagttaggcaaatccgtccatctcgttaagttagagctcagcataacacatggtgggagtggggtaccagaagcattactgaaccagatgtttggaaacaacgggctagaatccgaggagggtattagcctactgatcagcagaaagctgctgaagctgatgaatggagatgttcgctatctaagggaagcaggcaaatcagcttttatcctctctgctgaacttgcagcagcccataatttgaaaggttaa

SEQ ID NO: 107164 - DNA, 519 bp, Glycine max
  Peptide Sequence Number=SeqID_223942
atggattcggcaattggaattggcaggcaagcaggggacaaggttgccaagtcagcatcaaggccgttagaggtagtccttgagggtttcttgccgaaggtcaactcgtatggcgagattcctgaacctaaatgtatcgaggaatctcgccaattgtgtcccataggcacccatgtggcctcctatgggggacgagtgatactctgtgagcaggctaggaataaacgaagaccccaggggcaaccaaatgcgaccacctttaagactacgatggtctgtaagaatggtgaaaaggtgacccagaagatattgtcaccatttctttaccgcgacagtaatggcgaagagttcccgcacataagtggaagcttgaaggagtttggggataacacggcgcccatgccggcaccagatgcgtcagtctacaatgtaaaagtgagggtgaaatccaataaatgtagaacaggagcagtggtcagcgccttctttaattccttgaaagcaagttctgtcgcggag

SEQ ID NO: 107165 - DNA, 177 bp, Glycine max
  Peptide Sequence Number=SeqID_223943
atggccttacattcactggctcagagttcggtagaaggtggatataatgattggtgggctgcgatggaggtaatgaagatgatgattggaaaaaggtggtcaatggtagtttggggtggagggaggtctgtcggggtaatgtggatatggaaatatgcattggcttcatctttttga

SEQ ID NO: 107166 - DNA, 399 bp, Glycine max
  Peptide Sequence Number=SeqID_223944
atggcacgggagaaggagtggtcgagggagaaggagacactggaactggggaggaaggaaatggaggtggtctactacggaaggaatgacaaccatccaccagtttctcctcttgcaaacgcgccaagcccgccgcctggaccagggtcagaggttgcagagcttgtacctcctggcgaatgccctagtagggtcgtcatactgggagggggtgaacctggtctgaagtgtctaaaggaacgcgggccaagaagtgaattgaccattacgggtcatccactgaaaccacgccaaagctctaccttccatgtagcaggaagctatagtaaggcattcatgtgcgcagaagatggagagacaaggattagaatagcagtggataatgagggtgaatggtga

SEQ ID NO: 107167 - DNA, 204 bp, Glycine max
  Peptide Sequence Number=SeqID_223945
atgaaagttggatatgttgtacgaaatgcaattgcgcacactttcactgatgggatttgcgagataatattcgtggagggagaaaaggaatcgcatgaagacagtacaagtggaggtttcaatcccttctccgtctctctgacgtttgggaactctatcagagcagtcggaggaaaaattggaggaatcttaggaaagcgctag

SEQ ID NO: 107168 - DNA, 1137 bp, Glycine max
  Peptide Sequence Number=SeqID_223946
atggaaggaaaagaaactgagggaatgttgaagatgacgacagataagagacaacagaagcgaatcagaagtgacagagaagacgaaagggacaggctgagtgagttgcctgactgtgttgtgctccacataatggaatttatggacacaaaatatgctgtacagacttgtgtcttgtctaaaagatggaaggacctttggaagcgtctaacttatcttggattcaatacaaccctctttaacaatgttgtcaaattcaacaaatttgtgtctcgcgttctgtctggccgagatggttcagtttccctgctcaatcttgaattcacgcgttgcggtatggcagagcccaagctcttcaacaggctgatgaaatatgctgtgctgcacaatgttcagcagtttacagtatctctaaatttaagcttcagacagagtttcgagtttcgcccctacatcttttcctgcgagtccttgacatttctgaagctttcatttaattcttttgacacctcgattgtagcacttccaggatctctgaacatgccagcattaaaaagcttgcaacttgaggctgtctctattactgcaagggacaatgactatgctgagccgttttctacctgtaatgtgctgaatactttgatacttgatggttgttcgttgcataaagatgcaaaattcctctctatatcaaattctagcctctctagtttgaccataagtggtagctttgaaggaggagcttacaaaattgcgctttctactccaaaccttagttctctcacagtcacgggtcataataatcacacaatctcctccgcatgcaatctttctttccttgaagaagtaaccattgacacccttggttatacactttttccgaatacagacttactcatcataagctggctgcaagttctcaccaatgtaaagatactgaggctctattcgggtacccttctgacaatactacgggatatatcaaatcctgtttcggtgagtactcagcctccctgctttgttcaattgaagtcattgattttggcgaaccaaccatctgcagatatatcttttgaccaactaaagagagcagtggagtacctacttcaaaactctccacaacgtagaattgattaa

SEQ ID NO: 107169 - DNA, 948 bp, Glycine max
  Peptide Sequence Number=SeqID_223947
atgggtattaagggtttaacaaagcttttggcggacaatgccccgaagtccatgaaggagaacaaattcgagagctacttcggtcgcaagatcgccattgacgctagcatgagcatttaccagttccttattgttgtgggaagaagcggaactgaaatgctcactaatgaggctggtgaagttaccagatatgtttttgatgggaagccaccagatttgaagaaacaagagctggccaaacgttactccaagagagctgaggctactgaagatttgtcagaagccttagagactgccaataaggaagacattgaaaaattcagtaaacgtacagtgaaggtgacaaaacagcataatgacgactgcaaaagacttttaaggctcatgggagtgcctgttgttgaggctttggtttctacaggcaccctcagaagcagaggctcagtgtgctgccctttgcaaagctggaaaggcaagttcatatctgttgtttatgctgtggcttctgaagacatggattccttaacatttggatctcctaaatttcttcgccacctaatggatccaagctcaaaaaaaattccagtgatggaattcgaagttgcaaagattttggaggagctaaatatgaccatggaccaatttattgacttatgcattctttctggctgtgattattgtgacagcattcgagggattgggggactgacagctttgaaactcatacgtcaacatggctctattgaaaatatactggagaacctaaacaaagagaggtaccagataccagataattggccatatcaggaggctcggcggctttttaaagaaccaatggtcataactgatgaaaaggaacttgatattaagtggtcttctccagatgaagaagggttaataacatttctggttaatgagaatggtttcaacagtgatagagtgactaag

SEQ ID NO: 107170 - DNA, 576 bp, Glycine max
  Peptide Sequence Number=SeqID_223948
atgagaacggggaacctcttctggcttggcattgttgcagcacttgttttcagcttctgggttgatgccttttcagccaatcaatattacccccaccaccacttcaatgaaaccgagttctcttcgttggagtctcaagaacaggcacattcatccctccttgggaggactcctctcatggttggactcacccttattcaaagtgctgctgccaaaggagcagtttgcttggatggaacattgcctggttatcatttgcatcggggatatggatcaggagcaaacagctgggtcgttaatttagagggaggtgggtggtgtaatgacgttagatcatgtgtttatcgcaagaaaacacggcgtgggtcatcaacattcatggaaaaacagataccttttacaggaatattaagcaacagtgctgaagataatccagattttttcaactggaacagagtgaaaattcgttattgtgatggtgcctcttttgctggggatggtgaagataaggtagattttgatgtcttggagttattgaaaattgaaacgatgtttaattctgtggaggctgactag

SEQ ID NO: 107171 - DNA, 711 bp, Glycine max
  Peptide Sequence Number=SeqID_223949
gtggcgcaactgcaatttagaggacagcgtatttggttggctgcaatggaagatttgaagtcaaagggaatgcgatttgccaagcaggctcttctttctggatgctcggctggtggtctggctactattatacactgtgatgaattcagaggttttttcccagagactaccaaagtgaagtgtcttagtgatgcaggattatttcttgatgcgattgatgtctccaggggacataccatcaagaatttattcagtggtgttgtaaggctacagtgcttcttccctcagaatttgattgccggtattagaaccccactattcattcttaatacagcctatgactcatggcaggtccaaacaagcttagctccttcatcagcagatccccatggcttttggcatgattgtagattaaatcatgctaaatgtacttcttcacaaatccaatatttgcaaggattcaggaatcaaatgctgaatgctattaaaggcttctcaagatcacctcaaaatggattgttcataaattcatgttttgctcactgccaatctgagaggcaggatacatggtttgctgacaattctcctgtcattgggaacaaggcaattgctcttgctgttggagactggtatttcgaccgagcagttgttaaggccattgattgtccttacccttgtgataatacatgtcaccatcttgtcttcagatga

SEQ ID NO: 107172 - DNA, 204 bp, Glycine max
  Peptide Sequence Number=SeqID_223950
atgactgctctcctgactggcgggtgcagttctacgtatttccctacgcccacacccaatcgatgctccacgagtcagacaacgtttcttgaagaagaagatcatcgacgtgaagaaagagtcgcgaattcgagaatgagattttggaaactttcaggtggaagagaggacggaggttataaaggaaatacgcaaacgttttga

SEQ ID NO: 107173 - DNA, 444 bp, Glycine max
  Peptide Sequence Number=SeqID_223951
atgacgggattctttggtgcaatgtttttaaatcaaagtatgggggctgaagtgatttggcaaaagtatgaggtggcgaggatccaactttcaaacgtagaatattggaggctagggagttgtagggatgctaaattctggctggacaaccggaatggtgatacagtttttgggctttggctgacaagtatagcaggttattcacaaattcttgtaatccgaatgccctggtggctgaaatgggatattaggtaccctcccaaaaaaacaatgttatttttagaggggccaatgggaattgggaagctgtgttgtgtggccgcatgggatctggcaaaacatagagcttgggcatggattaatgcgaaagggaaaggaagaaaattctcttattgtgaatgggagatgaatcccagggcttgtttgaattgtttaacgttatga

SEQ ID NO: 107174 - DNA, 387 bp, Glycine max
  Peptide Sequence Number=SeqID_223952
atgcatcttcttggttacgatgatatttttacaacgaacacgtctcttactagagttagagctgttcctgcatatagcttcagcatcaatactttagaggaactaaattatcaaacagaacagttgcatgaggggtgcaaagggaaagaaagtggtaagagagaaagagaagaagaagcagtaagatccgaaactttgtttgaaggtgatagttttgagacgggtagagacagagggaaggctttgaagggtaggttttctggtgttcttgtgagtaggttgagtatattgagaagaaagcgccgtggtgcaaaaattcaggaagatgatgacagtcctgaatcttcatcaaaggatcatgcgtgctcatttatgcactacttttga

SEQ ID NO: 107175 - DNA, 2484 bp, Glycine max
  Peptide Sequence Number=SeqID_223953
atgaggaacaacaagccacagttatggctttctctttcactcttcatcacatgcttctctttccacacatcccttgctgctttgaccaccatctcagcaaaccaatctctctccggggatgaaactcttgtctcacaaggtggcgaattcgaattgggcttcttcaacacaggtaacaactctaacaaattctacataggcatgtggtacaaaaagatatctcaaagaacctatgtttgggtagcaaatagagaccaaccagtttctgataagaattctgccaagttaacaatattggatggtgatttggtgcttttagaccaataccaaaatctagtttggtcaaccaatttgaattctcctagctcaggttctgttgtagctgtgcttctagacagtgggaatcttgtattaagcaatagggctaatgcatcagcatctgatgctatgtggcagagttttgatcaccccacagatacatggcttcctggtggtaagataaaattggacaacaaaacaaagaagccacaatatttaacttcatggaagaatagagaagatcctgcgcagggtttgttctctcttgaactagaccctgcagggagaaatgcttatctgattctttggaacaaatctgaacagtattggacaagtggtgcttggaatggacatattttcagcttggttcctgagatgaggctcaactacatctacaatttcacctttcagtccaatgagaacgagagctacttcacctattccgtttataattcttctattatcacgcgtttcgtgatggatggctcggggcagatcaagcaactttcgtggctggataatgctcagcaatggaatttgttctggtctcagccaaggcaacagtgtgaggtctatgccttctgtggtggatttgggagctgcactgagaatgccatgccatattgtaattgtttgaatggttataagccaaagtcacaatctgattggaatcttaatgattactcaggagggtgtgtgaaaaagaccaactttcaatgtgagaatccaaattcctctaacaaggacaaggacaggttccttccaattctcaacatgaaattgcctaatcattcacaatccataggagctggaacttctggggaatgtgaagcaacatgcctgagtaactgttcttgtactgcatatgcttatgacaatagtggttgctcaatttggaatggtgatctcttgaatctgcagcagcttactcaagatgatagtagtggacagactttgttcctcaggcttgcagcatctgagtttcatgattctaaaagcaataaggggaccgtcattggtgctgctggagctgctgctggtgtagtggttcttctaatagtttttgtgtttgtgatgctgaggcgcagaaggaggcatgttgggaccggaacatcagtggagggctcattgatggcatttagctacagggatttgcaaaatgccacaaagaatttctcggataaacttggaggagggggctttggttctgtcttcaaaggaacattggctgattctagtatcatagcagtgaagaagcttgaaagcattagccaaggtgagaagcagtttagaacagaagtgagtacaattgggacagttcaacatgtcaaccttgtaaggcttcgcggattctgttctgaaggtactaagaaacttctggtttatgattacatgccaaatggttccttggagtccaaaatgttttatgaagatagctccaaggtgttggattggaaagtgaggtaccaaattgctcttggaacagcaagggggttgaattatctccatgagaagtgcagagactgcatcatacactgtgatgtgaagccagagaacattctcctagatgctgattttgttccaaaggtggcagatttcggtcttgcaaagcttgttggaagggactttagtagggtcctcactaccatgagagggacaagaggctatcttgctccagagtggatttcaggtgtggctattactgccaaagctgatgtctacagctatggaatgatgcttttcgagtttgtgtcaggtaggaggaactccgaggcatcagaagatggtcaagtgaggttcttccctacctatgctgcaaacatggtgcaccaaggagggaatgtccttagccttttggaccctaggttggaaggaaatgctgaccttgaagaggtcactagagtcatcaaagttgcttcatggtgtgtccaagatgatgaatctcacaggccttcaatgggtcaagtggttcaaatccttgaagggttcttggatttgacattgcctccaattccaaggaccctccaagcctttgttgacaaccatgagaacattgttttcttcgatgactccagctccacacagagttcacaggttaagagtaatgcatcaagtgcttcctctcaagccaaaagcaacatctcatcatccaaaagtagcacctag

SEQ ID NO: 107176 - DNA, 774 bp, Glycine max
  Peptide Sequence Number=SeqID_223954
atgaggagcttctcaaagaacaagttcctcctctgttttcgtcctgtggttgacatagattgcatgataaagtccgaagttgctcctcatcgttcctctacttgtcgttttccacgcataccctcttcagagaaccacaacgtgatgaagaactcagaaaccaaatccgtatattttccccatctttcaccaaaacgaaggatttctcggaatagaagagaccaccacaaaaatcgttacatccatgattcttttggtccaaagtatttgtcctatggaggagaaaccaaaacccttcaatcgcctttgtcaacttcatcttcttcacacggtttagcttcaccttctttgagctcacacgcatcatcatttcaatcaaagaacgtgtcaagttactactccaccaaggaaaaaaggaaagagggtactggtcatggagggccactagagaagcaaaagaagttcgagtgcttaggaatatacttgattctcataagcttagcgtttacggtgttttgggggaagctttttggtattattttgacctcaacattactctactttttcgctgtttgggactcaagttctccatgccaaaagaggtttcctagttgtccaagacccagacaaagtctacaaggcaaggataatagaaattatttcacgggtcgaaattatcacatggctatggtcccgattaattttcataaaaatgggagggagaagttttttcagaaggtagagttcattgggaagtatgctccaaggcaatag

SEQ ID NO: 107177 - DNA, 417 bp, Glycine max
  Peptide Sequence Number=SeqID_223955
atgcccgatttgagttctgacatcgtacaacacagactacctctgaatcctaagtgttccccgataaagcagaaactgaggaggatgaggcccgagacgtccctgaaaataaaagaagaagtaaagaaacaatttgacgctggctttctggttgtcgctcggtacccggaatgggttgccaacattgtaccagtccctaagaaggatgggaagatggcgccagaggatatggaaaagaccactttcatcactctgtgggggacgttctgctataaagtgatgtcctttgggctcaagaatattggggcaacctatcaacgggctatggtggctttgttccacgacatgatgcaccgagaaatcaaaatctatgtagacgacatgattgccaagtctaaaactgaggaggaacacctt

SEQ ID NO: 107178 - DNA, 107 bp, Glycine max
  Peptide Sequence Number=SeqID_223956
atgtcgacgtcatcatgtcggctcagtggttcctcaccagaatcttactcccttgcaccctactgctgtcattctgctcccacgaaaaaggtttgtgatcatcacag

SEQ ID NO: 107179 - DNA, 713 bp, Glycine max
  Peptide Sequence Number=SeqID_223957
agagagtgtgtgcatcccaagtgagcgtgagacacttttgaagtttaagaataatctcatagatccttccaataggctttggtcttggaatcataataataccaactgttgccactggtatggagtcctctgccacaaccttacttcccatcttcttcagcttcacctcaactcttcagattctattttcaatgatgattgggaagcttataggagatggagctttggtggagagataagtccttgtttggctgatttaaagcatttgaattacttggacttgagcgccaatgaataccttggagaaggtatgtcaattccttctttccttgggacaatgacttccttgactcacctcaacctctctcatactggattcatggggaagattcctcctcagattgggaatctctcaaatttggtgtatcttgacctgagagctgttgccgacggagcagtaccctctcagatcgggaatctctctaagcttcaatatcttgacttgagcggcaattatttccttggagaaggtatggcaattccttctttccttgggacaatgacttccttgactcacctcgacctctcttatactggattctatgggaagattcctcctcagattgggaatctctccaatttgctctatctcggccttggaggtcattctagtcttgaacctctgtttgttgaaaatgtagaatgggtatcaa

SEQ ID NO: 107180 - DNA, 330 bp, Glycine max
  Peptide Sequence Number=SeqID_223958
atggctccaaagaagctcccggccaagaggtccaggaaggatgctactggagaaggttctagtgcagccccacaggcagatgtggactttgatagacataggttccggagtgtggaacaccaacaacggtttgaggccattaaaggctgctcgttcctcagagagagacgagtcctgctgagggacgaggatttctggggcatccaccggttttggaggaaggccagcactgtgagttctcacagaggaggagtcaggcctccggcttcgatgaggaggctatcaatcggttgctatgcgtgccaaggcaggactttgcccagagcgtag

SEQ ID NO: 107181 - DNA, 279 bp, Glycine max
  Peptide Sequence Number=SeqID_223959
atgcttcctgccctgtgcctacgttctcccaatactacaccagccccaggtattggtaaagaaagccatacaaatccaaagcattttggagtcaattatgcgtttcaagtccctattgctaccaaatatcgctatgtcattaccaaggtgcctttttacatgctcataacttgtttaaaacgtgtcttccttcagcatttacgttctacgcactcaaatgatttgaggctgcaaaagacaaccaaagcacaaaccgaaacacaaaaccgaatagtgtga

SEQ ID NO: 107182 - DNA, 471 bp, Glycine max
  Peptide Sequence Number=SeqID_223960
atgcatctaaagtgtgacacatctgtagaagcaagcttcatgatgatgaaccaagcaattttgatgatgccaaaagcccaagtgattgattcaagattgattcaagacttcaagatcaagcatcaagaatccaatccaagattcaagattcaaaagaagaaatcaagaagcaacaaagggtacatctacttgggttgtaatactgagaacaagagagggtacatctcttgtggatcagttcaagtggagggtacatccacttggtttttcaaagagaacaaggaagggtacatcccttgtggatctatgcttgtaaaggatttacaaggttattggaaatctcaagaaccggtgattgcttggggactggatgtaggcacgggttgtggccgaaccagacacggcagtgagcgtgacggcaaacacaatggtaagcgcaacagcggacacggggtaagagaagatcagtga

SEQ ID NO: 107183 - DNA, 396 bp, Glycine max
  Peptide Sequence Number=SeqID_223961
atgccaaagtatgccaagtttttaaaggggattatttcaaataaaaagaaattggaagactttgcaattgttagtctcaacaaggaatgttctattattgttctaaataaactatatcttaagcttaaagatccaaggagttttttagtcccttctaccactggcaacttgtcatttgatagagcattgtgtgatgtagggagattgacttggtggctaggtgaagaggaggaagtatttaagatgtttggtactacaaagagctccttctctcccctttcttgcaatcttgtgcaatccaccaacaaggtgaaagtcactgtggctaagcctcactcaagtgtggggaagaaagaccctcccgggaacaaagtcattccaaaagaccctggataa

SEQ ID NO: 107184 - DNA, 1209 bp, Glycine max
  Peptide Sequence Number=SeqID_223962
atggcgtaccataacccccaagaccttccacttcaccatttcactgaccaacaacaacaccataaccatactctccctcacaactccttgctctccgaccctgcctccaaacctgcctccgatcctcaccaacccgcgccaaattggctcaacaacgcccttctccgaacggactacacccacaccaccaccaccaccaccaccaacaccgctgctaacaacagcaacaacagcaccaacttcctcaacctccacacttccgcttccgactccggccaatggcaggcccgcccgatccttaaccgcaaccacagcgaggtcatcgatgacgtggccggcgcaggcgccgaatccggagatttgaagggagagacggcgccggtggacggcctcttgaactggcagaatgcgagattgaaggcggagattttaacgcatcctctgtacgaacagcttctgtcggcacacgtggcgtgcttgcggatcgccacgccggtcgaccagttgcccaggatcgacgctcagctcgcacagtcccagaatgtggtcgccaagtactctgccttcggacaagccatcgttggcgacgataaagaactcgatcagttcttgtcccactatgttctgttgctctgttctttcaaagaacaacttcaacagcatgtccgggtccatgcaatggaagcagtcatggcttgttgggagatcgagcaatccttacaaagtttaacaggagtttcacccggggaaggtacgggagcaacaatgtctgatgacgaagatgagcaagtagatagtgatgccaatctgtttgatggtgctttggatggtcctgatagcatgggattcggtcctcttattcccacagagaatgagaggtccctcatggaacgtgtaagacatgaattgaagcacgaattgaaacagggttataaagataaaatcgtggacataagagaggaaattttacgtaagagacgagctgggaaacttcctggtgacacgacctctgtccttaaagcttggtggcaatcacattccaagtggccttatcctacggaggaggataaggcacggttggtgcaggaaacgggtttgcagttaaagcagatcaataattggtttatcaatcaaaggaagaggaactggcatagcagtccctcaacttctactgttttgaagagcaagcgcaaaaggtattcatattaa

SEQ ID NO: 107185 - DNA, 642 bp, Glycine max
  Peptide Sequence Number=SeqID_223963
atggtcacctgggatgacttatacagtgagaaaagtagtagctcatacgatgaacaagccaacatctgtctaatggtagatatagacgataaggtcgaggtaaaaacctattttgaatttgatacttcttcttgtgcttcatcaaacaatgaagaggatatgccctatgatgttcttcttcagaactatcatatgatttatcttcaatgtaaaaggtttaaagaaaaattcaaagtttttgcttatgaacatattgaattaaagaaatcaaatcaggatctaaaaaaaaagatccaaactctaaaaaagagtctgagcctagctagtaagactgatgaaacttccattgttgaaaaactaagggaagaagtagcatgtcttactaatgactttgggaagttcttggaaacttcaaaaactttcaccactcttttgaaatttcatcaacatcctcatgataagtctagtctaggccttgaaaagggaacaacttcctccaaatgcacccataagaagaaacaaatgtctaaaagtactaactatgttggacctaaaaagatatgggtaccaaaatctcaaatagtgcctattgcatatatccttggtaggaaaaggccagggtttaagttgatacctagatag

SEQ ID NO: 107186 - DNA, 381 bp, Glycine max
  Peptide Sequence Number=SeqID_223964
atggagctcttacgcaagactctgattattgtgaagaaaaaggagacagagggactttgggcacatgggcaggcccaaggagcatatttaaggacacttcttgatgcatttggaggcaactacggcagtctgagggactacttgatgattaatagtggcatgtttcaagaaattgccaagactaatgcagatgcaattcgtggacttgagccaaagattagtatttggactaatggtggcgaagcaaatggtgcaagtggtggcattaaggaggttgctggtgtctacaagatgttaccacctctgtttaagacagtccaagagcaaacgggtatgctaccgccagcttggatgggaaccctgcctgacaatagttcttaa

SEQ ID NO: 107187 - DNA, 615 bp, Glycine max
  Peptide Sequence Number=SeqID_223965
atggtggacaagtcagttctgattcctaaggcagactgctacaagggcaaagagaagatgcactcccaacacgatatgttaaagcaagaccaagcagactcttcaaacatgaagtggctgctctacatcaaaaataggaacttacaagtagagggtgggaatctctacaaaggtattatggactttgagcccattcctctggtttggaacctgaggagaagccaccatcagatagagttcatcccaagacaggttgctgctatcagactatcaatcacgatacctttgtggttgattcaccatccaacaacgtttgcaatggaagcgagattttgtttccatcttccatactccagtttcacttttgttcatcatgtacaacccatcattgaagaggtgaattctaatgacgagattcctattgttgttgttgatatgaccatggaagtttacaatgacccacctccatccctagaagaagccaaaagatggaaagtccttggagaacaccttttaaggaaatgtgttgacgttctctttgatagttcaattgatgacgaatctggggatgagttatttcataagcttaaagtggaagaagaagttgtcaattaa

SEQ ID NO: 107188 - DNA, 585 bp, Glycine max
  Peptide Sequence Number=SeqID_223966
atgggccctggcagtcaagcccgcagggaccatgagtatcatcagttggaactactggggtctgggcaacctgagcgcagtggtgttctcgttctcttatggacaaaaccctttgattgcaaccttatcaacttctcgcaaaacttcattaacgtttctgttcacgaggcaagctcaccagtttggagattgactggctactatggctacctagaaaggcaaagaaggagggagtcttggaacctccttcgttatttagtagcagatacttctttaccttggtgcatctttgcagatttcaatgatcacccaacttggcttctaaggggatttcgagagacaatcattaactgcaacctccacgatctgccaatggagggtcaccaatacacttgggccaggagacggggaaaacatgatttcatggaagataagcatgttagaggcctagcaacgatgaactggatatacatattccctaacttcaagcttaccaatggaatcttagcaaaatccgaccactccccaatcctcatctatctcaacaatgctctaagaaagaaaactcaaaaaattcagatttga

SEQ ID NO: 107189 - DNA, 1521 bp, Glycine max
  Peptide Sequence Number=SeqID_223967
atgacacctccaaggaagaatgagccctccaacattcccatcatcaacaatgttgaagatgccattcaaggtttccctgaagattggtttatccctacgaagtggatacactttcaaaatctgaaagaagaaggctttgatgtgaagggactttttggcaaggttggttggaaaccctttttggagaagttcaatacctggcattatggcccatatgccctcttctggggaacaataaggcaagatggagtcagaatcaaggggactgttgttgagactcgagtggtaatctcttctaccaccattgttgctgcgtttggatgtgctatggatggtctgaccatgagcaaagattgggagaaggatataacccaggaaagtgtggacaaggtgctctatgtaaagccttacccaaatggagatgacaagaaggctctcaacaccttcttgaggatagctaacttgacctacatgtgtaggatgatccacagtgtgttgttcaacatattcatgcctagggttgtctcaggagactatgtcagtgacaaagactgtttctacatctacaagatcatggtaggggaagaagaagcctattccttatggaatgctcttcacctagatcctaaggcttgctggagtggagaaccagaaccttccctaccaatactagccccaccatcatctgaggtggaaatcctagaaatacatacccctgtacccttatctttactagcctttccttcccatcgatcacccaagcctgcttcaacccctctttacaaggccgaagttgttgccattgctaaggccaagcaatgcttaattgtagatgctaagagaagagcgaaatcagataagaccacgaaaacaaaggcacaggaagaaacatcaaggaagcttagacaagcaactgccagtgatcaagttcttgatgaagtggtgcttaaagctgccaaagttgcatctgaagaagagctacagaaggaagagtttgatgctagagtgcaatcaaccttggaaacaactctacatgttgcaatgctccagtctgtcattgaagtttctttgcaagggtctgatgttgttgctggttcaaactctattgaaacagaccctggagtttcacccttgcactctcatgtagtcgcagatgaccctgaagttgttcttgatgctctacttggtcaacctatgttagaattaaacatctcaagactggaaagtatctatgaagctactaagtctatctccttcgatgcaatgaagaagattgagcttcaaaagttaaatttggtcaagctatggaaagaaggtatgtcaaggattgattccttttcttattcatcttctgagaccctagaagaagaaaaggtccatgctttgttcaattacattggaagagaaagtcacataagggaatttctctcaaggaatccttttgctccaaacctcaataacattatctttgaatacatatcatctaaaaggaaagtttaccctctaggagctacaatctag

SEQ ID NO: 107190 - DNA, 261 bp, Glycine max
  Peptide Sequence Number=SeqID_223968
atgcttggtgcttgtgttttagttgtcgtaagaggtggtcatcctaattttgaaatcggcatatcgcttcctaatcatgtattgatacctcctagatgtccatctcaggcgaagtattggacggtgtacaacctttcaaacattgattcttatgacatggagtacaaccctccaagcattgagtctaatggcataaaatgctcaagggtaggtcatccctattcagtgttgagatttctaagacatccttctcgtgtgtaa

SEQ ID NO: 107191 - DNA, 234 bp, Glycine max
  Peptide Sequence Number=SeqID_223969
atggcgcagccccccactcgaatgtgtggtggccttatccagattaagaccatcttttttgagttgcactttgtcgtggaaaatgattgttcgggtcaaagcaaagcaaaacggtatattattattatcagtatggaacaattacgaaggagggaatttggctcaaaaagtgatacccaaataatgctctttgcgcgggttaaaagagacgtgcattttgttcttttatcataa

SEQ ID NO: 107192 - DNA, 281 bp, Glycine max
  Peptide Sequence Number=SeqID_223970
gggtagagggtgtcacacgttctactaaagcaactgccccatccacccttgttgaggcaagagaggaagaagtattggatgatgatggggaagaagaaagagaggcactagatctactgaatatgttgaagaaagaggaagagatgctttttgctattaaagatagacaatccaaggtagtacaatgcttggatggggataaggagttctctagagatgtttttgatgaacgtgccaagaaagcagaagcttggcattgtgattctgcagtttgtggataa

SEQ ID NO: 107193 - DNA, 270 bp, Glycine max
  Peptide Sequence Number=SeqID_223971
atgaagaaaagagatacaggctatcaaagtgtgtcattggagaataagacaggagattcaactgtgctaaagattggagattcggctaaagttgtgatgaaacaagacatgaagggaagaaagcataaatatgggtttaacaacaataaacgtgagaagacagagaagaaaagggtggtggatgatgaaactggcgacaaacatgacctgtatgattgttcttacatagcagtagtacaagtgttaggtgtcggggcttctctaatctga

SEQ ID NO: 107194 - DNA, 325 bp, Glycine max
  Peptide Sequence Number=SeqID_223972
ggccattgaaggaggtgaagattatgcttttgctaacctagaagagttgttcctagtacccaatatcatcacccctcccaagttcagggtgctggactttgacaagtacaaggggactacttgccccaagaaccatctaaagatgtattgtcagaagatgagggtatacgcaaaagatgaggaattgctgatacattccttccaagaaagtcttactggggtagctgttacctggtacactagcttggaaccttcccgagcccatgattggaaggacctaatggttaccttcgttaggcagtgtcattataatggcttcggatag

SEQ ID NO: 107195 - DNA, 279 bp, Glycine max
  Peptide Sequence Number=SeqID_223973
atggcctcatcatcggtcaaatgcagcataggcatgcctgctggtgatccttgtggggtgcttagctctagcactggtgtagatactggtgatgcctatggactggcctccgcaatcattggatctgcctctggatcagtttctggaataggagctagtgcagtagatgtctggggagcaacagaagatggaccctcagatcctctaaccctggccttgcgagtcccaagaaagatgaccgtggggtcgtccaagttccagcagttcttctttatgtaa

SEQ ID NO: 107196 - DNA, 276 bp, Glycine max
  Peptide Sequence Number=SeqID_223974
atgtataatagtataataacctatattggtctccactgcagtgcacattggcaaatggtcatcattttgcctaaggaaaatgttgtcatctggttttgttcattgcatactaggccagacaactacctcaaaggaataattaacagtgctttgaaggacttgacgatactccacaaagtaaatccaaggctggtgctaggtggattgttgttaaaacaaaaaggaagcaccgagtgtgggtattacgtcatgcactggatgtcaactataatctaa

SEQ ID NO: 107197 - DNA, 219 bp, Glycine max
  Peptide Sequence Number=SeqID_223975
atgggggagcagtggagacaattcaagtatgatttgacatcgaaatgggcatttgcagccgacaaggaaagtgtcgacgacactgatatgcgcaagaaggcacaagccaaccagaaacataacattgcccctcacgtgttgtctcgtgagggttatgaatattcagaaaacaagttgatggatgagaagagaaagaaaaaactagaggaagctgcttaa

SEQ ID NO: 107198 - DNA, 701 bp, Glycine max
  Peptide Sequence Number=SeqID_223976
atgggaatgggtacggtggagaaaagaccgagccgactgtggatttggaaggtggatgtggtatcagtgtcacgggggtgagggtagttaaagttggtgtcttaaacattaggattggtttgggggtgggaaatgggatgagacaggcaccacgcaaaacagaaggagataagctcaatgaaattgaagggctaggtcatgtgaccatcccaaaatcacgtgctgtgatgacggtgggtgagagtatgaccaattcgttgtcagtgacctcagacacaaacagattcagtgctaatcaggcggagccagctactgctacaagtggatacactggcaactctgcttctaccaagaggtgcagaagaaaaaagacctttgcagaattaaaggaagaggagagctccctgctaaaggaaagcatatatctgaaaaagcttgatgtgggatcaaaatatcagaacaatccaagttcaacatctgttgaaccgcagcgtctgcctgctggtcaaccccatcagagaatagtggtatctacggaggccctcatacgtcccattcaagaagatactcattcacttgcatcagaatctaggccaaacaggataaaatcaaccggggaaagttttttcttgataccagatctaaatatggtgccgtccgaggatgtttcttgcactgacgctctatgtggaatgagttga

SEQ ID NO: 107199 - DNA, 141 bp, Glycine max
  Peptide Sequence Number=SeqID_223977
atgtacttgagattggtggtgttgatatcttctttggtcttgttgggagagaacaaacctaggaagacaaaaagtgaggtggcagaggagaatgaagatggtaacagagtgaaagagaaagtcctgaggacggagaagtag

SEQ ID NO: 107200 - DNA, 327 bp, Glycine max
  Peptide Sequence Number=SeqID_223978
atgagggaggaagaaatggtggaaaacataacatcaattttgcagaaaaagaacaaggtaaacggaggagtggaatccttcatccctcacccctctcatcctctcacggaagccccttcactccgaaaccacgcgccaccgtccatccgttcctctgaatcgccgcccttctccacaatgccgttcacagtgggacaaggaggccaatctgcgcgcataagtgggtcacttcggtgcaaaagcgctgtatcagctgattcagctcatgttgcaagtgtctatcaaaagttaacacttaaacgtagaatttctaagatttgctcgtga

SEQ ID NO: 107201 - DNA, 2928 bp, Glycine max
  Peptide Sequence Number=SeqID_223979
atgatggaatccggggctcacttctgtaactcttgtggtgaacaaattggacttgatgctaatggggaggtgtttgtggcttgtcatgagtgttattttccaatttgcaaggcttgttttgaatatgaaatcaatgaggggcgtaaagtctgcttgagatgtgccactccctatgctgatagagcaaaggataataatgacaccaaggtttatgaaaaccaatccacaacagctgcccagatcaatgtttctcaggatgttgggctccatgctaggcatgtcagtactgtgtccacagtggatagtgaattaaatgatgaatccgggaatccaatctggaaaaatagagtggaaagctggaaggaaaaggataaaaagaagaagaagaaaaagtctgcacctaaggctgaaaatgaggcaccaattccaccagaacagcagatggaagaaatgcagtcctcagaggctgctgctgctgaaccactttcaatggttattccaatctcaaaaacaagactcgcgccatacagaactgtgataatcgtgcgactgataatcttgggtcttttcttccattatcgagttacaaatcctgttgacagtgcttttggtctgtggttgacatccatcatatgtgagatctggtttgccttttcctgggtgttagatcagttccctaaatggtctcctgtcaatagagaagcttttattgacaggctttctttaaggtatgaaagacctggtgaaccctctcagcttgctgctgtggatttctttgtcagtacagtcgatcctctgaaagaaccaccattgatcacggctaatacagtgctttctattcttgctgtggactatcctgtggataaagtatcctgttatgtgtcagatgatggtgctgcaatgctgtcatttgagtcccttgtggagacagctgactttgcaagaaagtgggttccattttgcaaaaagttttcaattgaaccacgcgcacctgagttctacttctctcagaagattgactacctgaaggacaaagtacaaccttcttttgtgaaggaacgtagagcaatgaagagggagtatgaagagtttaaagtgcgagttaatgctttggtagcaaaggctcagaaaacaccagatgaaggatggactatgcaagatggaacttcatggccaggaaacaactcacgtgatcaccctggcatgattcaggttttccttggacacagtggtgcccatgacatagagggaaatgaacttcccaggttggtgtatgtttctagagagaaaaggccaggctaccaacaccacaaaaaggctggtgctgaaaatgcactggtgagggtgtctgcagttctcacaaatgctcccttcattctcaatcttgactgtgatcattatgtgaacaatagcaaggctgtacgggaagcaatgtgttttctgatggatccagtagttggcagagatttgtgttatgtgcagtttccccagagatttgatggtatagatcgtagtgatcgatatgccaatcgaaacacagttttctttgatgttaacatgaaaggacttgatggcattcaaggacctatgtatgtgggaactggatgtgttttcaatagacaagcactttatggctacagtccaccatctatgcccaaattaccaaaatcatcatcctgctgttgctgcccctcaaagaagcaaaccaaagacgtctcagagctttatagagatgcaaagagggaagaacttgatgccgccatttttaatctcagggagattgacaactatgatgaatacgagaggtcaatgctgatttcacaaatgagctttgagaaaacatttggtttgtccactgttttcattgaatctacactaatggagaatggagggcttcctgaatctgctgatccctcaatgctgatcaaagaggccattcatgttattagctgtggatatgaagagaaaactgcatggggaaaagagattggttggatctatggttcagttactgaggatatcttaacggggttcaagatgcaatgccggggatggagatcagtttactgcatgcccttaaggcctgcattcaaaggatcagcaccaatcaatctttctgatcgtttgcaccaagttcttcgatgggcccttggatcagttgaaattttcttcagcagacattgccccctctggtatggttttgcgggaggtcgcctcaaatggctgcagagacttgcttacataaacaccattgtctacccctttacatcccttcctcttgttgcatattgtactttgcctgcaatttgccttctcacaggaaaattcatcataccaacgctttcaaaccttgcaagtgccctctttcttggacttttcctgtccattatagtcactagtgtgctcgagctgcggtggagtggtgtgaccattgaagctttgtggcgtaatgaacaattctgggttattggaggagtttcagcgcatctatttgccgtgttccaaggattcctgaagatgttggcaggtgttgacaccaacttcactgtcactgccaaagctgctgatgacaccgagtttggtgatctatacataatcaagtggaccacactcttaattcctccaacaacccttatcattattaatatggttggtgttgttgctggattttctgatgcactcaatggaggatatgagtcttggggaccactttttggaaaggttttctttgccttctgggtcattttccatctctatccattcctcaagggtctcatgggtcgccaaaaccgcaccccaaccattgttattctgtggtcagtgttgttggcttctgttttctctctggtttgggtcaagattaacccttttatcagcagacctgacagtgcaagcatttcccagacctgcatttctatagattgctaa

SEQ ID NO: 107202 - DNA, 270 bp, Glycine max
  Peptide Sequence Number=SeqID_223980
atgacccgtgcctacatccagtcctcaagcaacctcttgagatttcctttccttgtaaaaatcatttacaagcaaagagccacaaaggatgtaccttcccttgttctctttgatcaaccaagtagatgtaccctctacttaaagcgaaccacaaaggatgtaccctcccttgtgttcactattacaaccaagaagctacctgcttcttacacaaaattctcaaacgttcagttctttgaattcagtatttgggcaaagaattctcaaacg

SEQ ID NO: 107203 - DNA, 183 bp, Glycine max
  Peptide Sequence Number=SeqID_223981
atggacgttcaaggaaaagtagcaatatgttgtttctcacaaaacagtgctttagaacgtatgctaaacgatggagattgtttgaagtcaaaatgtcatataaaggagagcttagagcattcaacaggagttatggctaccatggaacataatcattaccttagcaaaattcttctgggataa

SEQ ID NO: 107204 - DNA, 1692 bp, Glycine max
  Peptide Sequence Number=SeqID_223982
atggcagctccaaagccagaggagataagccacccaccaatggaccaacttcaaggcttagagtactgtatcgactcaaacccttcctgggtggagacaatagttcttggtttccagcattacattttggccttaggaactgcagtcatgattccttcatttcttgtgcctttgatgggtggaagtgataaaattgatattgatatttcaaatattgatacgatgattcaggatgataaagtgagggtggtgcagacgctgctttttgttgaaggaattaatacacttctgcagacactctttggaacccggttaccaacagtgataggagggtcttatgcatttatggtccccattatatcgataattcatgattcctcattgacaaggatagaggacccacatttgagatttcttaacaccatgagagcagtacaaggggcaatgatagtagcatcaagcatacaaatcattttgggctttagtcagttatgggccatttgttctaggtttttcagtccacttggaatggtcccagtaattgcattagttggatttggattatttgaccgaggattccctgtggttgggcattgcgttgaaattggaattcccatgttaattctgtttgtagtcttctctcagtacttgaaaaattttcatacaagacaactaccaatactagagagatttgctctactaatatcaaccacagtgatatgggcatatgcacatctcttaacagcaagtggagcatacaaacaccgtcctgatttaacccaacataattgcagaacagacagggccaacctcatttcttctgctccatggtgccaggaagcaagcacttttgagctgttgccaatgactcttctacatgttgcctacaggataaagattccataccctcttgagtggggtgctcctacatttgatgctggtcatgcttttggaatgatggctgctgttttagtctccttaattgagtcaactggggcatacaaagctgcatcacgacttgcaagtgcaacaccacctccagctcatgttctgagccgtggtattggttggcaaggagttggaatcttgctgaatggcctttttggaacactgactggttcaacagtttctgtgattatccattacagagagaatgtggggctcctaggaagcactcgtgttgggagtcgaagggtaattcaaatttcagctggttttatgatattcttctcaatgttaggaaaatttggagctttatttgcatcaataccattccccatttttgcagctgtatactgtgttctgtttggccttgtggcttctgtggggctatcattcttgcagttcactaacatgaactcaatgaggaacctctttattcttggtgtagcccttttcttaggtttttctgttcctgagtatttcagagagtacacttcaaaggcccttcatggtcctactcatacaagggctggatggttcgatgatttccttaatactatattcttctcatctccaactgttgcattgattgttgctgtattcttggacaatactcttgattacaaggatagcgccaaagataggggaatgccatggtgggccaagtttagaacattcaatggagatagccgaaatgaagagttctatacacttcctttcaacctcaaccggtttttccctccacgataa

SEQ ID NO: 107205 - DNA, 135 bp, Glycine max
  Peptide Sequence Number=SeqID_223983
atgcatttgtccaattcaccactcatagacccataccgatatgcaagagctcgacctccaattaaggaaccttatgaaggcaaaatcaagcataagcccagtcaagaatctggaaagggtttgaaggaatactaa

SEQ ID NO: 107206 - DNA, 1320 bp, Glycine max
  Peptide Sequence Number=SeqID_223984
atggcgtccaagaagaagcactcagagggcatcgccttgttgtccatgtacaacgacgaggaagacgacgaaatggaggacgcagaagacgacgacggcgaagaagaagaagttgatgcagggatgcgaatggaagaagatgtcgccggagatgcgaaattttcggcgggggaagattccgccaatagaacagccgccgttgattccggcaacgaaggcggcgcggatgtggggttcattccggcggagaagagtagggttgggacttcgacaccgcagacgaacaatttgatctctccaccgctggagcaaccgaggattggtcggaaaggggctcttacgatagtggattatgggcatgacgaagtggcaatgtcacctgagcctgaggagggagagatatatggtagcggtagagtcatgattggggaccagcttcattactccatatactgtgtccttacttgggtttttgtgaatgaggttgagcagaaagagtgcattgatggttctgtttcactacttgttatgcttatgaatgggtatgtaaatactaaagggaataatagcatgctttaccttatggaatatgttattgcaggtgatttgcaagacagatcaccattgggaacagtccaagttttgacacctagcaatcaagctaacactccccagttctctgagccattgaaatctgataccatgaacaaagatgctatgatcagatcagatgatgctgaatttggagaagcagatcaagatgagcaaaaatatgtagatccattggataaatttctccctcccccatcaaaaactaaatgctctgaggagttacaagctggaaaaagttttaatgcagaagttcgcaacaggaaggactatcgaaaccctgacttcttactgcatgcagtgaggtaccaggatattgatcaaatagggtcttgcttcagtaaagatgtatttgaccctcatggatatgatccaagtgatttctatgatgaaatagaagctgatatgaggcgcgaaagtgagaggaaagagcaagaaaagaagaaagcacagaaggttgaatttatttcggggggtgcacaaccgggaattgtagctagcgcttctaggattagcatgcccattgcaggtgcttctgctgtgactgcaagtggtttgcctttggtgcctcctacagccgattctattaatcgggatggtagacagaataaaaaatcaaaatgggataaggattctgtatctactattggggttcatgcagccattttatctgctgctaatgccggcggtggatatatgcaatttgcgtaa

SEQ ID NO: 107207 - DNA, 294 bp, Glycine max
  Peptide Sequence Number=SeqID_223985
atgaaccccaagtctcatcggacttcccgaaaccgtaagaagcggcccgttcccggcccagctcggcccacaacatcctcgaaatcccaagtcaacaacaagccgccgcagcagcttgtcatgggtcaggtcaaaatactcaaacgcggcgaactgctgtcccaaacgacgccggatccacagccgcagacggaatccgtcgagaagaagacggaaaccgttgtaaaaaagggcttaacttcaactgtagaggcgggaaggtcgagtcaggagtgcaaatctcttattgcttag

SEQ ID NO: 107208 - DNA, 773 bp, Glycine max
  Peptide Sequence Number=SeqID_223986
atggatcaacatagaggtgaggtattggatccggttcatgataggaatttgagtcattcggttgaaggtgttgcaattgcaagagctagtataagtggagaagtaggagaggtggatgaggatttgggatctgataaggaactaaaggacgatgttaagggtcaagacaagcatgatcaagaaaatattagtgataaattgcctggggttgatcaggggactagttataattcaaacaatttggttaatcaggaagtgatagaaactgtggttgtaattgagtctgttcagaccgagtatgccaatgaagataatacgaaactggaagcaaaagttgatgaatcagggttgagcttggtatccatgaaagcaccaaaaggggtgtctgaaactgataaaaattcatgtgtgattgatataaagtgcagcagccgcaaaaaaatttacaagagttctgaaggtgaaagaatttgtaggatttgccatctgacttctgggcagtcatcggatgcaacaactgttggcacttctgatagtgctacaagcgcagatttgattcagcttggttgtgcgtgtaaaggcaagccaggcattgcacacgttcattgtgctctggcgtggttcaagcttaaggggaacatgttatgtgaaatatgtggtgaggcagcaaaaaatgtttcaggtgttactattaatggatttatggaagagtggaatgaaagaagattgatggacaccgaaggtaacgcgtcccacagggttgttggatgctg

SEQ ID NO: 107209 - DNA, 264 bp, Glycine max
  Peptide Sequence Number=SeqID_223987
atggcagtccccaaaaagattctaaagattcaaattgctcaatgtagttcctctttgagggaccatgaggtgaacatagagaagcttgacacaactcttagaggaagtgtccaaatttgtaccgcacagtccttctcatctaggtatagctacattgtgttttcatttgcaaaaaaaagttgcatgtttgcatctaatgaccttaaaattgagcgacgccttgttacatgcttcaatgcttgtttggttgatcatattgagtaa

SEQ ID NO: 107210 - DNA, 177 bp, Glycine max
  Peptide Sequence Number=SeqID_223988
atggtggacgcatgtgatttcttgctcgtcaacgttgtatgcacaattgaccaatacaaaagttggacagaaaagcacaatgtgaactctggagtatggattatttacgagaatgggtggtataaacagttcgtcggggtttctctccaccaccacccactctttctatttctttaa

SEQ ID NO: 107211 - DNA, 276 bp, Glycine max
  Peptide Sequence Number=SeqID_223989
atggctacaccatcgagctcccctcttcccgagtctgcctcttcgttgtcaatgtcgaaaaggattagaaaagccatacaactcagatcatattctgctagacttgtgagggtggagagaccactagttcatgtggatcctaccacttggaaagctgatggtccccaccaaaagaaattaaggacctatttgggggctaaatttgatattctggaagtgtccgataaaaggacgaagaagaaaatcctccagattgcagcagtcagtacatcctaa

SEQ ID NO: 107212 - DNA, 555 bp, Glycine max
  Peptide Sequence Number=SeqID_223990
gtagaacctgtccatctgcttgtcgatgcatgggcaactgcaattgcttcctctgccaatcaagcattggcccctatgtatgatacattggaaagtgatttgaagaagcctttgtattcaagatgcaagaagtcattgacactgttgtcagcggtattaagtctggctaatgtgaaggccaaatatgggtggagtgacaaaagcttcacttcatcgcttaagaaaattcatgcatgccctaatgattgcatattgtgtagacatttgccccaggtgttatggtatctttctatcactccaaggtctaagggtctgtttgctaatggagatgatgcaaaagaccttacatggcatgcaaataggagaaactgtgatggaatgctttgccatccgacttattcctcccagtggaagaagattaattggccaagacaactaggaaatgacattgatgtttatctcaatcccttgattgaagacttaagaaagttatgggatgagtgggttgacgtgtttgatgggagtcaaaatgagacattcaagttgcgtgcaatg

SEQ ID NO: 107213 - DNA, 651 bp, Glycine max
  Peptide Sequence Number=SeqID_223991
atggttcatccaattttggatcagagcttctttcttgacaatactcacaagatgagacttaaggaggagtttaaaattgaaccatggacttttgagcaacatgttggagaagctgtcatcattccttctggatgtccataccagattaggaatcctaagtgttgtgtacatgtggaattggaatttgtgtcccctgagaatgtctccgagtctatccaattgattgatgaggtccggctgcttcctaaagaccataaagcaaaagtagaaaagctagagccaaattcatgggaagacaccatgagagatgaattggatcgcaagaagtatccccgtatgccatggcataatgtccattgtgctctttggggacctccctgtcgtgacattgctcggcactttgttcaacattggaaccatgctaagagaactaaagctccaaatgaacatggaattccactacttatgcctcaccatcacatggtcctccctcattacatgggaagaagcaaagagatagacattaatgaaaagaaagacaaagacaagaggaaaggaattggcaggcaggattcattttcctttaatccaaagaataagattactgcagtacctgctgaggaagaggaaatctggggtgcattcttcaag

SEQ ID NO: 107214 - DNA, 2730 bp, Glycine max
  Peptide Sequence Number=SeqID_223992
atggacttagaaggaagtgaaaaggattcagtggttactcagattagcattggcggatttggcagtgaggtcaaagcaagtgatctcgtgaattacttggaggataaaattggacttgtgtacaggtgtaggttgaagacttcttggacccctccagagtcatatccagaatttaatatcattgatactgcaaatattagaagaacggataactataagaaggtggagccccatgcctttgtgcattttgcatctccggaatctgtgactgcagccctgaatgcttcaggttgttgtgatctatttttgaagaatcaacccttaaaggtcagctgtgggcctgaaaatccatacttcctgaaccaaaggaggagaactacaactccttttaagatgtctgatgtacttgttgaaattgggactttggttagcccaggggagttttttgtttcttggagaggacctgataaaggtgtaaaatttcttgtggatccctttgatggcatgtgcaggttttgtttcagtagggatactgcattctcattcaaagggatagaaaaaaaagcagtgataaagtgtgattttcaggtgggattcctggttagagacattaatgagatcaagagatataatgatacatcatatctcgttgttttattgcacctagcttcttcaccttgggtttggtacagaactgccgatgatgacattgaagaatcagtaccatttgatttgctagatgatgatgatccttggattagaaccactgattttactcccagtggggcaattggtcgatgcaatttttatagaatttcaatcccacctcgccatggtgcaaaattgatgaaggccatgctttatctgaaaggtcaaagagtgcaaatgcaagaacttgcacttaaacagacacttaggacactgaatgaacctgattttggtgtgcccatgtcagatgctttcttctatatacattttcagaaggacattgcttttgacataatgtttttggtcaatgctattgtacataaaggcatattcaatcagcacaggttgtcggataggttttttgaattgctgaaaaatcaacctaaggagctcaatgtggctgccctgaagcatttatgttcttacaagcgcccagtatttgatgcaactaagaggctaaaaatagtccaagaatggttgctcagaaatcctaaactttatcagatctctaaacagttggatgatattgttgaggttagaagattggttattactccatcaaaagcctattgtataccgcctgaagttgaattgtccaacagggttctcagaaaattcagagaagtttcagattgtttcttgagagtcacctttatggatgaaggcatgcaaacaattaatgtgaatgctcttaactattatgttgctcctatagtgaaggaaatcacatcgaattctttctctcaaaggacaaaaatatataaaagggtcaagactatcttggaacagggattttacttttgtggccgaaaatattcatttttagccttttcatccaatcaacttagagatagatctgcttggttttttgctgaagacaaaataagatgtgatgatatacgaaattggatgggcaagtttaatcagaggaatgttgcaaaatgtgctgctaggatgggacaatgcttctcgtctacttatgcaacagttgaagttgctgcaaatgaagttaactccatgctacctgatgttgagaggaacaattacattttctctgatggtattggtgttatcactcatgatcttgcaagggaagttgcagaaaagttgaagttggacaatgtaccctctgcttaccagatcagatatgctggttttaaaggggttgtggcctcttggccggccaaaggggatggagtcagactttctttgaggcctagtatgaacaagtttcaatctactcataatatcttggagatctgtgcttggaccaggtttcagcctggttttcttaaccggcagattataacattgctttcagcactgggtgtgcctgatgaagtattttggcaaatgcaggaggcaatgcttttgaagttaaatcaaatgcttgtggatgcagatattgctttcgatgttcttaccaaatcatgtgctgagcatgggaatgctgcagcaataatgttaagttgtggcttcagtcccctaacagaacctcatcttagaggaatgctaacttctacacgtgctgcgcagctttggggacttagagaaaagtccaggatttttgtatcgtctgggagatggttgatgggtgtcttagatgagtcgggcgtgcttgaacaagggcagtgctttgttcaagtgtctactccttctcttgaaaattgtttctcaaagcatggttcaagattttcagagacaaagaacctgcatgtagttaaaggttttgtgattatagcaaaaaatccttgccttcatccaggagatgtaagagttttggaggcagttgatgcccccgatttacatcatttaaatgattgtcttgttttccctcaaaagggtgacagaccccatacaaatgaagcttctggaagtgaccttgacggggatttatattttgtcacatgggatgaaaatctcattccaccaagtaagaggagctggatacctatggagtatgcccctcaagaaagcaaacttaagacacgtcaagtgatgacccgagtatgtcccttttga

SEQ ID NO: 107215 - DNA, 381 bp, Glycine max
  Peptide Sequence Number=SeqID_223993
atgaagttctggaagatcctcaagagccagatcgagcagaccctgcccgagtggcgtgaccagttcttgtcctacaaagacttgaagaaacagttgaaggttatgtgtcccaaagatgctctaactccacctcgtttggatgctgacgagcttaaccacttccttcgcctcttggagcttgagatcgataagtttaacgctttctttgttgacaaggaagaagaatacatcatcaaatggaaggagttacaagacagggttgccagagccattggttcaaacttggagttgatgtcactagggaggggaattgtggattttcacggggagatggttttgttagagaactatactgcactcaactacacaggcatgctctaa

SEQ ID NO: 107216 - DNA, 219 bp, Glycine max
  Peptide Sequence Number=SeqID_223994
atggaagttatccctatagatgccacatttatgcctgttcgaaatgtaccgaaaccattaaaagaacgcccaataacttattgggcactgtacgaagtatttgaaatacgggaaagaaataccattcgggtaatatttccaaaggagttgcaaatggatccgcgggttccccaatcatggatggttctagaaccgctaagcctacgttacaggcaatag

SEQ ID NO: 107217 - DNA, 1057 bp, Glycine max
  Peptide Sequence Number=SeqID_223995
ggcaaaccgctttatcagcacgttctgcagcgtttacagccgcaggtcaatattgtgttgattagcgccaaccgtaacattgatcgttatcaggcaagtggctgtcaggtgattcgtgattcgctgcctgattatcccggtccgctggcaggcatgctcagcggcctgcggcacagccagaccgaatgggtggcgttttgcgcctgcgatacgccgtggctaccgcaggattttgttgcacggctgtggcagcagcgtggtgcagccgccgccgtgtgggtgacatcgggtcagcgtgatcatccggcgctggccctggtgcatcgtgcgctggccgatgatctggaagcgtggctgctgcgcggagaacgtcgtctgatgcagttcatgcgagaacatggcggacacggcgtactgtttgatgatgatgaagccgccttccgcaatatcaatacgcctgacgatttggttaatgaggaaagtgctggcaccggcaaaaccaccctgttacaacaggtgattccgctactgagagcgcagggcattcgccccgggctgatcaagcatacccatcatcagatggacatcgatacgccgggaaaagacagttatctgctgcgcaaagcgggagccgatcaggtgatcgtcgccagcgaacaacgctgggcgttaatgtgcgaaacgccgcagcagccgcttagtttagcgcagctggcaggccgtatggacgttgcatcgctggacctggtgctggtcgaagggtttaaacaggaacctgtacccaggatggtgttgtggcggcgcggcgttaagggggaaattgatgaattgctggacgactgggtgattgccgtagcgacggatgaagcgttagcgcttcaggtaccggtgctggatattaatcagcctgatcagtacggacgtaaaaaagccccggactctcgtccggggcttcttcactggtttgatgcctggcagttccctactctcgcatggggaggccccacactaccatcggcgctacggcgtttcacttctgagttcggcatggggtcag

SEQ ID NO: 107218 - DNA, 856 bp, Glycine max
  Peptide Sequence Number=SeqID_223996
cgtgttccatcacgaccgagaacttgcaccgctcagccagcagcccgtgatccggcagaaccgcgacacgctgtactcggtggcggtgaccgatctcgccgagggcggggcgacgctgacgatccccgatgcaggcgaccgctacatctcggtgatggtgatcaaccaggaccattacatcaaccgggtgttccacgaggccggcgtgtacgagctcacggcggacgagttcgacaccgcctacgtcgtgatcgccgctcgaatcctgttcgacccttcggacgaggcggatctcgccgaagtacaccggctccaggacgctctgacggtcactgcaggcagtcagcgcgagttcgtataccccgactaccacccggtgagctacaagggagtccgtgacgccctcctcgtgctcggcaagaccatgagcgggctgaacggatgcttcggcgctgccgggaaggtcgacccgatccgccacctggtcgccacggcctcagggtggggcggactgcccgacgccgaggcccagtacatcaacatcgacccacgtcgcccccgcgggcgctacacgatgacgttcggcaccgacgtgcccgccgacgcgttctggtcgctcagcgtttacaacggcgacggctacttcgagcccgatgcaagcaacgtcacgaatgtgaactcggtcttcggcgcgaaggacgacgacggctcgaccaccgtccacctcggcgattggcccagtgacgccccgaaccgcatctcgctgcccgaaggttggaatctgctcgtccgcctctaccggccgcgtcttggccaactggccgcgtggtcgatccccgaaatcgtcgcccactga

SEQ ID NO: 107219 - DNA, 567 bp, Glycine max
  Peptide Sequence Number=SeqID_223997
atggcgccaggctcctcatcgctggagaagcacgccgacgggacggccatcgacgcgggcggcctcgtccccgacgtgaaccgcgtgaacagctgggtgcagtcggtggaccaggtcgatccgctcgagatgctcgaggtgcagctcgcgaacacgacagcgccgttcctgctgatcagccggttgcgcgcgtcgatggccgcatccaccgcgcaccggaagtacgtcgtgaacgtgtcggcgatggaggggcagttctcccgccgctacaagggaccgggccacccgcacacgaacatggccaaggcagcgctcaacatgctcacccgcaccagcgcgggggagatgctggagaaggacggcatcctgatgaccgccgtcgacaccggatggatcaccgacgagcgcccgcactacacgaaggtgcgcctcgccgaggagggcttccacgccccgctcgacctggtcgacggcgcggcgcgcgtgtacgacccgatcgtgcgcggcgaggcgggcgaggacatccacggcgtcttcctcaaggactacgagcccagcccctggtga

SEQ ID NO: 107220 - DNA, 222 bp, Glycine max
  Peptide Sequence Number=SeqID_223998
atgactttgttgttcccggaggaacaaaaggtgcagaagactgtgtcagcctctgcatgctatcaagcgttctgtcttacagatagcaaaagaatgggtgcgaataaccataagaatgaccaaacttggtctctgcgtgccatcggacacaactgtgtctgcctagcaaaggggggtgcagataaccgtaaggtatctccgcgtatcatgggtgcagaatga

SEQ ID NO: 107221 - DNA, 129 bp, Glycine max
  Peptide Sequence Number=SeqID_223999
atggctcgggttcttgagaagaaaagccaccactttcagttgacaaacatccctgttcaatttgcaaatgaaaggggcttccaaaatggtgttgttgtacggtcacctactaaacttgtgcgaaattaa

SEQ ID NO: 107222 - DNA, 534 bp, Glycine max
  Peptide Sequence Number=SeqID_224000
atgggacaaacaaagaagttcagaggagttaggcaacgccagtggggctcctgggggaagagaagggtgtggctagggacatttgagacagctgaggcagcagcaagggcatatgaccaagcagccattttgatgaatggtcagaatgcaaagaccaatttccccacctcaaagaaccaagctgaagctgatgacaacaacaacactgacactttcttatctccaaaagctctttcagaacttctcagcacaaagctgagaaagtactgcaaagaccctgctccttccctcacttgtctgaggctagatgctgataattcccacattggagtgtggcagaaaggggcaggaccacattctggctccaactgggtcatgaggttagagcttggaaagaaacaaattaccgaggagggtagtgagtcaacggagtcaccacaaagtagtactaatggtgctactgaaaataatgaagtagaagaggaggatagagtggctttgcagatgattgaagaactacttaattggaactag

SEQ ID NO: 107223 - DNA, 267 bp, Glycine max
  Peptide Sequence Number=SeqID_224001
atggtaacttgggtcgtggacaagccacctaccttggaaaaacgggcttcctattacgtttcaaatcatagcatagaaacaaaaatgcctcagttgctacacgggacgcttaaggtaaccatatttgaagttgatagactacatactggatgtcatttggatttctgccagaagaaggttaatgcatatattataaaaacgaaagtttacaattttacccaacaagcaggggcgggtccagaaatatttattgagcaactaacataa

SEQ ID NO: 107224 - DNA, 132 bp, Glycine max
  Peptide Sequence Number=SeqID_224002
atgccgcatttgctgcacgggaggctcgatgtgatcatatacgaggtcgacacactaccaactctcaacgactgcaatcttaacctctgcagcaagattagaagtcaaattaaaaacaaatggggaggataa

SEQ ID NO: 107225 - DNA, 1317 bp, Glycine max
  Peptide Sequence Number=SeqID_224003
atgcatagaaatgatttccatcagccaactttcccaaatgcttccatagataaaggcggtccaagagagccgtggcatgacattcattgcaagctagaagggcctattgcttgggatgtcttgtacaattttgagcaaaggtgggagaagcaagttgggaagaagttgttgtactcacttgatgatcttgatgagattcttgtccacccatctgaagcacaaaaatcagaagtgggagtagaagaaacatggaatgttcagttgtttagatcaattgatggtggtgctgcttctggcttcccccaaaccccgaaagaagtttctgaattaggccttgttagtgggaaagacaatgtcatcgagagaagcattcaggatgcatacattcatgctattcggcgtgcgaaaaacttcatctacattgagaaccagtacttcctagggagttcatatggttggcaagcaagtggtgatattgtggttgaggacattggtgctttgcatcttataccaaaggagatatcattgaagattgcaagcaagattgaagcaaaagagaggttttctgtgtacatagttatccctatgtggccagaaggtgtacctagcagtgattcggttcaggcaatattggattggcagaagagaaccatggagatgatgtattctgacattactgatgccttaaaaaaaactggcattcaagcacgccctcgagattatttgacatttttttgccttggcaagagggagaataaggatccaggagattatactcctctagagaaaccagagcctgatagtgactatggaagagcacaaaattctaggagattcatgatctatgttcattccaaaatgatgatagttgacgacgaatacataatcgttggttcagctaacataaatgaaaggtcaatggagggtgcaagagacacagagattgcaatgggtgcattccaaccacgtcatctagcatcgagtgggcgacccaaaggggagatatatagatttcgacgtgcactatggtatgagcaccttggggatgatggttttgggtcaaaaatattcgattttcccgaacatttggaatgcatcaatcatgtgaataaacttgctgaggccaactgggacatgtactcaatggaaacatttgttgaaaataaaagacaatttcaccacctaatgtgctaccccatacaagtaaccaatgatggagccataacaaatcttccggggtttgaatattttcctgacaccaaggctcggattttgggttgcaaatcaaaacttattccttcaattctcaccacttag

SEQ ID NO: 107226 - DNA, 801 bp, Glycine max
  Peptide Sequence Number=SeqID_224004
atggacacaatccttaaacctttggttttagaagtaggacaaaacctagacctaatttctcagaatgagcttgaatatggaggagaggaggcaccagtgtccccaaggcagccaatgcatcaacagaattcccagactgcaatgcacaacactaactttggtgcgtccataccctctaatgcatttggagcaactgtggcaggacaggggatacgtgctggacaacctgatcaacaaccaaagaactcagtgttctcaaatgcactctctagtcctattcgacgcagccttcagccatatcatttggcacaggggagctttccttcatgtaatatcatgtcttcaggaaatggaacccggaatagtgacatgacttatcctaatggccagaacagggacacaaattcttccaactccagtgattgcatggatatgcattcagatagtcctgaaattgtgacggtagttttggggggttttgacagaggaagaaagatatatggagatggagatggagatggagggggagggggagggaccatcgatactgatttcttgaccaagaagaagaagcaagtttcggtgcaacttccgagtttgacatcacctgtctccactgtgaggttctgcgatctcaattttggccgcttgcaaccttcggatgacgaattggatcctcacaatagatttgagtttggcaatttcgttgcacgacaagccctgcttcacgaagagtattggacagcagcgtggctaagggcagaagagtgggcaagtcgaacagataaactgtatgacacg

SEQ ID NO: 107227 - DNA, 3573 bp, Glycine max
  Peptide Sequence Number=SeqID_224005
atggtgaagtatagagtgcagaagaatgcaaatgcagcattagatgcgaaaggagaaacaagggatagatggtgcaagagagaagtgggggaggatgacatcaaaaagactaggactaatggagaagatgcaggatggaaggttgttcggaataggaaatggagaaacagggacattgtttccttcttcattaccaatttcccggattatgattggaaggaattataccagatttttcgtcgatatggacttgtgaaggaggtatttgtggcagcaaggagaaatagaggagagaagaggtacaattctgtgagggttgatgcagcgtgggttcttgtgatggtgttgtcaattcaggctatgagaatagatacacaggtcaggattaagaataaaatttgcagaatctgtttgatggaggagaatgtggtgcaggtggttcagtgccggtgtagccgagatagtgaggaggaacatctacgggaagtggtggacgaaaagggacaagatgattggagggccagccagcgaccttgctccgacgaggtgatggtacaaaaaccggtgggcaatagcaaaaagactaaggacagtacaaactatccacctaacggtggtaatcagaaaaacctggatctagaaagttgtttggtaaaggggtttttggaggccagaaagaaggtgatggaggtgggcttagggctcaaggaaggtacagtggaaaatatggatgacgacagagaggaaagaggtttgaattttgaagagaagatttttgaaatgaaagatgaggggcccacagagcacaatgcatgtgtagataaaggaggagggaacagggagcatagtagcctggagtcagtagagaagagtgtaagcttgattggccttgggagcaaaaacaagaaagcgttatgggtgcatagtgaagaggaggaagcaaataaggtgtgggagactggccagggattgggtgtgcgtttgcaaggaaacaaggaagctatgatacaaaaccgggttttattgcaaaaaagagactatagtcagaaaccaggcccatgtgcttcgaaaaaggagggcacgggaagtggcaatgatgttaacgacgaaactaagaaggaggtggttaacaaggagttgtgttgtgcattatgggggaacaatgatgtgcaatgggagatgactctgtctattaatgcaataggtggtcttttgtgtctttggtgcaaggaggcatttaaactaaataatacttttagaggaaatggctttcttgggttagaaggcatatggagggaggggagggtagaaaatcgagatgttactttggtcaatatatacttgccttgtgatatggaagggaagagaagattatggagggaactaaaggataaaaaaggtagctcaaccaatcctacatggtgtgtgatgggagactacaattgtgtaaggagattgggtgaaagggttggtatcaatggtgaacaacatggagggagggaggatgacaagccaaatggaaaagccaagagtagaattgatagagttcttatctcaaggaagtggctggactcttggcaaggttgcactcaatatgtcttgaataggaatgcatgggatcattgcctgatacttgttaaaaataactcttttgattggggtcctagatcatttaagatcttcaattgttggtttcaagacaaaaggctccatgagttggtgaagaagtggaacaaggaggagtttggtatcttgaatgagaagcaagcaagaattgaaaaagaaattaatgcacttgatgtaagaattggggtcttagctaggatgatttcaatagtagattgcaatttcaagaagaattttgcaaggttgccttgcataatgaatcctttcttagccaaaagtctaaagctatatgggggtgtgggaggaggacccactcaaagtgaaagaggaagtgaggaggtccaagagattaagttagctatttggagttgtaataactcaaaatgcaccggcctgaacggcttcaacttttgcttctttagggagttttgggaggttttggacaaggttattgatcataggcaaaacgtctttctttgtgggagacaattgcttcatagtatgatggtgactaatgagtttctcacatgcatgttgaagaggttggacttcaatgacacttgggttagttggataaaaggatgtttaaattcttcttggtcttctgtcttagtcaatggtaatccaactcaagaagttagatgctctacgggactacgtcaaggggatcttttagcccccttccttttcttagtggtggcaaaagggttgagcagtttgatgagggaggctaatgcaaccaattcattgaggggatatgaggtggggcgtgaaaagtgtgtgatatccttactacaatatgttgatgatacaatctttgtgggagaagcaaatgctagaaatgtattcactattaaagtcatcttgagaatgttcaaattggcatccgatttgaaagtatacttcttcaagagtagctttagggcaattggtgtaggaagtgaagaggtggctacatggaatcctataattgacaagttcaaaaagaggttggctacttggaaacacaagcaaattgtctttcgatgcttgatgaatttggttcttgtggggtggagattattcaagaaactgagagaaagaaagagaaaaccagagaaaaaggatgcgtgtaaaagtaagaagaatgggggacatggagtgaaggatttagccatattcaatgatgtgttgagcttaatgacagatgatgatcttccatgggaatctctacggtggagacatttgagaaaaacttgtggcataaggaatgaggaaaaatggtttgatagtggtgtatcttggaaagttgggagtggagataagataagcttttggaaggatgagtggatggaggggcaaagtttggaagttttatttccaaggctatacatactctcggagcaaaaagagcatttaattggtcatatgggtatatggagggaagaaacatggcattgggatttaaaatggcaaagggtgttgtttgagtgggaaaatcaactcattatacagttaaatggttttttggctaatgtgcaggtctgtagagaggatatggatttatggcttggtcgggatgctcttcggggatttactcaacattctcggcttgtaaatggagattacaagagcatgtggctcggaaagctaggtcggcatgctacttggctatcctctgactttgtgacagtggattcaaacaacttaaagggacattgctggcaacatatggacttaggaagatcaaagtctgaatcccaagcttggaggaggttaaatttctggtctggtcatggctccattcttcagcaaaatggttcaaatcctcctttgtgcagtggtattacgaccctgcagcttctttgtatggagggggccaataccttaacagaaatgaagggagggtgttggatcatgtattgggatcctgttctttgttgtttggttgcagcggggttatgctag

SEQ ID NO: 107228 - DNA, 264 bp, Glycine max
  Peptide Sequence Number=SeqID_224006
atgagcaggagtttgggaattccggtgaagctgctccacgaggcttcggggcacgtggtgacggtggagctcaagagcggagaactctacagaggaagcatgatcgagtgcgaggacaactggaactgtcaactcgagagcatcacctacactgccaaggatttaattgaggacttgaagttcggaaatgcaactttgaattgggttttaaggccaggaattagagataaggtagggtgtgtttgggacacctgcaacaactag

SEQ ID NO: 107229 - DNA, 471 bp, Glycine max
  Peptide Sequence Number=SeqID_224007
atgattcaaacgccgttttcatggaccccgtccacgttctcaatcgttcctacctccgcgtcaccgtttctccttctagctactattcccgttttttcaaatcctcctcaacaacccccaactccgtcaccaccgttacttcccctctcacgacacagaaacggaaagagcctcgagctttggttgacacgtgtgggttgtgtaggaagcgaggcctctgttgttggcggcacacgagtggcgcctcaacttgaggtaacgctaaatttacgtgtcggtgacgctgactctgaccctcacctgcccccaaacgatttggaagagattcgcctagtgtgcaatgctgcggtgctccctgcattcaataatttggttgctaatgacaccaaggatgacgcggtggctgaaattttgaacaatcgttatataatgccccaggagagttgcttttacatggtttttaattcttaa

SEQ ID NO: 107230 - DNA, 339 bp, Glycine max
  Peptide Sequence Number=SeqID_224008
atgtcgttgtgctacgccatcgaggtcaccctcacaacctcaccttctacctctgcctcagtgagtcttccccgccgctgcgccatcgttcctcagcaacttcgggtcgtccttgcacaacgccgtcgaggttgccctcacggcctcagcttctacttctgctttagcgagtcttcccctccgctaccgctgcgccgtcgtgccacaccaacgtcgggtcatctttgcacgacaccgtcgaggtcgccctcaccctcaccctcaccctctacctctccattctcgaacaagactacattcagtgcattggtatttgcctatttggtactttggtattga

SEQ ID NO: 107231 - DNA, 1155 bp, Glycine max
  Peptide Sequence Number=SeqID_224009
atgaatgtgagtttgatgtggaactctgtcggtttctatcagattgctaagctgagtatgattccagtatcttgtttcctggaagttatcttggacaatgtgcgatattcaagggacacaaaacttagcatttctctagttctccttggcgttgctgtatgtacagtcactgatgtgagtgtcaatgctaagggttttatagctgctgcagtggcagtttggagcacctcactacagcagtatttgttcatcattatctcctgcaccatcgcagtagggacaaacctcagccagttcatctgcattggcaggttcacagctgtatctttccaagtccttggacacatgaagactattctggtactggccttaggtttcgttttcttcagaaaagaaggtgtcaatttacaagtgattctgggcatgaccattgcaatagcgggaatgatatggtatggcaatgcatcttctaagccaggagggaaggaacgtcttagcttaccccttaaccatacccccaagacacaagaggtgagggtgagggtgagggcgacctcgacggtgtcgtgcaaagatgacccgacgttggtgtggcacgacggcgcagcgggcaacctcgacggcgttgtgcaaggacgacccgaagttgctgaggaacgatggcgcagcggcggggaagactcactgaggcagagggaccgagagagagacagaggcgccgcgagattgttggaggaaggagactcaggagaggccgggactcacgaggctgaaaaggaatatattatgggtgataggctagtagttgaccaacagcacacgggtgatgcacaacttccatcttctcctccctcaaaagatgatatggtttcgtgtgttatggctttggaggctgctttgcttccctttgatgtggataggtatgcaagagattttatggaggctgccaagaagcttcagctttattttatcagcctgcaacgagaggataagccaacaaaacttgaaatgcttagaaaggaggttgctctcatggaagaggagcttaacaaaaaaaatgagctgataaaaaagcaagaaaatttaattcaggagtggaagaaagagttgaaagatcagttggacaaacacaagattgagttggatagggtttag

SEQ ID NO: 107232 - DNA, 375 bp, Glycine max
  Peptide Sequence Number=SeqID_224010
atggaggttggggcatggatgtttggaatgaataacaatagatataaggatttagggcttagaccatttgtgtatgcaagatccattggaccttgggaggcaacatcttgtactatgtctgttccttggtctctgttacggactttacttggatttagggttcaggcgttattagtttgggaaatgtccaagtttatggtcatccctgacatgctgaagaatgctcctatgtttaagcgtttggatgcaagaatcaagggtaagggtgcatcacttggtgttggtaggggcagagcagttgcaatgcgagcaaaggctcaagctgctgggcgtggagctgcgcctggaaggggtgtaccaccagtgcggaggtga

SEQ ID NO: 107233 - DNA, 1719 bp, Glycine max
  Peptide Sequence Number=SeqID_224011
atgggtgtcagtttccatgactacaagacctatagtcgtccacggctgcagacatgcaaatgccaacaggctgaaagtgcgagtggaataactacaggagatgaaaatggatcaagacttgtgaatgatggtgaaacatcaaattcagtaagcaatgggatgagtgcaaagcatatcctagagtttgaggatgtcgaagcccaacagttgaaacaggaaaaggaggttttgtcatctaatcttacaaatggatctattacagacagctttgacacaattggccgcaactctattgaggaagaagcatgggacctactaagggaatctgtagtttattattgtggcaatccaattggaactattgctgcaaaggacccaaccagttccaatgttttgaattatgaccaggtctttattcgtgatttcattccttctggaattgccttcctattgaagggggagtatgatattgttcggaattttatcctttatacacttcagttgcagagctgggagaaaacaatggattgtcatagtccaggacaaggtttgatgcctgctagttttaaggttaggacagttcctttggacggtgatgattctgcaacagaagaagttttggatcctgactttggagaggcagccattggtcgtgttgctccagttgattcagcatacggaaaatgctctggtgatctatcagttcaggagagagttgatgttcaaacaggaattaagatgattttgaagttgtgtcttgctgatggctttgacatgttcccaaccttattagtaactgatggttcttgcatgatagatcggaggatgggaattcatgggcatcctttggagattcaggcactgttttattctgccttactttgtgcacgtgagatgcttactccagaggatggatcagctgatcttatacgggcactgaacaaccgtctggtagctctttcatttcatattagagaatactattggattgatatgaaaaaattaaatgagatttaccgttacaagacagaggagtactcatatgatgcagttaataagttcaacatatacccagaccagatttctccttggttagtggaatggatgccaaacaaaggaggctatttaattggcaacctacaaccagctcacatggatttccgatttttttcactgggaaacttgtggtctgtcgtaaacagtttggccactgaggaacaatcacatgccattttggatcttattgaggccaaatggtcagatttggtggcagagatgccattcaagatttgttatcctgctcttgatggtcaggagtggcagataatcacaggcagtgatcctaagaacacgccttggtcctaccataatgcaggctcctggccaacactgctctggcagctcaccgttgcatgcataaagatgaagagaacacatattgctgcaaaagctgttgagattgccgagagacgcatattaagagacaggtggccagaatattatgacacaaagagatctcgattcgtcggaaagcaatctcgactatatcagacttggtcaatcgcaggataccttgtggcgaagctgctgcttgcagacccaagtaaagcaaacacattgatcactgaagaggattctgagcttgtgaatgccttgataagtgccaaccctagaggaaagcgagggcgcaaaaatttgaggcagacttacattgtatga

SEQ ID NO: 107234 - DNA, 474 bp, Glycine max
  Peptide Sequence Number=SeqID_224012
atggacccatatttaacatctaaatatgatcttgattatgttctatctctacttattgactttccagaaactagttctactaataagtttccatggaacacaaacgggtgtcaagcaatcaaggttagagtaattggatctcaagtgaaagctatcaatacttctaatgggaggaatttacctgaatgcccaactttaatctttgaattttgttggacgtggggtttgaagcgattgctcttacactacagtattactttgtttataaacattcaagaaatagaaatctgcatgggggaggaagatggatatatgatgacaaattgtggtgctgtgaactttttggtgcatagatttcttgtgattaattttgcaccgttattggatgtggctaaagatgactccaagaataatgtacaacagagtcagcaaaaagttcatggaatgcagccacagctacaacaacaacagtag

SEQ ID NO: 107235 - DNA, 2274 bp, Glycine max
  Peptide Sequence Number=SeqID_224013
atggatttttccttgggtagtgaggatccacctatacttaagctgcacaaatgggacctgtctgaggcccaaattgggctttcggactttcgcgaagcttttctttctcctacgagagagatactgcttttgcattcttatgagagggaagctcttttgcttcctctgagtaaaggagagttgcattctggtggtgctgaaggtggctatgattatgatgataatcacaatccaggttctgcaaatgtttcctcggaggcatccactaggcctagtgaatcagttttggtgaatgattcaccttgcacttcaggttcagatgttgatattgatactgatcttgtgggaattaaatgttcaaaatccaatagtctcccatacattagtgatgtgaactcattggcctgggctcgctgtgaggacggctatgatcagcacaaagatgctttatttagagaggttctatttgtttctgggagatgtggggtaacagtccatgcttttctcaaactaacaaaaaccaagggaatggttcaacccatgttggagggtaactttaggcaaggcaggtgggttgaatgggggcccgttgctgcattatcttccgacttcagtcatggagtctctggagaccagaatgtaaatttgactggagatggtggagttgaatcattaagaggttctgctactaagagatacttagaatcatttttcacaaaagttgaaactactgtatctgatggtattcttttgaccaaattccctgagaataatgaatttccttgcttgacagaagtggtttcttttagcatatttgatggcagtctatctttggaccatctcctcaaagaaaaaacagtccaaagtaaggagaattggcaggaaccagttgattcagcaagagatgcttctgaccgctctagcttgagcttttgtggagcagatactaagcttgattgtgatgaagatcaaagaggcagaagcagagatttacttcttgttgccaagttagataattggggtattcggtgggtttcaatggtgaagcttgatgaaagaataaacacagttcagtcagttgagtggatggatttccaattttctgataatcttcttgtctgtcttaattcttctggcctgattgttctctactctgcaatgtctggtgaatatgtgacacatttaaatgttttacaggcttgtggccttaaccctcattttaatttgcaagggttagaaaagttatattcacatgataatatatatgctaaacaagagtgtagcataaatgataacatgtctgatcagcagagtgattcttttaggggatcattcaagaggttagttgttgcttcacactcctccctgttagctgtggttgatgaatgtggtgtgatctatgtgatctctttgggggaatacatacctgacaaaatttactcatctgagaagttacttccgtattgtcagcaatttgtgcagggaatgctggttggctgggaagttggtggttctgatatagatcgccaagcagtatactccaatttatctggacactttcgatcaaatgatttaaacataaaacatggaaatgttgctttgtcagacaaagctgtggcaggtaatgcacttcagaaaattaatggctgcacattcaaagaaaagggggatttgtttggctcctattcaagtggtttttctgctacttctaaagtaaataatggtcacacatttcttggttatgatgtgaaattacctgttatgagaaagatattccttcccaattttagagtctgtgaggatgattctatttgtttttctcctttgggaattactattttctctaaaaagaagtgtgtaaagaatcagaatagttctcaacttatccattttaatttggaagtgaagttagaagtccatgatgacaacttcttagacagtgtatatgatgtataccactttgatggaaaagatgttattggagaagcaattggttgcacattccaaggttgtttttatattgtgagagatggtggtctatcggtatatattccctccatttcaattttatcaaattttcttcctgttgagtacattggttatcgccaatcaagtaaggatatggagatttcagttctacttaaagacaatctagaaataaaagaaccgatcaaaaggttttctccttggaaagttgaaattttggacagagttcttctgtatgaaggcactgaaatggcagatcaattgtttttgaaaaatggtaagtgttaa

SEQ ID NO: 107236 - DNA, 827 bp, Glycine max
  Peptide Sequence Number=SeqID_224014
agggcaaacacgccctcacgttaaaaggactacacggcctcatcttcaaagggctacacaccatcaccttcagaggaatacacgtcctcgcctttagaggactacacgtcctcaccatcagaggactacacgtcctcccctttagagggctacacgccctcacctttagacgactacacgtcctcgctttcataggactacatgtcctccccttcagtggagtacacgtcctcaccttccgaggagtacacatcctcgccttcagaggactacacgtgctcgcctttaaaggactagacatcctcggcttcagagggctacacagagtcaacttcagaggactacatgtcttcacctccagagggctacacgccctcactttcagaggactacacgtcctcgccttcagagggctacacatccttgccttcagagggctacacgccctcaccttcaatggactaccggtgctcgccttaagaggagtacacggccttaccttcagagggctacacgccctcaccttaaaaggactacaggtcctcgcctttagagggctacacaccctcgcctttagaggtgtacatgcccttgcctttagaggactacatgtcctcaccttcagaggactacacgtcttgaccttcagagggcaacacgccctcaccttaaaaggcctacacgccctcgccttccaagggctacacaccctcaccttcagaggactactcatccttgccttcaaaggactacacgtcctcaacttcagaggactacacgtccttaccttaagagtgctacacacccttaccttcagaggactacac

SEQ ID NO: 107237 - DNA, 181 bp, Glycine max
  Peptide Sequence Number=SeqID_224015
ggcggcggggagcggcgcggccggttgggcctggagcgcgggcggcaggctcaggacgaacagcgcaaggatgagcgcggcggaacgctcggaacggcgcgaagggcggggcggcacgggtctcccggatgcggtagtggataggcaaaaggactgcaaggagaacccttgcagtccgtga

SEQ ID NO: 107238 - DNA, 319 bp, Glycine max
  Peptide Sequence Number=SeqID_224016
gatcgttctcgctgacgaaatcaagattccggccaggatttcctcgaccggcaagaacatcgtcttcgatatcactaacggcaagctggatccagcggcgttggccacgaccagcaacggtctggtcttcgctggagacgtaacgattacggcaaacgacgtcagcaattcgaaggcgtgggaagaaatcggtggcctcgatgcagaccccacgtacagcctgaccctgttcggccccaacggcgcggaaatcgccggcaccatcaccggcctgccggagcgcatcggcggcgtagccgtcatcggcgccaagcagtaa

SEQ ID NO: 107239 - DNA, 582 bp, Glycine max
  Peptide Sequence Number=SeqID_224017
atggcattaccatggttgaaaacggtttcactggacgatttcatatttttacatgctcctcaggttatcaagcaacgaatgcaaactgggcagtttgcttcagcttctggtgctgttcgctttattgcttctaaggaaggcttcaaaggattttatgctggatatggatcttttttgttgagggatttaccctttgatgctattcagttttgcatctatgagcagattcgaataggttatatgcttgcggcacaaagaaatctgaatgatccagaaaatgcaattattggtgcttttgcaggtgcactaactggagctataactaccccccttgatgtcatcaagacaaggttaatggttcaaggatctgcaaaccaatataagggaatcgttgactgtgttcaaaccattattaaggaagaaggacctcgtgcctttttgaagggtattggtcccagagtactatggataggcataggtggttcaatattctttggtgtccttgagagtacaaagcgttttctttctgagagacgccctaccgtacctcagaacacatattcagagaagagcaaagattaa

SEQ ID NO: 107240 - DNA, 7180 bp, Glycine max
  Peptide Sequence Number=SeqID_224018
atctttggaaatgctcgtggatgttgatctagcagaagagggaattttgagattgctttttgctgctgtgtatcttatatttaataaaggtggcaatgatagtgaaactcctgctgcttcaaggcttcttgccctggccgcttgctttgcaacaaagatgctccataaatatgggttgctacaacataaaaaagatacatgcatagcagagggctttaacaagatgggattactttctcttccaccaattgaaccagttaaactacaaactgaggtggattttgctcagaaactttgtgagatagctcatttcttggagatcatccgaaatctgcaatgtagacataggtcaatatttcaaagggccagtcaaggattggctgacagaggagaagagtcatctttaataagtacagacatgttgcaggaagaatcccaactttcaattcttccatcagatttagagtcattggatgtgttgaaccaacatgagctttcttttcctcgaccaggcagcaacaataatgaaaatcttgcgctggtgcctgttgattctgagtctcatttggtctcagatgaatttggctacatatctcatttaaccccattaggaggaatcttaggaaagaaagttttgcctgtggaaaatccaagagagatgatggcacgttggaaggtagataatctggaccttaagactgtggttagagatgctttgctctctggccgtcttcctttggcagttctacatcttcatcaaatgaatgattttgttgctgataaagagcctcatgatacttttactgaagttcgtgacattggcagagctgttgcttatgaattatttttgaagggtgaaactgaacttgctgttgctacacttcaaagacttggagagaacgttgaatcttatcttaaacaacttctgtttggcactgtaaggagatccttgcgaatccagattgctgaggaaatgaaaagatatggttatctaggaccatatgagtggaaaatattggatgatatgtcactgattgagagtctctatcctagcagtagcttctggaaatcatataatcaccgactgaaagaaatcagcattgcaccggactctgttttaccagtggaaaataaattaaggctcttgcataaccattcatttgatagtcatgtcattgaatgtggtgagattgatggaattgtctttgacgcatggattgatattagtgaaagttcctctgctctggaagttgatgaagatgatgctcatgttggatattgggctgctgctgctgtctggtttgatgcctgggaccaaagaactgttgatcgtatgatattgaatcaatctgttcattcggacaattctatattgtgggagtcacaacttgaatatcatgtttgtcgtaaccactggaaggaagtctttagactgctgaacttgatgcctgcatatgtcctatcggctggaagccttcaactcaatttggatcttgtagagcctgcctcatctttaggatgcaacatgaatatgaagtcttctaattatggaaatttcttgtgctcttttgaagaattggattctgtatgcatggaagttcccaatgtccaaatgtataggttttcacctgatatatgttctgggtggatgaggatgctcgtggaggaaaagcttgcaaaaagatttatattttttaaggaatactgggaagggacattggagatgatagctctcttagctcgttcaggtttcatatctggcagagataaggtctgcttggaggatgatcttactaagacgtcatctgtcagagatggagctgtacaagctttgcataaaatatttgtgcatcactgtgcacaaaataacttgccaaatcttttggacctttaccttgatcatcatagtttggtccttgacaatgattcactttatgcattacaggaaactgctgttgattgtgaatgggcaagatggctactcttatcgagagttaaggggtgtgaatatgaggcctcacttgccaatgctcgatcgataatgtcacgtaatttagttcctagaagtgacctcagtgttctggagttagatgaaataattcgaactgtcgatgacattgctgaaggagggggagaaatggcagccttggcaacactgatgcatgctgctgttccaattcaaagctgcttaaatagtggtggtgtaaataggcatagtaattcctctgcccagtgcacattggaaaaccttcggccaactttgcaaaagttccccacattgtggcgcacgctcattggagcatgtctaggacaagacacaatggccttgctggtccctaaagcaaaaactgactatcttaattggcgtgatgacatcttcttctctaccagtcatgatacttcacttctacaaatgcttccatgctggtttcctaagcctatacgcagattgatacagctttatgtccagggtcctcttggatgccaatcattttcagggttccctacaggggaaactttgctacacagagacattgatttattcataaatgctgatgtacatgctgagataaatgcaatctcctgggaggcaactgtccaaagacacattgaagaagaactatatggtcctttacttgaggaaaatggatttgggcttgagcatcttttgcatcgaggacgagcattggctgcttttaaccaaattcttggtcatagagttcaaaatctgaagtcagaagaggaatctagtacttcagctcatggacaaactaacattcaatcagatgttcagacacttctttcagcagtagaacaaagtgaagagactctactttcatctgttttgccagttgccattatgcattttgaggattccatgcttgttgcttcatgtgcttttcttttggagctttgtggtttatcagccaacaagatgcgcattgatattgctgtgctaaaacggatatctttgttctacaaatcgagtgaaaataatgaaaatctctggcaattatcacctaagggatctgtgtttcatgcaatatcccatgaaggtgatgtaacagaatctcttgctcgagctttagctgatgaatatttgcacaaggattctcctgcaactgctactgagactgtaagtaaacaagcttcacgagctcttatacttgtgttgcaccatttggaaaaggctagccttccacagttggttgatggaaaaacttatgggtcatggctattaagtggaaatggtgatggaaatgagttaagatctcaacgaaaggctgctagccagcactggactttggtaacaaatttttgtagattgcaccagcttccgttaagtaccaagtaccttgctgcattagctagagacaatgactggattgaatttttgtctgaagctcagattggaggatattcatttgatacagtagtccaagtggcatcaaaggagtttagtgatccgcgtctccgacttcatatgttaacagttttgagaggaatgcagtcaaagaaaaaggcaagcactgcattgttcttggatacactggagaaaggcagtgaaacaacctttcctgatgaaaacatgtgtgttccagttgaactcttccaaatattagctgagtgtgaaaagcaaaaatgtcctggagaggctctcttgaggaaagcaaaagagttgtcctggtcaatattggcaatggttgcttcatgtttccttgatgtctctccattgtcatgcctgacagtttggttggaaattactgcagcaagagaaacttcatccattaaggtgaatgatattgcctcccagattgcagacaatgttggagcagctgtaaatgctactaatgccctacctgtaggtgacagagtacttacatttcattacaataggcagagtcctaaacgtcgacggctaataactcttgtttcactagactcctctgcttctgcaatatctgacatctgtagctcttctataagtgaagaaatatttgattccaaaggtaaaactatggagaatgatagaaaaatagaacattttggatgcattaatgttccaagtgattcccatgaagggcctgcttctctctcaaagatggttgcagtgctttgtgaacaacaattgttcttgcccttgctaagggcatttgagatgttccttccatcatgccccttgctaccattcatccgtgctcttcaagcattttcgcaaatgcgcctctcagaagcttctgcacatttgggctccttttctgcacgaattaaggaagaacctttctacttacaggcaaatgtaggaagagaggcgcagattggggcatcatggattagttctactgcttcaacagctgctgatgctgtgctttcaacctgtgcatctccttatgaaaaaagatgcttactgcaacttcttgctgctactgactttggtgatggtggacatactgctgcacactatcgaagggtttattggaaaattaatctggcagagcctttacttcgtaaagataatgagttgcatttaggtgatgaaatttcagatgatgcttccctcttgtctgcactagagaataataggcactgggagcaagcaaggaactgggccaagcagttggagcccaatggtgcaccctggaaatctgctatgcatcatgttactgaatctcaggctgaatctatggtagctgaatggaaggagtttctttgggatgtgccagaagagagggttgctttatggagccactgccacacactattcatcagatattccttcccttctcttcaagctgggttattttttcttaaacatgctgaagctgttgagaaagatcttcctgcaagggagcttcatgaacttttattgctttctctgcaatggctgagtgggatgataagtctttccaaccttgtctgtccattgcaacttctacgtgaaattgaaaccaaagtatggctcctagccgttgagtctgagactcaggtgaagagtgaaggagatttcaattttaccttttctaccagggagagtggtatcaagaacgaccccagtattattgaccgaactgctagtataatagcaaagatggacaaccatataaatacaatgaggagtagaattgtagaaaaatacgagtccagggaaaataaccaaatcccccacaagaatcaagtgatggatgctggtctttcaactacttttggtgggaatacaaagacaaaaagaagggccaaaggatacatggcaccaagacgcccacctcttgaatcagcagataaaagtgctgatactgatgatggctctagtaccaatagtttaaaaaatgagtttcagttgcaagaggaaaacgtaaaagtggaaatgtctttttctaggtgggaagaaagggtcggagcagcagagctagaaagggctgtactttctttattggaatttggacaaattgctgccgccaagcaactacaatataaattctctcctggacaaataccatctgagtttagacttgttgatgcagccttgaagcttgctgctatttcaacacctcctagcaatgtatcagtgccaatgcttgatgaggaagtgcgttcagttatgcactcatatggtataatgaatgataagcactatgttgacccgctgcaggttttggagagtttggtgaccatttttattgaaggcaatgggcgtgggctatgtaagagaataatagcagttataaaagctgcaaacaccttgggcctctcattttctgaggcgttcaacaagcaaccaactgaactactacagctgctttcgcttaaagcacaagattcctttgaggaggccaactttctggttcggactcatccaatgccagcggcaagtattgctcaaatacttgcagaatcttttctaaagggtgtgttggctgcacatcgtggaggatatatggattcacagaaggaggaagggcctgctccattgctgtggagattttcagacttcttgaagtgggcagagctttgtccctctgaaccagaaattggacatgctttaatgcgtttggtgattactggacaagaaataccacatgcatgtgaggttgagcttcttattctgtcacaccacttctacaaatcatcttcttgccttgatggagttgatgttcttgtggcccttgctacaactagggttgatgcttatgtcttggagggtgattttccatgtttggctcgcctgataactggagttggaaatttttatgctctcaatttcatttttggcattcttatagaaaacggtcaattggatcttcttcttcagaagtattctgctgctgcagacacaaacactggcactgctgaggctgtcagaggatttcgaatggctgttcttacatccttgaagcatttcaaccctaatgaccttgatgcatttgccatggtctacaatcattttgatatgaaacatgagacggcagcccttttagagtcacgtgcagagcagtcatgtgagcagtggtttcgctgctacaacaaggaccagaatgaagacctgttggattccatgcgctacttcattgaagctgctgaagttcactcttcgatcgatgctggcaacaaaacacgtaaggattgtgctcaggcttcccttctgtctcttcaaatacgaatgccagacttccaatggctttatagatcagaaaccaatgctagacgagcgttagttgagcagtctcgatttcaagaagctctgattgtagctgaagcttataacctgaaccagccaagtgagtgggctttagtactctggaaccagatgcttaaacctgaagtaatggaggagtttgtggctgaatttgtggcagttttacctcttcagccttcaatgctgtttgatttagctagattctatagagctgaagttgctgccagaggggaccaatcccatttttctgtctggctcacagggggaggattgccagctgaatgggctaaatatttagggagatcattcaggtgcttactgaagcgaacaagggatttgaagttgcggacgcagttggctacagtggcaactggatttggggatgtcattgatgcatgtacagaagaaatggataaggtccctgacaatgcagcgccactagttctgaggaagggtcatgggggagcttacctccctttaatgtga

SEQ ID NO: 107241 - DNA, 831 bp, Glycine max
  Peptide Sequence Number=SeqID_224019
atggcggggtgtcgtagagacgcattattgctgacaagagataaaggccaatcatcggtcggatctcgaatcgtcgtcaccggagttctcttcggctgcatcttcgccttgttcaccggagttcccactccacttcacattcccagcccttctaagatggtttcatctgcatgcaaatcaccagaacaagttaatgcacttaaagttgatattctatcagcaaaagagaaaaattccgagctgaagaagcaggtcaaggatcttatggagaagctgcgtttggccgagcaaggaaagggtcatgctcaggaacagtttgttgtgcttggtgagagccacaaggctgggccttttggaactgtcaagggtctcagaaccaatccacctgtcattcctgatgaatctgtgaaccccagattggccaagatcttgggggaagttgctatttataaagaacttattgttgctcttgctaactctaatgtgaaggagatgttgcagctatggttcaccaacatcaagagggttggcatacctaattatttggttgttgccttagatgataacattgaagagttctgcaaatccaatgatgttcctgtttatagaagggatcctgatcaaggtgttgatgtggttggtaagagtggtggtagccatgctgtttcaggattgaaatttcgtattttgagagaatttctgcaactgggttacagtgttcttctctcggatgttgatattgtgtacttgcagaatccctttgattacctctatagggattcagatgtggaatctatgtctgatggtcacaataatagcttacgggtataa

SEQ ID NO: 107242 - DNA, 1254 bp, Glycine max
  Peptide Sequence Number=SeqID_224020
atgcaccatcttctactctttgtgatccttgttgtgcttctagtgtttcttgcaagagttgcatattcaatcatttgggtgccatgggtcatcgcacgtcactttcgtgaacaaggcataaggggtccttcctaccgtccgatcaaagggaacaccgatgagatcagaggcatgtacgcggaagttcaatccaggccaatggcattgtgccacgacatcctcgagcgtgtgtgtccattctatcacaaatggtcacgcatgtatgggaaaactgttctgtattggcacgggtcggatcccaggctggtattatccgacccggatatgataaaggagatccttttgaaaacgggtgattggtttgagaggatagatccgaatccgtcggcgaaacggttctttggagaaggaatattggtgttgaaacgagacaaatgggcagtgcatagagcaatagctaatcaggcttttaaaatagagcgggtcaagtgttggattccacaaattatagatagcacaaaaacaatgttttacaagtgggaagatgagaacaaaggtgttgatgaatttgagattgaagtgagcaaagatctccatgaccttacatctgatattatatctaaagtcgctttcggaagtaactatgaagaagggaaggggatttttgatttactagaacaacattatcatcttgtctcccttgctagcagaagtgtctatcttcctggattcaggtttttacctacgaagaagaaccgagaaagaaagagattagagaagaaaaccagtgaatcaattcaagtgttgattaatgacaactataaagcagaacaaaattcagagaacttgctttctttgttgatgtcttctcacaaatttatcaagaatgagacacaaaagttaagtatggtcgagatagtggatgattgtaaaaacttctatatggcaggaaaggaaacaagtgcaaattcattaagctgggcactcctccttttagggataaatcaagaatggcaaagcaaggcacgcgaggaagtactaagtgttttaggacctaatacttctccaacttcagaagcattaaatgacctaaaacttgtgaacttgatacttcaagaaacacttcgactctaccctaatccagggacattgaggtattcttttgttgtatcaccaacatatgctcacggaccaatgttgttgatgactgtgacacctcaatatggcatgcaaattgtctttaggagattatga

SEQ ID NO: 107243 - DNA, 540 bp, Glycine max
  Peptide Sequence Number=SeqID_224021
atgaaattcaagtctaagaaaggatggaaatctattgtaccacttcatttgaaaggaaaatcggcgacccgtttttctttatttcgcaaagtcaattcagctgcctatggacctggcaaaacacccgtttatctgaatgtgtatgacttgacacccatgaatggttatgtgtattgggctggtcttggtatctatcactctggtgtagaagttcatggtgtcgaatacgcgtttggagctcatgactacccaaccagtggtgtttttgaggttgaacctcgccaatgcccaggcttcaagttcaggaagtcaatattcataggaaccacatctttggattctactcaggttagggagttcatggaacgccagtcagcaagctacaacggtgacacatatcacttaattgtcaagaattgcaaccacttctgcaaagacatttgttacaagctgacggggaaatcaattccaacatgggtaaatcggctggccaggctagtgtgtttggatggagggaatggagaaaaggagagggaatga

SEQ ID NO: 107244 - DNA, 276 bp, Glycine max
  Peptide Sequence Number=SeqID_224022
atgggtctctttacactgtccgttatggttaatgactctgccatttcattaccagatacttgtacgaaaagaaagcagaacttacttctgaaaaattcttttgcatcagttagcatgggagatgaaaagccatttgacttcctacgcactttatttgagggcgttattgcaggtggtacagctggagttgttgttgaaacagctttatacccaattgacacaataaaaacacgtctgcaggcaggtttttatgacaaaaactgtaatgaagattaa

SEQ ID NO: 107245 - DNA, 789 bp, Glycine max
  Peptide Sequence Number=SeqID_224023
atgtgggcgtgttgtatgaatttggttctggctcattgccagctacaaggtggcgaaggagcagaggctgctgtatctggtgttggtgtcaattggggtgcaatagcatctcatcctatggaacctcacattgtggtgaatttgctaaaggagaatgtaagtgctttttctggcacagacattgaagttatggttggaattcccaatgatcaattgaagaaactatccaaagacctagaccatgcagaagattgggtcaaacaaaatgtcagcaaacatgctcatgatgaaggggtcaacatcaggttctaccaagggttccttaagaaaatggcaagcaataaaggaactctgcttcaccctggacccgtgaactcttatttagtttctctttttgatgagaacatgaagagtgttgcaccagatgactttgagcgtcattggggtatttttcattatgacgggaagcctgagtttcctattgatttttctggcaaaggagaagataaaatgccaataggagcaaaaggggttcgttaccaagagcaaaaatggtgtgtccttaaaagtaatgccaacaggagtgaattgggtgggtatttaagttatgcttgtgctggtggtgattgcacaagcttaggaaatttggatgcatctggtaatgcttcatatgctttcaatcaatactttcaaataaacgatcaaagtgttgaggcatgtgatttcgaaggggtggccactattgcatcaaaggagaatgttttttttccctgtatcaatcatcagtag

SEQ ID NO: 107246 - DNA, 270 bp, Glycine max
  Peptide Sequence Number=SeqID_224024
atgaacttacggtttaagtttatgaacacggttgtgatcggggagaagccattgaagtttagttacgaacacagcaggggcaacaatacaacccttttggagggaacctttgagttggatcctgcgaacaaggtttcggttaattacgcgtttgactcaaaaatctgcaagttgaagtacacttatgttcatgaggagttgacaacatttgaacctacctatgacatggctaagaatacgtgggactttgcaacggtgatcacacgttga

SEQ ID NO: 107247 - DNA, 1980 bp, Glycine max
  Peptide Sequence Number=SeqID_224025
atggcgtcgtggcaaaaaggcaagttttttatcttctctttgctcttccttttctcttctcttcatgtttccagtgcccccttagaccccgaatcatgttctatagtacaatccaagctggaccacgattcatgccaggaacatgttcctgaacaaccccaaatagctaataatttgaatcagcaagttttgttggataggcttgaggagttagtgagaaatcttagtgatttagtttcaagattagaatcaaagctacctgaccctccaaaagaaaagggtaggtttactcacagaaagggtggtggtgatgacgatgatgaggatgatgcaagatcaagtagtaaaggagttgaagatggtgaatttgaggggaaaatccgagatggggagagagctaggggaacgtctgtgacaaagtacacacctttttggtcagagaggttccagtttgcatctgctgtgaagttggattccgaggtcacttgtataaatgttttgccttttagggatcatgaggggctgagtaagtatgtggcagttagtgatgagaggggaagagtgtatgtgttcacgaggaatggggatgtgttggttgagtttgatacctcattggagtcttcaattacagcaatggtttcgtatacttcggtttataagaatgagagttttgtggtaactggtcatcgaaatggggaaatcttgatacatagagtttgggagggagggtctagtggagaggattatagttctgttttcatggagaatgttggtaagtttctgtctcctgaaaaccatgaagatgggttgccggtgagtctcttggaagttcattatgtagggaggatgaagtacattctgtcagctgatacaagtgggaagatcaaggtttttaaggagaatggttcgttacacggttctgcctcgccctctagtaggccgctagtttttttgaagcaacggcttatgttcttgacggaaactggggcaggttcattggatttaaggggcatgaaaatcagggaatctgaatgtgaagggttgaaccactctattgctcgaacttatgttttcgacgccatggagcgttccaaggcatatggttttacctcggatggggatctgatttatgtcttgttgcttggagatgtgatgaacttcaaatgcagggttagatacaagaaaaagtttgatgtagacgagcctcttgttgctctgcaggcaattaaggggtatttgctgattgctaacccggagaaggtttttgtgtacaatgtttcatctccgcattacgtgagagttggtgtgcctcgacctgttttctcctcaagtattgatgagcttagatcatcattcttgaataataatccaaccccaagtttggatggagaaacaagagtgacacccttgatagctagtgaccgtgaaaagcttgttattgttggtcttggaggtgggtatgtgggaatgtatcattctaatctacctatcttcaaaggggaattcaataccatgctatggactagtcctgtgttgttcttcatacttttcctatttggggcttggcactttttcgccaagaagaaggaagcacttacatcatggggaccagatgatccatttagttccacgtcagctaccaccagtgcgccgttggcatctgcctctggggacagatcttttgcagactcttcttcgagaagttccgaggttatggatcttagaggtggaaatctcagagctccaccgagaaggtatggctctccttcaaggtatcccggtggcggggctgcaacttcctataggcttggtgttggtggtgcttctgctgatcacaatgctaggccagcttcagttgatccagattttcgtgcagcctccgagctcaaatttagggcctccaccatggaccctccaggttttcctaaaagaagagatggtatgtttgtagggaatcaagttgtaaatgaccgcagttga

SEQ ID NO: 107248 - DNA, 1125 bp, Glycine max
  Peptide Sequence Number=SeqID_224026
atggcgtcagaacaaggcataggtccatgttcatcatcgttggcgacaagtctcgagaccagtctctactgtgtgcagattgtaaatcttcattacatgcttagcaaggcacagattaagtccaggccaactgtgttatggtgttacaaggacaagcttgaactaagcagtcacaagaaaaagcgtagcaagcagattaaaaaattggtgcagaggggtctctacgatccagagaaaggtgattcgtttgacttgtttctggcaggtgggggattcacttactgtttatacaaggaatcagaaaaagttcttggcaatacctttggcatgtgtgtgcttcaggattttgaggcattgacacctaatctcctagcaagaacaatagagacagtggagggaggagggctgattgttttgctgcttcggtctctatcctcgctgaccagtctgtgcaccatggtgatggatgtccatgatagatttcgaactgaatcccacaatgaggctgctgggcgctttaatgaacggttcttattatcacttgcttcttgcaaggcatgtgtggtaatggatgatgaactgaatatattaccaatttcatctcacataaggtctattaccccagttcctgttaaagaggactctgacgaactctcagaagcagaacaggacctgaagaaccttaaagaacaactaaatgaagatttccctgtagggccattgattaagaagtgttgcacattggaccagggaaaagctgttgtgacatttctggatgtaattttggacaagacacttcgtagtactgttgctttattggctgctcgtggtcgtgggaaatcagctgctcttggtttatcagttgctggagccatagctgttgggtattcaaatatctttgtgactgcacccagccctgagaatttgaaaaccttgtttgactttatatgcaagggttttgatgctcttaactacaaggaacatattgattatgatgtggtgaaaagtgcgaatcccgagttcaagaaaggtactgtaaggatcaatatttacaagcaccacagacagacaattcagtatatactgccacatgagcatgaaaagctttcacaagttgaactgtag

SEQ ID NO: 107249 - DNA, 150 bp, Glycine max
  Peptide Sequence Number=SeqID_224027
atgaagccagtaggttgtgaagttggttatgtgggaggagatggtctaactttaagctttgtcttccagatcgtagcatctgttaacttggccgaggagttgaaagctcccaaacttgttgctgagaccacatggaattttgagatgtag

SEQ ID NO: 107250 - DNA, 1653 bp, Glycine max
  Peptide Sequence Number=SeqID_224028
atgaagcagttggaagagcaaagccatgtgtctactaagagcacaaaggacactggtcgcctgtttaagaaaatagaattgagtgaatccatcagatatgcttctggggatcccattgaaagctggcttaactctctactttgcttagatgcttcaaacaccatccctaatattagcaggttacctccacctagcgagtgcgatttatactatgttaatcgggatacgctcttctcctatcacagagatagtgaattatttttgcagcgaatgatggccttatatgttgcatctcattacaagaattctccaaatgatttgcaactgatggcggatgctccagcacaccacttatttgtactacttggacctgttgatgaatcaaagaatcaacttcctgatattttgtgtgtcatccaggtttcccttgaggggcagatttctcgtaagtcagcaatccaaagtttgaccgatggtcatcaaccttttggagatcaaattccatggaaattctgcgagcaattccgagatacagttttcccctcgctttcaggtgctcgtattgtacgcatagcgacacacccaagtgccatgaggcttggatatggttcacaagcagttgaacttttaatacgctactatgaaggacaacttattcctatttccgagattgatgttgaagataaagtgcaggctccacgagttagagtcacagaagctgcaaagcaaaatgctgtgactggtgagcatacatgcatgatcctgaaacccctaaacaatgatgaaattgaagctgatggatcaaatcaactgggcttttttagtccattttaccaagattttagacaaagatttgctaaacttcttgcttccacttttcgtgtcatggaatacaagcttgctttgagcataatagatcccaaaatcaatttcaagaaccaagaccctacggaggccacatctgataaatgtctgcagtcagtcaaagattatttatcaccacatgatatgaagcgattagaggcgtatgttgacaacctggctgactttcatctgttaggagagagaggagtattaatgacaaagattttagatttggttccaacccttacacatctgtacttccaagaaaagctcccagttacgttgtcgtatgctcaagcttctgtgttactctgcattggtctgcagaatcagaacatttcatacattgagggacaaacgaatttggaaaggcaaacgatattgtctctatttataaaggttatgaagaagttctacaaatatctagatggccttgcatccaaggagattgaatcaaccttgccaagactgaaagaaattgtcatggaacctcatagtgtctctttggacgaagatctcaataatgcagctaaacaagttgaggatgacatgaaatcaaaagcagaagcaacctttactcccgaattgctccagcagtttgccattgaaggagaatctggctttgagactgttttacaaaataatggtggaaaaatacccataggtggtcttattagcgtgaaatccagcaaagtgaagcatgaaaaggagaagggaagtcataagagtgacaaaaagcggagtaaagataaccacaaccataaatcaagcaaaaggaaaagatcttga

SEQ ID NO: 107251 - DNA, 291 bp, Glycine max
  Peptide Sequence Number=SeqID_224029
atgacttttggagtagagtttggtccaattccaaattctaacatgctatcagagtttaccttaatggttgttcgcaagacaatcaggccacctgttatccaactgttattagatcacctgcagatgtctagtcctgcaaattatgagagtgtgttgggtacatttaatctcttcccacaaaggcttggaattttggacactggtggaaccaatcttgctatatgcttagagttagaaaattggttgctttatattttgctagagggttcattcacggttgattttcaatag

SEQ ID NO: 107252 - DNA, 2802 bp, Glycine max
  Peptide Sequence Number=SeqID_224030
atgctgcaacagcaatacttgttgcaactgcattctcaagcacagcagatgcccttgattgataaactcctgttgctgaagcagcaacagaagcaggaggagcagcagcagttactgcggcaacagcaacaactgctttcacaagtgttgcaagaccaacagtctagccagctttttaacaattcatcttttggacagttgcaaggtgtattacccatggggaatttgtatgctgatccttctcaacttcaacaaccacaagagatctttcctataagctctcagatgccaattcccagtgtgcataatgaggatagttctaattctttgaatttaccactgaatgttagtcaagacacaagtggtaatgtaagcagtgaagcttctatacgtctgcctcaccaattatttggggctactagtccagaaaattggggccctagtcttactgaacaaattaatgaaaagtatcagaatgaaattttccccatatcaactcttgttgagtgctctccattgcttgatcagaacagacccaaagaggaaccacacattggtccagaacctcattctctttctgattacgctgctaagtcagtggagcagttgccacctagccattttacgcctgatgtcgtgacctcaatttctaagccagatgagaactctggacatctacagtgtgttgcacccaccattgcctcatcttcagctggatctaacaggattgagttactgcctgcaagtgatcctggtatggaggtgaagaccaaatcagatattgtgcatcaagagcaacattctggaagagacagctctgtatctgatccctctccggcagacatacgaagcattgaagctcatgaacccaaaaaggctactgagaagaaatctaagaagcaaaaatcagccaaatctcagtcttctgatcaaataaagggagtgctaaaaaatgtgacttcgcagccatcaaatcagccagaagctgaaataccaaaattaagcgagttgggggaagcctacagggctgaatcattacatgaaacaaatatgcaacaaacaagagtcaagggaactcagattggaagtgcagtcatagaggctgttgatcaccaacaagctggtggctggcctgctattgttgctggaaacctcactgaaacagttgatgtgggtgaggccaaggcagctagctctatttcgatgcagaaagttgaagtacctgcaggacgagcttggaaaccggctcctggtttcaaaccaaaatctttcttagaaattcaacaggaagaacagaggaaggcagagactgaaatacttgtatctgatattgctgtttctgtcaattcaatgagtctggtaagtccctgggctggggttgtttccaatccagactctgtgaatgtttctagtgaatgtcacaaaggagtccatacagaatatcctgttaaatctgaaacttctcaaaatcttaagagcaagaaaagtcctctacatgatctattagcagaagaagttttaaaaaaatctaatgaaatagaagctgaggttccagatagtatattgccctcacataatatagctgcacattcagaatcactggatgatggcaattttattgaggcaaaagatactaaaagaagccgaaaaaagtctggaaaatcaaagggtttgggaactaaagcttcattgcccgttgcatcttccgaggcacctatagcttcaagccccattgaaaagggaaaaaactcccgttcagcacagcaggagaaagaagaattgcctgccatccctgcaggaccctctctgggagattttgttctttggaaaggagagcgagaaccaccaagcccatctccttctccagcatggtctactgattctggcagggttccaaaaccaacttcattaagggacattctgaaggagcaggagcgaaaaggctcttctgcacttcctgtgactgtgagcccaatgcctccccctcagaaatctcagcctcctcagtctacatggagtactgtttcctcacggtcaatttcagcatcctctccatctaaaaatgcttctccaattcagataaattcccaagcttctcaatcaaagtacaaaggggatgatgacttgttctggggtccaatcgagcaatctaagcaagatactaagcagtcagatttccctcagcttgcaagccagggtagctggggttcgaaaaatggacccttaaaaggtaattctcctggattattgacaagacaaaaatcagtgagtggcaaaccaactgaacggtctctagcatcatcacctgcctcttctcaatcagtgctgaaattgaaaaaagatgccatgacaaggcattctgaggccatggacttcagagattggtgcgagaatgagtgtgttaggcttattgggacaaaagatacgagtttccttgagttttgcttgaagcaatccagatcagaagctgagatgcttcttatagaaaaccttggatcatatgatcctgaccatgaattcattgataaattcctcaattacaaggagttgttaccatcagatgttttggacatagcttttcagagtagtaggaatgataagaaagttactcgacatggtgcggcaggcacggcatcagctaatgcagatatacaggatgtggactacactgaaggaggatcctccaaaggaggtggaaagaagaaagggaaaaaggggaaaaaggtcagcccttcagttttgggatttaacgttgtgagtaaccggatcatgatgggtgagatccagagtgtagaagattaa

SEQ ID NO: 107253 - DNA, 165 bp, Glycine max
  Peptide Sequence Number=SeqID_224031
atggagtgtagagtgaacaataaagcttcctctgtggtggagagatttatgtttggtttatgctggaaacagcaaggagaaatggaaatcacgttttatgcttggttgtggatgaaaaatttgacaaactctgatgtctgctcttttgctcagtggcaatcttaa

SEQ ID NO: 107254 - DNA, 807 bp, Glycine max
  Peptide Sequence Number=SeqID_224032
atgaccataaaactccagagagaattactgaatgctgatatattggtgattgttgctgttacaaacaaggaatccgttgagtggattaataacaactgcaaaactattgaaaatgtaatatgccttgactcttcaccagatttgaaaaacaaattaggaggctatgatgttcccagtgaagtaagaggaagtatatttggaaatttttttggaaagtctcaatctgataaagctaaagaatcatatgaagtagtgcaaacagtatctgaagcatgggatcgacataattctgatgatataaggttctgtttgctggtactaatcaatgcttatataaggccggttccagggttgaagaacttgggagctaaaggtttttccaccctaaactgtatgttgaagaactgtggtcgtcaggtacttaattgcttgttggatcccaattgtaggaaagctcttcaatgcttgaataagtgtagtcctgttgatcaaggcagaacccggcatatgatcaatttccatgccaataccagtttttctataggggaaaagcaaaagggtcattttggtatgagcccgtattccagtgtattagataacggagttgtttcaaatgagttttggacaattgtggatgtatctgataatcttagttggggtttgttctattatcacggtgctgctagagttgcagggcaatcttatactggggcagtacttgttagtccagatggagcatttccaaatgacacagagaggactaagatagttgctgcactagacaaatgtgaaattaaagagtgggaa

SEQ ID NO: 107255 - DNA, 291 bp, Glycine max
  Peptide Sequence Number=SeqID_224033
atggccaaagccaaattgcaggggggaagggacagtacaagaagttgtggtgggtgtaagagtggcttacctcgtttttggaatgatgcttttcatgcggcttacgaccacttggtcagtgatgttcggagcgtccgagatgctgctgtctccgaaattgccaagatgtccctccactctcttcctctacaccacctcaaatcacactccattgtgcagaatatcatgggatcaagaaaaatgaagcaagcagagagtagcatggacactacaattgacaataaccaataa

SEQ ID NO: 107256 - DNA, 525 bp, Glycine max
  Peptide Sequence Number=SeqID_224034
atggacatttcacagagaaagagaactttgctaaagatcattgttcttggtgatagtggaaaattcagccagcagtataaagctacaattggggctgattttgttacgaaggaaatacaagttgatgataaactcgtaacattgcagatttgggatacagcagggcaagaaaggttccatagtcttggggctgcattttatagaggggcagattgctgtgttctggtatatgatgtaaacatacacaaaacatttgatacactaaacaattggcatgatgagtttcttaagcagggagatatgaacgaccctgaagcatttccctttgtattacttgggaacaaggttgacgtagacggtggaaacagtagaagggtcactgagaaaaaagctagagactggtgtgcttcccggggaaacataccatactttgagacctctgcgaaagagggctacaacgttgaagaggctttttcatgtgttgccaaaattgcactagaaaatgaacatgatcaagacatgtga

SEQ ID NO: 107257 - DNA, 462 bp, Glycine max
  Peptide Sequence Number=SeqID_224035
atgaggtgtatccgcacgccaagtcagacactgcagcttgcacaaaggaaccacctattgaagaagaaaaagcctcaagggaaagataagtgtaaaagtcgtgtgtgctggctggtaataccagctgttattcaacgtgcatctgcagagattgttgtatttcttcaatcggttaaaacggagacacggaaaaatgctccatggttatcggtgccgcaatttggggactgggatcagaagggccaagtgccggactactcacttgatttctcaaagatccgggaaactaggaagcagaacaagacaaatatttccagggcaagccttggcaatgaagaagaattcatggattcaacaacctccagcagcgtcaacactgcccacagcagtgagcaccctcaaccccactaccatcaaacccactctccaactgtaagattcttgtctacacaagctgcttag

SEQ ID NO: 107258 - DNA, 441 bp, Glycine max
  Peptide Sequence Number=SeqID_224036
atggataaattcagcagaaccattctattctttcttcttttctgcgtcctaatcattctccaattccaacctgcaacacttgatcatgaagagggtggccaaaatgttgatcaagaccacccagaaaaaccaaaattgtcagaaagtcacatcaaagttcctgggagaaaatcaaaattgtcatacatgatcttcaaatgcagttttctccaccaaatttggaaaattatgtattttttttttctcagtttcaggggcacgggatgggtaggagacagagaatatgatggtgtcaaaagaacgttcagagaagcagttgagaagaattttggcaaaagcaaagagacggttgaggaaagtgctgaaacagcagcaaaactagttgaagaagcaattcataagactacagaaaaggtgaaggagagttctgactctgcatga

SEQ ID NO: 107259 - DNA, 216 bp, Glycine max
  Peptide Sequence Number=SeqID_224037
atggatgttaaagctgcgccgaggttacaactttcagcggtggttcaacccgaaagtattggaagaagaccacccagcacatgtcgtttgggtgtgtctcgggaaccgcagagccttcgggtttttgtttcgtcaacgatgatgcgccgcagaacaaccgctttggaggtttcctgttcttacggcaacatttcaggttcccattctaaccaatga

SEQ ID NO: 107260 - DNA, 2553 bp, Glycine max
  Peptide Sequence Number=SeqID_224038
atgatgcgaagccagcatcgactactactaggaatatcccacttcaaattcctcaacaaagacaatgtgagccaaactttgcacttctccactctgttacctccttttcttcaaccacatgattctccaatccttatacaaaggaaaattggtcgtgaattgggcaagttattgcaattgccatccccaaacattctcacttctcattactataagaaaatccatgcccacattgtggtgttgggttttcaccaacatgatgtcttccttgttaacactctcttgcacgcatactcaaaaatgaaccttcaaagtgatgcacagaagctgttcgatactatgcctcataggaacctagttacttggtcctccatggtttctatgtacactcaacatggttacagtgtggaagcactgttgttgttctgccggttcatgcgaagttgcagtgagaaaccaaatgaatacattttagccagtgttgttagagcttgtacacaattgggtaatctcagtcaagctctgcagctgcatggttttgttgttaagggtgggtttgttcaggatgtatatgtgggtacgtctttgattgacttttatgccaagcgtgggtatgttgatgaagcaaggttgatttttgatggcctaaaagttaaaaccactgtcacatggactgcaattatagcagggtatgcaaaacttggaagaagtgaagtatccttgaagttgttcaaccaaatgagagagggtgatgtctatccagacagatatgtgatttctagtgttttgagtgcgtgctcgatgcttgagtttcttgaaggggggaagcaaattcatggatatgtgttaaggaggggctttgacatggatgtttcagtggtcaatggaattatagatttttatttgaaatgtcacaaagtgaagacaggtcggaagttattcaatcggctggtggataaagatgttgtttcgtggaccacaatgattgctggttgcatgcaaaattcattccacggggatgccatggatctgtttgttgaaatggttagaaagggttggaagcctgatgcatttggttgcactagtgttctcaattcatgtggttcactgcaggccctacaaaagggaagacaagtgcacgcttatgctatcaaggtcaatattgacaatgatgattttgtaaaaaatggtttgattgacatgtatgccaaatgtgattccttgactaatgcaagaaaagtctttgaccttgtggctgctataaatgtagtatcctataatgcaatgatagaaggatactcaagacaagacaagctggttgaagcattggatctttttcgtgaaatgcggctaagtttatcgccaccaactctattaacatttgtaagccttcttgggctatcttcatcattatttcttctggaactaagcagccaaatccactgcctgattattaaatttggggtttctttagacagttttgctggaagtgctctaatagatgtttattcaaaatgctcatgtgttggggatgcaagactagtttttgaggagatatatgacagagacattgtagtatggaatgcgatgttttctggttacagccaacaactggaaaatgaggagtctctcaaactttacaaagatcttcaaatgtcaaggctaaaacccaacgaattcacttttgctgctgtaatcgcagcagcaagtaacatagcaagtctgcgacatggtcagcagtttcacaaccaggtgataaagatgggtcttgatgatgacccctttgtcacaaattccctagtggatatgtacgccaagtgtggaagcatcgaagagtctcacaaggcattcagttccacaaaccaaagagacattgcttgttggaattccatgatttcaacatatgcccagcatggagacgcagccaaagctcttgaggtgtttgaacgcatgattatggagggagtgaagccaaattatgtcacctttgtaggtttactatcagcatgtagccatgctggacttctagaccttggatttcatcactttgaatcgatgtccaagtttggaattgaaccagggattgatcattatgcatgcatggtttccctcttgggccgtgctggtaaaatatatgaagctaaggaatttgttaagaagatgccaataaaaccagcagcagtagtgtggaggagcttgctcagtgcatgtagagtctcaggtcatgtagaattgggtacatatgctgctgagatggcaatttcgtgtgatccagcagatagtggatcatatatattactttcaaatatttttgcatcaaaaggtatgtgggcaagtgttagaatggtgagggagaaaatggacatgagcagggtagtgaaggaaccaggttggagctggattgaagtgaataatgaagttcacagatttattgccagagacacagcccatcgtgactctacacttatatctctagttttagacaatttgattctacagatcaaagggtttggttatgtgcctaacgctgccacattttttcttgatgattga

SEQ ID NO: 107261 - DNA, 386 bp, Glycine max
  Peptide Sequence Number=SeqID_224039
ttccaataaccgtaattgcttctactaaaaaggttaaatctcttgttagtaacattaatatgcttactcaagccatccgttcatcttcaaaacttgttttgagcgttgatggcaaaaaggttaagcgcaaacatccttacactgaaagggaaaaagaggacttgcagtctcgcaccgttgtggcagagaatttacctgacgatcattcccatcagaatcttcaaaaaatatttggtatggttgggagcgtgaaaacgatcagaatatgccatccccaagagcctaattcttctcgcccaaaatctgatttctttgtcagtaataagagtttcttaccccatgttacttggtctctcaatcaagctccatgcgcttgtggagtatga

SEQ ID NO: 107262 - DNA, 183 bp, Glycine max
  Peptide Sequence Number=SeqID_224040
atggagaattggcgaacagcgctacgcaataacttcgcggggctccagactccgctaggcaataacattcatggggctccgaaaaaaagtggagcatggagaattggcgaacagcgctacgcaataacttcacggggttccagactcgaaggtggaggatccatgaacagcgctaggcaataa

SEQ ID NO: 107263 - DNA, 867 bp, Glycine max
  Peptide Sequence Number=SeqID_224041
atggctaacacatctcttcttcccaaaccatattattaccgtaatttccattatcaacatcaaagatgcttcaagatcaacctcccaaaatggacaactagagcttcctctgctgcccctggggtcgacctcaacactctcgaatctgccatttccaagaaagacagtgatgctgttaaagaggcacttaatcagcttagtgaagttggttgggccaagaaatggagttctcagccatatgtttcacgtcgtacgacatcactccgggagctgacaagtctaggaattaaaaacgcagagaatcttgcaattcctagtgtcagaaacgatgcagcttttctttttactgtggttggaacaacaggatttctgggtgttctggctgggcaacttcccggggattggggcttctttgtaccatacttgattgggagtatttcattagtggttttggctgtagttgcttatctgcttggcctacccatttttgactattcactggatattgggaaagagcatgtcaatctcattgatgagaggcttgaaaagcttatctatagcggacagcttgatgccaaagagctagatagattggctgttgtgtcaatggctggactggcagcagaaggtttaacatatgacaaggtggttggtcaatctgctgatcttttcagtctccagagatttattaacagaaccaagccacccctcagcaaagatcagcaacaaaatctcacaagatgggcagttctgtttgctgcttctatcttgaaaaacaacaaggtgactcatgaagccttaatggcagcgatggcaaagaaggcaagcgtactggagtgcattcgggtaatcgaaaatgcagcatag

SEQ ID NO: 107264 - DNA, 969 bp, Glycine max
  Peptide Sequence Number=SeqID_224042
gctaagactcatgcttctttctcttccaagaaaaagccaattaattttcaagcctccaagcagcctatcctcaacatgatgcatgaagagttagaggctcaatgggactccaacaggttcacatcccccgctattcaagaccgctttaacaatgtcaccatcaactggcacttgagtcctaagaggaaagatagcattgatgagacattagtgatggagttttacactaatgcttatgacccgaagagtacctatcccactaaggccaagcctttgcctgggactgacaacctcctcacccatatgaccagcaagtaccacaagatgatggcagctaagctttgcaagctgagaaaagggttcgagatgtcgcacgacgcttcatggaggatccataaggagtccatgaacactctgacaagtcttggagtgtatactcctactacaaccttatgcccactactcacacttctgacatcaactttggtggggcaaatctcccaagtgttgaagtctcttaggatggatttggatttggggtacttcaagagatactgcatggtcctgagcgacattgctattgttcttccagaggttcccaccaaaagttgcaacatgcaccacctctccttgcaccaacctttgactaccttagaggttttctctggccatgttcagtggcctggggtcaggcctactattcttgatgaagagggtgttgttattgctgcaaaggatgccaggaatagagctaatgatgatgaagataatggaggagtttatgttaaagttggtcaagctatagaggaggaccaggatgaagggcttggtctcaaatatggccatgtggaaaaagggagccatgccattcactcaactcgcccaacgagtaaatccctttgggtggaagaaattgcaattccatttgggaattttgaagaactccccaagcaagttggccttaactag

SEQ ID NO: 107265 - DNA, 342 bp, Glycine max
  Peptide Sequence Number=SeqID_224043
atggaagagttggggaggacgaaggagaaggataagagggtgctagaaaggtgggagggtaatttcagttctggagttattgtcgtaaccttccaaattacttgttctagaaagtgctcaatgagaatgacgatgccaagatcgaggcaaacaagaagagaagccctttcattcttgctcccttcctttggccttactcacttgttgcatccaatgaccctaagtgcttgcaatgttcacgctgcccctatttcgcataatatcttcaactactgcactgatagaacctccccctactaccccaccagttgtctcccctacatgcatgggaaaactgaatga

SEQ ID NO: 107266 - DNA, 531 bp, Glycine max
  Peptide Sequence Number=SeqID_224044
atgggaagtagttgcatcggcgtacctctacgaccatctctcctatgcgaaccagaataccaagtagtgtggaggctatatgatgttactcatgccaccagatggaaggcattgagaggtatcgagcgtgcccttccggccagggagagactagatgacctacagatggatgctatcgtgtggtgtccatatgaggaccacgggggtgtgaggcctttcgtagagcaaacctttttttctgacttcatcaaatgcgggactgatgtgaggccttattgttcggagagggtttcccttccttatgtcattctgccagagaaggggaaaccatcacatggtcctataaatttaccatccatcctagtacagccacaaccactggcagactatgtaccaggtggagagtactcttgtcaaggcatgagtcatcatcaagtcatacaacaagctttgcaatcgttgcatgaggaattagtagctcgatgcagctcagacacaaagataatggaagaggcttgccaaggatggtaa

SEQ ID NO: 107267 - DNA, 327 bp, Glycine max
  Peptide Sequence Number=SeqID_224045
atgttggattttggagacgagctgactttagatggtttcaggatcccatggctcatatggattcaacttttagtgttccttcttctccttgcccttctcttttgcctctccgtcattgctctagatccctctcaccacaccacgtctccttcagcctctgccactgccactgattctgatcttcacactcaacaaccctccaaccaccattccactgctgtgaccaaccgtcttcagagcacccgggttgtagatctttctgggagtaatagtgggttcgctgttacaacttacaacacccctcccactgattttaattacctttaa

SEQ ID NO: 107268 - DNA, 387 bp, Glycine max
  Peptide Sequence Number=SeqID_224046
atgtggccaacgacagctgccaatagagccagagctttagccatagccacattggagctccatttggaggagtcatgggcatttgcacatttgcctacttttggttattgcaaggctaagaccaatgctctggatgactcgatagccaagagatggaagccaactcgagatcaattccggatggcattaggcgctatacagagcttgttggacctcaaagttgtgctagaaggcacgagtcatcatcagaccatacaacaaactttgcaattattgcaagaaggcttcaaagctgggtgcacctcagagaggcaaaggaagaagattgccaaggccaaggacaaggatggtgacaagggcagcaagaagggtagcaaaggcatatga

SEQ ID NO: 107269 - DNA, 729 bp, Glycine max
  Peptide Sequence Number=SeqID_224047
atggagaatgaaactctcgtcactaccactaaactcgatagggttgatgctaaaactgcaaagatgagcatggaacatttatttgatattccaaaacttggaatgaactcaaagtttgcttatctcatgattctggtgcgtacaatttgtggggtaaaagtcaatatctcaacaaactccatacaggaagccattagcaagtttaagggcaaggatcaaatactcgagtataaggacttgattgatgaagccaagatatcaaagcaattgtgcaacaagtactctacacaaggctggtttaaaggacttcatctttgtagttcaatgttttgccttgtcccactagtggacaaggctgacaagaatgttgttaagaagaagtgtccaaagattgtaaaactactcactgattcttatggagtgtctattgttgagaggaaaattcaaaatgtcatgaaaatacaagagaacaaaaggattacaagacaaggagcacaagttgatgattttgataatcaagagattgaggaaatgattaacaaaagaaattatccaagtcctactacgtccaaacctgcatctaaacttacctctaagaaagctaagactctcaaaacatcaatcaacttcagcactaaatctgatatctcagactcagatgacagtgatgataatcaggctatcaatgtggtgtatgaaaagagggcaagagaaaaaatgtctacttag

SEQ ID NO: 107270 - DNA, 2121 bp, Glycine max
  Peptide Sequence Number=SeqID_224048
atgtgcggtggtccagagaaatcaaagtctctttcaactccatcttcatctgcggtagaaggttcaactaacggcaaagacatgaacaaattaacagttcatgctgcagattctttttcctgcttactcgagcttgcttctaacaatgattttgaagattttaagctagctttagttagggatgtttctctaataagtgaagttggcctctggtatgttcgccagattgggtccaaacaaattgttcttgagcaccgaactcctttaatggttgctgctatgtatgggagtatagatgttctaaaacttatactctcatgtccggagactgatgtcaatttctcctgcgggacagataaaagcactgcccttcactgtgctgcatcgggtggttctgttaatgcagttgatattgtcaaattgctcttatcagccggtgctgatatcagttgtgtggatgctaatggaaatcgtccagttgatgttattgttgttcctcctaagcttgaaggtctgaaagcaacccttgaagatctactttcagatactgcttctgatgggtctattgctgctcatttatcaccacctgaaaatgggttgccatcctctcctatggcatcaaagtttactgatgcagctgttaattctgtttctgagaagaaagaatatccaattgatccatcacttcctgatataaagaacagcatttatgcaacagatgagtttcgcatgttttcattcaaggtgcgaccttgttcccgggcatactctcatgattggactgagtgtccttttgttcaccctggagagaatgctcgtaggagagacccccgaaagttccattacagctgtgtgccatgccctgattttagaaagggggcctgtaggcgtggggacatgtgtgaatatgctcacggagtatttgagtgctggctacacccagctcaatatcggacaaggctgtgcaaagatggtactagttgcaatagaagggtatgtttttttgctcacaccgcagaagagctgcgtccattatatgtgtccactggatctgctgttccctcgcctcgctcatctgcctctactccaaatgtcatggacatggctgctgcaatgagcctctttcctggttcgccgtcatcaatttcttccatgtctccatctccctttgcacagccaatgtctccatccacaagtggcatttctcattcatctaatgcttggccacagccaaatgttccagctcttcatttaccaggaagcaatattcaaactagccgattgagatcttctcttagtgctcgtgacatgccacctgaagacttggatgtgttgcaagattttgatggccagcaacaccttttgaatgacttaggctgtttctcgcagccccatcctggtggcatttcagtgagtcgatctggtcggtccaagacactaactccatcaaatcttgatgaactattttctgctgagatttcttcatctccccggtattctgacccagcagtggcttctgtattttccccaacacacaaatcggctattatgaatcagtttcaacagcttcaaagttcattatcacccataaatacaagtgtcttgtctcctaggaatgttgagcatcctctattccaggcttcatttggtgtctcttctcctggaaggatgtcaccaagaagtatggagccaatctctccaatgagctctcgattatcatttgctcagcgtgagaaacagcaccaacagctgcgaagccttagttcaagggaccttggtgccaacattcctgtctcaatggttgggtccccagttaactcctggtctaattggggttctcctcatggcaatggaaaagtagattggtcagtaaatggaaatgagctaggtcgattgcacaggtcatcatcgtttgagcttggaaacaatggggaggagcctgatctatcctgggttcaatcccttgtcaaggaatctccatctgagataaaagagttgggaggttctggccctgttgcatttgctgatggaccgagttcaaatcctcaagttgagtctgttgatcattccgttctaggagcctggcttgagcaaatgcagctggatcagcttgtagtctaa

SEQ ID NO: 107271 - DNA, 342 bp, Glycine max
  Peptide Sequence Number=SeqID_224049
atgttggtgagtggtgtggggatgagcggaagtggaacttggtgtgaaggagggaatggtttgaatgagagaagggaggaagaagaatcattgtttcacactttattttggtgcaaacctgcactagaaatatggcatacctactacaagtggtgtgggttgcaaagcgtgtttcctggcactattaaggaacattatttgcaacgcgtgttgattaaagagaagaaaaatgtgtggtgtggtctctatggaaggcaagaaacaacactatcttcaggggaggtttcttcgataacaacaagatcatgcaaaaagctatctttcatatgtggacatggttga

SEQ ID NO: 107272 - DNA, 555 bp, Glycine max
  Peptide Sequence Number=SeqID_224050
atgctatatggaaaacttagacataataccctcgaccaagactactacaaatctatcaactacataaagatgttagctcccatgatcttggatgacctagaccttgaccccagaactcataaggacaataaggtaaaaccagttgaagaatcgtgtaccttcaagctaggtgacaaagaaagacaagtctcccaaattggggatcacctgaatgttggagttagccctagtgggcaatccatttcatattgtatttgtatcttgattttgactgatgaccacgtctcgtacgtcatggatatgagatatcaaatcagcatgcaggattcgtccctactacaaagtcagaggtatgtctataggcctcttgataaagggggacacgctatatgcgtggccacgcaaaaatatttgagagagaaatgtttgtcacaccaaatccctatgctctcccatcagctagcatcaagaccatactccgctagttgctcacatggactgagtaaaggtgtcttactttcaatgcttggtgatcaagggcaacacattctttga

SEQ ID NO: 107273 - DNA, 549 bp, Glycine max
  Peptide Sequence Number=SeqID_224051
atggaattagagcaaatcgatgtcaaaatttcctttttccatggaaggctggaggaagacattctggtgcaacaacttgaaggttttgaggtggaaggaaacaaaaattatgtctatagattgaaaagtgaatttgagatgaaggacatgggagctgctaaaaagattattggcatggagattaagagggaccgaatccacaagaagcttttttttgtgttagaaagaatacattcaaaaagttttgaatcattttcggatgacattttcaaaaccaatttggatgctaggagattcgtgactaggtatgcattcatgattaacaactttcttgtcagttggaaggcaacacttcagcccacagtggctttatacactacaaaggtagagtatgtggctctggcagaagcaacaaaggaagggatttggctgaaaggtatcgagaaaccgataattggacttaacgaggaagacactcttatgccttgtgttcaatcaagatttttagacaaagggacaaatgctacacgatggatatggttgcaataa

SEQ ID NO: 107274 - DNA, 162 bp, Glycine max
  Peptide Sequence Number=SeqID_224052
atgccttggatgatccacatctcagggtcaggtgccaatgagcacattaaactatccatgtggctgagagccctcacagtccaggcacaacaacgcaattatcaggggcgcgctctaccactgataaagattaggaggacaatagcccatgtaatactataa

SEQ ID NO: 107275 - DNA, 552 bp, Glycine max
  Peptide Sequence Number=SeqID_224053
atggtaacccattattgtggtgtgactccatgcatcaaccgtttctcaacccttttcacgtggaactccaacttcagacaccttgtcaatcagggccatgcccaaaacgcccttattctcttccgccagatgaagcaaagtggcatcacacccaacaactcaacctttcccttcgtcttaaaagcatgtgccaaactttcccatctcaggaactctcaaatcatccatgcccacgtcctcaaatcatgctttcagtccaacattttcgtgcaaaccgcaacggttgatatgtatgtcaagtgtggtcggttggaggatgcacacaacgtgtttgttgaaatgcccgtcagggacattgcttcttggaatgcaatgctgttgggatttgctcagtctggcttccttgataggctgtcttgtcttctacgtcacatgaggctttctggaattcgtcccgacgcagtcactgtcttgctactcattgattcgattttgcgtgtgaaaagtctgacatctttgggtgcagtttattcctttgggattcggattggt

SEQ ID NO: 107276 - DNA, 1441 bp, Glycine max
  Peptide Sequence Number=SeqID_224054
caagaaaaagggaaagagattaccacctggtccaaaagggttgccaattttgggaaaccttcacaagttggggtcaaatcctcatcgtgatctgcatgaactagcccagaaatatggacctgtcatgtacttgcgcttaggatttgtgccagccataattgtttcttcaccccaagcagctgaactgttcctcaagacccatgatcttgtctttgctggtagaccacctcatgaagctgcaaagtatatggcttgggagcagaagaacttggcttttggtgaatatggttcttactggcgcaacgtgcgcaagatgtgcacattggagttgctaagccaaaccaaaattaactccttcagacccatgagggaagaggaacttgacctattgatcaagaatctaagaggggcatccaatgatggagctgttgttgatctcagtgccaaggttgcaacactcagtgcagacatgtcttgtagaatgattttagggaagaagtacatggaccaggacttggatcagaaggggttcaaggctgtgatgcaagaggtgttgcacttagcagcagctcctaacataggggattacattccttacattggtaaacttgaccttcaagggctaatcaggcgtatgaagacactgcgcagaatctttgatgaattctttgacaaaattattgatgagcatattcaatcagacaagggagaagtcaataaggggaaggattttgtggatgccatgttggacttcgttggtaccgaagaatctgaataccgcattgaacgccccaatatcaaagccatattgctggatatgttagttggttcaatagatacttcagctacagcaattgagtggacaatttcagagctactcaagaatccaagggtgatgaagaaactccaaagggaattggaaactgtggtgggtatgaagaggaaggtgggggaatcagacctggacaagttgaagtatttggagatggttgtaaaggaaggcttgaggctccatccagtggcaccgttactattaccacaccactcgagggaagattgcatggttggagaatatttcatacctaaaaattcaagggtgatagtaaatgcatggacaattatgagagacccaagtgcttgggatgaggcagagaagttctggccagagagatttgagggaagcaacatagatgtgagagggaaagacttccggttcttaccttttgggtctggcagaagggtctgtccaggattgcaattgggcctaaacacagttctcctaacagtggcccaactggtgcattgctttgattggaagctaccaaataacatgttgccatgtgaattagacatgacagaggagtttggcctctcaatgcctagagcaaatcatctacttgtcattccaacatattatcgccttcatgatcaaagttgttag

SEQ ID NO: 107277 - DNA, 1280 bp, Glycine max
  Peptide Sequence Number=SeqID_224055
atgatttggatagcactttttttagtttcactggcttttctgcggttatggagaagcaataagaatgcaaagaaattaccacctggtccaaaagggttgccaattttgggaagccttcacaagttgggaccaaatcctcatcgtgacctgcacaaactagcccaaaaatatggacctgtcatgcacttacgtttaggttttgtgccgaccatagttgtttcttcacccaaatctgctgaattgttcctcaagacccatgaccttgtctttgctagtagaccacgtttcgtggcggatcaatacatctcttgggggcagaggaacttaggctttgctgaatatggttcttattggcgcaacatgcgcaagatgtgcacattggaattgctaagccaatccaaaattaactccttcagacgcatgagggaagaggagcttgaccttttgatcaagcttgtaagagaggcagccaatgatggagctgctgttgatctcagtgtcaaggttgcaacactcattgcagacatgtcttgtagaatgattttaggaaagaagtacatggaccaggacatgtgtgggagagggttcaaggctgtgattcaagaagcaatgcgtttattagcaactcctaacgtaggagattacattccttacattggtgcaattgaccttcaaggcctaacgaagcgcttcaaggtactttacgaaatcttcgatgacttcttcgagaaagttattgatgagcacatggaatcagagaagggagaagacaagaccaaggattttgtggatgtcatgttgggctttttaggtactgaagaatctgaataccgcattgaacggtccaatatcaaagctatattgctgggtgatgaagaaactccaaatggaattggaaactgtggtgggtatgaagaggaaggtgggggaatcggacctggacaagttgaagtatttggagatggttgtaaaggaaagcatgaggctccatccagtgacccaagtgcatgggttgaggcagagaagttctggccagagagatttgaaggaagcaacatagatgtgagagggcgtgacttcgagctgataccatttgggtctggcagaagggcctgtccaggattgcaattgggcctaataacggttcgtcaaacagtggcccaacttgtgcattgctttgattggaagctgcccaataacatgtttccagatgatttggacatgacagaggcgttcggcctcacaatgcccagggccaatcatctgcatgccattcctac

SEQ ID NO: 107278 - DNA, 325 bp, Glycine max
  Peptide Sequence Number=SeqID_224056
atgatcttgaacattaaatggagagaagaagaccacccacctttcccacttcacagaacgacaactgtgccagcattcattatagagagacgtagtactacacttcttgagatcgatcataataaacactcaaaccaaacaagcaaaactaaacttaccaatgaagttgaagcagcagaaaatgagagtagtagtagggtcagtgtggctgtgcctctttctgttggctgtcggggagtcggagggagcggatttggcggcgaagtgcaacctgctggttcagaaagtgctgccgtgcctgaacttcgcgacggggcaggcggcg

SEQ ID NO: 107279 - DNA, 210 bp, Glycine max
  Peptide Sequence Number=SeqID_224057
atggcagagcttctgggtctatctccaaactccgctgacgctgctatcttcagaaatggttcgttgaaaacgaattcagcttcaacagtctcagaagaaatccacaagggctcttatggaaacatgcttagacctgttctcgttgcagacctaatagctgttctcctcgtcatgattccaataggttgcagcatatatagaattaactga

SEQ ID NO: 107280 - DNA, 987 bp, Glycine max
  Peptide Sequence Number=SeqID_224058
atgcatgtgcatgtgccacaggcagagaaaccttcttggaattctattggaatttttaaagtatcaaatattactggaaagagacgtgagccggtgcctaaacttggaactgatgacactgaaatggatggtgaggatagtgacagtgacgatgatagtgaggatgaagaaggtggtgctcagggtcccagtttgcaggcaacttcctcttcatttgagtttttattgtttcatttcttgactgcttcaaatccgatgttgcggaaggttgctcaccaaggatgtgtcaaccgtatacgctctatgccacaaaatccccatatatgtgcagcttgggccgataccggtcatgtacaggtctgggacctcaactctcacctcaatgctctagctgagagtgaaacagaaggtgtccaaggagttgctgcagtttttaatcaggacccattgtataaatttaaacacaaagatgaaggttatgctatagactggagtcctcttgttcctggaaggcttgcatctggggattgcaataattgcatttatctgtgggagcctacatctgctggaacatggaacgttgataatgctccatttactggacatactgctagtgttgaagatctgcaatggagccctacagaacctgacgtttttgcttcttgttccgtggatggaaacattgcaatatgggatacccgtttggggaagtcaccagctgcatcttttaaggcacataatgctgatgtgaatgtaatgtcatggaacaggttggctagttgtatgttggcctctgggagtgatgatgggactatttctattcgtgatctcagactgctcaaggcatactacatcgaatttgtaaagctgtctgatatgagtttctttttcccttgtttcattatcacatccttcttttaccattcatgtgcaaatcaagtgcctataaatccatgcatgaaggaacttctagatgcattatggtga

SEQ ID NO: 107281 - DNA, 630 bp, Glycine max
  Peptide Sequence Number=SeqID_224059
atggagactaaacagagttcggtgacggttacgctcagttacggcgcgttgacgtgcgccgcggaatttctcgcgactttgctagcttctgctgtcgtcaaagcctcgcttttggccccgggtattaaagtcaaaagtcaaggaagcggattcgtatgggttattcgcttggatatgccgttgagcgatctctaccggctgctattgatcaacacgcctactgccaaaggagagagcaaaattcagagtgaagacaagcaacgtgatgcagagggagaagatggtaacgatgatgaaggcgacgatgacgacgatggagatggtggatttggggagggtgaagaggagttgtcatctgaagatggaggtggatatggcaacaattccaacaacaagagcaactcaaagaaggcacccgaaggtggcgcaggaggggcagaagagaatggggaagaggatgaagatgaagatggtgatgatcaagatgacgacgatgaggatgacgatgatgatgacgaagaggacgaggcaggtgaagaagaggatgaagatggtgctgaggatgaggagaatgaagaggacgaggaagatgaggaagcattgcagcccccaaagaaaagaaagaagtga

SEQ ID NO: 107282 - DNA, 273 bp, Glycine max
  Peptide Sequence Number=SeqID_224060
atgactcgcggcataaaacaccgtcagaaagccaagagcaagaagaaggtctcgaagaaagagagtgggtcttcttcatctttggcgccagaaattcccgcgaaggtgtggcaaccgggtgtggataagttggaggaaggtgaagagcttcagtgtgatccttctgcttacaattctcttcatgcctttcacattggatggccatgtttgagaaagaggaaagagaacaaaactttgagcttttttgatagacaaacctgtttgtttttgctg

SEQ ID NO: 107283 - DNA, 2181 bp, Glycine max
  Peptide Sequence Number=SeqID_224061
atggcaatgggaagaaggtgtgttgtggaagttgagattgagagtgaaagatctccactgggatacaacaattttgcaaaatggggaataacagacaaaggagattcagaactcatcgcgcacaatcaagtcgacaccaccaccaacaactcttactcagaaaatggtgagggcgaggaagaggaggaggaactcacggaacctaaaataaagcttgctattccggctggaaatcaatgtgtctcaagagaagattactctttaatccagaagaaaggattggctgttgtggattgttcatgggcacgcttagatgacgtgcctttcgtaaggctgcgctgtactgctcctcgcctcttgccatggcttgtagcagcaaatccagtaaattatggtcggccatgtcagctatcttgtgtagaggctttatctgctgctttgacaatatgtggggaagaaaaaactgcaaatttgttgcttgacaagttcaaatggggccatgcttttatgtctctgaatggggaattactgagggcctactccaaatgccaaaatagtgctgaaattatatctgttcaaaatgcttggctgtcacaagagagtcagattccaagggctcctactgacagtgaagtaatcatgctgcctgatgacctggtcgaggtcattggttctactggaaacagcctctctattcatgaggataaggctgtcaaagcagagctggtagtgggaacatggaataaacagtttcacaattcagagaaggttcagcgagtcccccttctgtatcttgcaaatgatatcctgcaaaacagcaggcgtaaaggaaatgaatttgtgaccgagttttggaaggttcttccctcagcacttaaggatgttcttgagaaaggtgatgatcaagaaaatcgtgcagtatttagactggaaaggagagtgtttggatctcaggctaagagccttaaaaatgtaatacttggagaagaagcacctccacagttggaattcaacaaaaagcggtcccgttctgttagaattgtgaaaaaggattctcgttccatcaaaacggtgagactgagggtccttgtgaaattgtccattggaggtacagcagaaaaaatagtctcagcctttcatacggtgcttaatgaacattccaatgaagatgcagagatgagtagatgcaagtcagctgttcatcgtgtgaggaagatggaaaaaaatgttgatattgcatgcgctgttgtaaaggaccctaagcgaaaaactttgtccaaggagctagtggaggaagaaaatattttgaaagaatgcattgaaaatctcaaattagttgaagcaagtagaacagcactttcctggtgccctcttgcaattgtttgtgcttttatgtatcaggaatctgagctggagaatgttcgcactcagattcaggtagcgcaagcacaagtagaagaggctagctacatgcggaagcgacttgatgatgaagattcttcatataaagcctcaatttcaacgacttcacttactgatgtgaatacaaaatcagaagcagcaactaagaagtcagctgctgcaattgcagctgaggttgcagataagctaacagcttctacgtcatctcagttaatcatgacttctgttctctcaacatttgcagcggaagaggcaaaaagtgcttgtctaacttctgagtccatgtcaaaacctgagaagtcaatacctatatcagatccaaatgtttttgtgtcttcacaacagttaattgccacacccaatcattcatatccttcagttttggtacctcaacccaccttgcagaatccagctgctgcatcacagggtcaatatcaaatgctttgtaattcatcctcccaacattatttgcaatcaacaggaggtgtcatttcttcttatggttatggtagcatcacaccattaccaccgggaccactcccaccccatatggtgggtccagtggtgcctttgacgcatcaggcaatgcaaataactcagcagcagccaacacctatagctcagcatcaaccaataaaaatgacacaacaagccccagcacctcctagtttccgaccacttcaaccgccaggaatggtgtactatgcaaacagtatgctcactggggttgagttggaaaatgcgtggacgccaggctag

SEQ ID NO: 107284 - DNA, 483 bp, Glycine max
  Peptide Sequence Number=SeqID_224062
atggcactgtcacaattctccttgtggtgggcattcagtggggataggacgactgctaaagtattacaagcaggattcttctggccttccatcttcaaagatgcccatgatcatgccctcaaatttgtcaattttgacgactctctatctggagagaagcataagttgcaattgctagagctagaagagatgaggcttaatgcctatgaatcctccaagatttataagcagaagatgaaagtgtaccatgatcgaaagatgataaagagaaactttcaactcggacaacaaggtaaactcaagtccaagtggtctggtctcttcaaaaccaaagaggtgaagtcttacagagcagttgagttgatggatcctacctcaaatgaacctaagcggagttggattgtcaatggtcaaaggttgaagatctacaatggtggcaacattgagagactgtccaccatcattcatcttcaagacccatga

SEQ ID NO: 107285 - DNA, 825 bp, Glycine max
  Peptide Sequence Number=SeqID_224063
aaacacatctacccctccccactttatatttctaacaaggtttttattcttatagccgctattgagaaagatttatgggcttctggaactgtgaatgacgagtatctgaaagccttaaattctctatttaccaacttcccaagacttagagcaactgaaccagcaacccttagcattccccatctggttacagccttaaagacaggttcagaggcttgtcaggaagctgcattggatgcacttttcctgctcagacaagcttggtcagcatgcccagctgaagtttctagagctcagtcaattgcagctgcagatgcaattccattgctgcagtacttaatccagtctgggccacctcggtttcaggagaaagcagaatttttattgcagtgtttgccagggacattggtggtgatcatcaagcgtggtaacaatatgaagcagtctgttggaaacccaagtgtttactgcaagcttacacttggcaacactccaccaaggcaaacccagaggggccacttgattttgtctgtgtatgcactaggatccagtgacatggatataaaagtggtttcaactggccctaatccagagtggggtgagagcttttcatggacctttgaaagtcctccaaaaggccagaagcttcatatttcttgcaaaaataagagcaaagtgggaaagagtaaatttgggaaagttacaatccagattgatcgagtggtaatgcttggatcagtagctggagagtatgctttgttgcctcaaagtaaaagtggccccccacggaatctagaaatagaatttcagtggtctaacaagtga

SEQ ID NO: 107286 - DNA, 117 bp, Glycine max
  Peptide Sequence Number=SeqID_224064
atgcctccactcgttgctgtcctgattatctggaagagagctgtccaagaaaagagaacacataagtcaatggaactagaaagcaccggctatgaaaatgcaaatggtggaagaaag

SEQ ID NO: 107287 - DNA, 132 bp, Glycine max
  Peptide Sequence Number=SeqID_224065
atgacaaagagggttacaaccattaatattagcatgacacgcaacctaggacgtgttgatgtttatgcttccaagacccgcaagatgatgagtagggacatgcagggtgctaatttggaagaggcgaggtga

SEQ ID NO: 107288 - DNA, 588 bp, Glycine max
  Peptide Sequence Number=SeqID_224066
atggcactctcagtctcctcaccctcatgcgtacgcgttccttcatgtttttggaaaccaaatggcaagagttgcaaagagcgtactaaggtttcatgtgcagctcacaatgataataagaatccgttggttggaatcggtattggggttgtaacgtcttgtgtgatgggtttaactgcattggatgcggacgccacgagaatcgaatactacgcaacagtggcagagcctttgtgtgagtacaactatgttaagtctggcctcggctactgcgatattgctgagggcttcggtgacgaagctccactgggtgagcttatcaatgttcactatactgcgagattcgctgatgggatagtattcgatagcagctataaacgtgctagacctctcaccatgcgcattggtgtgggcaaggtaatcaagggactggatcaggggattttagggggtgaaggagtacctccaatgcggataggtgggaaacgcaaactgcagattcctccgcacttagcatatggccctgaacctgcagggtgcttctcaggttatgtttcatcgcactttggaaattgctatatcatctaa

SEQ ID NO: 107289 - DNA, 378 bp, Glycine max
  Peptide Sequence Number=SeqID_224067
atgtcacggaggagtgaaattgagaatggggagattgccggtgagagatggaagaaaggggaggcggagaggggggagtttgtttctggaaaatggagaaagttggtttcaaacttcttaatattacaagacaggttagtagcaaaaatccggcaaagtgctactgagtctcctaatccaaaacctgaggttggagagattgacactagcccaccttttcaatctgttaaagatgttgtctctctatttggtgaaggtgctttctctggtgaaaaacctatctttaagaaggcaaaaccttattctgctgaggtaattgtcatttttatatttgcacttgttcttaatcacaaatcccatggtgcaagacaacattga

SEQ ID NO: 107290 - DNA, 420 bp, Glycine max
  Peptide Sequence Number=SeqID_224068
atgtggtcatctgctcttttcggagacctcagtatctttcgaccgagactattgcagtctccacttcctcaaccggaggcaagcaagcctgttgacatgcggagaccaaataaagtcattttctccttttcaaagaccttagtgtcttctgaccgagactattgcagtctccatttcatcaatcggaggcaagcgagcccgttgactcgcaaagacaaatatggtcattggtttttcctagagaccttagtgtctttcgaccgagactattgcagtctccacttcatcaaccggaggcaggcaagcccattgacatgcagagaccaaataaagtcgtatactcctttttggagacctcagtgtcttccgaccgagactactacagtctccatttcatcatccagagacaagcaagcctga

SEQ ID NO: 107291 - DNA, 1124 bp, Glycine max
  Peptide Sequence Number=SeqID_224069
atgacaggcgccgccgatgctgttcagacagagggagtggctactgatgggagcttggggtcacctgctgcagatgagggtttcctcggtggaccacgcgacccatcgattttgaccgattttgccgagcatgtcgcacacaacatctggagtggacaggaacgacccgatctgaagttggtctcccacggtagaaaagtagataaaattgggagaccagcgcctgagatcgaagggttgattgctggcaccggattgagtccactgatcaggtgttctgttatcaccactgatcctggactcatatccgccttcgtcgagagcacgttccacttgccagtaggcgagttgacgatcacgttggatgatgtggcgtcactcctacaccttcccatcactggcgcgctacatacgttcgagccgcttgttacttcagacgccattggtctactgacggagcttcttgaggaccagacgatgggttgttgcagcttgcacgtatctgctccacttggtgggctgtactcttttcgccaacaagagttcaacccatgtacatgtcgtgcacctggaggctttcatggacctggcccaggcagggggatttgcctggggagcggctgcattggtccacatgtacgagcatctgaacgacgcgtcgcaggcctctacacggcagatgggcggttacattacacttctttagtgcatacatgcgtcgtacatgatgcttatgatgaggggagcccacgggcgtgcaggtggcttacgggtaaggctcatatgacggggatcaagggagctctgtatcggacacgaatggatgccctgactgtgactgacgtgtgctggatgccctatgctgagcaccacggagtcagaggctttgacttgatatcgtcgtacaccggtcagctcagatggggtcagattgtcgtgtacgttcgacctgagcgggttcttcgacagtttggctacattcaaatcgtccctccgccgccggtttgtgattctttgacgattgatgatatagatgactggtggctgcatttttcagaccatttgttgcctgcaggggagctctgtgtagttcctgggcaggtggtgccagactacatggactg

SEQ ID NO: 107292 - DNA, 600 bp, Glycine max
  Peptide Sequence Number=SeqID_224070
atgtctcacaaagaaaacctcctatgtgaactgaatacagagaaaggtacttggaagatagtggtgcgaataactgatatatggcgtcttaacaagcataatggtcgacaatccattgagatggtgttgatggaccatacgggtacaaagattggggcaactctatggcaagaattgttccctgaatttgagcccaagttgcattgtggtggtgcatatgttattcagaacgtgaaggttgttgatactcattcggactacaaaacaacctctgtgaaagaggtagacagacctgagattcctcctaatgttcattccattacttcatttgctgatataatttcaggcgttgcaaaacctgatactttagttgatgttgtgggtgttattgctgaagtgattgaacgcaaaacagttaatcctgtatacagagtgactgtcaagttgagagacaacagtcatgttgagatcatcatgaccgtgtgggaggaatatgctcttcagctggatgatactattgagaaaaaccattttgtgcaaaagccattggttgttatgctaacccttgctaagatcaaagaacccaagggccagtattaa

SEQ ID NO: 107293 - DNA, 1038 bp, Glycine max
  Peptide Sequence Number=SeqID_224071
atgacaacgcggttttggaggaagcgacattttcacttttgcatggtgctaatgaatgtcgtggaggtgcatgataacaaagggcacacattagtaatcgtggtttgtacaaaatcccaatccattaatccctctccacttgcggtggaggtgcaggggtgcctgatgagtggcatttctgtccatttggggtattttggggtgcagaaagcaaaagatgggtttaaggaagtaattaccctcatagggagaagtttctcgaatatagaagtgcggttacaaatatcaggaattcatttgcgcttccgaacaacaaaacaaagtcccccccctctctctctcggtgtctggaacagagattgcgtttgtttcgcgaattgtgaagccgctggtgaaatagcaccaaatatgaggggaagaagctgcagttacagcccatcaccttcacctccaaggcgttacagccgaagaaggcacagccttagccctaggggccgatatagaggatgtgatagggatttgccaacaagtcttctggttcgaaacctcaacagagattgcaggccagaagatctgcatggtccatttggccaatttggtcctcttaaggatgtttacctgcctcgagattattatactggggagccaagaggttttgggtttgtccaatatgtggacccagctgatgctgcagatgcaaaatatcacatggacggtcgaattcttcttggtcgtgagataactgtagtgtttgctgaagaaaacagaaagaaacctgctgaaatgagagcaagagaacacaggagggatcgatcgcatgattacaggcgatcttcacgaacctattctcctagtccagactattctccttctccaagacgaaggcgacattacaggatctgcagtgtttgtactcacctatattatgattcaggtcaatctcaccaagggacagaaagtatagggatcgatcatactctagatcatcttatgcatcaagaagccgcagcagaagtaggagttacaataggagtttga

SEQ ID NO: 107294 - DNA, 861 bp, Glycine max
  Peptide Sequence Number=SeqID_224072
atgaatgaagaaaatgaagaagcaactggtgtgaatgaagaacatgttgattgttctgatgcatttaatacttctcaggtgtttgctactcgagatgatgttttgcagtgggctcgattagttgcttatgaaattggatttgttgcagtgattatgaggtcaaacacaaacactagtatgagaggaatgacttcagttgtgttaattggttttgaaaggagtggtcagcataggtctaggaagaaagattttgtcagaatagatacttgtagtaggaaatgtgggtgttcctttaagtttcatgggaaaccagtggttggaggccaaggaaggatggtcaagttaatgtatgagagtccatacgttggtcgattgactaaggatgagaagacaattattgctgatatgacaaattcaatggtgaaaccaagaaatattctgctaatgctgaaagagcataatgccaatagttgtataacaatcaaacaaatatacaatgcaagaagtgcataccgttcttccataagagacagtgatactgaaatacaacatctaattaagcttcttgaacgtgatcagtatattcattggcataaattaaaggatgaagatattatagtacctacaaaacaaataggttttatggataaatggatggatataaccgacatgggatatgtcattgcatcaaggtataattttatccttggatcgttgtctctgcaacaaagcatgacgctttttcctcttagaactcaaccaccaacagatttttctgtgcattgcataatatgtattggtcacttctttggcaatcatttttttctaggtagattcatcgtaatgatatttttaaattaa

SEQ ID NO: 107295 - DNA, 2547 bp, Glycine max
  Peptide Sequence Number=SeqID_224073
atgtcaacccttaattcatcaccatgtactgcaccacatacaactacaggttgtcgacctactcagattgggatgacttctcaacatataaattcaggaagatacacaatattcaattccaaactaatagagcacatctcggatgacactgatgacgaactcgatataacacaagaagacattgttacagattattcatttgacgacatagcaactaaggattttgctgatatcgattatgatggtaatctagacgcaccatatgacaatgaaaataccggttacaaggatattggagattcaatttggcaatgcaagcaatgtaaagcgaagatgtgcagagattcacaagcaaagaaattccagcaaaacatatgtttatacaacctaatgtttgcattcacatctcctggtgtcaaagtggacacatcctataatactggaagaggtcctcctacattgcgcatacatggtcaatcgcatcaccttattggaagcctcctacctatgcctgataactcaccaaagtttgcacaactatatatttatgacacggaaaacgaagtcaacaataggctttcacaataccctatcaaaaataatgttgatgaagacattataattggtatcaagaatatgctagatacccacaatccatatgcacaaaaattcagaatggcaagggataaactggaatcttctgcagtgtgtgacctgaaactaaagctcattagtgacagacaatcagatggcagattatataatttgacaaatgcttctgaagtggctgctttaattgttggtgacgagcatacagtgaataacagagatatcatcatcgagaagcaaacaggcatgctgcaaagaataaatgaacttcatcctgcatatttacctttgcaatatcctcttttgtacccacacggtgaagatggctacagaccaaacattcttcataaggatcatccgaataaccatgctgcaaagaggaacaaagttaccatgcgtgagtatgtgtcggctcctgaagcatgttggaagattttcgcattcccaatgcatggacgtgcaccagcagttgaacgcctttatttccacctagaaaatcaacagtctgtttactggaaagatagtcaagaaattggcacagtactggataagagtacaatcaaagaatcaatgttcacagcttggatggattttaataaaatataccatcatggacgagatcttacttatggtgaatatgtttccaaatttgtttatgatgcacgaaaaagatgctggaaaccaaggaaacaaggaaatactattggcgggctcatttgggtgcccccttccagtggagagttgttctgcatgaggatgatgctttcctctgctaaaggatcacaatgttacgaagatattagaacagtagaaaatgttgtctatcatacattcagagaagcatgctttgcaaaaggttttctaggaagtgatcaagaatttgttgaatatgtgtggaaacaaacttggcaatggatggcagatgatattgtatttaatcataggagacaaggcatccaactaacagacaaagaaaaaatgcatctttgtttgacggaaattgaaaacctcctgcaagccaacaggaaaatcctacgagattttccttcaatgtcatacccactaggatatgccgccaacccgcaccaaaataatctcatctacaatgaactggcttacgacagggacatattggccaccgaatttgacaaatgctaccagtcgctaacagatgagcaggcttctatttttaataagattatgcatgtggttgcaactcaatcaggtggagtttattttctgtatggatatggtggcacaggcaagacatttgtgtggaaaactttatcatctgctatactctctactggcggcattgttttaacagtggcttcaagtgggattgcctcaatactattgtctggcggtagaacaacacattctaagtttgctattcttgtccctgcaacacaaaattctacacgcaatatccatcaagggagtgatttggctgaattgttgcatatcacaaaactcatcatatgggatgaagctccaatgtgtcatagatacagtattgaggcccttgacaaaagtttacaggacatcatgcacaacggcaatccttttggaggaaaggtcattgttttcggtggtgatttccatcaaatactacctgttgtgccaagaggtgatggtaaacttgaagaaccaaatgatggttatggtgaaatcaccatcccagatgagtttcttatcaaggactttcaagatcctatccaggcaattgttgaagcaacatatccagacttattacacaactacaacaatggagatttcttgcaaaaaaaagttgtccttgcctctacaaaagatgttgttgataaaataaatgactatgtcctgtctttgattcctgacattaggaatacccaatcacaagctcagaatcaaggttggtactcccatcatcctactacgaaatctggaccaagctga

SEQ ID NO: 107296 - DNA, 447 bp, Glycine max
  Peptide Sequence Number=SeqID_224074
atgacgcagaggggtgaagcaaaagtaaggggagatgcaagaagcataaaaggaggtgtagaatctgtaccccatttcgctgcaacgcgcttcgtcttcctccttgcctacaagattattgtcgcgccgccgtcattgtcaccgtcgtcagcctctgttgggtccgtcgacgccgtccacaccaccaccgtgacaattcctccacactctccgggttcaagattatgttttgaagatattgatggcaaattgatgcatttctctaactaccttacatcggaaacttgccaagcaattgcagaaaggttggagcggttgctcaacctaaggatagtgactgaaggcacaaaaacatacgatatcatgcaagactacctaaggatcactaggggtgtcactgtggatcgcaatttggtcactgctttgtctgaggatgataattcctag

SEQ ID NO: 107297 - DNA, 282 bp, Glycine max
  Peptide Sequence Number=SeqID_224075
atggcggtggtagaagggtatgactatgatctaatcggcaaattaagcttaggaagttcaccccataaatgcgttaaggggatgagacaatgtagtaagtgttgcagtgtggacaactaccagaggattggaattgtgggtgccgcgtgttgggcatgcgaggctgttttgcatatgcgtaactgcatggaaaatttgcatgctgttgatggtggtggtcacggaattaatgatgatcatcaaatagatcatgatgaagaaaccgtgagctgggtacactag

SEQ ID NO: 107298 - DNA, 1752 bp, Glycine max
  Peptide Sequence Number=SeqID_224076
atgtcttcgtttacgggtgcacgttccaaagcaaatgctaactctgaaatgaccaaagctaacgagattaacctctgccccgtcaacacaagtaccattacatcaacctcgccagatacaagtgccaagaatgagaagaaaaagaagtctatccttccaaagattttcggatcaaagcgaaatgggagaggttcagacgaagagacactcaaaacatcaagtgcagaagaaggagatggagttactctggatttggagaataagattgagacgagaagaaaagcatttttggaagcggcccccatcatgagaaaaagtttctcagaaagggagagtagtcctgggatcgaaggcctgaatttgtccaattttgaacggcctatgatcactatggaaactgaacttcaaagtttcaggatctttgttgcaacgtggaatgtgggaggaaagtcaccaagttatgacctcaacctccaagatttcttgctagtggagggctccgcagatatatatgtattgggttttcaggaaatcgttcctctgagcgctgggaatgttttagtaattgaagacaatgaacctgctgcaaagtggctggcattgataagtcaagcactaaacaaaccaagaaatgaatatagtgattcttctgactcgggaactggctccaaaacccagagtagttcgaaggagtcaaagtccccagcaagtttgaatttctttcagaagccttctcttaaagttattagtaaaaacttcagggcagagggtagcagcctccttaaggcttgcaattgtcctgtggaatctccatctagggagagacggaggatgagaaaatttagtgaccctatgagtaagttagatcctgagcttcgtggtgatgacactgtagaagagttgctttcaattgcagaaataccctcttctgctagccaaagtagatactcccttatatcaactaagcagatggttgggatttttctcaccatttggactaagaaggagttagttccacacattggacatcttagagcagattctgttgggagaggaatcatgggttgcttaggtaacaaggggtgcatatcaataagcatgtcattgcatcaaacaagtttttgtttcgtctgtagtcacttggcttctggggagaaagaaggcgatgagctgaaaagaaactctgatgtagctgaaatactcaaaggcacacaattccctaggatttgcaagaacccttgccgtcgagcgccagaaaagatagttgaccatgatcgaataatatggcttggagatttgaattatcgggtggctttaagttatgaagaaacaagggttctgttggaggataacgactgggacactttgttagcgaaagatcagttaaacatggaaagagacgcaggaagggtttttaacggtttcaaagaggggagggttgtttttgctcccacttacaagtattcacataattcagactcttatgctggtgagactgtcaagtcaaagaaaaaacgccgaacgccagcatggtgtgataggatattgtggcgtggcaatggcattgaacaattatcatacatacgtggagaatcaagattttctgatcatagacctgtttgtgctgtcttctctgtggatgtggaagtaagaagcagaaacaacaggttcaggaagggctattcctacacaagcccaagacctgaatacgaagactttatacctcaaaggcatagtttctatgattattaa

SEQ ID NO: 107299 - DNA, 1362 bp, Glycine max
  Peptide Sequence Number=SeqID_224077
atggtggagattcacgaagaaatcaacccctttgatcaagaagaaaatgaagacattggagaggaagaaatcgactatgaccagcttaagaagcggatgtggaaggatcggatactgctgcagaagatgaaggagaaacggcccaaagaagagccagtccaagaagcaaaacaagaagcatctaggcggaagaagatgtcaagagcgcaagactcggtcctcaagtacatgatgaagattatggaagtttgcaatgctcaaggttttgtgtatgggattgtccctgagaagggaaagccagtgactggttcttctgacagcttgcgtgagtggtggaaagaaaaggtaaagtttgatcaaaacgcaccaagttccattgcagaatacttgccactccttgaaacagatgagttggatccaagttcctacatacatctccttaacgacttgcaagacactactttgagttcactactttctgctctgatgcaacattgcatacctccccaaagaagattccctcttgagagaggcttggctccaccttggtggcccacaggggcagagaattggtggggtgaacaaggccttctggcccatgaacatggcccacctccttataagaagccccatgacctcaaaaaggcttggaaagtgtctctcttggctgcagtcatcaaacacatgtctcctgatttgtataaacttagaaggtcggtgactcagtccaagactttgcaagataagatgacaaccagggacacggcaacttggtccaaggtcatgaaccaggaagaaactctgctgcaactggccaacaagtgcctcaaaatatctccatcagaggaagatgataaaaatgagtgtgaaagctctactagtagcagtactatcatccatgaagggagtcatttaggtggcagcattgagaaaaggaagagtgatttggtgtttgacttagatgctgttattgataagctatatgcttgccaatactatcagtgtccacaaagtgaaatgggtatgggatttcttgacaaaaacacaagaatgaaccatgagtccctctgtgcttaccggactaatgaaggccaacgcgttctccttcaggattctctatccaatgacacacaaaatgagaataataaccttgttggccatctgattaatgatgagtttagagacattgcaggaaagacatcagaagaagattatggaggcttatggccaaattcccttgaagatcttgatttgcaagctgcactgaatcagatggacatggacttgaatccaaatccagagcaagatacaccacatggccaagacgtaacctcaatttgggacttagcctacaaatattaa

SEQ ID NO: 107300 - DNA, 233 bp, Glycine max
  Peptide Sequence Number=SeqID_224078
ttggggatcgaaatgttgttgtcgtaccattgcgttgccatgacagtctcaatgttgttggcaatgaggtccttggacgggaggctgtagcacatgccacatgtgcccatggagatggggtcactgacgccaacgatgttgaagtggaagggcaccatgccggtggcgatgccgtctcgcatggccttgaagaggtggaggtgcatgttgtaggtgttgctctcgtattatag

SEQ ID NO: 107301 - DNA, 228 bp, Glycine max
  Peptide Sequence Number=SeqID_224079
atgtatgagaattcgaatgatgtgtcaaagaaaagcgctagacaacttgtagaatatatcaaacttttgcagatctacgagcattttaccactgttgcttcttctattgctgttgagcattatcatgagaggaaaccacgtgcttgtcattggaagtctaggaaggcattaccaaagtcagcgtatcgtaagcggttagatagattgacattcgatgttttgtgctag

SEQ ID NO: 107302 - DNA, 207 bp, Glycine max
  Peptide Sequence Number=SeqID_224080
atggatgatttacaaggtacactaggatataatggacgaaaaggttcaaaaaacctgggtgaattagtgagtgaagattacccaacatttagagtcttctatccaacaacttggagggtaggattgcatcaccttacaaccaacaactttcagttagagccttcatctaaggaggatgaggatgatccttttgaggattcgtcttag

SEQ ID NO: 107303 - DNA, 234 bp, Glycine max
  Peptide Sequence Number=SeqID_224081
atggggtggtgtggggttggagatggtcgagagctcgttttgagcgagaagatgtggtggtacaacagatggagaccttattttctacggttcgggttatatttgatgatgaatgacagatggttgtggactgtgggcgagtcttccttttcgttggccttggcttatcaggttatcacatctgaggtttctattagtctaacattggtgaatttccccgttttggaagtgtga

SEQ ID NO: 107304 - DNA, 285 bp, Glycine max
  Peptide Sequence Number=SeqID_224082
atggtgctccaagcttccaacaaccaagaaaactaccattttgacaccatagaaaaggaaagagaaaaagagatgaaaaacatggttaaatacttttgtgtagccctaacaagaaaaaacataagaggaaagttcattttgcttaaagaggatggagaaaaatggacacttgaaccaatgagtgttggtggtgggtttaagacatttgacttgatgggttttgatggaggtgtgaggaagcaaaattgcatctctatgttgagaatgcatttggcttgtggatag

SEQ ID NO: 107305 - DNA, 1173 bp, Glycine max
  Peptide Sequence Number=SeqID_224083
ccttggtcttcaagtctttgcacgcacgcattttcctctttctgtgttgtgtgtttcacgtttcaacaaccagaagaagaaaaggctgtgatgggaagacttgcaccattatcagaagaacccatcaatgaagaaaatgaaggatacaacaacaatagtaacccaaagaaatgccttcaatcatggaggaactggaactggatcaagactcatttttctcttgtctttaacaagaagtccaacctcaagatcctccttagtgtcttgggttgccctttgtttcctgttcctgtctcatcttcggcacagtatatcatacaacactttagggctgcaacagggtgtaggaagttggagggaacagtgaagaacgtgttcacaacagggaaagtgacaatggatgtggtggatgagctcggatccgccggtggcagcgttaatttggagaaagggtgctttgtgatgtggcaaatggttccagataagtggcagatagagctggttttgggtggccaaaaggttgtggctggtagcaatggtgccattgcttggcgccacacgccttggctaggtgtgcacgctgccaaaggcggcgtccggcctcttcgccgtgctcttcaggcaagttcatcgtcatcatcatgtcttggactagaccctttggcagtgtcttctgtattctgtgcggcacaatacatgggggagaaagaaatatcaggcatggattgctttgtgctgaaactctcagctgaacagaaagacctcgttgagcggagtgacagcaaggccgagatgatcaagcacgccatatttggctacttcagccaaagaagtggccttttggtgtacctaggggactcttacctgaccaggatccaagcaccaggatctcaccccacatactgggaaaccacaatgtcaaccaagattgaggactacagaattgtggatggtgtgatgattgcacatgccggctcatcgaccacgttgatcaccaggtttggggacaacctcaaggctggaccatccatcactaggctggaagagtcatggacaattgatgatgttgcattctatgtgaaagggttgtccttggactgcttcatacctcctcaggaactgcagagagattgttcttcagatgatgagctaggttggagatctcatgcatag

SEQ ID NO: 107306 - DNA, 165 bp, Glycine max
  Peptide Sequence Number=SeqID_224084
atgacgaaggtgttgatgctagacatgaccatggccgaaggtgttgatgccagagaagtgaaggtgaggccaaacgaaggtgttgcggtggtggccagaggtgttgacgatggcgaaggtgacgtgagacgaagggacgatggcagagaggaagaagatggatag

SEQ ID NO: 107307 - DNA, 312 bp, Glycine max
  Peptide Sequence Number=SeqID_224085
atgtcattgttaggagtcattcaagagttggggaaactacgctcgagcggtgatggagacaccgtggaggttgaaggatcatgtggtgacacgattggaggaccacatgccagtggtggagatgagggctcagagagccatgagatgaataagatgttaaactggtgggacctcacgtggttcagaattggcatcgtcactggcttcgacatatttgtcctcaccgacctcaaggcaaggatggtggttagacctgttgtcgtgctgtcctacattagtggtggcttatggagcagtcataggaacgattaa

SEQ ID NO: 107308 - DNA, 1855 bp, Glycine max
  Peptide Sequence Number=SeqID_224086
atggcttattcttattcctcaagtttactcactaaactcatatttggagtgtcacaaaacaatgagttgtgccattcaaggaggaagggaaatgttgtgtattgccaagggggtgggaagaatgtgatcaagtcctcatcctcaggaagcttgtcttctgtgttgacagaaagatcatcattggttggcacagatcatgaagctgcagtaactctaatggatgcaggaagcttggtcttgtcacaaaatgggaaaagccaggcagagattgtggtgaaggatttggtgccttatggtggaacaacaacattgatagggttggaagatggaataggcattgtcaagtttcttggagggaaaaagtttttcattactggggcaactgggtttctagccaaagtttttattgagaagattctaaggacagaaccagatgtggggaaaatgtaccttttgatcaaggcaaagaataaccaagctgcaatggagagattgcaaaatgaaatcataaacacacaacttttcagatgccttcaagaaatccatggaaaatcataccaagcctttatgttgagcaagctagttcctgttgtaggcaatatttgtgaacacaatcttggactagatgaagatatatctaatgttatagcagaggaggtagatgtctttgtaaattctgcagctaatacaacatttgatgaaagatatgatactgctatcaacataaacaccatagggccatgccgccttatgaacattgccaaaaagtgcaagaagctcaagctctttctgcatgtttcaacagcatatgtcaatggacaaaagcaaggtaggatcatggagagaccatttagcattggagagtgcatagcaagagaaaaatatatatctgaagtttcaccaaaataccttcccacattggacattgaaggagaaataaatctggtttcaaattacaaaggggacattgaagataacttactaactcagaaaatgaaggagattggtctagagagggcaagaagatatgggtggcaggatacatatgtgttcacaaaggctatgggagaaatgatgattgacaaattgagaggggatattccagttgttgtaatgcgaccaagtgttattgagagcactttcagtgaaccatttcctgggtggatggaaggaaataggatgatggatccaatagttctctggtatgggaaagggcagctaacaggtttcttgatctgctccctcttcctcctcttcctcgccaccctcacctccccggagggaacccccatcctccccttctaccgctccatcaccgccgcctcctactccgtcttcgtcgaatccaagctccgccccctccccgtcgtctcctccctcccccctccgccgagcctcgcctacctcgtctccggctcaaagggtgacgacgccgccgtcacccgcgtcctcttggccctctaccaccccaataaccgctacgtggtccacctggacctcgaatcctcgccggaggaacgctccgatctggtgaggttcgtggagggccacgcgctgttcaagcggttcgggaatgtgagggttataaagaaggcgaatctcgtcacgtacaggggacccaccatggtcgcaaacacgcttcacgccgtcgcgattctgttgagggagcttggggattgggactggttcatcaatcttagcgcctccgattacccacttgtcacacaagatggtacgagtcatcagcgtgcgaggccgatcatcgttgatccgggtttgtatatgaataagaagcaagatgtgttttggattacgcagaggaggagtaggccaacgactttcaagcttttcacag

SEQ ID NO: 107309 - DNA, 273 bp, Glycine max
  Peptide Sequence Number=SeqID_224087
atgtgtgaaacaactacccatacaatgtgtgtaattccaacacttggaacaagtacccatgcaattcacccttatacaactaaggaagtagctgagttattcattaaagaagtggtgagactgcatggttttcctgcatcaatagtatctgacagagacagacttttcatgagtctcttttggaaggaattgttcaagagaccaggaacccaattgaagatgagcactgcctattgtcctcaaatagatgggcagactgaagtagtgaactga

SEQ ID NO: 107310 - DNA, 378 bp, Glycine max
  Peptide Sequence Number=SeqID_224088
atggtgatcagacgtgcagtggtgacaggtgcgagttctgggatcggcgcggcgacggtgcgtgcgctccgggcccgggggtgggatgtcgtgggggtcgcccgacgcgaagaccggctctccgccctcgtcgcggagaccggcgcctcggccatcgcctgtgacctaacggaccagtcggccgtcgacgcactcgtgtccgaactcgcggcgtccggcccggtccatgcgctcgtgcaagtcgccggaagaacacgcggaacggaccgcgtcgaagacgcctcggtcgaggactggttgttgatgttcgacgcgaacgtgctggcggcgcagcgactcgtggagaagttgcttccgctcctgatgcagggcctctga

SEQ ID NO: 107311 - DNA, 895 bp, Glycine max
  misc_feature (58)..(58): n is a, c, g, or t
  Peptide Sequence Number=SeqID_224089
cgtacgaggtggtctggtagatcggcgtggcgcgtgccttggtgaccgggtcggggcnagcgccggagtggatctgcttggtctcgaagcgccaggactcgggtgcggacatgtgttcccccaggagccccggaatcccgtggctctcggccgccgggggcggcgtcgcgacgtctctgtcgcgtccgatcgcggggtatcaggccgctgccgggttctgtactgtgtggggcagggcgtgcacggagagtcgcgcacggagacgggaggctcacagatggcggagaatccggggatcggcacagcggacgccgcgggcgagagcggcggatcgcgggcggggctgcagcgacggacggtcctcgccggtgccgcatggtcgctgcccatcgtggcagccgccgtcgccacgccggccgctgcggcatccaccggtgcgctcggccgcttcgtgatcgagacgatgcagggcggcacgtgggtgaaccccgactactacggtgcgtccctccagctccgcaacgacgacactcaggcgaccaccctcccggtcgccgacatcaccagcggaaccgtcacggtcacgttcccgttggcggatgccgggccgctcgaacccgtgatcattgcgaacgcgggcgggacgagtccgtcggtgcccgcgcttcccaacacggatcccacctggacgccggccggggtcgccgacaacggcgacggcacggtgacctacacgctcgcgtacgcagggagcctggcaggtcagggtgtgacgcacgtcacgttcggcatccgcggcccgagccccctgcactccggggtctcggtcacggtcacgtccaccgggagtcccaccgacggcaccgtgcacaccaggacggccactctcttctga

SEQ ID NO: 107312 - DNA, 483 bp, Glycine max
  Peptide Sequence Number=SeqID_224090
atgaatttgagtgtgacaaatttcgacgaggatatgaatcatgctcaatcgccaacaaagcctcgtgatagaggtgatggtggtagtcaagtgaaagtgtcctttcgtgatgaaacgatgtgggaacaagtgtttaagaaaagagagattagggatcttatagcccaaaagaagttttgtgttgagtacgaacatggtgataggttgaaacctaaatgttttgaggatgatttcattcttaaggagctcttggatccttggaaggaagcggttaacgtgaagtttttgggggaagactatcaatttttcactgaagggaagaatgcaggctggtttggcttttacatggtcaagattgatatctcaccaaatagagagaaggagatcaatgatggcccttggatgatatttgatcattatctagtaatcatttcatgggttccagactttattgcctctgaagttcagatagaaagcacctag

SEQ ID NO: 107313 - DNA, 1074 bp, Glycine max
  Peptide Sequence Number=SeqID_224091
atgagaacttcatgggcggattctgctgacaactcaaccattggttctggcaatagcaattcctcggcttgccctccccggggagcttatgtgccgccgcatcttcggaaccgggtattctcgtccgaggttcctccggcagcgtcacacccagtggctccggggaatgaccgggtgaatcatggtggtccagctcctcatcagggtagtggttactttaaagccgatcatgggcggcagccgcagcaaggatttggatatggttctggttttcagagtggtggtggtggtggctggaatggtagaggggcgggaagggaccgtgggaggcgcgaggcgaacccttttgagaatgttgaggctgaggatcaatcttttagtgagctagagaacacagggattaactttgatgcatatgatgatatccctgtggagacaagcggggagaatgtgccaccgcctgtgaatacattcgcggaaatagatttgggtgaggcgttgaatcagaatatacagaggtgcaagtatgtgaaaccaaccccggttcaaaggtatgccattccaatttctcttgcggggcgagacttgatggcctgtgctcagactgggtcaggaaagacagctgcattttgcttccctattataagtggaatcatgagggagcaatatgctcaaaggccacgtgtggctcgaactgcttatccgctggcacttatcctctcccctacaagggagctttcatgtcagatacatgatgaggccaaaaagttttcttatcaaactggtgtcaaagttgtggttgcttatggaggagcaccaatcaaccaacagttacgggagcttgagagaggcgttgatattctggtggcaactccaggacgattggtggatttgcttgagagggctagggtgtcattgcagatgataagatacttggctcttgatgaggcagatcggatgctagatatgggttttgagcctcaaataagaaagatagttgaacaaatggacatgcctcctccaggcatgagacagacgctgttgtttagtgccacatttcccaaagagatacag

SEQ ID NO: 107314 - DNA, 450 bp, Glycine max
  Peptide Sequence Number=SeqID_224092
atgggcgccaattcgttgccatcggcggaatcaaacttcgatctcgacgagcagatctcgcagctcatgcaatgcaagccactttccgagcaccaggttagagttttatgtgagaaggctaaggagattttgatggaagaaagtaatgtccagcctgtgaaaagccctgtgacaatttgtggtgatattcatgggcagtttcatgaccttgctgaactatttcgaattggagggaagtgtccagatactaattacttgtttatgggtgattatgtggaccggggttattattcagttgaaactgtaacagtactaattagttattctctccagcttcttgtgtcactgaaagtgcgatatcctcagcgaattactattcttagaggaaaccatgaaagccgtcagatcactcaagtatacggattttacgatgaatgcctcagaaagtga

SEQ ID NO: 107315 - DNA, 720 bp, Glycine max
  Peptide Sequence Number=SeqID_224093
atggctaattttaaaagagctacaaaaggtatttttctgcttaaagatggggaccgccttttatccactcaggatgacatacatgatctggccaagactgttattcctgttattatgctaaccaacattcccacaaaagaagaagtggaggtagttgtctttgtgatggatggagacagtgctccaagacccgatggctttgggggaagcttttatcaagctttctgtgatattattggttttgatgttgatggctcagtttttgcagtttttcttgtagggttggtttctgctaggtgttgcatcttttcgggttccatccagtcttctaccattggatctatcatcttaaagtctgcaaggatgaacaacattagggagtgtttgggttttggtgctagtaacctccccttcaactatttaggagtgcccatctttttaggcaagccttcatcaaggtaccttatgcctctaacagataagatcaaggtttattcttggcatgtttctttgttgaagatggtggagggatggaggagaaattttttgtggtctagtgatataaatgtgaggaaactgggaggtcttggcctgaaatctctacgtgctcttaataaggcttttttgttgaagctagcgtgggagttgactaactcagacttggaatgggcatgcttgttgcgagcaagagtgataactacaaaatataagctaatttga

SEQ ID NO: 107316 - DNA, 252 bp, Glycine max
  Peptide Sequence Number=SeqID_224094
ggtgcaggattgtgtgcatctagcatgttaggccgcaacgtctctttgatcttgtcgctacatactgtacttcctaccactccattttcccggtcatgggagtcaggtgtcgttgtaacttctagggatgaaagttggcctcctcaaagaaatctcggttatgggacttggggcgagttgttcctcctctcaaagtcagtattaccaagacagtcgacttggacaatatacattgatggtggtttgagctag

SEQ ID NO: 107317 - DNA, 1521 bp, Glycine max
  Peptide Sequence Number=SeqID_224095
atgaactcgataagcgagcaagctgctctaagcgagttcatcagtactcattctaagcgagctttgcttgctaagctcccaacacttaatggaaaatttgaagaattggtgccgctaagcgtagcctttaaggagcttagcgcatatccttacgacggatgccagctaagcggaccatgtctcgctaagcggccaatggcctctaggaaacataagagtagtgattctaggccacaggatcaaaatgataacaggagatttcaatcagaggaagcttggaaccgatatatcgataatattttagatcgaaggatcctttcggaaagaaatgtggaactttatcattctgagttcgatgagtttaaagcagaattggagaggcgaaaccttcacaaacatctcgccaactttcaggaagggagcatagatgtggcagtggttaaagaattatatgccaatttctatagtgcagcagatcaagctcccaaatgtgctagaataagaggccatttaatcaagatagatgcagacaacctaaatgagttcctccagactccagtgttattagaggagggggaatctttacccacttattctagattttgcagattaaggtctgatcccagagagatggaggctagtttatgcattccgggaaagggctttattctaagcatagagggccaaccatggaagctcctcagaaaagatcttaccaccctggctcagacatggagcatcttctcttactcaaacctagctcctacctcccgcacttcagatttgaacacagacagagctaggttggtctatggcttaatcacaaggatggacatgaacattggcagtttgatctctggacaaatgaccatgatggctcagtctaactcttctcgcttaggcttcccagctttaatcacagccttgtgtagattgaggggagttggatctgatgctcttacctcctacgaaaacctaagaccggtcattgacttagcctatatcataaggaactgttggaatgcgaatgaaccaaaagttaattttctagaggcaaagaagaccaagctcagagcagctgatgttccttattcctttgcaccaatagctggcatccctgcatcttctacttcaaccccacttccagctttagcagacttatctgcccagagctcccagacttcagatgccaaattgcaaagcttgtttaaagggcagattctcattatgcaaagcttgcaggaactggctcagcaaaggccaattatgagtgtagagcaattcattgagaaggcacctcaacagcatgagctagagccagaaaatgatcactcatctgaagccatcatccctggagctgttgatttttcaaaaagaagattagagacgagatccaatgaggctgctcatcctggaccagtgctagtatcagctgatgtaccatttccaggggtggattcatcttcacctcaacacgcagcagactcttccactcctgtcttagagatacctaagggctag

SEQ ID NO: 107318 - DNA, 330 bp, Glycine max
  Peptide Sequence Number=SeqID_224096
atgattgcaatgactcttctgaaaaagtgggctcttgcctcggattttctttcaaattatgtgtttctggctgttggaagggtcggttctagtactgatctaattgctcaaagagtagaatacgtgctcgagtcagacaagagaagccacctcatggaccttcttcacgctcagagggaaactggagttaatggcaagcaaggtttgacattagtttttgtggaaacgaagaaaggagctgatgcattggaacactgcttgtgtgttaatgggtttcctgcagctagcattcatggtgacagaacacaacaatggctaggggctgtttag

SEQ ID NO: 107319 - DNA, 483 bp, Glycine max
  Peptide Sequence Number=SeqID_224097
atgggattagcaacggccttcttcaacgaaggtaatttgaacttggctaaatcattggctgatttgatgcaagaggcaaatcaagaagtacctgcctggctcagccgatatgcagcaagggctatttacagtggtggcaacagaaataggaagtctgggggatctcgttttggtggccgcgattttaggaaagagggttcgtttaataaagcaacggattactatggcagtggaactggtggtggatatggtggcaattatggtggagggtatggtcaagactttaatggtgaaaaagctgtatcttctcaaccacggctttgcctgaatccatgcattccttacgacaggaaatcttttatcgtagtaaagatttaccatttcctggttctgctgaagagggagagagaagagggtgtaaacagattggttggggaccaatggtcagatattactgagtttaaatgggtccttagcatttga

SEQ ID NO: 107320 - DNA, 171 bp, Glycine max
  Peptide Sequence Number=SeqID_224098
atggagagagaaaaaggaatcacacgaagacaatacatatggaggcttcaatcctttctccgtctctctcacgtttgtgaactctatcggagtagtcgaaggaaaaactggaggaatcttagagaaccgctagagatgccactatcgctgtcggaagacacggatccttag

SEQ ID NO: 107321 - DNA, 195 bp, Glycine max
  Peptide Sequence Number=SeqID_224099
atgtgggcaaagcatagcaagtcttttgggaaacttccatatgacctgctattatctttagtaaagcatcctcatttgactgttgacagtgagttgcatctttctgatgcacttcttctctggcttgaaagtaacactgaaaatttggagaggccaagcaaatccgaagagaactgctatgaagttttgaaacaa

SEQ ID NO: 107322 - DNA, 477 bp, Glycine max
  Peptide Sequence Number=SeqID_224100
atggatgtcaatagtgatttcctaaatagttacattgaagaggaagtttattttttccaacctcctggttttgaggatcataaaaatccaaatcatgtatacaagcttaataaagctctttatggacttaaacgaacaccaaggaaatgtgaagcatatggaccatggaacatttctccatcaaacaaaatactacaaggaacttctcaagaagttcaaaatgtggatgacatcatttttgttttcactaacaaatctctttgtggagagtttgtgtacaagatgcaggaggagtttgaaatgtcaatgacgtgggagttaaactactttcttggtctccaagtgaagcatatgaaccatgtaacatttctccatcaaacaaaatactgtaaggaacttctcaagaagtttgaaaaggacaaaagcaaggaggctgcaactcctatggctactaattactaccttagtgggggatga

SEQ ID NO: 107323 - DNA, 252 bp, Glycine max
  Peptide Sequence Number=SeqID_224101
atgaaagcttgcagaaatagaagtagtggggatttcgcctccacctctaggacctcacaatcactcacaaactcatctcaagctcataggacgacttcctcttccagctctgcgaacatgcacagctcatccttcttccagattcttcctcgggctcagccgaggagtgttgcgctcagcggatggctcgctaagcccgaagatcggcttagcgagagggtgaaaatcagcacttcaaaactacttgcctaa

SEQ ID NO: 107324 - DNA, 121 bp, Glycine max
  Peptide Sequence Number=SeqID_224102
atgaaagttggtggtgaaattgagaggaaaacgcaagggagtatggtatgtggcggggacctgaaggatatcggggtaggggtgtgggaccaagcgtgggtcccagcagggtttataacaa

SEQ ID NO: 107325 - DNA, 465 bp, Glycine max
  Peptide Sequence Number=SeqID_224103
atggtggggttcagaaacagatacatggtgatggaggtttttctgaaccctaatagagacaaagttggggatgcgtctgttataattacacagtttaatgtgtcaaaagctgtaagagacagcatattggtgaattttggggagtgtggtttggcttcatcattgggatcgttccaggttaagtacgtgaatccaatcactaatgtgtgtataattagggcatcaagggaggagtatcagaaagtatgggctgccattacaatggtcacaaatattggaaactgcccggtcatgtttaacttgctggatttatctggaagtataagggcttgtaaaaatgctgccttgaagtgtgaggagtcaaaatttgagcagtacaaactcatgcttggtgatcgattctctgccgatcatactcatcgcatgaatacctatctcgaccggatcaaagttttggagcactga

SEQ ID NO: 107326 - DNA, 438 bp, Glycine max
  Peptide Sequence Number=SeqID_224104
atggcaaaacctatatctaaaaagggttcgcgtaaaaatgtacgtattggttcgcgtaagcatactcgtaaaataccaaagggagttattcatgttcaagctagtttcaacaatactattgtaactgttacagatgtacgaggtcgggtgatttcttggtcctccgccggtacttgcggattcaaaggtacacgaagggggacaccttttgccgctcaaactgcagcaggaaatgctattcgaacagtatcggatcaaggcatgcaacgagcagaagtcatgataaaaggtcctggtctcggaagagatgcggcattaagagctattcgtagaagtggtatactattaaattttatacgagatgtaactcctatgccacataatggatgtagatctcctaaaaaaaggacgtgtgtaaaaactaaaaagaaacattga

SEQ ID NO: 107327 - DNA, 1071 bp, Glycine max
  Peptide Sequence Number=SeqID_224105
atgccctatttttcttttgtcatcactcaaattctcacgctgcaagcatcacccaatagcaattgtgagctttactgtaatgctgcaacacataaattaaaagtcatcaacaacacaatgattgggaaacaacataccaaggatgttatggagggtcgtagcgttggtgatcatgtacaagaagtttggataaatgatcatgcttttatgcaaatgggtctggaaaaaaatggaataagcttccaagaagaagcctttgacaaggatgttgaaaaggaaggtgtcaggtttgagaacgaaagagaagagaccacttgcaagggaatcatcaaggatgagttgtgtgtagggttgaagcaggaaccagtgaaatttgctaatgaaaatggagaccatgttgcccaaaagattgataataatgatattgctggtttggaggctaatggtggtcaagaaccttacatgggaatgaaatttgagtcacatgaatatgcttattttttctacaatcattatgctaaatgtgttggatttggcataatcaggagatgcaaatgcaatgttgcggtgttttatgcttatgcaagaagaaaatccaaaaaaaattatgcaattgatttggatggcaaaagttatgtgagacatatattttgggtggatgcaaagggtagagatgactaccaagagtttggagatgtgatttcctttgatgcaacatatattacaaaaaggtataagatgccacttgctcatttcgttgacgttaacaaccactttcaatcaaggttacttggttgtgcattaataacatatgaaacttcaaaaactttttcatggttgatgaaaacatggcctaaagctatggatggcaagcctccaaatgcaattataactaatcaagaaaaagcaatgaaagtggctattaaagaggtacatccaaatgctagacatcatttttgtctttggcatattctaagaaaggtacctaaaaaagttagtcatgtattgagaaaacatgaagatttcatgacatatctcaacacttgcatttacaagtcttggtcaacgtaa

SEQ ID NO: 107328 - DNA, 204 bp, Glycine max
  Peptide Sequence Number=SeqID_224106
atggctataccagagcctagagaggtatttaattttctgactacatatatattcttagtccttggtgcagcggtaaagttgtgccttggtgacttgttggtcatgggttcgaatccggaaacagcctctttgcatatgcaaggagagaaagctatgggagtgtatctggcatggacaagagatattgattcaagcgttgaataa

SEQ ID NO: 107329 - DNA, 189 bp, Glycine max
  Peptide Sequence Number=SeqID_224107
atgcattgttggatacgctacacgcctaggccacatgggtatccatgtgacccaagatgccctggtattggggagcagagcaatgatgctgttctgctgaagggtcactgccatatacctccattatataactttggcaccttggtcactttaacatctcagccacacaccatggcatcagttatgtaa

SEQ ID NO: 107330 - DNA, 489 bp, Glycine max
  Peptide Sequence Number=SeqID_224108
cagggaactcagtttggaaaggactattcttttgaagattatcaatgggaatcagaatggcaaccttgttatcagaatgaagcagaaggattgtctaatctggatgacctgttaatgcaattcaagggtatagtagattcaatgcaacaagcgtttaaaagagctgagactcagattggtaagttggtggatgatatgactaaagttgtggtcagaagaaaagaagagtatgcagagattgaaacacatcaagaaagtattcttcaagttaacacaatccatcatcaattgatcaacaatgaagaaaaggatgaagtctccattattccagaatattcctgcatggtaaccactggctatgatgtaggcaaagataaaggtcgattggaactcagtgtagaggatcataacatctcctttgacctctttaaaggaatgaaacacccagatatgagtgatgcctgttttgaagaagaagaggtggagtag

SEQ ID NO: 107331 - DNA, 342 bp, Glycine max
  Peptide Sequence Number=SeqID_224109
atggtcgcgagggaggaagaagatggaggggatccctgcggcagcgcagtaggcggtggaagcggagatcgattccacgatctcgagttagaatatactcacgcgccgctgctctgcttgccaccgtcgagggatacgattcgtgcatggttgaatacctcgccgttggcaagctcgacaaacctctctctctcgataagacttcgacttcacaaaattcaaagtttgagcttgaatctgatttttcgcttaacacaaaaagttcttgatgattgtttaactcaaaatttgggtctgaatctggaaaatcttgtgagagaagtggacgaaagaggtaaataa

SEQ ID NO: 107332 - DNA, 258 bp, Glycine max
  Peptide Sequence Number=SeqID_224110
atgaccaccaagctcaagcccaacagtgttgttcttgtcactcctcgtagtgaggttgtgtgcgacgccatgctactggatcttgaaggggtgggttgcgtgaatctcgacaagggaagtagtggaactgcacgatctggtaagttctatggttgggatgcgacagtgcttggaggagtgcaacactgcttgacaggattagggttatgtagggaatttggacttgtggacaaaagagacatttcatccttttggtag

SEQ ID NO: 107333 - DNA, 177 bp, Glycine max
  Peptide Sequence Number=SeqID_224111
atgaaaaagtacatgcattcaatgcaacaaccacaaccatcagatgcaagctcaaatgatggaaactatccatttagagacatcagagcctgtagtgacttggtaggacaaagaatattatgttgtaccaagcttggtgtagaacctgaagtaagagccagaagtaacatcaactaa

SEQ ID NO: 107334 - DNA, 1419 bp, Glycine max
  Peptide Sequence Number=SeqID_224112
atggattcggcaaacaccagcgggagcttgcaatcctcaagcggcgctgatgaagagtacgattcacgcgcagaatcatcaccactctctatgttcttaaccaaccaacctcaaccacaaccaccaccaagccaagttgctccctttattccaccaccacatcaacaactacaacaccaccaaaacacccacatgttcgaccctttatcaaactacttggatccgatcccacaaagttcagcatcactgttaaaccttgacgtgatgtggtcgaaacaagtgagatccgaaccaaaccaaacggatcttgttagcttgatacctcataaccaagcttttgtgtcaagtcaaacacgagggaacaatagtggtgcttttcctactttgcctccagagagtggttcccgaggactaatgctttcagtgtcagccgcaaacaatgatcaaattcaaacccacaccaacaacagcagcagcaacatggttcgaaacccgaagaaacggtcaagagcttctaggcgtgcacctaccactgtgctaaccacagacaccaccaatttccgagccatggttcaggaatttactggcatcccagcacaacccttcacatcctcgtctttcccgagaaccaggttggatctctttgcttccgccgcaacaccaactttgatgagatccaacgttaacgttaaccctttggaccctccaacacaacctccttatcttcttcgcccctttgcacaaaaactccaacttcgaagtcttcacccgtttcccccctccttttccaataccttcttacctccttcaacaaactcttccactaattcaacttccattaattaccaacaacaacaacaacaactatctgaacatttcggctttgtgaaacagcctctcaactttaacaacacaaccccagacaatagtactctcgaagcatatcatcagctcaagcaccatcttggcaactcttcttctgttctcgtctccagaacacaacaacaccactccttggaaattccgccgaatctcaaaaatggtgtgtttgaagaactgggactgagacacgaccatgttaacaccgacctcggatgtcttcatcagagcatggtttcgtcaacatcagttggagtgggagcattgtcaagtggaaacaacaacaacaataacttgagtaatgctactaattcttcaacggaatgggcccagagaacgggcaccattaccaacaatgattgcgatcacggaggaggaggagctctcagtggcactatcaactacagtgacactaatggcaaagtacactactcagcttcttcatcggattttcatggagagaaggggccagacttcactgtaactgcaaccagaactcaaggaatggtggagtcctggattaattgttcttctgattaa

SEQ ID NO: 107335 - DNA, 444 bp, Glycine max
  Peptide Sequence Number=SeqID_224113
atggaaagacgtgagggagacaaagtgaagagagattctgattacttgcacatagaacaacaaaatgaggtatgggagcgagacaaagagagagagagattttttctggttgtggaaagacaagctagttttcttcagaaagtgcttcctcccacacacgtctttaaggctctctctctgcaagagtactgcaactggcacacagtgcttgaatcacttttacttaatctgtgtttgcacaaaagggtgttacgtaaacaagggaataaacagaccacggatgatcatgcatttaatatacttggtgcagagagaggttgtgaatacaagttactctgtttgggacttgagagggtgagagaagtctttgctatgtctcttgcctctttctttgtcctgggttttggattaccactacagattgtgaaaaggatcaagtattag

SEQ ID NO: 107336 - DNA, 426 bp, Glycine max
  Peptide Sequence Number=SeqID_224114
atgcataaggcattacaggccaatgcacctttcccttaccctcaattggtcactctatttctccgtcattttcaaattccgcttgatgatgaaccatttgttcaagtcaagcgttcctttgctattggtgctggtgcagtgacttcttttggataccataaggatcgaaatggtcaatggctaaagaaagatgcacttcctcctcaagatgagcgtacgccttctcctcctcctcagcgagatgattcagccctcatgactgaagttctttccgagttacgaggtcttcgtacttatgttggcgaacattttgattctctggatactcgctttgccggcatggatattcgtctcacacagcttgaagaagatgtgggttatattcatcagagcttcgaccttccaccaccacctccaccttcttag

SEQ ID NO: 107337 - DNA, 615 bp, Glycine max
  Peptide Sequence Number=SeqID_224115
atgaaccagtcgaggttagtagaccttgctacgacatggtatcatgccacgaataggggcttggtgaatgtgcttttagagaggcaacaccaggaggtgtcttccttccacctgtccgttaaagaaatgaccatcacactagatgatgtgtcttgtttgtttctctttcttgtcataagcaagcccattgatcatgtcccgttattcttcaacataaaggcagtgaagatcctgttaatgagtcatctgggtattctgatagtaacaaaggcttccacagcggcaaacgcaggtgtcagggtgaggttgacgtggttagaagacctttaccgccgctatgttgagtcaggcttttatgtttgggctgcaacgacttatctcttgcacttgatcaacaatatgatatttggtgacaagtacaccactcacgtccatgtctcctacctccaatacctcgacacatggatgtttgccacaatcatgggtatttgtgcatttgtccactgttggctacttagagatggaggattatattgtggaagactcgatagccaccaaatggtagtcgttgaaaggtttcgggtgtgtccttctagccaaggtgagactggatga

SEQ ID NO: 107338 - DNA, 136 bp, Glycine max
  Peptide Sequence Number=SeqID_224116
atgggaaacaacttcccacagggaaaatgtggctgtggtggcttaatattctggcgtcctcctcccaacaacaacaataacaacagcaatgccaacaaatttgagaatttatcaaacgcctctgacacaaaaaaag

SEQ ID NO: 107339 - DNA, 129 bp, Glycine max
  Peptide Sequence Number=SeqID_224117
atggctgttacctctcgtgcatcatcattaagatggtggaatataatagcagagaggaaaaccaccgaaaaggggacgatgagaggcaagaaaatattcgcgtacgtgttgctgaaaactaaacagtga

SEQ ID NO: 107340 - DNA, 1280 bp, Glycine max
  Peptide Sequence Number=SeqID_224118
ggtccctaaagaagcaattggcatttctggtgaactggaaagcatgatcaccgatcgccaaaaggggagcagcaaccttgttcgtgcttcttctagcaacgttatgatgtttaataatttaggtaacctcaggcaaggagggaatacaaatacgtattctcagaaccctgttgccaatggaagatacacaaaccaaacggtggagaatgtaagtaaaggaaacaaggaacaaccgggttctctatgcagggtcgtgtctactagaatgaaccccgaacaattaaagataatgggcaatgaggattataagaatggaagatttcaagaagcattggctctttatgatgctgcaattgcaattgaccctaataaagcttcctataggagcaacaaaagtgcagcattaacggctcttgggaggcttctggaggctgtgtttgagtgcagagaagccattcaaattgagcctcgttatcaaagagctcattaccgattgggaaacttgaacatgagattaggagaaatggataaggctctttatcattataaacaagcaggaccagagattgacccagacgagaatgctaaagtcaaaaaaattcaggtccatttgaacaaatgcaccgaggcacgtaggctaggagattggaacaagttgattaaggagaccaataatgctatttcatctggtgcagattctgctccacagatatttgcgttgcaagccgaggcatttttgaagctccgtaggcaccaacatgcagaagaagcaatgtcaaaggggtctaattttgatgttgatcattgcaccaagttctttggacctatttgccatgcaaatacattggtgactcagtcccgggttcatttggctgctggcaggcttgatccaaataataatgagatgaagaaggtgatgaggaaggctagagctgcggctgcagctcgatcaaacggaaacgagcttttcatggcatcaaaattctctgaagcatctgttgcctatggagaagggttagagcatgatccatataactcggttttgctatgcaaccgagctgcatgtagatccaaattaggccaatttgagaaggctgtggaagattgcaatgcttctcttagcttgcgtccatcttacagcaaggctaggctgagaagagcagattgtaatgccaaggcaagcacacttattgtcaatgatcaatactcaaatcctttgaagaaaaaggataaagcacgttgtggaggaggaacactacgggcccgttgccaagggaaag

SEQ ID NO: 107341 - DNA, 594 bp, Glycine max
  Peptide Sequence Number=SeqID_224119
atgaaagaaatgaaaagagaaaaacatgccttctatagtagtcataactcttgcaagtgcctaactgaagaacttcgcgactattatgaaggaaggcatagagaaaaggaaagaaagcctcaagaggctaacattaaactctcatacttccatgggaaggacaatgtagaggctaacttagattgggaaataagggtagagcaacaacttaaaaagaagtctacttcaaaatcttatggctctcactcttatccaaagaaagaccaaggtcaaggcatcttaggggtgacaccttctaagcccaaagatgataaggggaagacaatagaaaagcaagcccctaaggctagtatgcaagagaaaactagctctataaagtgctttaaatgtcttggaagaggacacattacttctcaatgccccaccacaaaaaccatgattatgaggggccaagacatttatagtagcctagatgaggctactacttcaccttcctctagtgaaagtgaaaaagcaaaaggggaagaatctagtgaagaaatctacccccaagaagaaggacaaccattagtggttaaagagaagtgtaaggag

SEQ ID NO: 107342 - DNA, 466 bp, Glycine max
  Peptide Sequence Number=SeqID_224120
atggggtccaatcaaacaccttcgcttaaaaagaggttctatcaagtcaaggtcaagagcctagggatcaccaatctaagcgagttagggcaattgatgggtcagctccagcgacaagcgtttcgcaaagcttacggtaaaatctgggacctagccatggtagatgtctccacggaggccattgcatccctcgcccagtattatgaccagccgttgagaaaaccatacctcttctcaaggttctatccctcattagctagaatttctaagatagtccaaatctcagtgcaggaattagaccacaaaaagcaagtcgaaaatggggtggttggaataccgagaaaatgtttggaggcaaaagcaagaatattggcagcgatcgacgctttcctcgcctatcatgaccgcaaggaaagtccggttgtctctatactagtcgatctatacgacaccttcgaccgaagat

SEQ ID NO: 107343 - DNA, 943 bp, Glycine max
  Peptide Sequence Number=SeqID_224121
ttggaactcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgcttccctttatgatgtgcttggtatttcagtgggtgcaagctgcatcgaaataaaggctgcttacagaaagctggcaagaacataccatcctgatgttgtggccatgaatcagaaggaaagctcagcgaaccaatttatgatgatccattcagcttactcaactttatctgacccagagaagcgagctcaatatgacagagaatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccagaagatacttaa

SEQ ID NO: 107344 - DNA, 372 bp, Glycine max
  Peptide Sequence Number=SeqID_224122
atggtaccacatttgatgagaatcctgaaactggccaaatacaggctaaaggcccaaatggagaaggacgaaggcccaagtggagaaggacaaagcccccgagtggagaaggatgaaggcccagaggcagagacactatcaagactattaattgttgctcaagaaaacttttggcatttgataaaatttggtgagagcttctctctgggttccttgttgaaccaatatcagacttatcaaggtaatccttgtggcgtctatcctgacttatcttccttcaccggaagtgacgtctaccctgacttatcttccttcaccggaagtggtgtcatccaattctccgtagcatgtatcaaacgttccgccccgtaa

SEQ ID NO: 107345 - DNA, 390 bp, Glycine max
  Peptide Sequence Number=SeqID_224123
atgtgggaatgctccctctctggtctcttacagttgcctgcctccctagcctatttgatagcaaaaggaatgattgcacgtcgcacatgcctaagcaatgaggccatacacagttgtcttccacccatattgtttattagcctaaacctcttgggcatccaacaaaaggcacttggcagccctactgtgctaaggcctccaacttttgatgatgttcttccacaacacaagtgtttgtccagaacaagtcaaagggctaatgcacaaccagctcatgtgagtgctagggttatggagcatggcgggatgttaggatccaattacaaggtatgggacttgagtctcgcattcaaagtgtgggattctagtgtggggtttataaggcattag

SEQ ID NO: 107346 - DNA, 594 bp, Glycine max
  Peptide Sequence Number=SeqID_224124
atgggtgctagggctgtagagcttggtgggatgttaggatccaattgcaaggtatgggacttgagtcccacattggaagtatgggattctaatgaaaagagacaattagaggaagaagcacaggcacaactagacattcagcttgctctggagaccacttatgccaataaggccaaggatataagtactgagctttgtgagattgatatgcatttgaagagtctcaaagaaatggtgattcaacagtgcaggaaactgtctactcaagagaagaaaatgctcatgtcagctcttggtaaattgtctttggaaaacctctatagggcgttggatataattgccgagactaacccaatgttccaaccttcttctactgaagatgtggtccttgacttagatgctcagagtgactacactctatggaggttaaaggcttttgtaaaagattcactagaagagcaagtaaaggtcaatgcaggcgcaggtattaatcctaatgataaccctgatgacaagaaaaacaagaagaggcgagattctggtgattcttcgggcaagacaaacccaaaaaggaagaaactatctacattgtga

SEQ ID NO: 107347 - DNA, 261 bp, Glycine max
  Peptide Sequence Number=SeqID_224125
atgagttacacttatgagaaattaattgatgagtacttgcgcaaaatcaaaggatatgttgatgaacttgctggcatcgaagttcttgttcgtcacgaggagtatgttgatacgcttctcaaaggactatcgttagattacgtgccagtaatctctataatcaagattaagaagcacactccattcatcactgagatagatgctttactctatggtcatgaaacttgtcttacgcgttacaatagagatgctcacaggtga

SEQ ID NO: 107348 - DNA, 144 bp, Glycine max
  Peptide Sequence Number=SeqID_224126
atgccaattcaacgactcaaaaaccttcctcaggctcgtgcattcaaaatagagaacgcagatccggatccggatcccggggcgctccgaaacgggctgggcccggtccaaactgtagcggcagtggttcctaacggcccatag

SEQ ID NO: 107349 - DNA, 438 bp, Glycine max
  Peptide Sequence Number=SeqID_224127
atgtttggatcaagaaatttaataaggatattcattctctcactattctctctcttgcaacagtgcaacagcttctcccgatacgtgtcgtttttgcttccccgttgttgcggattcgaatatctttcatttccaactcaatcgatttgtcgatacgacttgccatttagcacgttcattgatttgattttgattttgattatatgcgagagtgttgcggaattttcaagaagtttgaatgttcgttcatgcatctggaagcacgccaccacgttaaggtttgtccgtggagagaacgccgatggcaccagcgacgcgaacgggctcgcggggcagacggttgggcgaaggggaggcggagtagggctgagcgggcgacggcgcgccgtagctgtagctgggaggctggtggagatagtcagacatgatgaaatttga

SEQ ID NO: 107350 - DNA, 1461 bp, Glycine max
  Peptide Sequence Number=SeqID_224128
atgaagatgaaagcggagacattgacgttagttctggtgaatctggcaggtattatggagagagcagacgagtctctgcttccaggagtgtacaaagagattggtgctgctctgaacgcagatcccactgcgctaggttcactcactttcttcagatcaattgttcaatctttatgttacccactcgctgcatacctcgccactcgtcacaatcgtgcgcatgtcatagctctcggtgcttttctttgggccgctgccacattctttgttgccatctcctccaccttcttacaggtagcaatttcgagaggtttaaatgggattggactagcccttgttactccagcaattcagtcccttgttgcagattccacagttgatagcaatcgtggtatggcttttgggtggctgcaactaacaggaaattttggaagcatcattggtgggctctttgccgtgcttattgccccaacctcatttaagggtatacctgggtggagaatagcttttcatctggttgcattgattagtgttatagtgggtatattggtttgcctcttcgctaatgatccacgcttttcaaaggccagagagagagcaacaacatatgaagctccaaacaagtccttttgttctgatatgaaagacctaatgaaagaagcgaagtcagtaattggaaatccatcatttcagataattgtggctcagggagtgtttggaacatttccagggtcaagcttgtcatttgccactctttggttagaactaataggcttcccccgcgtgacaactgcattcctttggacactatacgtggttgctacttcatttgggggtctatttggaggaaggatgggggatattttatcccaacggtttccaaactctgggagaatattgttgtcacaaataagctccagttcagcaattcctcttgctgcaattttgttgttgggattgccttatgatccatccacggccttcaagcacggtctgcttttatttatcatggggttaataagatcctggaatgctccagccactaacaatccaatatttgcagaaatagtccctgagaagtcccgaacaactatatatgctttggatcgatcttttgagaccatattgtcatcctttgcaccacctattgttggagctttggctcagcatgtttatggttacaaaccaatcacaaaaggatcctcagatgagatagaaaaagatagagaaaacgctgcatcactcgccaaggcactttacactgcaattagtattccttcggtactctgcgtttccatctactcgtttctttattgcacgtacccgagggacagggagcgagcgagaatggaagcattagtggaatcagaaatgcaacagctacaggtggaagactataatgatgttgattatccaagggaagaggatgataatgatgagaaagttttgttgtctcggtag

SEQ ID NO: 107351 - DNA, 354 bp, Glycine max
  Peptide Sequence Number=SeqID_224129
ccgaacgagaagttggcgattcagtaccaggaaggggacgtgtcgctgttgttgttcgatgagagtaaggttgccgaggggaagtttccaacgttggagcaagggggaggtgaggcgagtgaggttaagcttgagctgaccggatccagtggagcgtttcccaggggaatgcatggtggggacgcagccgtggatttgaaattggagatcaaacttgcgataaggattaggaccgcgggtctcgaaacgtggggtatgagctccaatgtggcgtgtcagtttaaggatcatgggatgggattgggatatgtgtcttattgttgtagcatggcaaacactgcacttaaaccatga

SEQ ID NO: 107352 - DNA, 747 bp, Glycine max
  Peptide Sequence Number=SeqID_224130
atgaagaaagaaaacagtgttacgctgaaagctggggagctccctggtcgattgactcgtgctcgagctgctgctgctcttcgtgcatctggacagctaccccctttgaaagagagagcacagcaaaatcagaatctgttatccaaagtcaattcaaaaggagcagtttctgataatacatgtcttcagcgtaaaaggaaggctgttcttcaggaagttactaatgtttgccgtgaaaatgcatacaagggttgtttcaactcaactaaaattcaggctaagaaaagcaagctggctaaggctggtcaaattaatgtgtccaaagtggctccttctgttactgttgactccaaagcaaaggaaacagcattgcaatcggaagatactatgtgctcaattaatttggaaaacaatgaatttctacgactgagtgctaatgattgtagattgcctgaaagtcagatgtctggaatatctgctcatcctttgatttctcagaagaaagacaagaaagataaccttccaaaacttttgactgcattgaaggatccagacatcactaatatagatgatgatgatcttgaagatcctcaatcttgcagcctctatgctgctgatatctacgacaccatgcgtgttgctgaggtttgtgccataagtatcgtgccatacggtcatattttctcggtcagctctgctagctttaaaagcatggaattagctaactttttttgccatcccctatag

SEQ ID NO: 107353 - DNA, 591 bp, Glycine max
  Peptide Sequence Number=SeqID_224131
atgagtttccaagaatttgggcagtctgatggatgggctagcttggcatgtctccaatggcatttcaacctatttctagaccaacaattgggttcccacttcatgggtggttgggataatcaaaagcttcatgtttcccttctcaatgatgtttggataaccatttctaccttagtgccacctgtgatatccaatacctctgatatgtctgcttggaagcataaaccggatggaactttttctgtttcctctaccaacatttctatttcaagtcctcctatggcaaatgatccttcattcaatctcatttgtcgaaatgagttcatcttctctgctaaacctagttctatcactagcttatgcgttctcaaccccaatctcttcatcttctgggaagcgccactgacatgtttgtataaacttaactgtgatgttgtcgttgctctagtggcaaagctcatgtatggtagggtgttgaaggaccactttggaaccattgtttttgccttttctagcaagattggaacttgctctatcaatattgctgagttgtgggctatagccattaggatcaagattgcttccttaagg

SEQ ID NO: 107354 - DNA, 1548 bp, Glycine max
  Peptide Sequence Number=SeqID_224132
atgaaatcggagacactgaacctggtgctggtgaatctggcgagtattatgcagagagcggatgagtctctgcttccaggagtgtacaaagaggttggtgaggatctgaaggctgaccccactgcgttgggttcgttgactctcttcagatcacttgttcagtctctctgttaccctctcgcggcttacctcgccacccgtcacaatcgtgcgcatgtcatagctctcggtgcttttctttgggctgctgctacattcctcgttgccatctcctccaccttcttacaggtggcaatttcaagaggtttaaatgggataggacttgccattgttattccagcaattcagtcccttgttgctgactcaaccgttgatagcaaccgtggtatggcttttgggtggctgcaactaacaggaaacttaggaagcatcattggtggtctcttctctgtacttatagcctcaaccacagtcgcaggtatacctggttggagaattgcctttcatctagttgcattgatcagtgttatagtgggtatattggtgcgcctcttcgctaacgatccacactattcaaagagcgatgacacagcaacaaatcaagctcaaaataagtccttttattctgaaatgaaagatctaatgaaagaagcaaagtcagttattagaattccaacttttcagataattgtggctcagggagtgtttggatcatttccctggtcaggcttgtcatttgccactctttggttagaactaataggcttctctcatgtcacaacagcgaccctttggaccctattcatagttgctgcttcatttgggtctctgtttggagggtggatgggagattttttatccctacggttacccaacgctggtagaataatattgtcacaaataagcgctggttcagtcattcctttagcagcaattttgctgttgggattgcctgatgattcatccactgccttcatgcatggtcttgttttagtcatcatgggattcacctcagcctggaatgctccagcaactaacaatgtggacagtccaatatttgcagaaatagtccctgagaagtcccgaaccgctatatatgctttggattgttcttttgagtccatcttggcatcctttgctcctcctattgttggattattggctcagcatgtttatggttatagaccaatcccaagcggatcctcggattctgtggagattgaaacagatagggaaaatgctgcatctctcgccaaggcactttatactgcaattataatacctatgacaatctgcgtctccgtgtattcattgctttattgcacatacccaagggacagggaacgagcaagaatgatatcattagccgaatcagaaatgcagcagctagaagtggaagatggcacaaaagaagagtattgcgaaattcatgaatatttagagtcaaatgtggtgaatgataaggaaagtagcaagtttgatattgattatccaagggaagagagcgtcgacgtggatgatgatgataagaaagttttgttgtcctag

SEQ ID NO: 107355 - DNA, 324 bp, Glycine max
  Peptide Sequence Number=SeqID_224133
cttgcaagaaggcctcatccgaactttatggagacagtgcagcgagatattactcaaagcatgcgtggaatactggttgactggcttgtagaggtttctgaggaatacaaattggttacagacactctttacctcactgtgtatctcatagattggtttctgtccaaaaattacattgaaagacaaagacttcagctacttggcatcacctgcatgctaattgcctcgaagtacgaagaaattaatgccccacgtattgaagatttctgcttcatcacagacaatacatacacgaaagctgagtttcacacattgaaactttaa

SEQ ID NO: 107356 - DNA, 3267 bp, Glycine max
  Peptide Sequence Number=SeqID_224134
atggtgtattacaaaatatcacatgttgatggtcgtataactaatccggaacaaagaattgccagtgatgtgccaaggttctgttcagagttgagtgagattgtacaggatgatctaactgcggtcactgatggactgctatacacttggcggctgtgttcgtatgcaagccctaaatatatcttctggatattggcctatgtactcggagctggggctgctatccgaaacttctctcctgcatttggtaaacttatgtccagagagcaggaattggaaggagggtatcgacagcttcactcacggttaaggactcactcggaaagtatagcattttatggtggagagaagagagaagaagctcatattcagcagaagtttaggaccttagttagacatattaatagagtgctacatgaccattggtggtttggcatgattcaggattttttattgaagtaccttggtgctactgttgctgttattttgatcattgaacctttcttttctggccatctaaggcctgacagttcaactttagggcgtgcagagatgctaagcaatctaagatatcatactagtgtcattatttccctatttcaatctctaggaactctttctatcagtgcaagacggctcaaccgactcagtggttatgctgatcgcattcatgagttaatggccatatcaagagagctaagcctggagaatgggaaatcttcactgcaaagacaaggaagtagaaattgcataagtgaagctaactatgttggattttatggtgtcaaggctagtccaaatggcagtggaaagagctcgttattccgggttttaggaggtctttggcccttggtatctggacatattgtgaaacctggagttggatctgatcttaataaggaaatcttttatgtgccacaaagaccatatactgctgtaggaacacttcgtgatcagttaatttaccctcttactgttgatcaagaggttgagccacttacagatagcaggatggttgatcttgagtatctattggatcggtacccgcctgaaaaagaggtaaactggggtgatgaactttcattgggtgagcaacaacgattgggcatggccagacttttttaccataagcctaaatttgccattcttgatgagtgcacaagtgctgtcacaactgatatggaagaacggttttgtgctaatgttctggctatgggaacatcatgtattaccatatcacatcgtccagcattagttgcattccatgatgtggttttgtctttagatggtgagggaggatggagtgttcatcatagaagagaggactcttctactgaattggggaatgatatgatgaaggcttcggagaccaaaagacagagtgatgccaaggctgttcaacgagcatttgctatgaacaaaaaggattctgcattcttaaattcaaaggcacaatctgatatttcagaagtgataatagcatcatctccgtctatgaagcgtaatatttcaccatctgctgtaccccaacttcatggtaatacaagggcattgccaatgagagtagctgccatgtgcaaagtattggtgcccaccatatttgataaacaaggagcacgattacttgctgttgtttttcttgttgtttcaaggacatgggtctcagatcgtattgcatcactgaatggtactactgtgaagcttgttttggagcaggataaagcttcctttattcgattaattggtttaagtgttcttcaaagtgctgcgtcttctttcattgcaccttctataagacacttgactgcaaggctagcccttggggggcggactcatttgacgcaacatctactcaagaactacttaagaaacaatgcattctacaaggtattccacatggcaagcaaaaacattgacgctgatcagaggataactcatgacttggagaagttaacaacagacttgtcaggactggtcactggaatggtaaagccatctgtggatattttgtggttcacttggagaatgaagatgttaacaggtcggaggggagttgccatactctatgcttacatgttgcttggtttgggatttctaagaactgttactccagattttggtaatttgattagtcaagaacaacaacttgaaggaacatttaggttcatgcatgaaagactttgtactcatgctgaatctgttgctttctttgggggtggtgctcgagaaaaagctatggtcgagtctagattcagggagcttctcacccactccgagtaccttttaaaaaagaagtggctgtttggcatcctggatgattttatcacaaagcaacttccacataatgtgacttggggcttgagcttaatatatgccatggaacacaagggagaccgtgcatcagtaactactcagggtgagctagcacatgcactgaggtttttggcatctgttgtttctcaaagctttttagctttcggtgatattcttgaattgaataaaaagtttgtagagctctctggtggaattaatcgtatttttgagcttgaagaacttctagatgcagcacaatctgagaatttcacgagtgttagtgctatacctccaatgagggatgttcattccagtgatgtaatttccttctcaaaagttgatatcataacccctgctcaaaagatgttggtgagggagttaatatgtgacattaagcgtgggggaagcctacttgttactggtccaaatggaagtggaaaaagttccattttcagagttcttagaggactctggccaattgccagtggaagactctctagaccatctgaagttgtggatgaagaggatggatctggttgtggcatcttctatgttcctcaacggccatatacatgtttgggaaccctaagggatcaaattatatatcccctttcccgtgaggaagcagaggttaaagcactgaagatgtatgggaaaggtgaaaagcatgctgacaccagaaatttgttggacacacggttaaaagttatcctagagagtgttcggttgaattatcttctagaaagggagggtagcaactgggatgccaatttaaaatgggaagacattctttctcttggagaacagcaaagattggggatggcacgcttgttctttcacgagcccaaattcggtatccttgacgagtgcaccaatgcaactagtgttgatgttgaagaacacctatacgggcttgcaaaagatatgggaatcacggttgttacttcctcacaa

SEQ ID NO: 107357 - DNA, 1893 bp, Glycine max
  Peptide Sequence Number=SeqID_224135
atggataaagtttcatcagactgtccgtacccgggatgcttcttttgtgtcatgaaggaagggaatccaagcaagcgcagagcaagtgtactgaaattctttagagaactaccgtgtcaagatgaagatggtcaggttctccctatcagtggcctttggaacacggctatggcacatccaaatgaccctgaattcatcgagctaggaatatttgaatgcatgtctgctctcatatggaagggactgaagaaccggcgttggctttctcatgaccaaaatatatatattccttattatgctgctcatatcatcggttcctacacaatgaatatggaagaatttgcagaaagtgccgtgcatgctggggtcattcctcctttggttgagcttttacgaggtagattaacttgggttgagcagagggtggcagttagagcattgggacacttagctacatatgccagcacttttcctgccatagcaagtcatggtgaaattcttgagctctccatccaattggcaatgagttccctggaaatagtttattcacacttttaccaatatgttgatagaaggctcagttatcattgtgatcttcttacacgtggcatgggtggcgttgaaatggagtccaggaaggctgaggaatgggctagtcagttgcagtgttggtcccttcagctaattaattgttttgcttttaaacatgaatttcttcctaccatatgcaaacccgaatttctgataaaactacctggtatgtggggtggacttgttaatgaaaattcaccagccggtattggtttattaagaacaatttgtcatcaaaagcttggtaggggacctgttgccagttgccctggtattattgatgcattgtgtaatattgctcggtcttcggatgattggcagtatatggctattgattgccttctatggctgcttcaagatcccaatacatgtcacaaggtgattgataaagtggtgcctgtattagttgaccttgctgagattacaactctgggtgatcataaaaagcttggtgattcaatccttaatgtttttcaagagtgcatccagtctcaagggtcaggacgaagctcaattagtagtcacactaaagaacagattgaggatatattagattcaaagcagagattaaaatgggaaaagaatatgcccaaggaagatctgcatattaagcaggctgcagcgctggttgtcaagcttgaaggaaattccctgttctcatctggaaatattgctggagctgcatcaaaatactctgaagcattggcattgtgtcctatgagatccaggaaggagagagttgttctatatagtaatcgtgctcaatgccatcttttgctgcaacaacctttggctgccataagtgatgctacccgtgcactatgtctccatagacctgtcaatcgtcatgccaaaagcctctggagacgagcacaagcttatgacatgcttggattagcgaaagagagtttattggatgctattttatttataaatgagtgctctcagtcaaatgatcctgatctctcactgaggcaaaataaagttccagattatgctgagcgtttggttaagaagcagatgcgttctgcttggttatttcgagaggcagctattaagcatggtggggtccatagtcagggtgatggtggtgatatgtatggcccagagactgatgattcggaatgggagacagctagtgaaagtgatataggaaatgatggacgggatgacatgggtgatgacgacgatggtgattggaataatgatgatcagaggaaagattatgacaaaccttcaatgaaagaattggctaatataccaaagagtttgcattttaaagtaaaaggcaaaaaagaatag

SEQ ID NO: 107358 - DNA, 357 bp, Glycine max
  Peptide Sequence Number=SeqID_224136
gaccaaagccttgaattggagtacctggccaattacctagctgaactaacactgatggactatggtttcttgaatttccttccctctatcattgctgcatcagctgtatttcttgcaaggtggacactagatcagtcaaaccacccatggaatccaactcttcaacactatgcctgttacaaagcttcagatttgaaaaccacagttcttgcattacaagacctacagctgaatactgatggctgtcctctaactgccgtccgcacgaaatacagacaagacaagcggctttgtcttcaccaaaactgcttgaaactttgttctgaagacaaagatgatttgacaagccaatgctag

SEQ ID NO: 107359 - DNA, 585 bp, Glycine max
  Peptide Sequence Number=SeqID_224137
atgaatggaatcagtcagatatcattcagcactgaaggaaacatttctccaaaaaaaccaacctccctacctgagatagcaaagcagcgtgaacttagtggaacatatcgaagcgaatcagtcatgaagatcaacaagcaaacatcaagtgccaagaccaaggagctcagcggaagtgatatatttgcccctcctcctgaaattgtgcctcgctcactggctgctgcacacactttggaatcaaaagaaagtgaagacacaagaaaacctgttccacaaaaagtgagcacatctgcacaagtttctaatcgtgctggtggccaaagtaatttctcattcagtgaagaaccagttaagaagatattaagaaaaaaaatacatgaccagaagtttgcagagatgacaggcaataatattttcaagggagacgctcctgcaggatcaccggaaaaaccttcgagcagagctaaacttagagaaatggctggaaatgacatatttgcggacggaaaggcagaaaacagagataatataagaggtgcacgcagacccccaggtggaggaagcagcattgccctcgtttaa

SEQ ID NO: 107360 - DNA, 132 bp, Glycine max
  Peptide Sequence Number=SeqID_224138
atgtcccatgaaatgaaaatgtttatggagtcatgcaagaggctgaggattatgaagaaatcagatgcgaagggcttcggtttgcaaccaaaaggatctttaaagggattcatagaaagcgcggcaaagtga

SEQ ID NO: 107361 - DNA, 135 bp, Glycine max
  Peptide Sequence Number=SeqID_224139
atggagttggtatttaagaaacagtcatattcaatgctcaaatctcaaattgccttggaacaagggtttcctgagtatcgagaagaagaaaaagaaagcaacaagaagggacgggattactctgataccatgtaa

SEQ ID NO: 107362 - DNA, 144 bp, Glycine max
  Peptide Sequence Number=SeqID_224140
atgctccaacaacctggtggctggtccgactgcgactgtggacgggagggcgcgagtgcgacggcctgctactttgtgcgtcaacgatgggaggtgctgttctggtgcgagttgctggatgttggtggcgagataattgcataa

SEQ ID NO: 107363 - DNA, 348 bp, Glycine max
  Peptide Sequence Number=SeqID_224141
atgccatccactatttgccgggatcgcgcccacaagacacccagtggacctggaggagtccaacagggccctggggtttccagctttggttacggacctctgtcagtcctacagggtgcccgtcccccccaacaagggatcgtgcccgcaagacacccagtggacccggagaagtccaacagggtcctggggtttccagctctgattacgggcctctgtcagttctacggagtgcccgtcgcccccaacaaggtcatcaggccccttactaaccgagctttcatcaagaagtactgcacccccaggcaggcacagggcaagacaccacagcagcctggggacggctga

SEQ ID NO: 107364 - DNA, 402 bp, Glycine max
  Peptide Sequence Number=SeqID_224142
atgccgactccccctgcgaaagtatcagttggtctatgccgtcccgacatagggatcacgaccacaagacacccagtggacccggaggagcccaacagggccctggggtttccagctttggttatgggcctctgtcagtcctacagggcgcccgtccccacagcaagttcatgccatcgtgacatagggatcatgcccgtaagacactcagtggacccggagaagtccaatagggtcctggggtttccagctctgattacgggcctttgtcagttctacgaagtgcacgtcacccccagcaaggtcatcaggccccctaccaaccgagctttaatcaagaagtactgcgcccccaggaaggcgcagggcgagacaccacagcagcccgaagatggccgatag

SEQ ID NO: 107365 - DNA, 402 bp, Glycine max
  Peptide Sequence Number=SeqID_224143
atggattggttctcagtatcagctattttgttccaggttgttggagatcgtaaaggggcagtgtttggtggcttggttgaagctcctctaagaccatccaacaagagaaaataccagctatgcggaattaaccgccacattgcaggagtaaaccgctacttcacactttgcaccactgacttcctagcaattggtggcggaagtcattttgcactttatttggagggtgatctattgaacggatcaagttcggtttcagaaacttatgggaatccttgccttgcacattctcaagaatttgaagtgaaggaagtagagttgtggggctttgtatttccttctaagtatgaggaaatagtggaattgagcagaacagaggcacctgggatctgtcgctggtaa

SEQ ID NO: 107366 - DNA, 1641 bp, Glycine max
  Peptide Sequence Number=SeqID_224144
atgaagtcccttcaagtagggcaagcacaacaagactccgatggaagtgataaggtttcagacaaaagcattgtagttcccaacaaattcatcgcaatagctgatagcttcaaaggagaacattcatggttcattgctcctcaaatcccaacagatttttcaattcaagtccaggaaaccacttataatgttcacaagtaccccttgatatcaaagtgcggttacataggacgattggaaattcagcctttgatatcaaattctggcaatgtgctcaaccttgaaaacttcccaggtggatctgaaacatttgaaacaattctaaagttctgttatggcctccctatagacttcagcccagataacatagctgcactaagatgtgcatcagagttcctagagatgactgaagaactagaagatggaaacctcatttctaagagtgaagctttcctcacctttgttgtgctttcttcatggaaagacactatcactgttctgaaatcatctgaaaacctatctccatgggctgaaaacctccaaattgtaagaagatgctgtgattccattgcatggaaagcttctaaagatgagctcacaagcgaggatgcagcacctaatcaagaaagctggtggttcaacgatgtggccgccttccgcattgatcattttatgcggatcatttctgcaataagggcaaagggaaccaaaccagagaccattggtaaatgtatcatgcaatatgccaagagatggctgccgggaatggaggtggagttagaagggctaagaggatatgggcatgaaaagtgtaacctacagttcagtatttttagtgggaagaagaaagaaagcagtggaaacagcaaggagcaaagaacaattattgaaagcctaataagcattattcctcctcagcaagatgcagtctcgtgtaagttcatgttgcagttgttaaagatggccatgatgtattctgtatcaccagctctcacaacagaccttgaaaagagagtgagtttggtgttggaagatgctgaggtgagtgatcttctaattccaagatatcaaaatggagatcaaggcaaaacggtcatttgcatgactaattcatctgaagaatgcaccatgctagacatagatgtagtgcaacgaattgtggaatacttcttgatgcatgaacaacagcagattcaacagcaacagaagactaggaaattcaatattagtaggctcttggataattacctagctgaaattgcaagagatccaaatctttcaattaccaagttccaagtttttgctgaattgctaccagaaaatactcgatcatatgatgatggcctatatagagccattgacacctacctcaagacccagccttcactgaccgagcatgaccgtaaaagactctgcaaaatcatgaactgtgaaaaactctcacttgatgcatgcctgcatgctgcacaaaatgagagattgcccctaagaactgttgtccagtttttcaacgtaagaaggataatacaaatcctcataagcagaaaaatgaaaacaaaagagaaacactccccaatgcccaatccctccctgaagccacatgcccaaggagaggccagaaaaacaatcctaacccaatag

SEQ ID NO: 107367 - DNA, 741 bp, Glycine max
  Peptide Sequence Number=SeqID_224145
atggcatctgataatggtttgtacaggcaaaaacaatcgattgagcaaattggagccttgttcttgttaatagttgcggcagttcttttaagtgttggcgaaggctctaccaaaggttctgctattggcaatgctgatcaaattttattttatggaattattcctgtattagttgcttcagtgctctctggattggcttcatccttgtgtcaatgggcctctcaggttaagaaacactcatcatacttgatgactatagaaatgtctattgttggaagtctatgtttgcttgccagtactttgaaatctccagatggggaagctatgagacaacatgggtttttctatggttggactcctcttactttgatcccagtaattttcaatgcccttggaggaattcttgtcggtttagttacaagccatgctggtggtgttcggaagaaattattattgcaccttatcggtggagcagtagaggcagtaactgcacaaacttatggtactttgagtagcttaggagttgccggacatgatgaaaattctgactttgaaaattctttcatagggaatattagggggtttgtcattgtttctgctttactcattacagcattgctacagtttattttcgatggaaagacaccttcattgtattgccttttggctcttccactagtggtcactagcatttcaatataccagaaatacccctaccaggttaagaagaaggagtcatag

SEQ ID NO: 107368 - DNA, 474 bp, Glycine max
  Peptide Sequence Number=SeqID_224146
atgtaccttgaagatagaactgttcgcttgcagctttgggatactgcagggcaagaaagatttagaagtctcattccaagctacataagagattcttctgttgcagttatagtatatgatgttgctaacaggcaatcatttctgaacactaacaagtgggttgaggaggttcgtacagaacgtggcagtgatgttattattgtgttggttggaaacaaaactgatcttgttgaaaaaaggcaagtttctatagaggaaggagatgcaaagtcccgtgagtttggaatcatgttcatagaaaccagtgccaaagcaggcttcaatatcaagcctttgtttcgtaagattgctgctgccttgccagggatggaatctctttcttctacaaagcaggaagacatggtcgatgtaaatttaaaacccacggtgaattcatcccagacagagcaacaaggaggaggttgctcatgctag

SEQ ID NO: 107369 - DNA, 555 bp, Glycine max
  Peptide Sequence Number=SeqID_224147
atggtgtctgacatggttgccttgttttgcaaggcaaggatcatcaagtcaaggctcgaggttattgaccaatccaacataaccaatcgcactttatcagaatcctacatagaagtaacccaaataagaatgtctgtcacaaatggtttgagggcaaaacttagggtcatgttgatgcatggatttcagtccttgagagacaagtttctcatggagaaaatgatttcgaggagtctcaaagttgagtttatggttgctgcagcagggaaaacggatattgataatgctgatttgggtgttaggcatgaggaagtgatcatggatatccagaggagtttgaatatgcttgaccagatttttgttgacatagctattttggttgagacccaaggagaaaacttggatagcattgaggatcgtgtggccagtgttgttaacaatgctaaccaaatgaagaggaagaacaccaacacagaatggctctgttgggttcttgtggtgatgctgctgactgtgtttctttactgggggagaaatttggagggagtggtttag

SEQ ID NO: 107370 - DNA, 192 bp, Glycine max
  Peptide Sequence Number=SeqID_224148
atgaagatagtgatggacaaggtgagcagggtaggatatgagtataatataagaatcaaagacggcttcgtattcaggcagcaccagtatctatcgtcagttgacagtggagcttgctgcagtgcagataataatattgttggtgcctctgtatacgtagctgtctacaatattaacaataaccatacatga

SEQ ID NO: 107371 - DNA, 342 bp, Glycine max
  Peptide Sequence Number=SeqID_224149
aagaatctttatgagctcattcaggcaattgcagcttctcaagggatgagaggtttttggaaagggaattttgtgaatattcttcggacggcaccctttaaggctataaatttttatgcatatgatacgtatagaaataagctgacaaggatgttggggaatgaagaatctactaattttgagagatttgttgcgggtgctgcagctgggattacagccaccttgctctgcttgcccatggacactgtgagtgggaaactcaggatcatgttacctgtatctgttctctcttgtgtttacattttgaattgtgatgctctgaggagcaatacgataggatag

SEQ ID NO: 107372 - DNA, 504 bp, Glycine max
  Peptide Sequence Number=SeqID_224150
atggtagcacctggtggtgaagccttgggaggtgtgattggtgccttccgccacatgattcaaacagagggcttcttttctctttacaagggtttagtaccctccattatcagcatggcaccttcaggtgctgtctactatggtatttatgatattttaaagtcagcatatctgcattcacctgaaggaatgaaaagaatccaacacatgaaagaagagggtgaagagctgaatgcactggaacaactggaattgggtcctgtcagaactttattatatggtgctattgctggttgttgttctgaagctgcaacttacccatttgaagttgtaaggagacagcttcaaatgcaagttcgggcaacaaggttgaatgcactggcaacttgtgtcaagattgttgagcaaggaggtgttcccgccctctatgtaggacttattcctagtttattgcagaagctgctttacaaccatggctgtgaaaataacagcaccgtgaaatag

SEQ ID NO: 107373 - DNA, 255 bp, Glycine max
  Peptide Sequence Number=SeqID_224151
atgtccgattcaggccgatcatatatcgacacgcttgaatttgaacacgaaagctctcggcaaattcaaatggccataacttttgactcgggtctgatgagaatcatgaaactggccaaatacaggctaaaggcccaagtggagaaggacaaagcccccgagtggagaaggatgaaggcccaagtggagaaggatgaaggcccagaggcagagacactatcaagacaattaattgttgctgaaggcccaaactaa

SEQ ID NO: 107374 - DNA, 1029 bp, Glycine max
  Peptide Sequence Number=SeqID_224152
atgtcacccgatgacacaccttcaaagcctgccacagcaaaagaccaagagactcaaagttccggtggtagtggcagaaaaagctcctccacaaggccccaagagcaaggtctcaattgtccacgatgtgactcacccaacaccaaattctgctactacaacaactacagcctcacgcagccaaggcatttctgcaagacatgtagaagatactggacaaaaggtggtgctttgcgcaacgttcctattggcggtggttgcagaaagaacaagaaggtgaagtcatcaaggctatcatgtgactccaaggactctggttcctcctcttcagaagttggtggactcaagttccttcattctctttctccttccatggactttcaccttggagggttacccttccctaggcttcaccatcatcatcaccctccaaccacttacaaccacttttcctcttttgaaaacacttctagtacttcttcatgtttcaaccttgacccttctcctggcaccaccaccaccctatcaagttcttttgctgctctctataattaccctttttcttacaatggtgcaatccaaggtatgagctctttgaacgttcatagtggccttgcctcttccattgagtctttgagttctataaatcaggacttgcactggaagcttcagcagcagcgattggcaatgctctttggtggagacaacaaccagaaagatcatagtggtgttaaccagattgagaaccagactcagaagccacaaaccattttgtttcaaaaccttgagatttcaaagccaggaactttcccagttggggactccagaaaagaacatggtccaagtggggacacacacacgccttcaaccgagtggttctttgggaattcctatgcctcagtgactccaacacctactagtagtggtggtggcccagggaataatgataatgcaagcaattggagtagcggtggtggtggtgtccatgcttggggtgatgtgccgcagcaatatagttctttgccctaa

SEQ ID NO: 107375 - DNA, 369 bp, Glycine max
  Peptide Sequence Number=SeqID_224153
atggcagcacagctgatccgtgatcgcgtcgtgatggagtgcctagaaggtatttgggagacccttgagggcaacgagaggtgccaattccgcggcacagttcgactcactactacatcgcttgtacatccggagcaacccgcacaggtgtcatcctccgaagaggatcctgaaggggacccagaggagttatctcctgaacctgctatggatgcccctgacttaccagaggatgatgaggacccacttcctgatgttgattctccagaggatattatgccagcacttgaggcagactctacagaggagagtggtcctggagggatggcgaatagcgacgactcttcatcacaacagacggctccttag

SEQ ID NO: 107376 - DNA, 3186 bp, Glycine max
  Peptide Sequence Number=SeqID_224154
atggatccgactcaatctaacgacgttctgcaatacccacaaaccctaatctcagagcctaaagattctccaatgcaagacgccaacgagtccttgttcgattcgatggtttgcgactccagctcaagactgatcccaactgggtttacgagatctgacaacgcagcagaagaggattgtttcatgtttgtgaatgcgggaggggatgcttttagtgaagaagctggtggaataactttcctggctgacacatattttgacggtggcaacgttatgcgtaccaatgagcaaatagtggagggtggagactacccatttatctaccaatcagctaggttgggaagcttttgttataggtttgataatcttcctcctggagactacattgtcgatcttcattttgtggagatcattaacataaatgggcccaaaggaatgagggtgttcaacgttctatctgaattggatatctatgcagttgttggagccaataagccactacagatggttgacttaagggtgtctgttaaggatgatggggtgattctcataagatttgaaagtatatctggaagcccagtcgttagtgggatttgcattaggagagcaacaaaggctccagttccgcaagtgaaaagtgattacattaaatgtagctcctgtgctgtacagattgaaattccttcatcacagatgaaagttatgcaggcaaagtctacagcaaagtatgagagcaagataaaagagctcacaatgcagtgcgatctcaaggcaaaagaatgctatcaggcatggatgtcattaactgcaacaaatgagcaattggaggaagttcagatggaacttgacaaagtgacatttaattcactcacaactgatcaaactgtagagaaacaagctgaaagcctgaggaatatttctaataggtatgagcttgataagaagaaatgggcggaagcaattaacagtttacaagaaaaaataaagttgatgaagagtgattattcaaatctttcctttgaagcacatgaatgtgttgattcaatccctgaattaaataagatggtttttgcagttcaggatttggttaagcagtgtgaagatctcaaagtgaagtacaacgaagagatggcaaagagaaagaaactcttcaatgaagttcaagaggctaaagggaacattagggttttctgtcgatgtcgtccattgaataaggctgaaatctcagctggatgcaatacaattgtggattttgatgcagcaaaggatagttgccttggaattttgacaagtggctccaccaaaaagtcattcagatttgacagagtttatacaccaaaagatgatcaagttgatgtttttgctgatgcatcatcaatggtaatctctgtactggatggctacaatgtttgcatctttgcttatggacaaacaggaacagggaagacattcaccatggaaggaacacagcagaatagaggagtaaattacaggactcttgagcacttgtttaaagttagtaaggaaaggagtgaaacattttcatatgacatatctgttagtgtgatagaggtttacaatgaacaaatcagagatttattggctacaggacaaacatcaaagaggttggagataaaacaagcttctgaaggatttcatcatgttcctggtgttgtagaagccaggattgataacataaatgaagtgtggaatgtactacaggttggaaataatgctagagcagttggaagtaataacgttaatgagcatagcagtcgatctcactgccttctttgtatagcagtaaaggctaaaaatttgttgaatggcgagtctaccaagagcaaactttggcttgtggatttggcaggtagtgaaagacttgcaaagactgatgtgcaaggggaacgactgaaggaagcacaaaatataaatcgatctctttctgcccttggagatgtaatatccgctctagcagcgaaaagcagtcacataccatatcggaattcaaaactgacacatttacttcaagactcactaggaggtgactccaaaactttgatgtttgtacaaataagtccatcagaccaggacgtaggtgagacactgagctcacttaattttgcaactagagtgaggggtgttgagttgggtcctgttaagaagcaaattgatacaagtgaggttcaaaagatgaaagcaatgcttgaaaaagcacggagtgagtgcagaattaaagatgaatctatgcgaaaacttgaagaaaatttgcaaaacttggagagtaaggccaaaggcaaggatcaaatttacaaaaatctgcaagaaaagattaaagaacttgagggacagatcgagttgaaaaaagccatgcaaaatgactcagagaaacaaatctctcaattatctgacaaattgagaggaaaagaagaaacctgcagtactcttcaacaaaaggtgaaagagctagagaaaaagatgaaagaacaactgcagtcagaatcagcaagttttcaacagaaggtttgggatctagagaaaaaactgaaagatcagatgcaagggtctgaatctgaatctgccattttgaaagataagatcaaggagcttgagagaaaactgaaagagcaggaacaaagctcaatgtccttgcttcgtcaacagatggaacaactggaggacagataccgagagcgagagcaacagtggcaacaaactgattcttttgtggatgcaacagtaaaagcagccacaccagatgtaggtaaaagctgcatgagtgaagaatgtccaagcgagattgagactggcattttaaggtgttcagactcagaaaatcgccagattagtcaaggttcttctttgttcaaagggaatggttccactcgtaagataagtcaaggttcttgtttgttcaaagggaatgattccactcacaagattagaagcaaaagagagtttagaagcaatgatgaaaacaactttgccatgccatcatcattacaacacgatagaagagtcgcaaggaaatctgatccacctaaaatagtgaggggtttgaggccaacaccaaggccagtcactgctaatctagccccagtgtctcacaagagagctagcacaagcagagatcaggttcaaggaatcaaagagagggacactaagaagaaaatctggtcaagatag

SEQ ID NO: 107377 - DNA, 2985 bp, Glycine max
  Peptide Sequence Number=SeqID_224155
atggctcctcttctcaccctttttattcaacattgttgcagggaactctctcacattgttctcgtccattatcgacaagtgaagggaaccaaggcgaattttacaagtgctaaagaaaatgaagaatctcttccttatgctcaacaaactgataaaattatgccccaaacagagatggacacttctttatcatctactcttcatccacatagttaccaggttccttcaaaaactgtcgatacaagcatgaacagtgcccaaacatcagaatatgaagaagctgaatctgcattcaataaccatgcaagttctgagttttattctttcctcgagttacaacgccctgttgagaagatttcacctcaacctgctgatttttattctcctcggccactcataaatgatcaagagaagttacctattattcctggggtgaattatatctcactcactcaagacaataaaaacaaagacattcttaatgctggattgacatatgaatccccaaaaccccttggcttttcctcatgggaaggtatcttagaaaataatgctggaagtcaacatgtgcattttcagcctttatttcctggaacacagcctgataacatgggaatcaatagcaatttttctcaaggagaagagataatggtgccatatttgaccaccagcattgctaagcagcatgagaatggaagtatcattaaagctgaaggaaattggcaggtttatgatgttgattctttacgcatgtccagttggcctatagatagtgcttattcaggctcaacatgtgaggtaagttgtagcaactgtgagcaggaagttaatgatgttgattttcagaaatccttggaacagtgtcttctacattcacacaaacaaaacaaggttctcatgcaaaatgatcttcaagaaaaacttttgaatgaaaaagaaaagataaaatcaaatctagaggcctatggaatagaagacacatatttatcttttaaaaggactctgttagatggacctccagctgaagagggtctgaagaagcttgacagtttcaaccaatggatgagtaaagagcttggagatgtggaagaatcaaataaaccatccacttctggtggttattgggatacagttgaaactgaaaatgaggttggcaacacaactattccttcccaagggcacctggacacctatgtattggatccatctgtttcccatgatcagctttttagcattattgactattccccaagctgggcatttgaagggtcagaaattaaggttatcatttctggagaattcctaagaagtcaacatgaagcagaacaatgtaagtggtcatgcatgtttggtgaggtagaagtgccagcagtgatcattgcaaaaggtgttctttgttgtcatacacctccacacaaggctgggagggtacctttctatgtaacttgttccaataggttagcatgtagtgaagtgagagaatttgatttccaagtccactatactccagaagacactacaggtgagaatagaggaagcacttttgatacttttagtatccgatttggagaacttttgtccctggggcatgcctttcctcagaattcagattcaattagtgtaagtgagaaatctcaactgagaagtaaaatcaattctttattgagggaggatgatgatgattgggacaagctactaaaacttactcaagagaaagatttttctccagaaaatttacgggagcagctgcttcaaaatcttctgaaagataagttacatgcatggctccttcagaaaataactgaagaagggaaaggccctaatgtattagatgagggtggccaaggtgtgcttcattttgcagctgctcttggctatgattgggccctagaacccacaatagttgctggtgtgaatgtgaactttcgtgatgtaaatggatggacttctcttcattgggcagcattttgtggcagggagcgcacagttgctttcctcatctctctcggcgcagcacccggagcactgactgatccatgtccagaacatccttctggtagaacaccagctgacctagcttctgcaaatggacacaaaggaattgcagggtatcttgctgagtcttcactaagtgcacacctcacaactctcgatttgaacagggacgcgggagaaaattccggagcaaaagtagtccaaagactccaaaacattgctcaagttaatgatcttgatggtttatcatatgaactgtcattgaaagattcactggctgcagtgtgtaacgccacccaagccgcagctcgtattcatcaagttttcagaatgcaatcatttcagagaaaacaactgaaggaatatgatgatgacaaacttggattatctgatgagcgtgctctttcactcataaaaatgaatgtaaaatcacacaagtctggaccacgtgacgagcctgtccatgctgctgcaatacgaatccaaaacaaattccgcagttggaagggaagaagagaatttttaatgattcgacaacgcatagtaaaaattcaggctcacgtgagaggtcaccaggtcaggaaaagctgtgggaagataatttggtccgttggaatcttggagaaggttattttacgttggcgtcgaaaaggtagtggcttgcgtggatttaaaccggaggccaattctgagggaactatgatacaagatgtatcttcaacagatgatgactatgatgtcttaaaagaaggcaggaagcaaacagagcaaaggttgcagaaagccctagctagggtgaagtcaatggttcagtatccagaggcaagagaccaataccataggctgttgaatgttgtaactgagatccaagaaaatcaggtaaagcatgagagcagttctaacaattcagaagaaccgagagaattcggtgacctcaatgatcttgaagcattgttggacgaagatattttcatgcctacagcaacttaa

SEQ ID NO: 107378 - DNA, 1758 bp, Glycine max
  Peptide Sequence Number=SeqID_224156
atggacttcatatttgtgctattgctattgggttgcttatgttcttttgtgttgcctgatacacaaggagatgcactatttgcattgaagatatcattaaatgcttcagctcaccagcttactgactggaatcaaaatcaagtgaatccttgtacttggtcacgtgtttactgtgactcaaacaacaatgtcatgcaagtatcactagcatatatgggattcacaggatacttgaacccaaggataggagttctaaaatatcttacagctctttctttgcaagggaatggcatcactggcaacataccaaaagagttaggaaacctgacaagcttgagcaggttagatttggaaggcaacaaattaactggagaaataccctcttcccttggtaatcttaaaaagcttcaattctttctgctagattcaaataatctgagtggccaaatcccagagcagttattcaaggttcctaaatacaagtatggatgtttcactggaaataatttgagttgtggtgcgagttatcatcaaccttgcgaaactgataatgcagatcaaggttcatcacataaaccaaaaactggtctcattgttggaattgtgatagggttagttgttatccttttccttggtggtctgatgttctttgggtgcaagggtagacacaagggctacagacgtgaagtttttgtagacgtcgcaggtgaagttgatcggcgaattgcatttggccaactaagaagatttgcatggagagaactacagatagctacagacaacttcagtgagaaaaatgttttaggacagggaggctttggaaaggtttataaaggtgttcttgctgataacacaaaagttgctgtcaaaaggttaactgattatgaaagtcctgggggagatgcagctttccagcgtgaggttgagatgataagtgtagctgtgcataggaacctgttacggctgattgggttttgtactaccccaaccgagcgcctcttagtttatccctttatgcagaacttaagtgtagcctatcgtcttcgagaaatcaaacctggtgaacctgttctggactggcctacaagaaaacaggtggctctgggaacagcccgtggcttagaatatctccatgagcattgcaatcctaagattattcatcgggatgttaaggcagctaatgtattactagatgaagattttgaagctgttgttggtgattttggcttggcaaagttagtcgatgttcgaaaaactaacgtgacaactcaagttcgtgggacaatgggccacatagctccagagtatttgtccactggaaagtcttcggaaaggactgatgtttttggttatgggattatgcttttggagcttgttacaggtcaaagagcaattgacttttcacgtttagaagaggaagatgatgtgctgttacttgaccatgttaagaaattagaaagggagaaaagactagatgcaattgttgaccacaacctaaataaaaattacaacatacaagaggtagaaatgatgataaaagttgcattactctgtacgcaagcaacaccagaggaccgtccaccaatgtccgaggttgtaagaatgctagaaggagaagggttagctgaaaggtgggaggaatggcagcatgtggaggtaaatcggaggcaagaatatgagagattacaaagaagatttgattggggagaagattcggtctataatcaagatgccattgagttgtctggcgggagatga

SEQ ID NO: 107379 - DNA, 1038 bp, Glycine max
  Peptide Sequence Number=SeqID_224157
atggagaagaagttcaaggtttatatatacccagatggggatcccaacacgttctaccagacgccgaggaagctcaccggaaagtatgccagtgaaggctatttcttccagaatatcagagacagtcgcttccgcaccgaaaatcccgatgaggcacacctcttcttcattcccatctcgtgtcacaagatgcgtggcaagggcacgagttatgagaatatgacaataattgtgcaaaattatgtggagagcttgatatccaaatatccttattggaatagaaccttgggtgctgatcacttctttgtcacttgtcatgatgttggtgtgagggcaacagaaggacttgagtttcttgtgaagaattccattcgagcggtgtgctcccccagctatgatgttggattcattccacataaagatgtcgctctccctcaagtgctacagccatttgctcttcctgctggtgggaatgatatagaaaacaggactactcttggattctgggctggtcatcggaactctaaaatcagagttattcttgcacgtgtgtgggaaaatgacacagaacttgatatttcaaacaatagaattagtagggctactgggcatctagtgtaccagaaaagattttacaggagtaagttttgtatatgtcctggtggatcacaggttaatagtgctcggatagcagactctatccattatgggtgtattcctggtttgattttattttgcatattaagcctcttaaaactgtatacttatgtcagttcagtgatattgtcaaattactatgaccttcctttcaatgatattcttgactggaacaaatttgccgttgtactcaaggagagtgatgtttaccagcttaaacaaatcctcaaaaatatatcagatgctgagtttgttacacttcataataatttggtaaaggttcagaaacacttccaatggaattcgccctcaatcagatttgatgctttccatttggttatgtatgacctctggttacgccatcacacgatcaaatactga

SEQ ID NO: 107380 - DNA, 1954 bp, Glycine max
  Peptide Sequence Number=SeqID_224158
agcagttcacactaacgtcatcaaatctggtttctcttactcatttttaggccacaagctcattgatggctacatcaaatgcggcagccttgcggaggcacgcaagctgttcgacgaattgcccagcagacacatagttacttggaattcgatgatctcttctcatatcagtcacgggaagagcaaagaagccgttgagttttatggcaacatgcttatggagggtgttttacctgatgcttacaccttctctgccatctctaaggctttttcgcagttgggtctcatacgccatggccagagggctcatgggttggcggtggttttgggtttggaggtcctggatgggtttgttgctagtgcccttgttgatatgtatgccaagtttgataaaatgagggatgcccatttggtgtttcgccgtgttttggagaaagatgttgtcttgttcactgcattgattgtgggttatgctcagcatggtcttgatggggaagctttaaagatttttgaggacatggtcaataggggtgttaagcctaatgagtatacccttgcttgcatcctgataaattgtggcaatctaggggatttagttaatggccagttgattcatggtcttgtagttaagtctggtctggaatctgttgttgcttcacagacttcactccttaccatgtattcaagatgcaacatgatcgaggattctataaaagtgtttaatcagcttgattatgcaaatcaggtgacctggacatcttttgtagtgggtcttgtgcaaaatggcagagaggaggttgctgtgtcaatattcagggaaatgattcgttgttcaataagtccaaatcctttcacattgtccagtattcttcaagcatgctcaagccttgcaatgcttgaagtaggggaacagatccatgccataaccatgaaactaggattggatggaaataagtatgctggtgcagcactgattaatttgtatggaaaatgtggaaatatggataaggcgagatctgtttttgatgtgctaactgagttagatgtagtagccatcaattcaatgatctatgcttatgcccaaaatggttttgggcatgaagcacttgagctgttcgaaagactgaaaaatatgggacttgtgccaaatggtgtgacatttatcagtattctcttggcatgcaacaatgcagggttagttgaagaaggctgtcaaatatttgcctccattaggaataatcacaatattgaattgacaatagaccattttacttgtatgattgatttgctaggacgatcaaggagacttgaagaggctgcaatgttgatagaggaagtgagaaatccggatgtggtactgtggaggacactgctgaactcatgtaagattcatggagaggtagaaatggcagagaaagttatgagtaaaatcctcgagcttgctcctggtgatgggggaacacatatcctcttaacaaatctttatgcttctgctgggaaatggaaccaggtgattgagatgaaaagcacaataagagatctgaaattgaagaaaagtcctgcaatgagttgggttgatgttgatagagaggtgcatacttttatggcaggagatttgtctcacccaaggtctcttgaaatttttgaaatgttgcatggattaatgaagaaggttaaaactctgggttataatcctaataccagatttgtgttgcaggatttggatgaagagaagaaaataagttctttatattatcacagtgaaaaattagctatagcttatgctttatggaagactattggtaggactactactatcaggatttttaagaatcttagagaggtctatgttcctgtaaagattactggtgaatcatatttgttatatgctatgcctagccttctagatgctcactttcctcacagatctgtgcatacttccatgcctccatga

SEQ ID NO: 107381 - DNA, 2139 bp, Glycine max
  Peptide Sequence Number=SeqID_224159
atggctctctccgccaccttcgttaagacaaaccgttctatactaccatttcaccaaaattcaagtccaaaccatggtcgcataaaacagttgtgtgtgagggcttcagcaagtagcttggatgacgacgaggacagaacagttgtaaggaaagagaaagatgggtggaagatcaaattctcaagccagaaaccagcaactcccttgctggatacaatcaattatcctgcacatatgaagaatctatccttacaggatcttgaacaactcgctgcagagctaagggcagacgttgtacatagtgtatcaaacactggggggcatcttagctcaagcttgggagtagtggaattaacagtagctttgcatcatgttttcaacacacctgaggacaagattatatgggatgtagggcaccaggcatacccacacaagattctcacaggtagaaggtccaggatgcacaccattaggaaaacctcgggactagctggttttccaaaaagagaagagagcgtatatgatgtttttgggacagggcatagttctacaagtatatctgccggtcttggcatggcagttgcaagggatctattgggaaagaaaaacagcattgtctcggtgattggagatggagcaatgactgctggccaggcttatgaggccatgaataatgcagggttccttgactctaacatgataattatacttaatgacaacaagcaagtttctttgcctactgctactattgatggtcctgcaactccagttggagccctcagtagtgccttaagcaaaattcaagcaagcaccaaattccgcaaacttagagaagctgcgaaaggcatcacaaagcagataggaggaacaacacaccaacttgcagcaaaggtagatgagtatgcaagaggtatgatcagtggttctggttctacactttttgaggagctcggcttatactacataggccctgtggatggtcacaacattgaagatcttgtcaccattttggaaaaggtgaaagaaatgcctgccccaggtccaacattgattcatgttgtgacagaaaaagggaagggataccccccagcagaagtagctgctgataaaatgcatggtgtggttaagtttgtaccaacatcaggtcatcaattgaaaccaaaatcatccacacttacatacactcagtactttgccgagtcattgataaaagaagcagaaatagacaataagatagtagccattcacgcagcaatgggtggcgggacaggtctaaattatttccataaaaggtttccagaccgctgctttgatgtggggatagctgaacaacacgcagttacatttgcagctggtttagcagcagaaggtctcaagccattttgtgccatttattcatcatttctgcaacgtggatatgatcaggtggtccatgatgtagatcttcagaaactaccagtacgatttgctatggatagagctggtttggttggagcagatggaccaacgcattgtggggcatttgatatcacatacatggcctgcttgcccaatatggtggtcatggctccatcagatgaagctgagctgatgcacatggttgcaacagcagcagccatagatgacagaccaagctgctttagatttccaagaggcaacggaattggagccagtttgcccctcaataacaaaggaactccacttgagataggaaagggcagaattctgagacaagggagcagagttgctattttaggatacggttctgtagttcagcaatgcttgcaagcagcacaaatgctcaaaccactagacatttctgtgacagttgctgatgctaggttttgcaaacctttggatactgatctcataaagctattaggtaaggagcacgagtttctccttacagtggaagagggttctattggaggttttggttcacatgtttcacatttcctaagtatagttggcctcctggatggaccactgaagtggagacctatgatgcttcccgatagatacattgaacatggatcaccacaagatcagacagaagaagcaggactttcatcaaagaacattgccgcaacagtcttgtctcttctggaaaggccaaaagaagctctattgttcaagtaa

SEQ ID NO: 107382 - DNA, 105 bp, Glycine max
  Peptide Sequence Number=SeqID_224160
atggggaattcatcctcagctgttactaagatccagtatcacgggcaaggttgcatcatccagccacaaaaactggggaatgctttcagtcctatctgtctttga

SEQ ID NO: 107383 - DNA, 126 bp, Glycine max
  Peptide Sequence Number=SeqID_224161
atgaggggtgatcaattggttcgtgtgcaagttgaaatccctaaaagactgagcaatgatgagagaaagcttattgaagaacttgctgatttaagcaaaggcaaaactgccaccggtctagattga

SEQ ID NO: 107384 - DNA, 221 bp, Glycine max
  Peptide Sequence Number=SeqID_224162
atgccattgcctagcgctgttcatgcatcctccaccaacgagtctggagccccacgaagcgctgttcatgtgtcctccacctacgagtctggagccctgcgtactgattgcttagtgcattcccaattctccattctcgccttttttccagagccccatgaatgtcatttgcctaccgctgttcatgcgtcctccacctacgagtctggagcccccataag

SEQ ID NO: 107385 - DNA, 558 bp, Glycine max
  Peptide Sequence Number=SeqID_224163
atgatctatcctccatctcccatcagatggcacgtcaaatgcaagatgacccgcacgaagaaaattgaccagatgacgattcgttggaggagcaggtgccacagggttgttgtccatggacgtcaggatgtactgactgctaccattgggcgaccagaacaccccagtcgtgtgggtgctgctagagccggtgtgacgatcaagcaatactttggaccgactagaggagttgatcacaaaaaaagtgactcgataactaatggacttgcactgcctcctgagcctgaggttggtccttcagctgctcgtgtcagcacaaaggagagttgtattgatcactcagggaacgatccagacatgtgtgactcagacaaatgcgggttgtacatcgatgaaaatcctccttgcctggttgccctaggaagagtttatgagggatccataatcattcacaacatccctttgttgcatgatcaagtgaaggtcggtgttgaggaggttagagatgcagatgctcttattcctgtacccattgaagaggttaagttagtggggtag

SEQ ID NO: 107386 - DNA, 297 bp, Glycine max
  Peptide Sequence Number=SeqID_224164
atgtcattgtctagtgctgttcatgtgtcctccacctatgagtttggagccatgcgtagtgattccttagtgcaattctccaacctcgcctttttttcggagccccatgaatgtcattgcctagcgctgttcatgcatcctccaccaacgagtctggagccccacgaaggtattgcgtacaactgttcgccaattctccatttccactttttttcggagccccatgaatgtcattgtctagcgctgttcgtgtgtcctccacctatgagtctggagccccgcaaatttattgcgtag

SEQ ID NO: 107387 - DNA, 147 bp, Glycine max
  Peptide Sequence Number=SeqID_224165
atggctttcttgggtgcatgtttcagtgtgggtaggtggtggcgaggatggggagtgaggcaaagttggtggtggtgtgagtggtggaggtggtggttgaattggcgtataggacactacaaaaatccaaatggagcatgtgattag

SEQ ID NO: 107388 - DNA, 285 bp, Glycine max
  Peptide Sequence Number=SeqID_224166
atgctggtgcgtgttgcggttgctgcagtggtgcgagcgggcacccgtaactgggcccggtgggcttcgagtggggcgtcgagcccaagcctttcgatatggcggcggaagaaggagatggggaaggaagggctggtggtggccaaagagctgaagaggttccggtcggacccggtccggctagaccgcttcatccggtccagcgtctcccgcttgctcaagtccgacctcgtcgccgtcctggccgagttccagagacagaatcaattcttcctctgcgtcaag

SEQ ID NO: 107389 - DNA, 471 bp, Glycine max
  Peptide Sequence Number=SeqID_224167
atgggttacacaaaggaactatctcctttctcactgggcaagccattgtatgatatagtccggaaagaaatatggtaccggccagacatgtttttttatagggacatgcttatgatgcttgcacgaaacaaaagggtagaagaagctaaaaaggtttggggtgatttgaaaacagaggaagttttatttgatcagcatacattcggagatattatcagagcttttctagataacgggttgccctcagaggcaatggacatatatgaagaaatgagacagtctcctgaacctcctctttcattgccttttcgcgtgatattaaaagggctcattccctatccagaattacgtgagaaagtaaaagatgacttcttagagattttcccaggtatgatcatctacgaccctccagaggatttgttcgaagataataaacagcacaatgatagagataactatagaattgcttaa

SEQ ID NO: 107390 - DNA, 204 bp, Glycine max
  Peptide Sequence Number=SeqID_224168
atgggatgttacaattgtaataagcaaaaaggaagcactgagtgcgagtactacgtaatacattggatgtcaacgataatcctaggaggtttcaaggataattgggaaatgtattttactgattcaagaccattggaactagagacaatgaaggaaattcacattcggtgggcaagatattatctaaaagtttctgataattaa

SEQ ID NO: 107391 - DNA, 1888 bp, Glycine max
  Peptide Sequence Number=SeqID_224169
ggcacataagagaagcgtttgaaagctttttatctgagatatgggccgaaccccgtttgttctcaaacctcctccaagcatgcattccgttaaagtctgtttctttggggaaacagcttcattctctgatattcacttctgggtgttcctcagacaagttcatttccaaccacctcctcaacctctactcaaaatttggggaacttcaagctgctgtggcactgtttgatcgaatgccaaggaggaacatcatgtcatgtaacatcatgatcaaggcctatcttggaatgggtaatctcgagagtgccaagaacctgtttgatgaaatgcccgacagaaatgttgccacgtggaatgcgatggtcacggggttgaccaagtttgagatgaatgaagaggctttattattgttttcgagaatgaatgagttgagtttcatgccggatgagtactcgttaggtagcgtgctcaggggatgtgcacatttgggagctttgttggcagggcaacaggttcatgcctatgttatgaaatgtgggtttgagtgtaatttggttgttggatgctctttagctcatatgtatatgaaagctggaagcatgcatgatggggagagagttatcaattggatgccagattgtagtttagttgcttggaatacacttatgtctggaaaagctcaaaaagggtacttcgagggagttctggatcaatactgtatgatgaaaatggcgggttttagaccagataagattactttcgtgagtgtgatcagctcatgttcggagttagccatcctttgtcaagggaagcaaattcacgctgaagcagtcaaagcaggagctagttctgaagtttccgtagttagttctttggttagtatgtactctagatgtggatgcttgcaagactctatcaaaacatttctggaatgcaaagagcgagatgttgtgttgtggagctcaatgattgctgcttatgggtttcacggtcaaggagaagaagcaatcaagcttttcaatgagatggaacaagaaaatctgcctggaaatgagatcacattcttgagcttgctgtatgcttgcagtcactgtggattgaaggacaaaggactcggtttgtttgatatgatggtgaaaaagtatggactcaaggccagactacaacattatacttgtctggttgacctactgggcaggtctggttgtttggaggaggcagaggcaatgatacggtccatgcctgtaaaagcagatgcaattatatggaaaactttattatctgcatgtaaaatccacaagaatgctgaaattgcaagaagggttgctgatgaagttcttaggattgatcctcaagactcagcttcatatgttctacttgccaacatctattcttcagctaacagatggcaaaatgtttctgaggtgaggagagccatgaaagacaagatggtgaagaaagaaccaggcataagttgggtagaagtaaagaatcaggttcatcagtttcatatgggtgatgaatgccacccaaaacacgtggagattaatcagtatctggaagaattaacttcagaaatcaagaggcagggctatgtacctgatactagctccgttttgcacgacatggacaacgaggaaaaagaacagatcttgaggcaccatagtgagaaattggcaattgcttttgctttaatgaacaccccagagggagtgccaataagggtgatgaaaaacttgcgggtttgcagtgattgtcatgttgccatcaagtacatatcagagattaaaaaattagaaattattgtgcgagattctagcagtcatgggtcgttaatctacgcacagttggaacaacaaagatcaagccttcaacatgcgcctcctag

SEQ ID NO: 107392 - DNA, 237 bp, Glycine max
  Peptide Sequence Number=SeqID_224170
atgaagggcagtgaggcatcatcaggaggagacatgagtgtgaagcctgcatctgcatggcttgagaggcttatggctgagacattctttggtggttgtggggtccaccagaatcacaagaagaacgagaagaacatcttttgcttgcactgttgccttagcatctgcccccactgcctcccttctcaccgctcccattcccttctccagattactgacatgtttgggttagattga

SEQ ID NO: 107393 - DNA, 225 bp, Glycine max
  Peptide Sequence Number=SeqID_224171
atggtatgctggcaagaaaatgggcctatatctaacaaggctaaggtgaaaaaggatggaagccattaccgctgcatatggggcaaggttacgaggcctcacggcaacagtggtgttgtccgtgcaaaattcaagtcaaaccttccacccagatcgatgatcaacactctgtttgccaatgttgctagtttagtaaaactgtttttacctttacatgctatctaa

SEQ ID NO: 107394 - DNA, 787 bp, Glycine max
  Peptide Sequence Number=SeqID_224172
tgatgcgcaaagactttggatctacgctgggtgtcaggtggggtgtgtgcgtgcaatgctggaggacaatgacaatggtggcaagacgacaacaatggtgacacgcgatgaaggtgtgattcagagcttctattttggatgggggttccgtgactatgtgagggagaagtctgaggggaaggggagggggtgtagggatttagtgaatgggcaaaagagtgatttcacaaaactttgtagtgccaatagcactgttggtgatgggaatagtagatcaattaaaagaaaacgctggcctattgtacactcactagaaacggcccatttagcaatgtgcccaaacccagaagccaggaaaaacctatcggtcttgaagaagatggtgaagttccttaagcccaacaaggctgtcatcgtcctgcagggccgctacgccgggcgcaaggcggtgatcgtgaggaccttcgacgagggaaccagggagcgcccctacggccactgcctcgtcgccggaatcaagaagtaccccagcaaggtcatcaagaaggactccgccaagaagacggccaagaaatctagggttaaggcgttcgtgaagctcgtgaactaccagcacctcatgcccacgcgttacacgttcgacgtggatctcaaggatgctgttacccctgatgttctcggcaccaaggacaagaaggtcactgctctcaaggagaccaagaagcggttggaggagaggttcaagaccggcaagaataggtggttctttaccaaactcagattctga

SEQ ID NO: 107395 - DNA, 147 bp, Glycine max
  Peptide Sequence Number=SeqID_224173
atggctggcgggtgtgctggtcaaacaacgtcaaaagctgtgtttggattggaattggaaaggtttgatgtggaatggcaagatgagttcaataaatgcaacagaacaggatggcatggaatggcagcttcaggctgtggtacgtga

SEQ ID NO: 107396 - DNA, 927 bp, Glycine max
  Peptide Sequence Number=SeqID_224174
atgtcatgggaattgtgcatccttgatgtgcgaaagaatgcacaggtcattcagaaacaaaacattgtccctcatgtgttgtctcgtgaggtttatctagaaaacaagttgatgaaggagaagaaaaagaaacaactagaggaagcagctcaattcgaaagcaccgacatcgtcattgatcctccatctcccattagacaacacctgaagtggaagatggcccgcaccaagaaatctggtcaaatgacgtctaagacagcaaaggaaattactgacaaaattgtaagatttcatggaggagtaggcctcacagagaagctttgttgcccatggacgtcaggatgtactaattggggccattgggcgatcagaacaccttggttgtgtccgtgttgttggagctggtatcatgatttaacaatactttggatcggcttcaaggacctcctgcacatcttcgtccatggctcccaaagtcctggagcagctgacgaaaaatatcaaggaccaactacaggagtcgatcacagaaaagtgactcaacagctaatgttgtccttcatccagatgcaatcccagtttcaatcgcagatgcaatcacagggactcgcactacctcctgagcctgagtttggtccttcagctactcgtgtctgcacaaagaagagttgtgttgatccctcagggaatgactcagacgcaggtgagtcaaagaaatgcggattgtacgtcatagaaaatcctccccatctggttgtcattggaagactttatgaggggtcgaccaccattcacaatatccctttggcattcctatacccacttaaggttggtgttgaggaagttcaagatgcagatgcttgcattcttgtacccactcaagaggttcaattagtggggcagacacttaacaccttcgctgcttag

SEQ ID NO: 107397 - DNA, 321 bp, Glycine max
  Peptide Sequence Number=SeqID_224175
atgaagcaagtagtattcaaaatgtctgacatagataaagaaaggcttggaaaatcaggcaaatatgatgcaatcgtatgcataggagctgtggtacgaggagatacaacccactatgatgcagttgctaattcagcagcatcaggagttctttcagccagtctaaactcaggtggtgttccatgcatatttggtgtcctaacatgtgatgatatggatcaggctctaaatagagctggtggaaagtctgggaataagggtgctgaggctgcattgactgctattgagatggcatctttgttcgagcaccatctgaagtag

SEQ ID NO: 107398 - DNA, 2315 bp, Glycine max
  Peptide Sequence Number=SeqID_224176
atgcctccaaaaattagatgtttcattgatcatgttacttcagttccacttgagaagatagaagaacctttaaagggttttgtttgggagtttgataagggggattttcatcactgggttgatctttttaaccatttcgattcattctttgagaagtatgtaaaaccaaggaaggatctgcagattgatgatgattttctggacttggatcctccattccccagagaatctgttcttcaaattcttcgtgtcatcagaataattttggataactgcacaaataagcatttctatagttcatatgagcagcatctttcagcattgcttgcttctactgatccagatgtggttgaggctagccttgaaactttggctacctttttgaagaaaacagttggaaagtactccataagagaaacttctttgaattcaaaattgtatgctcttgcccaaggatggggtggaaaggaagagggtcttggactgattgcatcagctgtgcctaatggttgtgaccctattgcctgtgaattgggttgtacccttcattttgaattttatgcagtaaatgagtcagaaagtgacgtcaaggtgactgaacccttggtccaaggcttgcaaattattcacttatgtgatgtcaacaaatgtgtggaaactgatcttgagcttttgcataagttagttacagaatataaggtacctgccagtttaagattttctttattgacaagactgcggtttgctagggcttttggttctttggcttctagacagcaatatacatgcattcgcttgtatgccttcatagttctaattcaagcatgtgctgatgctgatgacctggtttggttcttcaatgcggagcctggattcatcaatgaattagtatcattgctgagctatgaagatgcagttttggaaaaaattcggattttatgtttgcactcgttagctgctctttgccaagatcgttcccgtcaacagtcagtacagactgcagttacatctggtgggcaccgtggcattttatctagtctgatgcaaaaagccattgactccgttactagtgatacctcaaaatggtcagttcattttgcagaggcactattgtctcttgtcactgtgttggtttcgacatcgtctgggtgctctgccatgcgtgaagcaggatttattcctaccctgctacctctccttaaagatacaaatccacagcacttgcatttggttgaaaaggctgtgcgcattttagaagcttttatggattacagtaatccagctgctgctctgttcagagatttgggaggtttggatgataccatatctcgcctaaagattgaagtttccaatgtagaaaatggtggaaagccgccagatgataattctgagtctagtgcaagaagtgtaaatatggttggaagttcttcaactgggctagacgatacacaacctttgtattctgaaccattaatttcatatcaccgtcggttgctgatgaaagctttattgcgtgctatatccttgggaacttatgcccctggaaatactgctcgtatctatggatctgaagagaatgtgctgcctcattgcttatgcataatttttagaagagcaaaagattttggtggtggagttttttctcttgcagctactgtcatgagtgacttaatacaaaaggatcctacatgttttcctgttttagattcagctggtcttccgtctgccttcttggatgctataatggatgatgttctcaactctgcagatgccattacctgcatcccccagtgtttggatgccttatgcttaaatagtaatggcctgcaggctgtgaaagatagaaactctctgaggtgttttgtgaaagtgtttacttctagaacatatttgcgtgctcttgcaggggacacacctgcatctttgtctagtggactggatgaattaatgcgccatgcttcctcattgcgtggccctggagtggaaatgttagttgagattctggaaactatctcaaaaattggttctgcagtggattcgtcatccttgagtcctgatccatgctcttcaacctctgttcctatggaaatggatggtgaggacaagagtttgatcttgcctaataacaaggagtcatccaaggctgatgacacagagcagacaactgagccatctcctgatgtgccaattgtaaatgtcgagccatttcttccagattgtgttaacaatattgctcgtctacttgagacaattcttcagaatgccgatacatgtcgtatatttgttgagaaaaagggaattgaagctattctgca

SEQ ID NO: 107399 - DNA, 1206 bp, Glycine max
  Peptide Sequence Number=SeqID_224177
atgggtgggagcaagaagaggaagaggaagagaaacgaagagcaaaggggaggcacagtgtattcagaaagagaaaacccaccagactttgctcttttggcttctctctaccctgaatttcacccttttgttcaattcttacattctcactctcgccccaccatcgattggaccgacttcaatgccactcgccaactcacgcgcgtcttgctccatcatcgccacgctctcaactgccctatgggctatgaagacagtgacaccgacaccgacacacctatcaaacacaccaaattcaatccggacacaggcgtcggtgtcggtgtcggtgtcggacaccggacacgacaagggactagagtgtctgtgcttcatagcctatgggcacatacccgcttcagaatagccactttttatcccattttccttgcaaagtggattcctgatggaaacctctgtccaactgtgccaaacaggtgcaattacattcattggcttcaacaccttctctcatctgacatcattccaaacaccatttcaagtgatggcaagttcaggggatttgacattggaactggagccagttgcatttacccccttcttggtgcttctcttcatggatggagttttgttggatcagatgtgactaatgttgcaattgagtgggcggagagaaatgttaatagtaatccacatatttctcaactgattgaaatcagaaaggttcaagacaatgcaagtgatccctgtgtggaagttgaagagtcggtgaatggtgacaacattgctttgtgcgggagtactgatgtggaggtagctcctttgcctcttgatttgcatgcttgcgagaataggaattatcatgggcctcccatacttgttggtgtggtaagggatgatgagaagtttgatttctgcatgtgcaatccaccattttttgaaagcttggaggaggctggactcaatcccaaaacttcttgtggtggaacttctcaggaaatggtttgccctggtggtaaaaaatcaaatctcaagtaccttacatcaaaactttgggaggttggagttgccgtagtgaagacaactgaatttgtccaaggcaggacatgccggtgggggcttgcttggtctttcttgactcccctgcagaagacaccagtttctttgcccgacaagaaaaacacgtccttcatgcttgaggtatag

SEQ ID NO: 107400 - DNA, 7779 bp, Glycine max
  Peptide Sequence Number=SeqID_224178
acagagcttcttgttcagccagttgcagttggtctctcaattggactctttccagttcctagagacccagaagtttttgtccgtatgttacaatctcaggttctggatgtaatcctaccagtctggaatcatcccatgttttgtagttgtagtcctggtttcattgcatctattatttcccttgttacacatgtatattctggtgttggagatgtcaagcgtaatcatagtaacattgtaggaagcacaaaccagcgtttcatgccccctccacctgatgaggcaaccattgccactattgttgagatgggcttttcaagggcaagggctgaggaagcattgagaagagttgaaacaaatagtgttgaaatggccatggagtggctgtttagtcatgctgatgatcctgtccaggaggatgatgaacttgcacgggcacttgctctgtccctaggaagcagttctgaatctactaaagctgagagtgctgagaagactatagatgtgctaactgaagagggacatgtgaagaaacctccggttgatgatatacttgctgcatctgtaaagttgtttcagagtagtgattcagtgccatttcagttgacagatttgcttgtaacactttgcagtcagggcaaaggtgatgatcgtccaaaggataactgtgcattgagtgtgttagcacatatcttagcactgcttctttttgaggatgtaagtacacgggaaattgctgctcagaatggcattatatctaccattatagatatcttgacaaacttcaaaggtagacaggagttggggaaagaaataccagtacctaaatgcattagtgctttactacttatattggatcaaatggtgcagtcaagaccgaaagttgaaaatattgaaggaacccagactgcttccctgccagattcttctggggagcaatttcctgatacagttttaccaaaggaaaataaatcaaatgggaatgagaaagaacctgctatggcttttgagaatatactgggaaaatctactggttttgcaactattgacgagagtcgtaaattgctggatattgcatgtgatctgataaaacagcatgttcctgctgttgtcatgcaggctgttctgcaattatgtgctcgattaacaaaaacacatgctttagctttacagttccttgaaaaaggaagtctggttgctctttttaatcttccaaggacttgctttttccctgggtatgactcagttgtgtcagctatagtccggcatctccttgaagatcctcaaacactacaaacagccatggagttggagatacgacaaactttaagtggaaatcgccaatcagggcgtgtctctcctcgatcatttttgacatcattggcacctgttatctctcgggatcctatggttttcatgaaagctgcagcagcagtttgtcagatagaaacatcagggggaaggactgttgttgtgttgtccaaggagaaagaaaaatcaaaatcatcaagtgttgaggttgggttatcttcaaatgaatgtgtccggatacctgaaagcaagccacatgatggaccggggaaatgtttgaaaagccacaaaaaggttcccgttaatctcactcaagtaattgatcagcttcttgagattgtgcttaagtacccacttgtgaaaggtcaggaagattctgagtgtgactcaacttccatggacatagatgagcctaccatgaaggtgaagggtaaatctaaggttgaagaggctgggatattagagcctgaatctgaaaggtctacaggactggtgaaggtgacttttgtcctcaagttattgagtgacattcttctaatgtatgggcatgcagtaggtgtcatactcagacgtgattctgaaatgtgtcaattccgtggatctaatcagccttctggacatagtggtattattcatcacgtattacatcggttgttacctctctctgttgataaatctgccggacctgatgattggagaggtaagttgtctgaaaaggcttcatggtttttggtagttttgtgtggtcgatctggtgaagggcgcaaacgagtgacaaatgaacttgttaaagaattgatgtctttttcaaatctggagagcaattcaatgaaaaacagcttattgccagataaaaggctattcacttttgttgatctagtgtattctattttgtcaaaaaattcgtcatctggtagcctacctggtactggatattcacctgatattgcaaaaagcatgatagatggtggaatcattcagtggctaactagtattctgcaagtggttgatttggatcatcctgatgcacccaaaattgtgaatcttatactcaaaggtttagaaggtcttacaagagctgccaatgcaagtgagcaaatctttaaatctgatggaactgaaaagaaaagatctgctggtttaaatgatagatctgatgatcaaataacagcaccatctgcagctgaagcagtggcacatgatcagaatgtgggcagtcaagaagcaatcagagatacaatggataatgcacttgatcaaggaacttctcaaggtgatgatcgtgctgataatccaaatcaatcaatggaacaagatatgagagtagaagaacggggagtaatggctcaaaacccatcaatggaacttggaatggacttcatgcgagaagagatgggagaaggtggtgtcttgcacaacccagatcaaattgagatgacttttcatgttgagaatagggctcatgatgacatgggtgatgaagatgatgatatgggtgacgaaggtgatgaggatgaggatgatgatgagggagaggatgaggacgaggatatagcagaagatggtgggggcatgatgtccttggcagacactgatgtggaggatcatgatgatgttggctttggagatgaatacaatgatgagatgattgatgaagatgatgatgattttcatgagaatcgtgttatagaggtgaggtggagggaagctcttgatggcttggatcacttgcagatacttggccaacctggatttatagatgtggctgctgagccttttgaaggtgttaatgtggatgacctttttcgtcttcagagttttgaacgccgccgtcagactggtaggtcttcctttgagagatctgccacagaagtaaatggttttcaacatcctctccttgttagacctccaccatctggcgattttgtctcaatgtggtcgtcaagtggtaattctgcatcccgagattcagaaaccctgccatctgggaatcttgatgtggcccatttctacatgtttgatgcacctattcttccatatgatcatgtgccaagtagtctgtttggagaccgtttgggtggtgcagcacctccacctctaacagattattctgtgggtatgggctcattgcatctacctggaagaagagtgttaggtaatggtaggtggactgatgatggtcagccacaaggaagtgctcaagccgctgccattgcgcaagcagtagaggaacaattcctagctcaactgtgcagtgtagctcctgaaagcagtcctgttgaacgacagttacagaattctggagaacaagagaacaagtctgatgctcttgcatcacatgatgatccaatattgactgctggaactgactctacttctcagcagattgatagtcaggagcaagaaaatggtaatggaatcagagctcagcaaatcaatgatggtgctctttgtgaggaagagataaatgtagactctggtgctcaagatacagctgaagacctgcaagctaatgagcctatgttggttcaaccagtttcattgactatcatgccaaatggtcttgattgcacagtgattgaagaaaatgccactcatgatgagaatgtagaaatagctcaggcatttgtcaattcatctattaattctgatgctgctatacaatgtgaaagtggtgctgatgttcctactagcatccacaatgtgccagttgagtccatggaatgcaatggatcatcaaatgctgacgggcagcctcctaatgttgagttaggggactctggttttgaaactcttaatccaggtgattcccatgcatcatcaatttatgctagtgctgatgttgatatgggtggtactgatgctgaaggaaatcaatcagagcaaccaactgtatctgaagacaggagggatgagatgttatcaactcagaacactgaggttgctccagatgcaactcaggccgaccaagttagtgcaaataatgaagcttccggtgctaatactatcgaccctacctttttggaggctctgcctgaagatcttcgggcagaagttctggcatcccaacaagctcagtctgttcaacctccagcttatgcaccaccttctgcagaagatattgatcccgagtttttagctgctcttcctccagatattcaagcagaagttttggcccaacaaagagctcaaagggttgcccagcaggctgaaggacagccagttgacatggataatgcctctataattgctacttttcctgctgatttgcgtgaagaggttcttttgacttcttcggaagctgttctgtcagcactaccatccccgttgcttgcagaagctcaaatattgagggatcgagcaatgagtcattatcaagctcgcagccttttcgggagcagccacaggcttaacaatcgaagaaatggtcttggatttgaccagcgacctgtgatggatcggggtgttggagttacaatagggaggagatctgttcttacagatagcttgaaggtgaaggagattgaaggtgagccactacttgatggaaatgcattaaaagctttgatccggcttctacgactgtcacagccccttggaaaaggccttttgcagagactcttgttaaacttatgtgcacatagtgttacaagggccactcttatttatcttttgcttgacatgattaaatctgaagctgaaggctctgtaggtagaccagcgacattaaattcccagaggctttttggttgtcactcgaacacagtttatggtcgatctcaattgttggatggtcttcctcctcttgtgttccgccgaattcttgagattctaacttatttggccacaaatcattctgctgttgcaaaaatgttgtttcactttgatcaatcagttattccagattcttcatctccagttaaggtgcatatgaatgagaaagggaaagagaaggttattgaagggggaccatcacctaattcctctggagctcagacaggggatgttcccctagtgctctttttgaagctcttgaaccgacccctgtttctacgcagcaatgctcatcttgagcaggtcatgggtctgattcaagttgtagttgatactgcagcttcaaaattagaaagtcaatcacagtctgaaaaaggaatggcagatacccaaaatttgtcaaccagtgaagctccaagtaatactgaaaaggatgctgctttggtggagtcggactctaatcaacaagataagcatgcagatgtaaatccatgcccttctgaagggaagaagaatgtagatatgtacaatatcttcttgcagttgccgcaatctgatttgcgaaatttgtgcagtcttcttggtcgggaagggctttcggataaaatgtatatgcttgctggtgaggtggtgaagaagttggctttcattgttccctcccataggaagttctttactttagagctttcagaatcagctcatgcattgacaggttcagccatcagtgagcttgtcacactacagaaaacaaatatgcttggtttgagtgctggttctatggctggtgcagccattctacgagtgctgcaagctcttagttcactcacttcacttaatactttgggtgatatggatatggaaaatgatgtggatcagcatgatgatcaagcaactatttggaatttgaatactgcactcgaaccattgtggcaagaactgagtaattgtataagtgcagctgagatgcagcttggacagagctctttctcttctaacatgtcaaacataaatgttgcggagaatctgcaaggttcctctacttcaccacctcttcctcctgggacacagagactcttgcctttcattgaggctttttttgttttgtgtgaaaagctacaagcaaatgaatccttcatgcagcaagaccattgcaatgcaactgccagagaagtcaaggagtctgctggttgttcagcttcaacaagtgttaaaattggtggagacccacagcgaaaatatgacggtgctatcactttcacgaggtttactgagaagcatcgccgactgtcaaatgctttcattaggcagaatccaggattgttggagaaatcactttccatgatgctcaaggcaccaaggctgattgactttgataacaagagagcctatttccgctcaagaataaggcaacaacatgaccaacacttgtctgggccattgcgtataagtgtaagacgggcttacattttggaggactcttataatcagctaaggatgcgtcctactcaagatctaaaggggcgattaaatgtgcaatttcaaggtgaagagggtattgatgccggtggtctcaccagagaatggtatcagctgctgtcaagggtcatattcgataaaggtgctttacttttcacaacagtgggcaacaatgcaactttccaaccaaaccctaattcagtataccagactgaacatctctcatacttcaagtttgttggccgagtggtggggaaggctttgtttgatgggcaactgctggatgtttactttactcgatctttctataagcatatacttggtgttaaggttacataccatgatattgaagcggttgatcctgattactataagaatttgaaatggatgctggagcttggtgtacagtctcatcagtggggtgagagggatgaaagtgttggtagtgagagggacagagtgacttggaggcagcataatgatgtgagtgatattcctgacctgacatttagcatggatgctgatgaggaaaagcacatactttacgagaagaatgaggtcactgattatgagcttaaacctggaggaaggaacataagggtcacagaagaaacaaagcatgagtatgttgatcttgttgctgaacatcttttgacaaatgccatccgtcctcaaattaattcctttctagaaggttttaatgaattggtaccacgagaacttatatccatatttaatgacaaagagcttgagcttctcataagtggtcttccagaaattgatttggatgacttaaaggccaacaccgagtatactggttatacagtggcatcaaatgttgttcaatggttctgggaggtggtcaaagctttcaacaaggaagacatggcaagattactgcaatttgtgactggaacgtcaaaggttcctttggagggttttaaggccttgcaaggcatctctggtccacaaaggtttcaggttcacaaggcatatggagctcctgatcgacttccatcagctcatacttgcttcaatcaacttgaccttcctgagtatacctctaaggaacagcttcaagaacgtttgttacttgccatccatgaggctagtgaaggcggttccaccatttgtgtctccaacttgtcatttggagaaggagttcgtgctgctattctgttgtgggcactattggtaagcatcacaatgagtcaatga

SEQ ID NO: 107401 - DNA, 390 bp, Glycine max
  Peptide Sequence Number=SeqID_224179
ggtcttcaacgccaatatgcagccattaatgtgttggaagctgtcaattcttatttctcttcacatggcctatcctgtacattgaatacctcctctttcaccgtggatgttgcagcagcaaaagatgactgtgatttgatcttgaggaatggattacccattatcaataaatccatcgattgccaacctacaagagaggcatctagtggatcaagcttgaatctctcttccgagagattatgcttttgtatatcggtttttcagcaaatccctgggacactgttggtgaaaggttcattacaagacaggaatagcacattatcgggagcattctcgatgattttccaaaaactagaggaagctttgcgggataaattttgtactaaatga

SEQ ID NO: 107402 - DNA, 582 bp, Glycine max
  Peptide Sequence Number=SeqID_224180
atgggggcagggaaaggggctgtttggttctccaacgcggtggcgttagtagctatcgcggtggtagcttgccatgcccaaccttcggcgacgttcaagtgcagcagcgcgaacaaacccacgtgtcgtcccctgattagctactctaacccgaacaccaccaccctcggcgacattcaaaagctcttcaacgtaaaacacatcatggacatcgtgggagcgaacaacgccacaaaaaaaatatacggtgcagcaacaacacgggatatcgtcacgacgacgtttgcggattacaatgtgagccatcccaactcaaatcaaccaactggtcttcttggccctctctggagtgttcaagcaacgtcattccctccacagattcctgcaatcgcacaacctgcgcctataccgctaatgatatgtttggttgtttctgattgtgttcaaacagtgccaccgagtggttcaggaggatcaactggttctgattcaggagcgtcgaggagcaccttccaaggcttgcttttgagtaatcttttgattgtcattcactttgtcctctttcttgtctatgttttgtag

SEQ ID NO: 107403 - DNA, 1524 bp, Glycine max
  Peptide Sequence Number=SeqID_224181
atgaccttgaacgtggtggagaagagctccggacgcggcggagaagagctctggtcgcggtggttggttgaagaagacgcagtgatgattccaccgaaggggaaaaaggggaaaaacagatttggagggaaaagaagagaagaggagatgccggtggcgaggcgagagacgtgcgatggaagagtgattgctcatgtagacatggattgcttctatgttcaagtggaacagagaaagcaaccaaatttaagaggcttgccctctgcagtcatacagtacaactcctacaaaggtggagccctcattgctgttagctatgaggctcgccgatgtggcgtcaaacggttattatcaacactcccacattaccacgctgttcattttatagattcaatgcgaggggatgaagccaaggaggcatgcccgcaaattcaactggtccaagtcccggtggcgcgtggtaaggctgatctcaactcgtacaggaatgcgggttcagaggttgtttcggttctttcacagaagggccgttgcgaaagggcttcgattgatgaggtatatcttgatctaacccatgctgctgaaaccatgttgatggaaactcctctggatagcatgcaagactttgaggatgaagttctcaagtcacatgttttgggtttggaaattaaggatggaagtgacgccaaagatgaagttaggaagtggctttgcaggagtgatgctagttaccaagataagctattagcttgtggggctctcattgtgtgtgacctcaggatgaaggtgctgaaagagacagaattcacatgctctgctggtattgctcataataagatgctggctaaacttgcaagtgctatgaacaaacctgcacaacaaacagttgtgccacaatcatctgttgaagggttgcttgcttctttgccaataaagaaaatgaaacaccttgggggaaagctggggagttccttacaaagtgatcttggtgtcaacactgttggtgatctgcttcagttttcagaggagaagttacaacagtggtatgggatcaatactggtacttggttgtggaatattgctagaggaatcagtggggaagaagttgaggggcgactacttccaaagagccatggttctggcaagacatttcctgggcctcaggctttgaagaccgttgattctgttcaacactggcttaatcaattgtgtgaagagctgaacgaacgccttcactctgaccttgatcaaaacaaacggattgcacagacactgactctacatgctagagcatataagacaggggattcagattctcatagaaagtttccttctaaatcttgtcctttaaggtatgggactagaaagattcaagaggatgccctaattctatttcaagctgggttacgtgattttttgggcttctacaactgtaaggctcatggaaacgaaaataacaactggggagtaacatcactttctgtttctgcaagtaaacttgtgtccataccatctgtaagttag

SEQ ID NO: 107404 - DNA, 252 bp, Glycine max
  Peptide Sequence Number=SeqID_224182
atggaggaaatgggaaagtgtagtgtagtatatgatatactagctaggcttgcctttaatgataaaggaaagtggggggtgttggagagtggagagaaggggaagacggttttggaagtgaagaagtgtgatgcaacacaatcagaaatggatcgaacaaaggactgttgttttgtcaaggccgaggttggaaggacacagttgcagaaaagtgagacagatgcaattgatgaaagcgcaactccctgctag

SEQ ID NO: 107405 - DNA, 330 bp, Glycine max
  Peptide Sequence Number=SeqID_224183
atgcgtgcatgtccattgcgacaccctctttttcgatctctaacatctccgtcaacgagttttcaaagaaggactggatctcatggccagcaacgcaccctatcctcttcaacgatccatctgttacacgatacagttgaaataggagacaggacaacgtatcagtttaggacactgtttaggaaagagatgtacatgtccatcttaaagaagaatgtaaagaggcagttgcaaaactggatgctcaggaggcacagggaactgctgtaccaaaaagactatcagcattttatatggaaaattatggacagtaataatatcaatgtatag

SEQ ID NO: 107406 - DNA, 2403 bp, Glycine max
  Peptide Sequence Number=SeqID_224184
atgagtgcttcaaaatcaggtggtggatcaggtcgtggtcaacaaggtgattaccattggcgtaatcgtcatggtcgcgataaggttgctagacttgaggaaatattcaaggaatgcacacatccaaatgaagtgcgacgccgtcaaataggcgaggagctcgggcttgatcctgaacaaactataaatgagcgattagatacagatgctcttcggcttgagaatgaaaggatacaatcggaaaacaacaaaatgagagagactttggagaatctttcatgcggatcttgtgggggtcgagccatggaaccagtaaagcatcaactttccttgcaagtcttaaggggggaaaatattctattaactaaagagtgcgagaggataacctcacttatggcaaacaatgggataaatattaatccagcactacttcctgtccttccttcttcttcatcacatgatgccttaggaggaagtttactaaatcaaccagttggaattcctgctcataatcaattcatttctaaccatgataaccattatattcctgccgcaattccaactccttttcaggataatcctattgttagccctcctagccataatcaagacattaaccctgctcctaccattgatcaacacattcctactcttgatgatcccactctcattggagataattctcctttgatttcaagttttgattataatattccagctttggttactgctcttgatcgaaatcttcccgcaatgattcatcctcacgatcaaaataatagcattccttccgctgagaaagaaattcatcaagtgtctaacaattcaaacaataacctttctgctctagagttggatgcagttcaaattctaaacaatgatatgttaccccaaccaatgaagagcctaagtaaagatatggatagtgtacaaatgttgaagattgcagaagatgcaatggaagaattgatgaaacttctcagtttgaacgagcccttctggtttagatctttactagatgggaaattcaatcttcggcatgattgctacaaaaggatatttggtaggagcaattgcttaagtggacctcatgtacgaatggaatcgtcgaaagattcacgagttgtgaaaatgagtggggcacaactcgttgaaatgttcttaaattcggacaaatgggttgatctattcccaacaattgttaaaaaagctcaaacaattcaagtacttgaaagtggttcatcaggaaaccgaaatggagctctacagttggtgaatgcagaaatgcacattctttcacatttggttccgagtcgggaatttctcttccttcgttattgtaaacaaattgaagtaggtatatgggccataggggatgtgtcaattgattcttcaacatacaaaactactgtttctcacgctcgaaggcttccatctggatgcctgattcaagaaaagtcgtctgagggattgtgcatggtttcatggatggagcacgtggaagtgaatgaaaagatgcaaacccacaatcttttcagagatactatttgtgggaataacgcatatggagcagacagatgggttatgacccttgaaagaatgtgcgaaaggtttgcaagctactcagctaaaactatacctagttgtgagactggaggagttgttagatcgcccgacgtaaaaagaaacataatgcacctaacgcatcgtatggtgaaaatgttttgtgggaatttggacatgcaagacaatccaaatttcccaaatttaacccggatgaacaacaatggggttaagttatccattcgcgtgaatcacacagggccaaatgagcctaaaggcacgatcattggtgctgctatctgctttcgggttccactctctccacaaattgttttcgataacttgatagacaacaacaaacgagccaagtgggatactctatgcgatggaagtgcagggcacgagattcaacgaatctcaactggaagcaatcctggaaattgtatttcaatcatgcggcctttcatccctaaagagaacaatatggtgattctccaagaaagttatgtagatgctttgggatccatgttggtattcgctcctttttatatggaaggattggatttgatcatgaagggagaagactcatcactgtttccgattcttccctctggccttaccatatcttgggattaccaatcaaataaagttcctgaaggacaatctggacaagttggtcaatcaaggggttcgttggtgactctaatgtttcaacttttggcatccagtacatctaaaatagataatgtagacatgaaattaataggttctattaatacactcgtgacctcaactgtggagaaaattaaagatgctttgaattgctcaaattcgaagtaa

SEQ ID NO: 107407 - DNA, 411 bp, Glycine max
  Peptide Sequence Number=SeqID_224185
ggtggactcttcggtaccagtaccctcaccttcagagggctgcacgccctccccttcagacgattgtgcatcctcgcctttagaggactacatgtcctccccatcagagggctacacgccctcaccttcaaggactacatgtcctcgcctttagtgagctgcactcccccgccttcagagggctacacgtcctcgtcttccgaggactacacgtcttcaccttcaaaggactacatgttctcgcctttagatagctgcactccctcgccttcagaggagtacacatcctcaccttcagaggattacacaccatcagaggactacaagtcctcgcattcagagggatacatgccctcgccttcagaaaactacacatcctcgccatcagagggttacatgccctcaccttaa

SEQ ID NO: 107408 - DNA, 135 bp, Glycine max
  Peptide Sequence Number=SeqID_224186
cctaaatcaaaggctcctgctaggtggattgtcatcaagtattttaacgatcctagaccattggagccagagagattaaaggcgttgcagatccagtgggcacattattatctccgagttagagatcagacttag

SEQ ID NO: 107409 - DNA, 649 bp, Glycine max
  Peptide Sequence Number=SeqID_224187
gcacccctctctttcaagaggattcgcggcatgtcaagccctggcgggatacttaacgcgttagctacagcattgcacgggtcgatacgcacagcgcctagtatccatcgtttacggctaggactactggggtatctaatcccattcgctcccctagctttcgtctctcagtgtcagtgtcggcccagcagagtgctttcgccgttggtgttctttccgatctctacgcatttcaccgctccaccggaaattccctctgcccctaccgtactccagcttgacgctttacgcccaatcattccggataacgcttgcatcctctgtcttaccgcggctgctggcacagagttagccgatgcttattccccggataccgtcattgcttcttctccgggaaaagaagttcatgacccgctttcgcccattgcggaaaattccccactgctgcctcccgtaggagtctgggccgtgtctcagtcccagagtgctgatcatcctctcggaccagctacggtcgatggtatcgataagctattgcctcaccaactagctaatcagacccgagcccctcctcgggcggattcctccttttgctcctcagcctacggggtattagcagccgtttccagccgttgttcccctcccaagg

SEQ ID NO: 107410 - DNA, 285 bp, Glycine max
  Peptide Sequence Number=SeqID_224188
atgggtgccaagtacctcgaagtggtcaaacgaaagttgcatgccaccaaacaatggtccccggacaaaattaggttgacgaaagtcgcgggtgaccataagatatctctgcatgcaactgactcgctgtccctggatgacaaaggcgcagaattcgtctatgcgcgtttaccacccaacttgctgctcttgaatgataaaggtaaaaatgcgggaccatctggttcccgcatgtcatcgggcccgctgcctctggatgacaaaaggtgtagaagactacgttag

SEQ ID NO: 107411 - DNA, 309 bp, Glycine max
  Peptide Sequence Number=SeqID_224189
atggataagaatgccctctttaggtttcttcttgttcttctgactctttcctgcgttgtatttgttgctgctgttcctgcaatcagaagctccatgattgggaaaattgatcctttagtgcaagatcttctggctaaggtcctctctctctctctctccttgcaggaggatccagttatgcggttaaggaatagcgaggaagaaatgaaagaagggattgtagagagcagaatgttgatggatattgtggactaccccggaacaagaccaaatccagcccatgatccaaaatctcctggaaagccttaa

SEQ ID NO: 107412 - DNA, 483 bp, Glycine max
  Peptide Sequence Number=SeqID_224190
atggcttctaggaaaaggaaagcctcaacttccaggccccagcctcactatgatactcacagattcacctctgtggacgcctggaaccgctacgctgacaacattcttggccagaacatccttctgaaaaggaaagtgaagctttttgtcacagagtttgatgagttcaggacagagctagtaagaagaaactggcacaggacgctgattaacctcatggaggggagcatagatgtggctctcgtgaaggaattttatgctaatctttatgacccggaggataagtctccaaagcaagttagggtcagagggcatttaattaagtttgatgcagattccctcaacacttttctggagacttcggttgttttagagccaggggagacccttcctgcttactccaggttctacaaactgagaccagaccctcaggagctggctgcccgactttgtatccctagtgggatttattctgaatgctga

SEQ ID NO: 107413 - DNA, 162 bp, Glycine max
  Peptide Sequence Number=SeqID_224191
atgtggaaaatacccaaaggggaggacaccagtggtgacagtcctctttggttcctccgccattggggttgggactgggagtgtgaatctctgagtgggttttatggtgaaagtaacaggacagaagagtgggtgagggaggccaccacggataatgggtga

SEQ ID NO: 107414 - DNA, 1218 bp, Glycine max
  Peptide Sequence Number=SeqID_224192
atgcaggggggtcacggtgagcggcggcgggggctggtcgctgagttcgaaatcggcgctggcgtcgaggccttccacgccctgcgcatccacggcgcgcaacaggatgcgcaactggccggggggcaggtcaccgatcgccagccgggtgtcggcagtggtggcggcaaacagcaggatttccggcgtcgctgcctgcaccacttccacacggtagcgcgcggcgccgtcgacggggtcccaggcgagcagggtcggcaggggcgccaggcgcacatcgtcgctgcgcagctgcggcgcgggaagaagggcggagacagcgtccggtgcggcatcggcgctgatgctgcggctggcctgtccaggctggaccatgcgtttgccgtgggtgttgccgacctgcaccttgccctgcagtacctcggtggcagcgacgtggccggtgtcaccggcgctgacccggaatacggtaccgcgcacgctgctggtcgccgtaggtgcatcgatgatgtagcgcgaggccgggccacgggcaggtgtcacccggttgctcgcgcggccctgctgcaggcgcaggcgggtatcgaccatgccggtgtggccgtagcggctgagctggtccaggcgcagccgggaatactcgcgcagctgcaggcgcgaggcgtcggcgaattcaagcgtgacgctggagtcgccttcggtctgcacggtgtcaccaatgcgaagttgttccccggcgagtatcgcgcgcgtggcgctgccatcggcgccggacaattcgaccttgccgcgcaccgacagcacgcgggcaggtgccggttcgatgcgcagccagctgatcgggaagcgcagcagctggcccggcggcagctggtaggggttgtcgatgcggttgtgctgttgcagctgctgccagcgcaccgagggcttgaggtacaggcctcccagatcccacagggtatcgccgggacggacccggtagttccagtcctgggcggcggcgatggccggcaggaagagaagagcgcagagcagcgcgccctggaagcgcatggcgaacgacagcgagcggacgaaggtcacagtttgcaatcccggcaatgcgggggcgcagctgcaagaccccatggccccgacctcatccccccgaacggatcgtggcggccgtacggccgccatcccgcgcattattgcccgcgttcagtgcagggattctga

SEQ ID NO: 107415 - DNA, 465 bp, Glycine max
  Peptide Sequence Number=SeqID_224193
atgactagtggaggaaccaggcctccggctttgacgaggatgccatcgcccaacttttgtgcaaaccggggaaggattttgcccggaccgctacagggagacgagtgcggatcatgcgcacctataagtgttcacgtggctcaattgattgctgatgcgatctatcagtttgcaggaatgacacctacgaggcaccctgtggacccagggaagtccaatagggcattaggatttccaacactaatcacgggcctctgccagttttacggagtgccagtcacccctagcaaggtcatccgatcgcctgtcactcgagccttcattgagaagtattgcatgcccaggttggcgcaaggtgaggtaccacaacagctcgaggatgatctgcagcaggctgcaggtgctccaccaccacctccagagtctacctctgatcacctgtggagattggagcggtatatatga

SEQ ID NO: 107416 - DNA, 150 bp, Glycine max
  Peptide Sequence Number=SeqID_224194
atggagtttccccagttgatgtgtgcaccgaggttcaataaccatgttggtcgcattgtcattgataatcttcctaggcaacctgtaccagcagattatctctttcttgatgaacctaaccacctcgctccttgtcacactagcgtatga

SEQ ID NO: 107417 - DNA, 216 bp, Glycine max
  Peptide Sequence Number=SeqID_224195
atgcaaaattcatcctcggccactagagttgcacccaagaatcatcaaactaccaactcaaaccatgacacagaagtagatgaagcagctacaccaccaactcgtgcaagatatttgagccttcctctcacccatttgaacttcaactgctcatcccttttagatctgttttatctttgtactcgattacaacttaaccctcttttccgggtttag

SEQ ID NO: 107418 - DNA, 492 bp, Glycine max
  Peptide Sequence Number=SeqID_224196
atggctgtgagagaggaagaggccgaagctccggaagagagtgaggagccactgccgaagccttggagcaggaaaccaagagggcctgaaaggaagaacacgtctgaaacaagttttgaggagctttatggggcaacaacagcgagcttaagctctgaagagacgaaagggatcagtcgcgagttgaagttaagcgagacagaagggaaaatgttggccatcattgataaatacaaagaaaagttgaacctagcaacagctcatgagcataggctagtggacgagtacaccaaggtattcgcggaaaaggaagcaggggggagggtaatcgattcattgcacggaaaggcaatgatatggatggatagattcgcctccaccctgaatagaaatcaagagcttccccaactgctagctcgagccaaagcaatgacaggcatatactcggcctcgaggagattcactagctcctcaactactgtcagcaaatga

SEQ ID NO: 107419 - DNA, 195 bp, Glycine max
  Peptide Sequence Number=SeqID_224197
atggcttccatgatggaagccatgctagggatgaaaagggtagcctcctcaacccaccggcgatgtccacatggacccccgagagcgcacccacgtggacgtcgactcctaccccctattcccgctgaggaaccggcgcctaatgcattgcctcaacccaacatcacagggatctctcaaccctgcccaatgtag

SEQ ID NO: 107420 - DNA, 204 bp, Glycine max
  Peptide Sequence Number=SeqID_224198
atgcatgacacaaatgcattttacggacatgagaggccaaaagattatctcttcttacttacaacatttgcagcacattgccccatagatatcattccctttgaagtcaacgttgtggcagtaaggactaccagcgacaacatatcctcaaagagaaaaactctagatgaggtttcactgtcatcaagcaagtcggagacttaa

SEQ ID NO: 107421 - DNA, 196 bp, Glycine max
  Peptide Sequence Number=SeqID_224199
atgatgctagttagtgtggtggtggtggcggtagtgatagtgacaattgtcatggtggtgattgacaacagtggtgacaacaatgattacgataatggttgcaacaagggttatagtggtaataatgaggatgatcatgatagtgggagttggtgtgctgatgatggtggtggaatcggccattatagtagtgatg

SEQ ID NO: 107422 - DNA, 219 bp, Glycine max
  Peptide Sequence Number=SeqID_224200
atgcaaaacgccagtgttactggcgaaatgtctgtggtgcaacacgtggccagtggtctcgccactgcagctggcgggatagccatgcagtggtggggcagggttcagagggcgcaagtgcagagggaccagggtagcaggctagggcgtttcgcaacccaagctagcaaaataggtgtacatttcgccaaagccattggcgacatacatgtcctttaa

SEQ ID NO: 107423 - DNA, 291 bp, Glycine max
  Peptide Sequence Number=SeqID_224201
atgagtataatgtctaagaggaaaatgcataaaccggcagaggcactagactttgctctcaaggagacttcacccaacataggtgcagatgttactggtggtgtggatccctatgttcaagagaagcttggaactacaagggccttaccaagcactttgagaaaagtccaatcctcactggaatcaggtttttgccttctccaaagaaaggattcaagcttctgttctggaggtggtgatcaaagacaaggatgttgttgtggaagactttgtagggagagtgatgtttga

SEQ ID NO: 107424 - DNA, 282 bp, Glycine max
  Peptide Sequence Number=SeqID_224202
atgccatgcaaaacgccagcgtcactggaaaaacgtccctggtgcaacacatggcgaaaacgccactgccactggcgaaatagccagtggtctcgccactgtagttggcgagttaagggtacagccctgggagcgtgcagagcagcagcgtgcagggacaggcttttacagaggtgcagggttgtcgccattatgactggcgagaagcacggtgcagtgggtgtcgccattacgactagcgagaagcttttcaaaaatgcaagaacgagtatttccctataa

SEQ ID NO: 107425 - DNA, 312 bp, Glycine max
  Peptide Sequence Number=SeqID_224203
atggggctaatagaggccaatcctaaaattggtgagaaggaatggacagtctctttcaccctgaacaaggacgttccaacctcatcctcctcagataattccaccactgttgaacctcttcagagggaaaccatcaccgtccaagaccctccatggacgaggtatgactatgagcacacaccatctgaggccttcaaggcttttcctacaaatgtcgtagttcatatactactaccacaatggacacgtccagtgcaaccacaagttatccagatgaaatcacattggcttgcacctagcacccagtgttag

SEQ ID NO: 107426 - DNA, 354 bp, Glycine max
  Peptide Sequence Number=SeqID_224204
atggaagaaaacatctgggcaatcattgaccagtataaagagaagctaaatctagctgctggccatgaacaaagactggaggacaagtatgtaaaagtatcggctctgcaagcgaaaagggaagcaagggaaagagtgatagattcattacacggagaagctatgatgcggatggataggttcactttcactttgaatggaagtcaagagcttccaagattattagccaaagccaaggtgatggcggacgtgtacttagttcctgaggaagatcatggactttttgattattgtcagcatatgatcgagttgatgtcccacatgattaggaaggcatttgtatttaggctttga

SEQ ID NO: 107427 - DNA, 333 bp, Glycine max
  Peptide Sequence Number=SeqID_224205
atggaaattgaagagtgtagggaagaagaagacaaatacaagatttatactggtttggaaacaacccgtgcctacatccagtccccaagcaacctacggttcttgagatttctttcaaccttaaatagggtggttgggataccaaagaagcacttggaagagtgggcttcattcaatgacgttttagcactattggtgttcgaggtcgtcctctttccaaacgtggatgggctagcggatatagtggcgatcgacactttcctggcttatcaccacagcaaggaaagtttggtcgtttctattttggccgatgcctatgacacatttgactga

SEQ ID NO: 107428 - DNA, 375 bp, Glycine max
  Peptide Sequence Number=SeqID_224206
atggcatgcaaagaccgtggtggtctctcgctttctttgtcccgagactatcaatgtcccctttcccatccagagacaaacgagtctgatgagccaaacatagtcgtctgtttccctcgtcaaaagaccaaacgtctatcggtcaaggctgccgaagtttcccctgctatcccaagacaagcgagtggaagctacctagctcgcctgggcaagctgggcggcaaccacctcccttatttttgctataaaatggcatttggggctgaggggagagggttcagcactctgggtattcagaattcacttaaaatcaatgaaaagaagaagaaaaaaggagaaaatccaagtcgaggcgcttctgtatcgcctccatga

SEQ ID NO: 107429 - DNA, 153 bp, Glycine max
  Peptide Sequence Number=SeqID_224207
atggaagtcggctgggagctctgttgcaaatgcaaggaacagggagctttagatggcatcagcttgatggcatcagcttgtaagcctgctgcaaaccacatgccccctcgagggggcaaccggctaaatgctgtcatagatgaaagggtctga

SEQ ID NO: 107430 - DNA, 1162 bp, Glycine max
  Peptide Sequence Number=SeqID_224208
cgatgcaaagctttgcaacgaaaccactgcacagcatgcaatcaacacgtccgagctgagcccgaccatgggcttgaagcgaaaagaaggggaagctaatgacgtgggcttccagttcggcaaagcaccggaatttggatccggggatcaaaggttcgacccctttcttcccagcaaaactggagtctggatagctcagcaggccctcctctgggagagattgcgttgcaacatcgcgtgcattgccttgcaatgttgcaatgctttgcttccaccgagaggccttggaggcgtggccgagaggcttaaggcgtgcctcatcgccccactctacccagacgtgccacgagagcaatctgtggatgcggagctccggggaaaatgtaatcggaaacgcggcaaagccgcgcaaagagatgctagaggtgtctacacgcagatagatggtagcgatcacgcccctggttttggcgtgtcaatgaggggagccaagccatcggagtatagacagacaggcgttgttgacatatctaccccctcgtgggccttgctccgcacgggttgtgtggctcttgccacatcccatcgaaccccctttaagaggcaaaggaccgaaagaataggggaagcaatgcaccaatcccgtccccccagctggctcaggcagaggagctctacagagactgcagctctgaaagagagacaacctctctctggagttattggggaagacttgtcaaatctggggtgccatctggcaaagctggtgaaaacatcgctgaagggacccccagaggggatccacttagatttggaatcccagcattgtcaagttttgatttccctatctccgcatcttgctttcaatgcatttaagagactccgtgcagagtcttcaatgggtctagtttgcatcattcactggtgcatagagacaaacaagctccctgcaccctttttggataagtctatccgaaacggagccccgccaagaaacggggcgagccctgctacatggttaccgccccttccattgccgcgcaataaatcccctcatgcccatgctcatgcccgtgctgggcaagcgcagcaaggggggtgtccctcaagcgccaaaaccgttctcgccgagcggttcgtccctcaaggcctttggccttga

SEQ ID NO: 107431 - DNA, 522 bp, Glycine max
  Peptide Sequence Number=SeqID_224209
atgaggattgatcctcaagagtttattgcccatctttgcatccctggtaagggttttgttcttaatacagagggccatccttggaagcttctaaggaaagatctcaccactcttgcacagacatggagtgtcctctcctacagtaacctgactcccacttcccacacctctaatcttaatatggagagagccaggttggtttacggcttagtcataggcatgtacatgaacatcggagccataatctcaggggtcaggaaggtaagggctcgaccagcaaatgttccttcttcttctgcaccaccagctcctcccacttctgccacgccaacaccagctgcccatgactctcaatgctttgaagccatgcttcagagtattcatcagggacaaattttattactgcagagcctacaggtggtagctcctccagggtccattctgtcggtagaacagttcattgagaaggtatcctggcctggaaccgttgatgcaatcctatcccccaagggcattggatag

SEQ ID NO: 107432 - DNA, 682 bp, Glycine max
  Peptide Sequence Number=SeqID_224210
atggcacactgtgctttgggcagcgtcggcggttttgcgttacagctcaatcagcggataaacgccggacagcagcggtcggcagagaattttgtagccgtcatggtcgaagccgtgacgcgcacgctgcagctgacgcgcttcctgctcactgctgaccgatcccagccagaaccagtgatcgatgacgtgaatctgcgtcatctccgtcccgcgctccaccatacccaccgggccctgccacggccagcataccacgcgcagctgctccagccctgccagcaggcgctgctgatgcgccgccagcgccgcgccccggttgcaggcgctctaatcccagcaggccgtgacacaggcgcagctcatcggcaaggctttttagcttctctaacgcggcaaagcggctgcggaataatccgtacaggtcaggcgaagaggagaaatcgagatcgcgcgcgtacaccacctgcggcgcttattgaacagcggctgctgcgttttgatcatctgcgcttcgagcagctgtgcgcccacgtccccggcggtagggatccagctgacgcgtcgcgcctggcgcagcatgctggcttcatctgccgtgcgaaagtgcgccatcacccggctgcgcaggttgatactcttaccgatgtacagcggcaggttgtcgttatcaccgtggaaa

SEQ ID NO: 107433 - DNA, 694 bp, Glycine max
  Peptide Sequence Number=SeqID_224211
ggcaaactgtcaatggagctgttgtatgacctatcgtcgccctgtgctggccgctatttttgatatggatggcttactgattgattctgaaccgctatgggatcgcgccgagctggaggtgtttgccagtctgaatgtggatattagccgccgccacgagctgccggatacgctcggcctgcgcatcgatcaaaccgtacgcatgtggtacgaagcgctgccgtggaacggaccggatcaggccgaagtcactcagcgcattattgcccgcgcgctggcgctggtcgaagagacgcggccgctgttgcctggcgtagagcaggcgctgcagctgtgtcagcaacagggcctggcgattgcgctggcctcggcgtctccgctggcgatgctggagcgcgtgctggagatgttcaatctgcgtcactactttagcgccctcgcctcggctgaagcgctgccttacagcaaaccgcatccgcaggtgtatctggatgctgcggcaaagctgggggttgatccgctcaactgcgtggcgctggaagactcgttcaacggcatgatcgccagcaaagctgcgcgtatgcgttccatcgtggtgcctgccgccgaacatcgccacgatgcgcgctgggcactggccaatgtgcaactggaaaacctgacgcagctgcaggcggaacatctgtttaactga

SEQ ID NO: 107434 - DNA, 513 bp, Glycine max
  Peptide Sequence Number=SeqID_224212
atggccagtgccgactggtggcatctggtgccggctgcgctgctgacctgcctgctgccggatatcgatcaccctaaatcggtgctgggccagcggctaaagtggctgtcgcagccaatagcccgcgcttttggccatcgcggctttacccatagcctgctggcggtggcggtcagcctgtggttgtttcagattaacgtgccggccgactggttcctgccagcggatgtcctgcagggcatgacgctcggctatctgagccacattgtcgccgatatgctgacgcccgccggcgtgccgctgctgtggccgtgccgctggcgctttcgcctgcctatcctcaacagccagcaaggcaatcaactggagcgcgcgctgtgcctcgctctggtgggttatgcgctgtggttcccgcccggcatgccgtcgtttggcgccaacggctggccggagcagctgttcaacaacctgcagaacggcattggccggctggtgaacggcagtacgcgctga

SEQ ID NO: 107435 - DNA, 291 bp, Glycine max
  Peptide Sequence Number=SeqID_224213
atggtggtaacggtggcgaagtttgtgccaacgacaatgatgacaacaatcatggttttaaattgcagtccacaaccgcaatgtcaaggctcaccgcaatgcgaccgcaaccgcaaccgcagtggtggaaatagtggcaacggtgatggttacagtgatagtgctgtcaacgacaataatagtggtgatggtaataatggtagtgacaacaatgatcatggtggtcgcagtgatggttacaacgttggtggcgtgacggcaagagccgcattaatggaggtcgcacattaa

SEQ ID NO: 107436 - DNA, 654 bp, Glycine max
  Peptide Sequence Number=SeqID_224214
atgtatgacttatctccagggtttcactttgggttattggattggaaagggaatgtgaaccaaacatggcttaatgtgaataacccaaaacacattccaccttatccaggtgggcttaatttgcagcatagtgtggaatactggctcacccttgatcttctgtcatcaaacattgcgaaaaaattttggtcttgcaccgcaattagagtgcagaattcaagccacacggatgtggtttttgtgccatttttctcatctttgaggcattccaaaatccatgggaaggaaaaagttagtgttaacaaaatgttgcaacagagattggtacagttcctaatggggcgggaagaatggaaacgttatggagggatggatcatgtgattgtggaacaccatcctaatagcattctgcatgcaagaagaaagttgggctctgccatgcttgtgcttgcagattttggaagatacccttctcaattagcaaacattaacaaggatataattgctccgtatagacatctagtaagtactgtaccaagagctgggtcagcttcatatgaggaacgttctacacttctatatttccaggggacaatatctgggaaagatgcgagtttctcctactctaatattatctcttcaatgcatgcttaa

SEQ ID NO: 107437 - DNA, 390 bp, Glycine max
  Peptide Sequence Number=SeqID_224215
atggccttatccaaattttgccttaacgttgctggagataccccatcctcaaatcgcctctttgatgccattgtgagccactgtgttcctgtgatcattagtgacgaaattgagctacgatttgaagatgttttggactactcagaatttggcttgtttgtccatgcctcagattctgtaaggaaaggctacctgctcaatcttcttcgttcaatcaaaccagagaaatggaccaagatgtgggcaaggttgaaggatattacacagcactttgagtatcaatatccaagccagcctggggatgcagtgaatatgatttgggaggaagttgcacaggaaaaacagataccagagaccttagcttcttgttatgatccactgaaatactaa

SEQ ID NO: 107438 - DNA, 918 bp, Glycine max
  Peptide Sequence Number=SeqID_224216
atggagtctcagccacttatgggttggagctctttctacgaaatagatgaagaaccatttccatttacgtgccaattttcttacagcggaaacagtgaagtgtatccctcactggattggccctacgattttcccatacaagactactatattgatgctgttcctcttatggattattacccttcagatcctttatatgaaacactcactactgaaccaacacaaagcgtgcaagattatgatttttatgacattaaaaaggggctacctttctggaaggaagtggatgctgtgtttgattcacaaaaagtatttttatttggcaacaacgaagaaagtgggaccaagaaggaaatgatggaggatggaaaagttaacgacaaccgagggatagaagagagaatcagcggtagcagtagcagttgcagaatgttgtcaaggaagaccatatctcagtacttctacatgcccataacacaagcagccagagaacttaatgtgggcataacccttttgaagaaaaggtgcagagaggtgggtattagaaggtggccccacaggaagctgatgagcttgcaaactctgataaacaatgtacaggagctaggaaaagaggaggggagagagagtgaagagaagttaagaagtgcgatagagatattagagagggaaaagaaggttttggaggaaatgccggatactgaacttgaagacactacaaagaggcttagacaagcgtgtttcaaggccaactacaagaagaggaagctcacagtcacagggcgggggagggaaccacactcttcttctttcagtggctttgttgctagaagtattgttaacgcaacgggagaatatagtaatgaaagtgaagaagaacgagacatcaagtatctgttgtctcagtttctggagtag

SEQ ID NO: 107439 - DNA, 1698 bp, Glycine max
  Peptide Sequence Number=SeqID_224217
atggcactagaaaccgtgatttctgctataaaatctgtttcccacaaaacccgtttgcttcaaattcacgctcacattatacgcacgaccctcattcaataccccacagtttctcttcagttcttgtcccgcatagctctctctggccctctgcaagatgccagctattcccagcgtttctttgggcaactcagccaccccttggtttcccattacaacaccatgatcagggcctgttccatgagtgattcaccgcaaaagggactccttctatatcgagatatgagaagacgaggcattgctgcagaccctttatcttcttcctttgctgttaagtcttgtataaggtttctgtatcttcctggaggggttcaggttcattgcaacatcttcaaagacgggcaccaatgggatacccttttgctcactgctgtcatggacttgtattcactatgccagagaggtggtgatgcatgtaaggtgtttgatgagatgcctcatagggacactgttgcttggaatgtgatgatctcttgctgtattagaaataataggactcgggatgctttgagtttgtttgatgttatgcagggttcgagctataaatgtgagcctgatgatgttacttgtttgcttcttcttcaggcttgtgcccatttgaatgccttggaatttggagaacgaattcatggttatattatggagcgtggttatcgggatgctctcaatttatgtaattctctaatatctatgtattcgcggtgtggttgtttagacaaggcttatgaagtgtttaagggaatgggcaataaaaatgtggtttcatggagtgcgatgatttctggtttggctatgaatggatatgggagagaagctattgaagcatttgaggagatgctgagaatcggcgttctgcctgatgatcagacattcacgggtgtcctttctgcttgcagttattctggaatggttgatgagggaatgtcatttttccaccgtatgagcagagagtttggagtaactcccaacgttcatcactatgggtgcatggttgatctcttaggccgtgctggcttgcttgataaggcttatcagcttattatgtcaatggtggtgaagccagactccacaatgtggaggaccttgcttggtgcatgcagaattcatggccatgttacacttggtgaacgagtaattggacatttgattgaattgaaagctcaagaagctggggattatgttttacttttgaatatttattcttcagctggacactgggaaaaggtagcagaagtgagaaaattgatgaaaaataaatcaatccaaaccacacctggttgtagcacaattgaattgaaaggagcagtacacgagtttgttgtggatgatgtttcacattctagaaaccgagagatttatgagacactggatgagattaatcatcagctgaggattgctggttatgttgttgaactttcatctgagttacataagatggatgacaaagaaaaggggtatgtgctctcccatcacagtgaaaaattggctgttgcttttggggttcttgctactccacccggcacaatactgagagtggctagtaatctccgcttcttagggaccataatcggtttcaccacttccggggagggcgctgctcatgtagcgactattggtagggatatcatgagctgctga

SEQ ID NO: 107440 - DNA, 1107 bp, Glycine max
  Peptide Sequence Number=SeqID_224218
atggacttcaaccttgcattagtgattgtagtaaccaccattttgggaattgggcttcaaggatgcgatagcaaggttgtgcagttcatttttggagactcactttcggatgttggaaataacatgcatctctcaagaagccttgctcaagcaagcttgccttggtatggtatagacatgggtaacgggttacctaatggaaggttcactaatggccgcacagtttctgacattataggtgacaatatggacctccctaggcctcctgcattcctggacccatctgtaaatgaagacattatacttgaaaacggtgtgaactacgcttctggtggtggtggcatcttgaatgaaactggcgcctattttatccaaaggttttctctggacaaacaaattgagctgtttcaggggacacaagagttaattagagccaaaattggaaaaagggccgcgtacaagtttttcaaggaagctagttatgttgttgctttagggagcaatgacttcataaacaactacttgatgcctgtttacactgattcatggacctacaatgatgaaaccttcatggactacttaataggaacattggaaagacaactaaagctacttcatagtttaggagcaagacaactggtggtttttgggttgggtccaatgggttgcattcctcttcaaagggtgctgactacaactgggaattgtcgagaaaaggcaaacaagctggctctttccttcaacaaagctgcaagcaagttaattgatgacttggcggagaattttcctgactcaagctataaatttggagatgcatatgatgttgtttatgatgtgattagcaatccaaataattatggattccaaaacgcagactcgccctgttgttccttttggaatattcgacctgcccttacatgtgtacctgcatcaagtctgtgcaaagatagaagcaaatatgtcttttgggatgagtaccaccccacagacagtgctaatgagctaattgcaaatgaactcatcaagaaatttggactttcaaatactaatcaagggggtgcaccttcaccagcacctgctgttgctccatctccagaagaccgatga

SEQ ID NO: 107441 - DNA, 1422 bp, Glycine max
  Peptide Sequence Number=SeqID_224219
atgcacgaaattagagaccctgcaattaggcttttcggtcagaagatccctttccctgaagatgttgttgttgacaaagaagaaaaagaaatagaaagtggcgaggaaagagaacaagagatggaaaaatatgaagaccaaggacacaaggatgctggagttgaaaatgttactgaggaagagctagaagttgatcctcctccaaatgctgaagagactaagaattcaggctcatcccctgaggctattgtgaaccccaaaacaccttccatagaagaagaaacagaaaaatcaaaaggtgacaaaacagagaaggaacaaggtgatgcagccaactcacaagagaaaaccctgaagaagccagataaagtgctaccatgcccccgctgcaaaagcatggacactaaattctgttactacaacaactacaatgtcaaccagccgcgttatttctgcaaagcctgtcaaagatactggactgcaggtggcaccatgaggaatgttcctgtgggggcaggacggcgaaagaacaagaactctacctcccattatcgccacatcactatctctgaggcccttcaagcagctagaattgattctcatcttccacctttgaaaggcaatggtagagtcctcagctttggattagatgcacatgcacctatttgtgattccatggcatctgtcaacaatcttggagagaaaaagcctctcaattgcacaagaaatgggtttcatcatggctttgaggatcaaagactcccccccgttccttgcaaaagtggggaaaatggtgatgactcttcaactacatcctccatcacagtttcaagttccaagggagaaaataacaaaaacaccttccaacaacaatcagtgccccaaaatcatggtttccttcctcaacttccatgtattcctggtgtttcttggccctatacatggaattctccagttcctccacctgctatgtgtccttcaggatttcccctaccattctatcctgctacattttggaactgtggcatgccagggaattggaatgttccattgttttcctcacattcatctgcttcaaacctcgagtctcgaagctccagtccaaattctccaactttggggaagcactcgcgcgacggtgacatgattaagcaatactctttgcctaaagaagaagcttcaaagccaagaaacgggggtgttttggttcccaaaacgttgagaattgatgatccaagtgaggctgcaaagagttctatatgggcaactctaggaattaagaatgagtcagtgagtggtggaggtatgtttaaggccttccaatcaaagaaaaatgaaaagaatcatgttgaagcctctccattgttgatggctaaccctgcagctttatctagatccctcaattttcatgaaaactcctga

SEQ ID NO: 107442 - DNA, 336 bp, Glycine max
  Peptide Sequence Number=SeqID_224220
atggtagcatctcctccatctaaagctgcagctccagctccgatggctacacctcccataaccacccctcttgcggctacaccatcgaaaggtcatggagttcctcctccgcagttctgtcctcgattctgtcatcaagaaaaccctaaccgccctccctctctcccccgtcgaaccacgcctcaagaaaaccctcctcctccgcacccttcaaacccacatccgtacaaccacaatatcggcaaaaagcgtgggatctctggtttccgaaattcctatgctgagcgtgctgaattttgtggaggagaagtttttgtgctagcgagggtgtgttga

SEQ ID NO: 107443 - DNA, 1011 bp, Glycine max
  Peptide Sequence Number=SeqID_224221
atgggaagagttaaattgaagatcaagaaattagaaagcataagcaatcgacacgtgacttactcaaagcgaaaaagtggaattattaagaaagcaaaggaattgtcaatactgtgtgatatagatgttgtccttcttatgttttctccaacaggaaaacctacattactacaaggagaacgcagcaatattgaggagatcattgcaaaatttgctcaacttagcccacaagaaagagccaaaaggaaaatggagagccttgaagcactaaagaaaacctttaggaagttagaccatgacgtaaaaatacaagatttcttaggttcaagcagtcaaacaatggaggaattatcttaccaagtcaaggttttacaagctcagatcacagaagtacaacagagactgagctattggaataatctagagaagatcaacaacttggaacatcttagacaaatggaagattcactacgggaatcaatcaatcgagtaggcctacaaaaagaagggatggcattaccttcgatgatcgcaagtctacaagactcccaaccattgtcttggcttttgaatgacgataatcatcacttgatgttacccaacgagccaaaatttcaatcatttagtgataataccaatagagatgttgagtgttcaactgacatttcactcccaaactattctggatatattgggagcaacaaatttgaagttggcagctctccccaagtcactactttgggtcaaggaggtggtgccatgaatgagttaaatggaactactttcttaaatgtacaatgttgtgaccagtttgcataccctcccccaccagatatcgaggaagtgaaacaattccctacaatggacaataaatcaaacactgtggattaccaagttcataacaactttgatcttccaagatcattgtttgaaaatggacatcagttttggaattctgcttctgggtcttgtgggatagccatgtttaacgagaacaactaccataagtaa

SEQ ID NO: 107444 - DNA, 198 bp, Glycine max
  Peptide Sequence Number=SeqID_224222
atggcttacaggcaacagctaatcgttcaaagggtaatcgaacagatatctccaaagctgaacttattcagaagagttcttattgcagggtttcagatcgtgatatggattttctggaactgtcggcctatggcaatgtccggcatggaccagattctagggggtgtagaatccaatgaacatttatctccatattag

SEQ ID NO: 107445 - DNA, 123 bp, Glycine max
  Peptide Sequence Number=SeqID_224223
atgaagcagtcacagggatgctatgcaaaccttcaaagtggagccagaaaggttaattatgaactcatgtggaaggcttttcaaagaagcattagcattgaatggaatgaaagtagtgcgtaa

SEQ ID NO: 107446 - DNA, 1682 bp, Glycine max
  Peptide Sequence Number=SeqID_224224
cctctgctgtttcattcttcaacggcaattcggtcatgaggctctcctctcatcgcggcgccttgcttacgaacaatgttttggagacgtccaagtctaaggacaagagcagcagcaacaataatattatattggtgagcgagaaacttggtgaagcagggcttaaagtgctacgcgaatggggcgacgttgaatgcgcgtacgatctctcacccgaggagctctgctcaaagatctcatgttgcgacgctttaatcgtgaggagcgccaccaaggtcacaagagaggtcttccaagcttccaaaggaagattaaaggttgtgggaagagctggtgtaggcattgacaacgtggacctccaggctgccaccgagtttggttgcatcgtcgtcaacgcacccacctccaacactgtcgctgctgcagagcttgccatcgcgcaccttgctgccatggcaagaaacgttgccagggctgatgcctccatgaaagcttccaagtgggagagaaacaagtacgttggtgtttctatggttgggaagacagtggcgataatgggatttggaaaagtgggatatgaagtggcgcggcgtgcaaaagcagcgttgggaatgaacgtggttgcgcatgatccctatgcctctgcggacagagcgagtgctattggggtccatcttgtgtccttcgatgaggccatctccaacgcggatttcatctctctccacatgccactcattccttccacccacaagatattcaaccacactagtttcgcaaagatgaagagaggagcgcgcatcatcaacgtcgcgagaggcggagtgatcgacgaagatgacttggtaagagccctggacgatggaacagttgctgaggcagcacttgatgtgttcacggaggagcccccggccaaagatagcaagttagtgaagcacgagaaagtgacggtaacacctcaccttggaggaagcacaaaagaggcacaggagggtgtggccattgaaatagcagaggctgtaatgggagcattgaagggggaactttcagccagagctgtgaatgctccagcggttccaaccgagctggtcgcagaactggctccatatgtcgtgctggcagagaagctggggcgggtagctgtgcagttggtatcagaatcaagagatgtgaaggtggtttatcgatcagctgatttggacactagacttttgcgagccatgatcataaaaggcctcattgaacccacgtccaattcagccatcaacttggtaaatgctgacttcattgccaaggagaagggggttcgcataagcgaggaaataatagctggcgtggaactaattgattcaatccagctacagatatcaaatgtaattagcatagagggaaaagtcaagtacggtagcccccacctcacacgtgtgggctcctttgatgtcgatgtgagcttagaggggaaccttatactgtaccggcaggtggatcagccaggtatgattgggcgcgttggaactatactgggtcagcacaacatcaatgttagctttatgagtttgggaaggacatgtcggagaaagatggctattgtggctattggtgtcgatgaagaaccaagcaaggaagctcttcaacatataggatcgcttcctgctatccaagacttagtctttctcaaactctag

SEQ ID NO: 107447 - DNA, 423 bp, Glycine max
  Peptide Sequence Number=SeqID_224225
atgggagcatctgagtcattgaatatgtcagtggcttttatttctgtcatcttgcttccaattgtaggcaatgctgcagaacatgccagtgctatcatgtttgccgtgaaggacaagcttgatatcactattggagttgctattggatcgtctacacagatatctatgtttgtgatccctttctgtgtagttgttggatggtgcatgggaaaagaaatggacttgaattttcaactattcgagactgccacgctttttatcactgtgttagtagttgcatttatgatgcaggaaggaacctcaaattattttaaagggttgatgcttattctatgctatctaatagttgctgccagttttttcgtacatgtagaccctaaaagtggtgagttaccgagaatatactgcatagattcacggtag

SEQ ID NO: 107448 - DNA, 204 bp, Glycine max
  Peptide Sequence Number=SeqID_224226
atggtctgcaccaagaaaactgggcagatgacgtctaaggccgcaaaggaaatcgctgagaagattgcgtcacagggttcatttgtcccccatggacatcaggatgtcctgacagctgtcattgggcgaccagaacaccctagccgtgtgtgtgctgttggagccagtgtcaccatcaagcaatacttcagatcggctccatga

SEQ ID NO: 107449 - DNA, 438 bp, Glycine max
  Peptide Sequence Number=SeqID_224227
atggagagtattatgggaaatatagtgccacaaggcaacatatggtgtagcagaaaaaaaaagatagaccctaagacaagtcgttgctttttcattagatatccagatcacgctaaaggaaacaaattcttttatctaggtaaggagaacaaaattgcaaagtccatgaatgctaagtttttggagcttgatgtgatagaccttgttgttccatctgatgatattgatgtcgagttgtgtgagactgtttcttttccactacctattccaattgttagtgtttttaatattgttccaattgagaccgtggttcagatcatcctaactgagactagggtcccaattgttccagttgagaccacaattgtgattggagatatagttagctctcaagccaatgatatgcttaatcctcctactatgaatgagaatgcataa

SEQ ID NO: 107450 - DNA, 528 bp, Glycine max
  Peptide Sequence Number=SeqID_224228
atgacgcgaacagaagaagagacagagaaaaagatcaaggtagaaaaagacactaggagtataggcacgagcgataacctccataagaataggaactcgcctaacaaatcagagatgcaccatcacaatgaagtctcccttctattactttcatggatagaaacttcaagggtatcaatgccatcaacttggatgaccccatggttgtctccatcatcatcaccaacttcatggtgtccaaggtcctcatcgactagggtagctccactgacatcctatattggaaaacattccaaaggctcaaagtctcgcccgccattgtccaccttcatgtcgactcactccttgaccgtcaaggcagatcaaaagcaagcaccacaatgctatgcggaaagcctgaaggtggaaccttatcctaacaccaaggagcctaccaaagcctcaccccataatttgagccctgattgtctacccgattgtctaccaaataagcttggacgaccaattcgatatagatatgcgcgatga

SEQ ID NO: 107451 - DNA, 1608 bp, Glycine max
  Peptide Sequence Number=SeqID_224229
atggcgtctatgccatatacccttagacttgttgactctagtacactgggctctaaggatgactctattggttgcctttgcatgtccgttggtctgaggatgttcaatagaggtgccattgttgatgacaatggcatacgggaggccatacctacatatgaggtgtctccaggtgaacttttccacctcgttggcaataatcgattgtatttcttgaagatgggtgtgtggaatgtctgtaaactcttggcatcatctacatctctttgtgatgtcaagggtgtcttccctgagtgttggccattagtagccatcatgcaccacctttgttgccagcattttaacaaggggggtcatccagtctggtttctgctcttctccggccataacttcttcagtgtctatgttgggactttggagtgtttcctagatgatagtcttgaggtgcctagtctttttaatgctaaccatcttggagagcaagtctactcttcattgtctccttggtctagtatctattggcaacttgtccctggacaagctgctttgaagttgagtttgagggcttgctttagggtaacattgtcgaggccttcgaggatgattccttcccccatttcctttcacgctagacgcaccgtcaatgtagaggctccaccaatccgggttggtttggtcgttcctagcaaattctgccaggaagtctgccacgtgttgggctatgatttgagatttgacgaccatatcatcgacatagactttgatgtcaaagggtatgacccagtagaaatagttgacatcttcagtgatgaatgttgttttctcctcgtctggagcgtgcatcctaatctggttgtatctggagacatcaacaatgtgtctgtgctcatggctagtgaggtccttactgagctacgtacatggcccaggtttgggtccaagctgcaacttgacgagctctttgataggctctgggcctctgtcagaagtgtcatcgcgcatatctatatcgaattggtcgtccaagcttatttggtagacaatcgggctttccgcatagcattgtggtgcttgcttttgatctgccttgacggtcaaggagatgtcagtggagctaccctagtcgatgaggaccttggacaccatgaagttggtgatgatgatggagacaaccatggggtcatccaagttgatggcattgatacccttgaagttatcgctcgtgcctatactcctagtgtctttttctaccttgatctttttctctgtctcttcttctgttcgcgtcatgactcctatgttgctcctattggtgtcctccggtatttggtcgcctctaagttcgacctgggaggtttcatcagaggtaacttgatgggtacctccaagttgaaatattcctcaaggattatactcgattggtctcttggtgcttccttctcgcttgtcattcttttgtttggtttgtctgactttgttcctgaatttggacatttcttccatctggatgtagcccttggcttatttgtgcagcttgtccatgctacaaggagggtgtttttcatagattgtccacaaacttgtcaagctatagagcgaggagcatag

SEQ ID NO: 107452 - DNA, 246 bp, Glycine max
  Peptide Sequence Number=SeqID_224230
atgactcctgtcataaccaagatccgccactacataacgcaagaaggagataatggtgaaaattctgatgaggaggaagaacatgaattaactcaatgggaggcaattatctggcttgctatcttgacagcatgggtatctatattgtctggataccttgtagacgccatacagagccgtaaatacaaaaccaagttattaatccaagaatcaggtggtgacaactcaagggtgataaacatttga

SEQ ID NO: 107453 - DNA, 1212 bp, Glycine max
  Peptide Sequence Number=SeqID_224231
atgggtaagaagcttgatgctctccttggtagaaccttcaaggtatcaaagttcaaggctattgttaaccttgccatctcacgcctagctgttctcaagaaccagcgccaggctcgccttagacatgcccgttctgatgtccttgaactcctccaacttggccaccaagaacgtgcttcacttcgagttgagcatgtgatcaaggatcagaacatgttggatgtgtatggcaggattgaaggatacttcaacctcttgatcgaaagggtccacctcattgagcaagagagagaatgtcccgaggaactgaaggaggcagcatcgggattgctctatgcagcttcaaggtgtggagattttcctgagattcaacagattcgtgtaattttgacatcacggtttggcaaggagtttgctgctcgatctattgagttgaggaacaactgtggagtccatcctcagatgatacagaaattgtcaacaaagatgccaagcctggaaagcagaatgaaggtactcaaagacattgcttctgagaatggtattgttctgcagctcgaagaaacttctgtttcggttgaggaacaatccagtgtagaaaagcaaaaccaacatgaacctgagaagaaggaagagaatgtaagcattttgcctagcagggggaaagatgaaaagttaattgattcctataagggaagaaaaacgtacaaggacgtagctgatgcagcacaagcagcttttgagtcagcagaatatgctgcagctgctgcaagagcagcactggaactctcccgatctgaatcacatgatcccgatgatcatgatagcacaagactccaaccaagaaaagtggaggaaggacatgatgtgagacctcaaatggaagaaaaggaaatcctcagtgaaactcaaagagaagatgagttaaaaaagtcgaaagacattataagttgcaattcaactgatgaggttttgaagggggctactgccttggtggatggtgaaattgaggctgatcctttggaaaaggaagtgattttcgatgatagtgatgatgagaatgataataaacagaatataaatcaatcttctaagcagacatcttcagggtatggtgctggtatagtagtaaatacagtgccaggatccaagatgcagaatgcgcctcagttggatttgcagaagaggcctatttcagtgaggactagatga

SEQ ID NO: 107454 - DNA, 1122 bp, Glycine max
  Peptide Sequence Number=SeqID_224232
atgaagctcaccgtgaagactctgaaaggcagccatttcgaaatcagggttcagccctcagacactattatggcagtcaagaagaatatcgaagatgtacaaggcaaagacaattacccatgtggacagcaattgctcattcacaatggtaaggttttgaaagatgaaactactttatccgacaataaggtctctgaggatggttttcttgttgtcatgcttagtaagggtaaaaccttgggatctgctggcatttcatcaactcaggcatgttgcttgctcatttttgctagcaacccacctacaactgtatcaacaccaaattccacgcctctagttcaacctcaatctgcaaacaacaatgcatctgccacagatgtcacaactacaaatgtgactacaaatacttatggtcaggcggcttcaaatttagttgctggtagtaatctggagcagactattcagcaacttatggacatgggtggcggcagttgggacagagatacagttacttgtgctcttcgagcagcttacaataacccagagcgtgctgtagattacttgtattctggaattcctgtagcagcagaaattgctgtgccagctgcttcttacccaatcagtcagacaacagaaacaggtggggcctctgtcggagctgttcctggggtccctaattcatctcccttgaatatgtttccacaggaaacaatttctggtgctggagctgaaattggatcgcttgactttcttagaaacaatccccagtttcaagcattacgctcaatggtgcaatccaatccgcaaattctgcagcctgtacttcaggaacttggaaagcagaatcctagtctcttaacactaattcaagagcatcatgctgaatttctccagttgattaacgaacctgttgagggttctgaaggtgatatatttgatcaacctgagcaagatatgcctcatgccatcaatgtgacgccagcagagcaggaggcaattggaaggcttgaggctatgggatttgatagagcctcagtcatcgaggcatttttggcatgtgaccatgacgagcaattggcagccaactacttactggaaaatgctggagattttgagggttaa

SEQ ID NO: 107455 - DNA, 1629 bp, Glycine max
  Peptide Sequence Number=SeqID_224233
atgacgaagttgttatcaccttcagcaccaccatgtccatgtctaagggttccaattccaaatccaaccgtaaaatatcgatatgcatacagtcacagagggcaattgcgtgttcgatgcagtgataatagtgatgaagagaaggagaaggagaagaagaagaagaaggaaaagcggttgtctcagcagtcgtcgtgggaagcccaagacgctgagggaagagactatctctaccgacttgggaaagaggctgataacatgaacatcgccgtcggccagcgtgctggcgtcatcgattctcttttcgccggcaattttctcggcaaagattcggacattgtctttgattatcgtcaaaaagtgacgaggtcctttcaataccttcagggcgattattacatcgctcctctcttcatggacaaagttgtatgtcacattgtgaagaactacctagctcgtgtcctcaacactaaagttcctttaattctaggtatttggggaggaaaagggcaagggaaatcatttcaaacagaacttatatttcaggctatgggaattgaacctgtaattatgtctgctggggaactagaatcagagagagctggagagccaggaaaattgattcgtgaacgctatagaacagcatctcaagtggtccagaatcaagttaggagttttaaagttttcaataatattccatgttttatggaaattgaaccctacaatcttctcttctttgtaagaattggagtaaagttagatttgaaaaagccaagggagaaattgcattggaacttgtgcttttcagtggaaagtgctagaattgattttctaatgggaaaaatgagctgtttgatgatcaatgatattgatgctggccttggtagatttgggaatactcaaatgacagtcaacaatcaaattgttgttgggactcttatgaatctgtcagacaatcctacaagagtaagtgttggtcaagattggcgagaatcagatgtcacaaacagaattccaatcattgtaacagggaacgatttttcaactctttacgctccactgatacgcgatggaaggatggataagttttactggcaacctaaccaggaagatatccttaatatcgttcacagaatgtatgagaaagacagtatatctagggatgaagttgaaagggttgtgaacactttccctaatcaagctttggacttttatggagctctaagatcacgtacatatgacagatctattttaaaggaatgtttccatggtacaagagtaagactaatgcaaatgcaactatctagtatctacagtactttactttactttgtaccccattgcccagaggctcttcgctatgcgaaggtatgggggagggatgttgtacgcagccttacccttgcatatgcaaagaggctgtttccgtggattgatgatattggaggtgttgaaaattttggaaacaaacttctcaagagaagaaaggaccaaagccttcctgtatttattcctccagagcaaacggtggatgctttacttgaatcgggttattctctaatcaaagaacaacggttgataatggaaactaaactttcaaaggaatacatgaagaacatagatgactaa

SEQ ID NO: 107456 - DNA, 543 bp, Glycine max
  Peptide Sequence Number=SeqID_224234
atgtttgaaagggaagtgaaagggatgttttcttgctttaactccagacagataaatgctgatggaccagtcgtcacatacattgtccaggaacaagttgaagttgagggaaatcagagagatgcaagagattacgaggtgtgttataatgaagctgaaatggaggtcctttgcatctgtggtttgttcaatttcagaggctgcttgtgtaggcatgctttatttatcttaagccaaaatgagataaaagagatcccagctcagtacattcttttacgatggagaaaaggtatgaagcgtggcaatgtagatgatcacaacggtagtggcattgattttagtaatccagttcataggtatgaccatttgtacaggacaggctgtgaaggttgtagaggaaggaataaacttcgaataggagcttcccaaatatctcctaaccgggcaatcaaggaaaatgacacctttactcaaacgccactgtccacaccggcaagaatggaagtcaaaatcaactttgttcagatgagggaaagcccgtaa

SEQ ID NO: 107457 - DNA, 1905 bp, Glycine max
  Peptide Sequence Number=SeqID_224235
atggcaaaaaggagtgaagagctaggattaagcttaatgaacactgattctgctaaccatgacaggattcctggtggttgccacccgaatgatacaaccgcccctctgcctctggtttcaccatctcctttcccccactggaatttgcatgaaacatctcaacattataacaatgaaccagctggagttaattcaatgattgattcctctcagttcagaagttatcagaatttccagatggaccataattactcacacagagcagaagaacataatttccttccatgcagaccagattctcgttttccatgtccagaaggatacatagggtggccatatcaatatgacaggcacaataatctagcaatcccttccaatgtgaggaatgcttccttcaatctaaataattttgagaagcctgacaatggtgggatgtgtgtgaccccaatttacggttcggctagcaggctacaaatggtcaaccctactggaacagcaatgagtgctaatattggtcagccttcactagatatgaattcgggaatggctctgtgtaatccaaatcaaggttgtgtagaaccattgcttacaataggaaaacatgatgaaagatatatgaccatgggttctggaagtaataacaaagagtccaaatccagtgctgtaacaccaaaattcaatgtgactggtaattctgagagggcatttcttcctccaatcaattcatatcacaatcatctgggtagcagaagttccttaaaccctggttttgacatgaatgacaccttttctgcttttcagaatgacagtggattcatatctgatttagctccttcaggcaatcatgaagctctgtttgattctatacctggtttacggttggggccatcatatgcttttcaatggccagctgctggtgagcaaaaccgttatttagggcagttcaacagggatttaggtcttgcaggtgtgaaagacacaagtatggaatttacagatgtaggtctcacaaatggccttgaaagatgcatggatctaaattcattgccaattgttggcagtcaaactatgccttttgaaagtcgacagagctgggcgaatagacagctagttccctcttcaagtggagtagtaactgataatttgcctactgagatgttacctaaaaataatgataagttctcatcacagtttttttctagtcctcctttagctgtggccactagaagcaccagagggcaagatctttcaagtaatcctggtcaatcacaggcaggtggttctattcagcaatcaaactctcttcttcgaccacaatctacttctggaatacaatccggaatgggatatatgactgctcaagtttcaaggccatccaacatgtcatctctaaagagagctgcttcccaaccactgtcatccactgtccagaatcaacacaggaagactctaccaactcagttcatacatccatcaattccaaattggaacagattggctccatcagtcccaaatacatcccgagcaatgtctcccttgatccgcccagcccaatctctcacagcccaagctcctcctcactctgttgttcctccatcattcccgacgacttggactaaatctgttcttcaagccccaaacacaacccgggcaattcatcccaaaatgcacacagctacatttcttgcacctaatgacaagagaatctcttctttccaccacccctcatcccatacttcacctcgtacaaaccaatctaaccatcaaatgttggctcaggctttggctcaccaacgtttgaaggctccaattataccatctgctccccgcattgcttccaattacattaaatttaaagagcatgatgttgttagatttcatattccagtgaaattgctcaattag

SEQ ID NO: 107458 - DNA, 3395 bp, Glycine max
  Peptide Sequence Number=SeqID_224236
atgaaagcgaaggacttcaactcttcaaacgcagcagaaggaccagaattattactagctggtacaacaatattaatgaaaggtcttggagtaggaggagctcttctagttcgtcctggaccgggttcaggagttggtggtggtgctgagtgtcgacgtggatgtgttggtggccttaaactcactttcctcagagttgctccaggggaatccggtgggaggaagaaggggtttgataggaaggttttgagtggggttgtgattggggttgttatggtttttgggggtggtggtgatgactttgggttggaggaggagaaggaagatgggtttgtgccggtgccgagggtcaacattctggcagtgcagattggtgcgattgagccttctgccactatgaatggttccacggcctatgatttcagtgctggacatctcaaccttgctctcgcaaatggaccctatgattggggttgttgcggttttaggggtggtgatgaagaagaagagggtggtggaagaaaaggggatggaggaatcaaacaacctcataaagctgcccttctggaattcagaaaaacaatcatatcagacccgcattcctcacttgctaactgggatgaagctgttcatgtgtgcaacttcacgggtgttgtatgtgacaaattccataaccgtgtcacacgactaatcctgtacgataaaggtctagtggggctgctttcacccgttctttccaatctcactggactgcactaccttgagattgttcgcagtcacttatttggcattattccacctgaattttccaacctcagacgccttcacagcatcactctcgaggggaacaatttgcatggctcaataccagagtccttttccatgctttccaagctttacttttttatcattaaggaaaataacatatcaggttcacttcctccatctctcttttccaactgcactctgctagacgttgtggacttttctagcaactcattaactggccaaatcccagaagagattggaaactgcaaaagcctgtggagtatcagtttatacgataatcaatttactgggcaacttcctctctcgctgaccaatctaacgcttcaaaatttagacgtggagtacaattatctgtttggtgaattgcctacaaagtttgtaagcagctggccaaatcttctttaccttcatttatcatacaacaatatgataagccatgataacaacaccaatcttgatccatttttcactgctctcagaaacaacagtaatctagaggagcttgaattggcaggaatgggccttgggggaaggttcacgtacactgtcgccggccaactcaccagtctaagaaccctgctcctgcaagaaaaccaaatttttggatcaattcctcgtagcttagcaaacctttcaaggcttttcattctgaatttaacatccaatcttctaaatgggactatatcctctgatatcttctttagcttgccaaagttggaacaactttccttatcacacaaccttttcaaaactccaattccagaagcaataggcaagtgtcttgatctgggtctactggacctgtcatacaatcaattctcaggtaggattccagacagtttgggaaatttggttggactaaattctttgtttctcaacaataaccttctctcaggaacaatacctcccacattgggacggtgtactaatctgtacaggcttgacttgtcccataatagattaacaggaagcataccactggaactggcaggcttgcatgagatcagaattttcataaatgtctctcataaccaccttgaaggtcctcttccaattgagctcagcaaattagcgaaggttcaggagatagatctttcatccaattacctaactggaagtatcttccctcagatggcaggatgcattgctgtttcaatgattaacttttcaaacaattttcttcaaggtgagctcccacagtcccttggtgatctgaagaacctcgaatcttttgatgtttcaagaaaccagttatctggattgataccagcaacacttggtaaaattgacacactcacttttctcaatttatcatttaacaatctggaaggaaagattccatctggtggcatctttaattcagtttcaaccttgtcattcttaggaaatccacaactttgtgggacaattgcaggcatatccttgtgctctcaaagaagaaaatggtttcacactcgttcgttgttgattatattcattttggtcatcttcatatcaacattgttgtcaataatttgctgtgtaattggatgcaagcgtcttaaagtaatcatcagctctcagaggacagaggcaagcaaaaatgcaactagacctgagttgattagtaacttcccaagaatcacgtataaggaactttcagatgccactggaggatttgacaatcagagacttgttggatcaggtagttatggacatgtctacaggggtgttctcacggatgggacaccaatagcagtcaaggtgctgcatttgcaatctggaaattctaccaagagctttaacagagaatgtcaagttttgaagagaattagacacagaaatctgataaggattatcacagcatgtagcctacctgattttaaggctcttgttctaccatacatggccaatgggagcttggagagccgcctctacccttcttgcggatcatcagacttgagtattgtccagagggtgaatatttgcagtgatgtagctgaagggatggcctatttgcatcaccattctcctgttagagtcatacattgtgatctaaaaccaagcaatattcttctcaatgatgacatgacagctctcgtttctgattttggggttgcaaggctaattatgagtgttggaggtggggctattgataacatgggcaactctagtgcaaatttgttctgtggatccattggatacattgcaccagaatatggatttggatccaatacatctaccaaaggagatgtctatagctttggcattctagttctcgagatggtgactagaagaagaccaacagatgacatgtttgttggtgggttaagtctgcaccaatgggtaaagattcattttcatggaagggtagaaaaggtgatagattctgctttggtgacagcctcaatagatcaatcccgagaggttagaaagatgtgggaagctgctattgtcgagttaattgagttggggcttctttgcacacaggagtcaccttcgacaagaccaaccatgcttgatgcagcagatgacttaaatcgtctcaagagataccttaatggggacacaacaggaacttttgcctcatcacttggaatttcatcttccactgtaggtggtgactg

SEQ ID NO: 107459 - DNA, 273 bp, Glycine max
  Peptide Sequence Number=SeqID_224237
atggacaagaatgaaattggaagtcaaaaccctaaattgaagaagaaattgggagcatttgcaagtgacttgtgttgtgggatcataatgagtgacacattgcttaagattgatttccatggagattgggggaagcaaaggggtgtagagaaggtggtcatcctattccataatagctattctaaaataggttttttggatcatagtctttttggaggtgcaggaagcgaaataggaggtgcaggaagtaacatcccagctcaacccatttaa

SEQ ID NO: 107460 - DNA, 1344 bp, Glycine max
  Peptide Sequence Number=SeqID_224238
atgggaccgaatccgaataaacgggttgaagttgaacaggaaaatcggtggacgggtgaagtgaagatgcctgcggagatgttgatcaatgtgaagcaatccaccatggttcggccggcggaggagacgccgcggagggcgttgtggaactccaacgtggatttggtggtgccgaacttccacacgccgagcgtgtatttctacaggccaaacggggtctccaatttcttcgacgccaaggtgatgaaggaggctctgagcaaggtcttggtccctttctacccaatggccgcacgcctccgccgggacgacgacgggcgcgtggagatatactgcgacgctcagggcgtgctcttcgtggaggctgagaccactgccgccatcgaggacttcggcgacttctctcccaccctggagctccggcagctcatcccctccgtggattattctgccggggtctcattaggtgttggtatgcaacaccatgtagcagacggagcatctggtcttcactttatcaatgcatggtcagatgttgctcgtggcttggatatttccctccccccattcattgacaggacactactccgtgcccgggatccacctcttcctgtttttgatcacattgaatacaagcccccaccagccactaagaagactactcccctgcaaccctcaaaaccattaggctctgacagtactgctgttgccgtctctactttcaaattgacccgtgaccaactgagcaccctcaagggtaagtccagagaagatggcaacacaatcagctacagctcttatgagatgttggctggccatgtatggagaagtgtctgtaaggcaagagcacttcctgatgaccaagaaaccaaattgtacattgcaaccgatggacgggcgaggctgcaacctcccctcccccatggttactttggcaatgtcatcttcaccaccactcgcatagcagtggctggtgatctcatgtcaaaaccaacatggtatgctgctagcagaatccacgacgcattaatacgaatggacaatgaatatttgagatcggctcttgactatctagagctgcagcctgatctaaaatcccttgttcgtggagcacatacttttagatgtccaaatcttggtatcactagctgggcaaggcttccaatccatgatgctgactttggttggggaagacccattttcatgggacctggtgggattgcatacgaggggctatctttcataatcccaagctcaacaaatgatgggagcctgtcgttggcaattgctctgccgcctgagcaaatgaaagtgtttcaggaattgttttatgatgacatttga

SEQ ID NO: 107461 - DNA, 967 bp, Glycine max
  Peptide Sequence Number=SeqID_224239
atggcagatctcaaggagaggctactaccaccaaagcctgcatcagctctaaacgtaagagaggttgccaatcgaccatctgcctctggaaggcaagctttccaaggggtggatgttttagggctaaagaagcgaggccaaggtctccggtcatggattcgtgttgacacatctggaaactctcaggccattgaggtagacaagtttaccatgatgcgacgttgtgatctacctgcacgtgatcttcgcctacttgatcctttgtttgtctacccatcaacaatccttggtagggaaaaagctattgttgtaaatctagagcagatacggtgtatcattacagcagatgaggttcttctcttgaattcccttgatagttatgtattgcactatgttatggaactgcagcgacggttgacaacaactggggtaggggaggtttggcaatcagacagttctgacatgaatcgaaggagaggaagtaggaatttcgaaaatgtatttagtaactcttcccctgattatttaccttttgagttcagggctcttgaagttgccctggaggcggcatgcacatttctggattcccaggcagcagagttagaaatagaggcttatccgttgttggatgaactgacatcaaagatcagtacactaaatttagaacgtgttcgtcggttgaagagcagacttgttgccctgaccaggagggttcagaaggttagagatgaaatagagcagcttatggatgatgatggagatatggccgaaatgtatcttaccgagaagaaaaggcgaatggagttgtcattttatggagaccagtctatggttggatataaatcagttgatggtgcatccatttctgctccagtctctcctgtttcatcacctcttgattctcggaagcttgaaaagtgtttcagcattgctaggagtcgacatgagagcatgaggagttctgaaa

SEQ ID NO: 107462 - DNA, 447 bp, Glycine max
  Peptide Sequence Number=SeqID_224240
atgaggagttctgaaagtactacggaaagtatagaggagcttgagatgttgctggaagcatactttgttgtcattgatagcactctaaataagttgacatcgttgaaagaatacattgatgacacagaagatttcatcaacattcaactggtgtatgggacaatgacttcttattcccatagtgaaagaacagctgaccgaatatttttctcacaggataatgtgcgaaatcagcttattcagtttgagcttttactcacaactgcaacatttgtggttgccatctttggagtggtagcaggaatatttgggatgaattttgaaattgaattatttgatgtcccctctgctttccagtgggtccttataataacaggagtttgtggagtcttcatattttctgcatttgtgtggttcttcaagtacagaagactcatgcccctatag

SEQ ID NO: 107463 - DNA, 393 bp, Glycine max
  Peptide Sequence Number=SeqID_224241
atgtcaagaccgacatccttcaattccacattcacgatttcgttcaatattcttcctcgagatgcattcaagggagtgtacttgtcgtattttgacttgactttgaactcttacaaggtgttaggtagcatttttgaaatggatatgaagaaaggagatccttacctcacaccgtccttagctagcatcaatatgactcctacctgtaggttgtccacaactctcacttctttattaaatcatgagatgtatcctttgagcggttcctctagcccttgtcagaataattttaagtcggtctcctttagtctttctctgctagtttcaaaggcgggtctaaatttctccctcaaatcgagccatgaattgatggatcttgatgaaagagattga

SEQ ID NO: 107464 - DNA, 354 bp, Glycine max
  Peptide Sequence Number=SeqID_224242
atggagaagtgtgttgaatatattgatttgaacaagcattgtttgaaggattcatacctgcttcctgacatagataaactagtggacggatcctctgactaccaatatctaagtttcatgaatgcttattcaaggtacaatcaaatacgattgcactctaatgaccaggagaaaacaaccttcatgatagaaaaagcaaactattgctacaaggtcatgtcctttggattaaagaatgacgacactacataccaaaggatgatgaacaaagtttttgaaaagcagataggtcagaacctggaggtctatgtagatgacatgatagttaaaagcaacaccaagaacaacacataa

SEQ ID NO: 107465 - DNA, 198 bp, Glycine max
  Peptide Sequence Number=SeqID_224243
atgggcatttccatgctgcgagttatacctaaaggccacagggctcatgtgtgcgcatccacaagctcaaaagaatacgaagcacctaaatataaacttaggatgaacaaagtaggaagcactttacaagtccaaccttctgcatcttggtcgaaatttaaatcccctaaaactggtgaaacaaaacatactagttag

SEQ ID NO: 107466 - DNA, 1275 bp, Glycine max
  Peptide Sequence Number=SeqID_224244
actgtcagtgagcggtggagacagtttaaatctgatttgacgaggaaatgggcacttgtagccgagaaggacagtgtggacgacactgtttgtgaaaaatacggcattagtaaggagaaatggacccagttttgtcaaacccgcagagaaccctcgtggcaggatgtgcagaaaaaagcacaggccatccagaagcaaaacaccaccctccacgtgttgtctcgtgggggttatgaatatttagaacataagctgatagttgagaagacaaagaaaaaactggaggaagctactcaatctgtaagcactaacggcatgattgaccatccatctcccatcagacaacatgtgaagtggaagatgacccgcaccaagaaaactgggaagatgacgtctgaggcagcaaaggaaattgctgagaagattgattctttggaggagcaggcgtcaccagaacaccctagtcgtgtgcgtgctaatggagccgaactcgagcagctaactcaacaaatcagggaccagctggaggagtcgatcacagaaaaagtgacttggcagttgatgttatccttcagccagatgcagtctcagttgcaatcacagatccaatcacagggacttgcactgcatccgaagtctgaggttggtccttcagctgctcgtgtcagcataaaggggagttgtgttgatccctcagtggccgatccaaacacgggaagggtttatgagggatccacaacgattcacaacatccctttgttgcatggccaagtgaaagttggtgttgaggaggttaaagatgcagaggctcccattcctgtacccactgacgaggcagctgtgtctccagcaaaacctccagataggctggatcataaggtcgatgatcccctatatttgatgacattgaccatcccacagctttttttgaagtctctccaggttatgtgggatgctaccgtgttcggggtgtttaatgaagacttctcgttgcttctgactgagacaagtatacgagcggggaatttcgatgtgtatagattcctcgagccacagtccattcagagatctgggcaatcgcaatttgaatcagaaagttacatgaagagttggatgcagagttcaaaacatgatgtctaccttggagcctacctgaatggtgctttgaaaggactcgatgatactccacaacctaaatccaaggctggtgctaggtggattgttgttaaggaagcactgagtgcggctattacgtcatgcactggatgtccatga

SEQ ID NO: 107467 - DNA, 459 bp, Glycine max
  Peptide Sequence Number=SeqID_224245
atggcagaagaaattacaagttggttaaaagaaggcattttcatagacatggacatgtcaatcattccaaatcatgatggtcccctactagttaaaggctttataaacaacaaggaggaatctcagaatctcaccattggagttgcttccttaaaactaggatctcataggtttctttggtcaccacataactctatcaggatacgtgaactacaatcatcctacaacgccatattgggaagtccagccttgaatgcatcaagagcggtgatttcaatgaagatatcaggaaagggaaatgagcacccaggccaaaaccaggagggatttgtcagaatctccaaggtcagaaaaagagaagaacaaatgttatccattggagcgaacttggatagtgaaaccatggaaaccttatccacttttctaaatgaaaatgccattatatttgctaggaaatag

SEQ ID NO: 107468 - DNA, 219 bp, Glycine max
  Peptide Sequence Number=SeqID_224246
atggcaacaagattggcagtgagatcagtgacaatgacacaaagacatgaagcttacctggtaagttacaatgaagacatgaagcttagacgaaatgtacctaggtacgttggcgatggacaacaaaaagcgagcagtcatggtcgtcagcgcgatggagaaagcttagatgcagaacacggagaagaagagagcgcgagcaatgtaggtcgtgtatga

SEQ ID NO: 107469 - DNA, 1680 bp, Glycine max
  Peptide Sequence Number=SeqID_224247
atggatagagcagagcggagtttcaagagcttcagaacatttctgattctgactttcataaccttccctattttagtcacatttactgtcagacaccaaaactcaatttttgatctcatccaaggatttaatgccaagaatgctactactgatgccttaaaacaagggggtaaaaactcatttaatgagtcaactgtaggtccaaagaataattcagttgaagatgggaagaagaatgctctatccctatctactactaccaatattgctaatgacaaactccttgatggacttctagtttcctcatttgatgaagcatcatgcttaagtagatatcaatcttacttgtatcgcagagcttcccttcataaaccttctaaatatctgatatccaaactacgaaactatgaacatgttcatcggagttgtggaccttcaaccaaatcctacaacaaaatcatgagaaagggtgcaaaatttagcataaatgaaactagtagagaatgcaaatatcttgtctggacaagtgctaatggcttagggaacaggatgataaccttggttgcagcattcctttatgctatcctcacagaccgtgttctacttgtcagatatggggctgatatgattggtcttttttgcgagccatttcctgattcctcatggttattgcctaagaactctccttgttgggaagacctgaaacattttgaaacgcatgaaagcttgttaatgaataacaaggtaaacaattcacaggatgagcttttgccaccatttcttgctcttaatctaacgcacatccatgttggtcatactaatctttttcattgcgatcgaagccaagatcttctccagaaaattcccgtactgattttatggtcgaatcaatattttgtcccttctcttttcatgatttccttatttagacaagacctaagcaaaatgttccctgataaagacactgtttttcaccacctgggacgttacctttttcacccatcaaatgaggcatggaaactaattcaaaaatcctatgaggcacacctagccaaggcaaatgagaggattggcctccagattagagtatttaatattcatcatccaccgcatcaaaccatattcaatgaaattatagcctgcacccttcagaataagttgttgcctgaactcgacatgctaaactcgtcagcaacttctcctttgaagaagcagacatcaaaagctgttctagtagtatctttatactcagaatatggtgagaagttgaggactatgtatcaggaaaatacaactgtgaccggggatgtaataagagtttatcagccaagtcatgaagagcatcaaaactcaaatgacgacatgcacaacattaaggcatggactgaaatatatttgttaagtttatgtaatgcattggttacaagccccaggtctacttttgggtatgttgctcatagtcttggaggtttgaagccatggattttgcagggagtatatggcaaaaccatcccagatccaccttgtcaacgagccaagtacatggagccttgttttcaatatcctcctgagtatgactgtagggcgaataaaactattgattttccttccatttttaatcatatcaagcattgcgatgatgtatctagtggattgaggctggttaatgattatcactaa

SEQ ID NO: 107470 - DNA, 102 bp, Glycine max
  Peptide Sequence Number=SeqID_224248
atgggtataatcaggagtggcttctctttcatagcagggacaacacgagttaaaaggtcagatttcagatttcagatactcagtttcttgaatcttggatga

SEQ ID NO: 107471 - DNA, 1006 bp, Glycine max
  Peptide Sequence Number=SeqID_224249
atgccttcaagacccttccctcccacaaatcccaccaaaaccaaggccctcttcctagcactcaccatctcagcttgtgttgtgattttctgctcaatcctctacttcctctaccatctgtggcattctcttgttcacagagctaagaccatcccctttgatgcaagtgctcccttgaagctccaaagattctcatacaaagatttaaagcaagccaccaatggctttgacactgccaatgtaattggcaaaggtggctctggcactgttttcagaggaatacttaaagatggcaagttgattgccatcaaacgcctggacacgttgtctttgcagtcagagagagagtttcaaaacgagctgcagattcttggagggttgaggtcaccattcttggtgaccctcttgggttactgtgtggaaaagaacaaaagggtgttggtgtatgagtatatgcccaacagaagcttgcaggagtcactctttggagatgatggggggggtttgagtttgagttgggggagcaggttttgcataatgttggatgttgctagagctttggagttcttgcaccttggatgtgatcctccagtgatccatggtgatatcaagccaagcaatgttctgattgattctgagtggcgtgggaagatctctgactttggcttgtcaaggattaaggtggaaggtgagtttggtgtggacttgtttagccaggacttggggaggagccaggatctatggaaaagccaagagctttcaggtaatttgactgcagaaactcctcctgctcttggtactccagttgaaaatgttagtgaagtagattttgctctagctttgcaagcctcttcttcatctaaaaatagtaggacttgctttaatgtcaaagctttgaacttgaattctttgaattataatgccaatattgctactgaaactgaaattaggagtgtaaatgcgaagggtaaggaagtttcggctttggatagggatgattggaatg

SEQ ID NO: 107472 - DNA, 237 bp, Glycine max
  Peptide Sequence Number=SeqID_224250
atggatgatgagtgcgatactggtgacaaggcttttaccactgaggatgaaggaagcactggtcccatttctaagagggttaaggtaggaggttcatcgttatacaaagtagatagaaaacttgcgttagaggtagcattgaagcttgaacacagaagtagtaaggttttcatttatggatcaccttatgagtggcaagtttacaatgcattaggcattagccacggtgttccatga

SEQ ID NO: 107473 - DNA, 717 bp, Glycine max
  Peptide Sequence Number=SeqID_224251
atgaagattcattgcacttttttttcttcatggtttacagtttttgcggtcaacatagtgactgttgttatgattgttgtgcttggatttaatcagaagattggtcgtggatttcggctatcagattcccagatgacccttccagaaaaatttgtcctgaaccttataccagctgttggagcttgtctttcaatcgtagacttaatttttctgtggaagaaagaccacaatagtcactttgttggatatcataaatggttcaatagctgttctgagttgattttgtgggtttcagtctgcatcatggaaagcttagttgttctcttgaatatctcatttagcatagctatcaatgtgatccggataaagataccatctttcaaaagcagtttattggaagatccacttctttcgaatggagtagaccttgaggaaggtggctataatgaccttggaaataatggaaacttttgggatttgatgactttcaaattcataactccagtaatgaatcatggtgtgataaagcaattagaccctgaagatctgttgccgctacctactgacattggtccttcttcttgtcatgatgtgattttatcctgctggcaagctcaactgagtaacaatgattcgaacccatccttgtttagagcactctgtagtgcgtatggatggccatatctctgcctgggtttattgaaggtatttttctaa

SEQ ID NO: 107474 - DNA, 1080 bp, Glycine max
  Peptide Sequence Number=SeqID_224252
atggcgaatgcatctgggagtggattcttcacactttctgttgtgagggttcgacctctgacttggaaagtttcttgctttggaagcaacgctgagggtgcaagcagagatagcagcttgactagtttagctaggaaagctcttgagatggcaaaggtgattgagttgattgtattctttttggggattcttggacttcacttgagtgctgataacaccttgagaccttttgaaaaaaccaccgtcttgaaggccctctctatctcttatgttactaaaccatgttacatttctcacaaaacaagattatcatcaccttcatcttcaggaataacaatgatcgcacgagcaacagcagttactggtactgtggaggatggaaatcaaggagaggctgataccattccaactccggtagttataattgatcaagactctgacccagatgcaactgtggtcgagataacctttggtgatcgccttggggctcttcttgacactatgaatgcgttaagaaacttggggctgaatgttgttaaggcaaatgtatttctggattcttctggcaaacacaacaagttttccatcacaaaagctgattccggaagaaaagtggaagatccagagttgttagaggcaatccgtttgacaattttaaataatatgattcagtatcacccggaatcaagcgcccaattagctctgggagcagcttttggacttgttactccaaaagagcagtctctttgctttgtgttgctaccagttgctagaaatgcattcgctttctccttttgttcgtttaatggtcctgtggcattttatattggtggaagccgccgtttgttgtatgtggagacagctgatcggcctggattacttgtggatcttgtaaagattattacagacattaacattgcggttgaatccggagaatttgacactgagggtctcttggctaaggcaaagtttcatgtcaactacaaggataaagccctcatcaagcccctccagcaggttcttgttaacagcttgagatatttcttgagacgacctgagactgaggaatccagtttttga

SEQ ID NO: 107475 - DNA, 318 bp, Glycine max
  Peptide Sequence Number=SeqID_224253
atgggtgaaggggacgacatcgaagagcttgcggaggagagcggagttgttgaggtcggcgtcgacgacgaagacgtcggcacggtcaaggaggcactggcgggcgcgcttgagggaggggtcgtggtagcagttgaagttgttgaggccgaggatgtcgtcgccgcgatgcttgagggagagggagacagggagtcgacgaagacggcaatgtcggagtcgcagagggagctgcaacagggggaggcggtgggtgacggcgatgacaaaatgaagaggatgaatgctaggaagaaggaggaccagatagtgagctga

SEQ ID NO: 107476 - DNA, 3138 bp, Glycine max
  Peptide Sequence Number=SeqID_224254
atgactctaatctatgagaagtgcctacgtgtgaacttagcagagcgttcaaaattcacaaatggcgaaattcagacatttatgtcagtggatgctgaccgtactgtcaacttgtgtaatagtttccatgatatgtggagcctgcctttacaaattggagtggcgctctatcttttgtatactcaagtcaaatttgcatttgtatctggattagcgataaccattttattgataccagtgaataaatggatatcacaattgattgcaagggctactgagcaaatgatgaaggaaaaggatgaaaggattcgtaggacaggagaacttttgacttatattcgcactttaaagatgtatggatgggaacttcttttttctagttggttgatggatacaagatctttggaagtcaaacacttagctactcggaagtacttggatgcatggtgtgttttcttttgggctacaacgccaacactcttttctcttttcacatttggactctttgcactgatgggacatgaacttgatgctgcaatggttttcacttgtcttgctttgtttaacacgctgatttcaccactaaattcattcccctgggtaattaatggattgattgatgccatcatatcctccagacgattgagtaggtttctctcttgtcctgaacgtaaatttaaagtgggagacacaaattcgagtccatcatcattcctaagtaaacagcctgattctgtacaaggtttgggtgtctttatacaagatgcatgttgtacttggtcaagcagtgaggaacaagcattaaatttggtgttgaatcatgtgactctaagtgtgtcccagggttcctttgttgcagttattggagaggttggttcaggtaaatcatccctgttatattcaattcttggagaaatgcagcttgctcgtggctctgtttattccaatgaatccattgcttatgtaccacaggtcccttggattttatctggaacagtgcgtgacaacatattgttcgggaaaagctatgatcctgaaaggtatactgatacactgcaggcatgtgcattagatgttgatgtctcaatgatggttcgaggtgacatggcttatattggagagaaaggagtcaacttatcaggtggacagagagctcgacttgctttggcaagggccatgtatcatgactcagatgttgttatgcttgatgatgtcctgagtgcagttgatgtacaagttgctcaacgtatcttacacaatgccattttaggtcctcttatgcagagaaaaacccgattgctctgtactcataacatccaggcaatatcttctgctgatatgattgttgtaatggacaagggacgcataaagtggatgggaaattcagctgactttccaatttcttcttatacagaattctctccattgaacgaaattgattcagctttacataatcatagacaatcttgcagcacaaatctttcatccaaatccaaggagcagtctcttcctaattcagatattgtgcatgttctggagggagcagaggagatagttgaagttgagttgaggaaagaggggaaagttgaacttggagtgtataagagttatgctgtcttcactggttggtttatgacagtcattatatgcctatcagccattctgatgcaagcttctcgtaatgggaatgatttatggctgtcattttgggttgatacaacaacagaaagcagtcaaacaagatattctgtgtctttctatctggctatactatgtctcttttgtattatgaattcccttttcacattggtgagggcattctcttttgcatttggtggattgcaagcagcaactaaggtacacaataaattgctcaacaagcttgtcaatgcacctgtgcaattctttgatcagaccccggggggaagaatactgaataggttatcttcagatctttatacaattgatgattctcttccgttcattatgaacattctcctagctaattttgtaggcttgttgggtattacaataattttgtgttatgtacaggtcttcttcttactcttgctattgccattttggtatatctacagtagactacagtggcttcagttcttctacaggtcaacatcaagagagttacgaagactggacagtgtttctcgttctccaatatatacatctttcactgaaacacttgatggatcatcaactattagggcatttaaggctgaggaaaaggttgctagagacattgattggcacactcaaacagctagtctaaagctaagttatggtaaaggttacatggacagtggtaggtgttcatcgatatacccaaagcactatcaactgaacctgcctctgaactctgaagtgctttttatttgtttggcattagttgcttgtcagatctgctctgacttttatactagtctagactttttctttgccaaattcattgaacatataaccttgtatcagaagacttcctacacagagatagtggcaagtttgtggctttccttgcgtcttcagttgttgctaataatgacattcttccagttattaggtgcatttatcgtctcattcatagctgtgatggctgttgttggatctcatggcagtctgcctatcaactttggtaccccaggactggtaggattggccctctcatatgcagctccaattgtgtccctgttggggagttttttatcaagcttcaccgaaacagaaaaggaaatggtttcagttgaaagagcccttcaatacatggacattcctcaagaagaacaaactggatgcctatacttgagtccagattggccaaatcaaggagttatcgaattccagtctgttactttgaaatatatgccttctttgccagctgcactctgcaatcttagttttagaattgtaggagggacacaagttggaataattggaagaacaggagctggaaagtctagtgtgttaaatgcccttttccgccttacacccatatgtacaggctctatcacaattgatggcgtggatattaaaaatattcctgtcagagaactacgtacacatttggccattgttcctcagagtccatttctgttcgaaggatcattaaggaagaaacaggattag

SEQ ID NO: 107477 - DNA, 198 bp, Glycine max
  Peptide Sequence Number=SeqID_224255
atggttgattgtgaaggatgtcaagggatggttgaggatttaggagtgattgctgaggatttggagcgggtcatcaaccttaggatggtcactgaaggcactgacttatatgacatcatgactcgttgtctgaggagagctagaggtgacgctgctgatggaagtcttaggccgcgacagagacgccgcatagattag

SEQ ID NO: 107478 - DNA, 576 bp, Glycine max
  Peptide Sequence Number=SeqID_224256
atggttttcaacaatgatggttttgtagagaccgtcttagaaagtaatacctttcaaaatcgccaccaccttttccaaccaccgatagaaaactacatccacatcgccgtcattgacgtccccttcgaacaggggaacgacttctgccgcgccaagctcttcatgctggatttcaagcccggggatggtgccgtcgtcaacgttgatgtagccagagaggatggttatggaggtggggttgtaggcgaagaggatcttcttgttgggggtgttggaggtgaggttcaagtagtagagtttcaaagacatgacgatgaaggtggggtggtgggaacggtagaggagttagaacaccttgtcggtgatgtcgatctggaggagaaggatcaacacggtgacgatcagcacggtgaggatcagccagaagaaaaaggtgtagcagcaccgacgttgatggtggggctgagggcgataggtggggtgggtggcaccgtaaagttgagcctttgttgtcgggaaagatgggttggtggcactgccattaatcatggcgggcttggccgatggatacaccct

SEQ ID NO: 107479 - DNA, 1863 bp, Glycine max
  Peptide Sequence Number=SeqID_224257
atggccagagaatacgagggatgtgcagtgggaattgaccttggcacaacttactcgtgtgttgcagtgtggctggagcagcactgtcgagtggagatcatccacaatgaccaaggcaacaataccaccccttcttgtgttgctttcacagaccatcaaaggttgattggtgaagctgctaaaaaccaggctgctaccaacccagagaacactgtgtttgatgctaagaggttgattggtaggaaatttagtgaccctgttattcaaaaagataaaatgttgtggccgttcaagattgttgctggtattaatgacaaacccatgatttcccttaattacaagggccaggagaaacaccttttagccgaggaagtatcatctatggtcctcacaaagatgcgggagattgcagaggcatatttggaaacacctgtaaaaaatgcagtggttactgtgcctgcttatttcaatgactcacaacgtaaagccaccatagatgctggttctattgcaggcctgaatgttatgcggataatcaatgaacctactgctgcagctattgcatatgggcttgacaagagaactaattgtgttggagagcgaagcatcttcatctttgaccttggtggtggtacttttgacgtgtctctcctcataattaaggataaggtcttccgagttaaggccactgcaggaaacactcaccttggaggggaggactttgacaacagaatggtgaactactttgtacaagagttcaagaggaagaacaaagttgacattagtgggaatgcaagagccctaaggaggttgagaagtgcatgcgagagggcaaaaaggatactctcgtatgcagtgactaccaacattgaggtagatgctttattccagggcattgacttttgctcctcaatcacccgtgcaaaatttgaggaaatcaatatggagctctttgaagagtgtatggaaacagtagataggtgtctttctgatgccaacatggacaagagcagtgtacatgatgttgtccttgttggtggttcttctaggattccaaaagtgcaggagctattgcaggacttcttcaatgggaagattctgtgcaagagcatcaaccctgacgaggctgttgcttatggtgcagctgtgcaggctgctttgttgagtaaaggcattgtgaatgttccagacttggtcctgttggatattacacctctgtctcttggtatatcgctaaaaggagatctcatgagtgtggtgattcctagaaatactaccattcctgtaaagacgacagaaacatactctacagctgtagataaccaatctgctgtcctgattgaggtttatgagggtgagagaacaagagccagtgataacaatttgctgggtttttttaggctttctggcattcctcctgttcctcgtaaccatcttgtgtatatttgctttgccatagatgaaaatggtattctatctgtttctgccgaggaaaaaagcactggcaataagaatgagattaccataaccaatgacaaagaaaggttatcaaccaaagaaattaaaagaatgattcaagaagctgagtattaccaggctgaagataagaaattccttaggaaggccaaagcaatgaatgatttggattgttacgtttacaagatcaagaatgctttaaagcaaaaggatatcagctcaaagctttgctcaaaagaaaaggaggatgttagttctgcaattacaagagctacagatttgcttgaaggtaataaccagcaggatgacatagctgtgtttgaggataatctgaaagagcttgagagcatcattgaacgcatgaaggccatgggcaaaattgtttag

SEQ ID NO: 107480 - DNA, 756 bp, Glycine max
  Peptide Sequence Number=SeqID_224258
atggaaatgagtactaagaagggttgtccaagccatgcacaaccaatgcaactgaagccaccaggtgcaccattcaaatgcagtggatgtaaacaaatggggttaggatgcagttaccactgcgaaagcagcaactgcagttacaccctccatgaagagtgtgcgaaagctgtttctctagccttccattcctttttccccaagagcgatttcgagtttcatgagaaagcaccggggaaccgcactaggtattgtgatggctgtggaaaagatgtgctggggtttgtgtaccactgctctaccacaggatatgacctacatccatgctgcttgaagctgaaacatagcctttctgatgaagaagggcgcgtgacgcttgaactgtgccagaaggttccctccaagtgtgggaagtgtaagcataggaatgttgtggagggagttaaagggtggtcttatgtgtcttctggggggaattattgttaccatgtgtcgtgtgtgaaggaactgatttttgagaattggaagaggggttatttctctcaagaaacaaattcaactgggatgcgtagtgatagcgagaacactcaaattgcactgagaagcatggcgatggtgcaaagtggaagaaggtcaagaagaatcaagaagtacactaagattgctgtgttggtgttcaagttagtagtttcagctatttttggaaatcctatatctgccattgctgcccttgtggaagcccttgtttctgattga

SEQ ID NO: 107481 - DNA, 675 bp, Glycine max
  Peptide Sequence Number=SeqID_224259
atgcccgtgccttcttgcggaagaacctgcagaacctttttccgcagactacctctctttctcgcggaagaacctgcgaaaccttcttccgcaggctacctctccttctcgcggaagaacttgcggaaccttcttctgtggaccgtgttttgttgtatattgatcatagttagaacacgaggtttaggtcatgtgttaggaactggtagaggtagaggcattagtgaggatgcgcatcaggctgatgttcctcggcgtcgcaggcctactacttcagcacgtaggcaatgggttcgtgtgcatgaggacgctacacagagacccgaggatgtgtctcagttgcataaggatgttcctcatgtgtctaatgctaccccagagatgacaggcgccgtcgatgctgttcacatagagggagtggctactgatgggagcttggggtcatttgctagagatgagggattcccctgtgggctacgtgacccatcagttttgaccggttttgctgagcatgtcgcacacagcatctggagtggacatgaaggacccgatctgaagttggtatcccatggtagaaaagtagataaaattgggagaccagcgcctgagatcgaacgcatgattgctgccaccggattgagtccactgaatcaggtgttctgttatcaccactga

SEQ ID NO: 107482 - DNA, 1509 bp, Glycine max
  Peptide Sequence Number=SeqID_224260
atggcagctcagtttgcagctgaagccactcttagaagggtccatgctgcccagaaagatgatgacatgcctccaatagaagcaattcttgcacctttggaagctgaactcaagcttgctcggcaagagattgctaaactacaagatgataacaaagctttagatcgtcttaccaaatctaaagaagctgcactacttgaagctgagaggactgtccaggttgccctggctaaggcatccatggtggatgatctgcagaacaaaaatcaagagctaattaaacagattgagatttgccaggaagaaaataaaattttggacaaaatgcatagacagaaggtggcagaggttgaaaagctcacccaaactgttagagagctagaagaggctgtccttgcaggtggtgcagccgcaaatgcagtgagggattatcagcggaaagttcaagaaatgaatgaggaaagaaagactctagacagggagttggctcgtgccaaggtaacagcaaacagagtagctgttgtggttgcaaatgaatggaaagatgctaatgataaagtgatgcctgtcaaacagtggcttgaagaacgtcgattcttgcagggagaaatgcagcaacttcgtgacaagcttgctatagttgagcgcgctgcaaagtctgaagcacaattgaaagaaaaatatcatttacgacttaaagtgctagaggagagtttgagaggaaattctaacagtagtaatcgcggtaccccagagggaagaagtatgagcaacggcccttctcgtcgtcaatccctaggcggagctgataacttctcaaaactaacctctaatgggtttttatctaaaagatcaccatcctctcaactgaggtcatccctatcctctagcacagttttgaagcatgctaaaggaacatctaaatcttttgatggtggtacaagatcactggaaaggagtaaaatgctgctgaatggaacacctctgagttactcatttaaccaatctcttgaagaaaccaaagagagagaggcaagtgataattggaaaggaaattcagatgataagccaaatgatttcccaactgtggatttagtggatagtgttcctggtgttttatatgacttgctgcaaaaagaggtgatagccttgaggaaagctggtcatgagaaagatcaaagcctaaaagataaaggcgatgctattgagatgttagcaaagaaggtagatacattgaccaaagccatggaagttgaggcaaagaagatgagaagggaagtagctgctatggagaaggaggtagctgctatgcgtgtggagaaagaacaagagaacagagcaaagcggttcagcaatgtaaagggccctgtaaacagtgctcagcaacagctaatttctggaaggctgggaattttaaccatcaaatggatttattctgttaagagagatcccatagtgaatagcatccctgagaatttggtctttaaccaagtccatggcattttgtga

SEQ ID NO: 107483 - DNA, 300 bp, Glycine max
  Peptide Sequence Number=SeqID_224261
atggaaataaaaacccagaaacaactctcgatcgctctttcggtgtcaatggctgttgatcgtgctacagaagtaaaccagacaagcaacgagaaatacgcaagcgtgagagggtgcccagtgcccggtcgcggtgggcggcaccaagaccatggctcaattggagttgctgcaaattctaaggaccaaataattgttaatgagctcaacatcttagttgaaggcgctgaaggtgaagatgtgacctttagggagaggggaggctcaaagaaaggaattacagcttggagtaaggcttga

SEQ ID NO: 107484 - DNA, 186 bp, Glycine max
  Peptide Sequence Number=SeqID_224262
atgaaaagaaagctaagagaagaagaaggtcaagcaggtggtgtctcgctaagcaagacatatgcgcttagcgagttacatccgctaagcgagacactcagcccgcttaacgcgtggggaaaccctacaagaggatcagtcacaaatgctcgcgcccagcgcgccgcaagctcgcccagcgagtaa

SEQ ID NO: 107485 - DNA, 321 bp, Glycine max
  Peptide Sequence Number=SeqID_224263
atgactttgttaaaggcacttgctggaaaactagagcaatctctcaaggtctgcatttcaaaagaagaaacaaccaaatgcaggaaaattgtgtgtgatccatcatatatgtctgataaggttcagaaggttggaaaggttgcttgtgcaatatgtattatgagtcatcctattccagacaccaaagactcttactcaacacaagtcattctgccacagaagcagcttggtcgcaagtcagacatctttatgattatccaattgattcaagagcaaagcgaaaccctgcacattcgtgtggtatcatggagtattatataa

SEQ ID NO: 107486 - DNA, 300 bp, Glycine max
  Peptide Sequence Number=SeqID_224264
atggactcaagcggtgcgtttagcgggatgatccctcactcagcgaacatgcacaactcatccttcttccagattcttcctcgcgctcagccaaaggaatggtgcactcagcggatggctcgtcaaaagcatataagctgctgggtggtggaaaagaagctaagcttcaagaattattttgatgatgccaaggaatttaagaattattttgatgatgtcaaggaatttcaaagatcattcaagatgaatttcaaggatgacgaaagcaagatgtcaagcaaagcaaagatctcaagataa

SEQ ID NO: 107487 - DNA, 630 bp, Glycine max
  Peptide Sequence Number=SeqID_224265
atggctacaccacccagctcacctcctctccctccttctgggtcagcaacacctttttcaccatctacgtcaaaaaagactagaaaagcaacacgactcatatcattgactactagactagctgaggtggagagaccaatggttcatgttgttcctgtcactgagaaagctgatggtccccacggaaacaaattaagaacatatttgggaattgtcgctcgcgataaggacaaagaaaaaatacttcggaccatacgagagcgatggaggcattttaagtcagatttgacctccaaatggaccgtggcacacggcaaggagggcgaggatgacaaagtctccgagaagtatgaaataagcaaaaagaagtggacccagttttgtcatagtcgtaaagacccttcatgtgagaccagttatcgttatgtgttactatcacaacatgttcaaaagaaggtgcaggccattcaaaaacaaaacattgtccctcacatgttgtctcgtgggggttatgattttatagaaaaaaagttgtggaggagaagcaaaagaaacgactggaggaagaaacctaatctgggagcactggcacagtcgttgatcccccatctaccaacagacaacacgtga

SEQ ID NO: 107488 - DNA, 299 bp, Glycine max
  Peptide Sequence Number=SeqID_224266
gctaagaataagtctttggccaaagcatgcaagaagggcaagttggatgagactctggaaagaaaggaggctttagagttggaagaagatgcccttgcatttttcaaagctctatcaactgaggagcacaagaagttggttgaagatgcaaagattgttgccttgacaatgtatgttgaagaaagtcaaaggaagaatgctaagaaggctaccatgatgaacatagatggtgagacagtgcctgaagctattattgttgactcaatacaggctgtgacaccctctaccccgacatataa

SEQ ID NO: 107489 - DNA, 423 bp, Glycine max
  Peptide Sequence Number=SeqID_224267
atgaattttctacataagctaaaagcggaagtaagctgcgaagggagagtgattctagttctaccaagaccaatcatgtcaatgacaccggtggcgaggccttggagtaagaagtttgaggcgcgagagaataagaagcatgaaaatggtggcgttttgtttagggttgaagccattggtggattggagggagacgatgtcttgcttgagctcgtcactggtggtggtgacggtgttgtccgacgtgacgccgcacgagttgttgttgtaactgagttttggggcggagaagtagtttccgtaaccgtcgaatcaggcgagggaggaataggtagagctgcaccatgcgggcctataagtgaaggagacatagttgttgccataatagacccacaggaattggccactgatgtcaagtattag

SEQ ID NO: 107490 - DNA, 207 bp, Glycine max
  Peptide Sequence Number=SeqID_224268
atgcctaaccataatagtttatactgtcattatgataatgtacctaacgacatgagacgcaacgcagtgagaagaggtaagactgagagatgtagtgacaacgaaggtgaaacgaagagaatagacctgagaacgcagggcgagaacggagaggaacaaagcgcggttgagatggagacaggaagaaagggtagcgcgaaagagtaa

SEQ ID NO: 107491 - DNA, 123 bp, Glycine max
  Peptide Sequence Number=SeqID_224269
atgagcatgcaagagtataaagcttacctgtcggcagcatgggctgagagcgaaggcgcgacaacacacaacggtggcacgacggtcacagcaatcacaacggaggcacaacggatgcactga

SEQ ID NO: 107492 - DNA, 1428 bp, Glycine max
  Peptide Sequence Number=SeqID_224270
atggggcctgggtttcttgtttccattgcatatatagatccaggaaactctcttgtaattcaatcaatggcagctaatctcggggtggtcactggaaaacacttagcagagcactgtagagctgaatatccccgggtgcccaacttcatcctttggattattgctgaaattgccatagtggcctgtgacattcctgaagtaattgggacagcctttgcattgaacatgctcttcaacatacctgtttggattggtgttcttctgacaggactcagcacattgatgctcttagcattgcagcaatatggggttaggaaactcgaattcttgattgcatttttagtatttacaattgctgcatgttttatggttgagcttggatatgcaaagcctgatgctaaagaagttctgaagggtctttttgagccagaactaaaagggagtggtgctactggtcttgcaatttctcttcttggagctatggaggcttgcagattttacatgatagaaagtgcttttgctctcatggtggccttcctcataaatgtttgtgttatttctgtaagtggtgctgtttgcaattcttcaaatttgaatgctgaagatcagatgagctgtcaggatttggatctgaacaaagcctccttcctacttagagtatgtgaaaactggagatgtctttcttactttggttgttattggtatggtgctcataaaatcatagctgatatatctgacatgtaccatactcagaatgtcttggggaaatggagttcaaagctgtttggaattgctttgtttgcatcgggtcaaagttctactattacaggaacctatgcaggacagtatgtcatgcagggatttctggatttacgactggagccatggattcggaatatgttaactcgttgtttagccatagtccctagtttgattgttgcagtcattggtggttctgctggggctgggaagctcataatagttgcatctatgatcttatcatttgagcttccttttgctttggttccactcctcaagtttacaagcagcaaaaccaaaatggggacacatgtcaactctacaatgatttcggctgttacttggataatcggtaccctcctcatggccattaatatatactacttaataactggcttcatcaagctgctgcttcatagtcacttaaaaattgcggctaaggtgtttcttgggatattaggattttcgggcatggcaatgtatttggctggtataacatatctagtacttcgcaaaaataaagaggctacacaccttttggctctaacagcaacagaaaatcagcagatgacaaatgaacaaggcaatggttcaatctattctcttccaagagaagacatagtaagcatgcaattgcctcaaagaagtactcctgcagatgttgactga

SEQ ID NO: 107493 - DNA, 600 bp, Glycine max
  Peptide Sequence Number=SeqID_224271
atggagagtagatttacactgttgggtttcgagaacagggacaggggcggggatatggaaagttgggagtggggtgtggaggaatggagcttagaagatggaggtttaccggcggtgtcatgctcattggcactgccacctcctccaccaggggtccctcttgcaagaaaggttggagctgagttcatagggaccttcattctcatgttcacaggcactgccgctgccattgtcaaccaaaagacaaatggctctgagacccttattggatgtgctgccaccactggcctcgcccacttcccttggaagcatgtgcccatgtatattggtgcacaagttttggcatctaaatatatatgcgccggatttgctctcaagggggtttatcaccctttcatgcgtggtggagtcaccgttccttccggaggatatggccaagcttttgctttggagttcattattgccttcaacctcatgttcgttgccaccgacaccagagctgtcagtattttctcctatacatcattttatgtctatttcaggacttgggtttttggaggagatacaaaaaacagtgatacttttcaggcattcatataa

SEQ ID NO: 107494 - DNA, 783 bp, Glycine max
  Peptide Sequence Number=SeqID_224272
atggaccttatatggccagagtcacgtccatctgaaaatctgaagatcccatttttagagactccacctccatgctcaaagccgccagtaccttccatggatacccagaaggagaagaaggaggacaatgaacacccccatgagtctgcttcagaccttgtactggatctaagtctccctagtaaacattcaggtggtgatggtgagtcaaagccagaactcaacctcatcaactgtatcgatacaaatttgtccatgaactcctcagaatcaagtcatggacatggtgatgaattggagccccggatattctcatgcaactactgtcaaaggaagttttatagctcgcaggcacttgggggacaccagaatgcgcataagcgtgaaagaacattggtcaaaagaggacacaaagctggtgctgcagtttccatagattttgcacggaggtactccagcatggcttctttgcctttgcatggttcctataacaggtcatcactcggaattcaggcgcattctatgatcagcaaaccctcttatcaatcacccttttttggtttgtcccgttctcatgctcagaagcggcctatgttctcacaaccgccaattgggacagaaagtgaatcttctttgactggtggcatcccagtcccacggttagggaatttttctccgaggctggtgccagagggactcggaggttactggttggatagtgttaaccatttgaagactaaacaagaggagttgcacaagcttgacttgtccctcaaactctaa

SEQ ID NO: 107495 - DNA, 198 bp, Glycine max
  Peptide Sequence Number=SeqID_224273
atgactcactgggcgagcacatctctggttgatcctcttctagggtttctcatcacactaagcgagctgagcgcctcgcttagcggatatggcttcgaggaaatgacgagtagtcccaagccagccttaggagggggagcccacatggggcttctcctagttcacctcagagatcacctgacagagatacgaggatag

SEQ ID NO: 107496 - DNA, 324 bp, Glycine max
  Peptide Sequence Number=SeqID_224274
atgaaagacataaagaaaagcatagatgatcttcatgaattggtgttgaatttaacaacacttgttactattggcacaccactcaagacgtctaacaaacaagggcgtcgacttaatctctatggaagtggtgacggtaaatgcttcgagaagaaagcagatagaaaaaaattattcttgcctatgaagaaaaatatgaaacccttgaaggttttacaaaccacaacttctaatgtagggtatcgtatcaacaatagatctgccatagagttggcacaactagcgagtgcaattgatgttagacaatggatggtccatcattag

SEQ ID NO: 107497 - DNA, 414 bp, Glycine max
  Peptide Sequence Number=SeqID_224275
atgaatttggcctcaatcctgtgtgggccatgggtcccaatctccctacgcggtcatgagatccacaacataatcattgtctgccttgaaatttgcagcatctccagtgccagaggtgtcacccccccatcaggagaaggagggaatactggtggcgaaattggtggtggagggactagtggtgcgtctggaacggctcggggtctgaccttccttggcccagggaaggccaagttgatcatggggctcagcgactcaaaggtcagggtgtcaaaagtgaccccctgtgcgttgcaaaaagccatgatcaatgcgggaaaattgagccaagaggtgttggactgggtgatctgtgtgatctgtcttgatatcatgctgcccaggtctatgtccatctatgtcaccaacccgtaa

SEQ ID NO: 107498 - DNA, 1947 bp, Glycine max
  Peptide Sequence Number=SeqID_224276
atgggaagtctcgaaaacatcaagaacgagacagttgatctcgagcggatacctgttgatgaagtgttccgagaactgaactgttcgaaggaaggtctctcaaatgaggaaggccaaaagaggttgcaagaaagcaagttgctgaaattcttgggttttatgtggaaccctctctcatgggtgatggaagccgccgccatcatggcaattgtattggcaaacggagggggtgagccaccggactggcaggactttgtgggaatcatggtgttgctagtagtgaactcaacgatcagttttatagaagaaaacaacgcggggaatgctgctgcagcgttgatggcagggcttgctccgaaaacgaaggttttgagagatggaaggtggtcagaggaggaggcttcaatactggtaccgggagacataatcagcatcaaattaggagacataatcccagctgatgctcgtctcttggaaggagatcccctcaagatcgatcaatccgcactcaccggcgagtccttgcctacaaccaagcaccctggcgatgaaatcttctccggctccaccgtcaagcaaggagagattgaggccgtcgtcatcgccactggggtccacaccttcttcggcaaggctgctcatttggtcgacagctgcaaccaagttggccatttccagaaggtcttgacagccattggtaacttctgcatttgctccattgctgttggcatgatcattgagattgttgtcatgtatccaattcagcaccgcaagtataggagtggaattaacaatctcctggttctcctcatcggagggattcccattgccatgccaacagtgttgtcggtcacaatggccatcggttcccacaggctgtcggagcaaggtgctatcaccaagaggatgacggccattgaggagatggctggaatggatgttttgtgcagtgacaagactggcactctcacactcaacaagcttacggtagacaagaatttgattgaggttttcgcaagagatgccgacaaggatacagtgatgttgcttggagctagggcctccagggtcgagaaccaagatgccattgatgcttgcattgttgggatgttgggcgatccaaaggaggccagagatgggatcaaagaggtgcatttcctaccctttaatccagtggacaagcgcaccgccataacatacatagacactgagggtaactggcaccgagtaagcaaaggtgcacctgagcagattatcgagctttgcaagcttcgggaagatgtcaagaagaaggctctttccatcattgataagtttgctgatcgcggtcttcgttcccttgctgttgccaaacaagaagtgccagaaaaaagtaaggagagtgcaggaggaccgtggacgtttgttggtttgctgccactttttgacccaccaaggcatgacagtgctgagaccataaggcgtgctctcaatctgggagtgaacgttaagatgatcactggtgatcaacttgctattggtaaagaaactggtcgcaggcttggcatgggaagcaacatgtacccttcttcctctctccttggtgagcacaaggatgagtccattgctggccttccagtcgatgagcttattgagaaggctgatggctttgccggtgtcttccctgagcacaagtatgagattgtgaagagacttcaagataggaagcacatatgtgggatgacaggagacggtgtgaacgatgctcctgcgctgaaaagggctgacattggaattgctgtggcggatgcaaccgatgcagctcgaggtgcttctgacattgtcctgacggagcctggcttgagtagccatcttccagagaatgaagaactataccatatatgctgtctctataacaatccgaatagtgttgggctttatgctgcttgctctcatctggaagtttga

SEQ ID NO: 107499 - DNA, 339 bp, Glycine max
  Peptide Sequence Number=SeqID_224277
atggctcacacacttcccagagaaaaaattgacatcgctttggtgaaggagttctatgcaaatgcctatgacccagaggatggcacgttgaagcgttgctggattcgggggaaagtcattcgattcgatgctgagacattgaatgactttctagagacccctcttgttatcccaaaaagggaggagtatccatcatactcccagtacctgcacacataccccgaccaccaggccattgcggccaagctcttcacaccgggagggcagtttgtgctaaacgcaaatggggctccgtggaagcttctacggaaggacctcaccacattggcccagacttag

SEQ ID NO: 107500 - DNA, 741 bp, Glycine max
  Peptide Sequence Number=SeqID_224278
atggaagctcagagagattttgttactggaattgtgcttggtacctacctcgctgtcatgactgttgtcttcttctgggctgctcatgcatctgattttttctcggataaatttggcgtgagatccatcagggagaactacagtgagctcacagcagctgtttaccttcaagtgagtattgtaagtcaggctcttatctttgttactcggtcaaggagctggtcttatgttgaacgtcctggcatgtttcttcttgttgcctttttcatagcacaactgattgccacggtgatagctgtgtatgcaaactgggaatttgcaaagatgaaagggattggatggggttgggctggtgtcatttggctctacagcattattttctacatacccatggatatactcaagttcatcatccgatatgcattgactgggaaggcatggaataatataactgagaatagggttgctttcaccacaaagaaggattatggaaagggagagagagaagcacaatgggctgcagcacaacgcacattgcatggcctgaatccacctgaaacggaggaaatgttgaatgaaaagaacaactacagggaattgtctgaacttgcagaacaagccaagaagcgtgctgaagttgcaaggctaagggagcttcacacacttaaaggccatgttgagtctgtcgtcaaactcaagggacttgacattgagacaatgcagcaacactacaccgtttga

SEQ ID NO: 107501 - DNA, 951 bp, Glycine max
  Peptide Sequence Number=SeqID_224279
atgaatcttcttgttctcttcctgcctgtttgggtgctaagcatttctttttcctcaccaattcttcatgctgcttcctccatttctctttctcaaaatgcacaagctgaatctccaggaattcaggaggttagaacagtgcaccaccagaatttgaataagagaattctaatcgcactagttgcttgttctgctcttcttgttggagtcttcctattcctgttatatgtctggttcggtcgacataaaaacttaagatgctccaaaagtaaaagccaagaaaccatcgaggctgcaaaaggggaaaccataagctcggttaatgctaaacttaactactctaagatggcagataaaaagagttcagttgctatttttgactatcagctgttagaggctgcaacaaacagctttaacacaagtaatattatgggagagagtggttctagaattgtttacagagctcattttgatgaacatttccaggcagctgttaagaaagcagatagtgacgctgatagagaatttgagaatgaagtgagttggttgagcaagatacagcatcagaatatcataaaaattatgggttattgcattcatggtgaatcgaggtttcttgtttatgaattgatggagaatggatctctggaaactcaattacatgggcctaatcgggggtcatctttaacttggcctctaaggttaagaattgctgttgatgttgccagagcactagaatatctccacgagcacaacaatcctcctgtggttcatagagacctaaaatcgtctaatgtttttctggattctaactttaatgccaagttatcagattttggatttgctatggttttgggaatgcaacacaagaacatgaagatgtcaggaactttaggatatttggctcctgagtacatatcgcatggtatagaagaatatttattatcataa

SEQ ID NO: 107502 - DNA, 753 bp, Glycine max
  Peptide Sequence Number=SeqID_224280
atgacattatcaagatggatttgtgctaataattcaaaaacccagcttctccagattgtccatgctggtggccatgttgaactccatgacagaccagtgactgcagcagagataatgtgccgctatccaagatgccgtgttgcatatccatatgtgttccagcaaccatgggcagttgctgaaccagagacagtgctcatgcttggacaaaagtactatgtaattccaaatagcacaataagaaagcttcaaaggctttctccaagaagctctccttctccttcttctcctgctcatgaaattacaatcagttcttcagttgatgaaattagaaacacaaaatccagcaaagaggaaaatgatggtgtgctctccacttgttgtgtcttcaggaataaaagcagtgcaaagcaatccaatatctacaagcaatactccaaaaataagatcaagaaatctgaaatcagagcagatgtaagaaatttgagtctaaatattaatgataagagtggtggtttatcacatgatagttgtttcgtgagtctgtttaatggaggcaggactaaagcaaatgctagtgatgtggcaaaagaaacaagaacaccatcaagcagtgctcacctttgtgatggcaatacattaaccaggaagaggacaaaagattttacaggaaatgggttaagaagctctcctaagaatgtatggtcttctgagcattggcaaccgagtctagagagtatcactgaagaatga

SEQ ID NO: 107503 - DNA, 1068 bp, Glycine max
  Peptide Sequence Number=SeqID_224281
atggccggtgcgcaggccgctcagcagcatcagcgcgcccgcactgccgagaccgtgctgcaggccgctgccggcgctcaggccgaccccggccataaacaccatcaggccaaactctttcaccatggtcagtgcgccctgcgggatgtagccgaacgtcgggtggttggcgcgcaggaagccgagcatgatgccggcaaacagcagtccggcggcgttgcccaggccaaagctgaagttgctgaactggaaagtgatcatgccgatcatcaggccgatgataaagaaggcgcagaacgccagcagatcggtcatctggctgtgaatagcaatgaagccgatgcgatcggccaggcttttcacccgacgcgcttcgccgctcacctgcagcacatcgcctttgttgagcataatgctgtcgtcgatcggcatctcaatctggctgcgaatcacccggcgtttattcaccgcgttgtggtttttcaccacgatctcttcggtgacgatgcgcatgtcgagcagatcgcgatcgaacacctctttaccattacggaaactggcgtcgagacgcgcatgggcatccggatagccgaccagagaaatttcgtcgccgagctgcaaaactgcatcaccgtccggactggccagaatgccgttacgccgcaggcgctcaatgtagcagccggtctgacggtgaatccccagctcacgcaggtttttgccgccgctccactcaaccagctccggaccaacgcggtaggcgcgaattaccggcaggaacactttacgctggctgtccgcatccagaccgcgctcgcgcgcgatttgctgggcgcaggtcggcaaatcctgatgctgcaggcgcggcaggtagcgtgcgccaaaaatcaggctgaccagcccaatcagataggtgagggcgtaacccaggctgagcatgccggcggtgaggccgatatcccagccaaacagtttgccgagcgtcagcgcaatcagcagggcgctgaccaccatgacgatcgccagaaagaaatagttcttaccgtcgcggaaaaagatggagaaaaa

SEQ ID NO: 107504 - DNA, 270 bp, Glycine max
  Peptide Sequence Number=SeqID_224282
atgaaccaccaaccaccggagatgtcctccaatgctcacgctctagaagagaagaggccaaggtcattgaatgcgcagagaagaaaagcatgcggcgcaaggtcatgttgcaagttgatgagagttgttgcggtaacccaaggactactagtaatggggggtctcatccatgactcacgtttccattgggttagagtttttatagagatattagttcaatcaatatcttgcatgttgagtaggcaacaattctacaaggctagagaatag

SEQ ID NO: 107505 - DNA, 174 bp, Glycine max
  Peptide Sequence Number=SeqID_224283
atgtggtggtcatggtacggctgtggcaatagttatgacggtcatggtggtgattgcggtgacggtgacgctcgtgatagtggtggtgaattaatgaaagagtatgtgctccaatttctttcacaaaatgaagatgaacatggttgcacaagtagcttaagggcaatcttttga

SEQ ID NO: 107506 - DNA, 1095 bp, Glycine max
  Peptide Sequence Number=SeqID_224284
atgaaccggacctgggatgttgttcatacccctcctcatgttcgtcccatcggatgcaaatggatttacaaaatcaagaggttacccgatgatattgttgagcggtacaaagctcgcctcgttgcaaagggcttttctcaaatcgaaggtgcggactacttcaaaaccttctcccctgtggttaaaatgtcaacaatctgtgtagtccttgcccttgcctccatcaatcgttggactcttcaacaattagatgtcagcaatgcgttcctccatggggacttatctgtagatgtttacatggagatccctcctggactacatggatttagtccctctcaaagttgcaaacttcacaaatctctctacggtggcacattctcatcaagggatttctctatgccaaagccaaaggaatattgtcttgaccttctcaaggattctggcatgcttggatgcaaaccgtcttctacacccatgtacagtactcttcgacttcatgctgattcctccggccttcttgctgatccacttccatatcgaagactggttggtcgcttaatttacctcacaatcactaggcctgacatagcttttgccacacaacaattgagtcagttcatgtccaaccccacaaaagctcatcacaatgcagcgataaatgtcctccgttatctcaaaagctgtcccggaaaaggcttagtctttcccagaaattgcaacactcaaattcaagctttggcaactgccacttgcgagttgcaatggcttacttatctccttagagacctgcgggttcctcgctcaattcaatctattatctattgtgataatcaaagcgctttacacatagctgccaaccccgtttttcatgaactgacgaagcacttggatattgattgtcaccttgttagagaaaaatctcaggcaggacttatgcgactgcttccagttccctcttcaaatcaattggcagatattttcaccaaaggcctcccaccttgcctcttcactgtcaattcatccaagctgaagttagctgatatctacctacctcctgcttgtgtggggctaacagaagaagatcatgattcttag

SEQ ID NO: 107507 - DNA, 411 bp, Glycine max
  Peptide Sequence Number=SeqID_224285
atgactattatcgttgttgctgccactgtcgcaatcatgttggtggtgacatacaacggtcatggcgatggtggtggactgatgatcataatggtgatgatagttcatccgtgtcagagtcgatgcttcatatttagaaatcaacattttcacttctatcagccagccaatggtcgttttcaacgcgtgccacctagatttggatcagcttctcccactcagcctttccctggtaacctcaggccaaacagtggcacacatgcacacacactatctttattcagatctactccatcatcattgaagcctcagttatgcttgaagcatcctttacaaccactgcctattgcaccatgctgctcacccaattctcctatcgccaaatcttcccccaagatcttcaacagatga

SEQ ID NO: 107508 - DNA, 414 bp, Glycine max
  Peptide Sequence Number=SeqID_224286
atgtcatggatactcaactctgtttctccctctatcgcccaaagcatcattttcttcgaaaatgctgctgcaatctggactgaccttaaagaaaggttctctcagggagatttgctatgtgtggctgagttgcaagaagaaatctactatctcaagcaagattctgcttcagttacagtttactacaccaacctcaaatcgctatgggaagaactagacaacttccgtcctctagttccttgcacatgctctgccaaggaatttcaccaacaagatttcatcatctgctttctcaaaggccttgatgagcgcttcgccatgcttgaacaacaacattccgctaccacctcgacttccctcgacaccaatccatttgctaacactgtttctggcagaggccacggcactccatag

SEQ ID NO: 107509 - DNA, 297 bp, Glycine max
  Peptide Sequence Number=SeqID_224287
atgacggtagggactaccagtgacaatatatcattgaagagaaaaactctagatgaggatcactgtcatcaagcaagtcagagacttagcatggccacaaattcacctccacttcctatgttcccatggacccagtccccagtggagtcgtcaactttcgcaacctacccttcgccgggagggcgacgcggggcacatgggtgcgtcttccaagggaggaaggcgtgcgaagtcgccaccaacgtttattcgaggaaaacgtcggaaaaaccggaacgtgtggtctacgaactttaa

SEQ ID NO: 107510 - DNA, 504 bp, Glycine max
  Peptide Sequence Number=SeqID_224288
atggtgggtaggatcctaacaaataacaatgtgaacccaatggaattcaaaactactatggttcaggcctggaatgtgaagaaagtatatgacctacccctgaacaggaggacaaagagtgttgttactcttgtaggcaactccattggtggttttatggaatgggataagggagataagagtaggtttgggaaggtgatgagggttagggtttccatggatgtaggaaaacctctcaaaaggggaatgtttattaagatggggaaagggatccaaagaaaaatcttctttaagtataagcggctaggtaacttctgctatacgtgcgggggtttggatcacgtgcttaaggaatgtgagctcatcgaggaaggaaacaatgaggagggagaggttatgatggaagggtatcgaggaagccacgtgctcaaagggaatagttctactacgggaccatgtgaagacaccattgatgacatgttgaaagcatcaacaaactattaa

SEQ ID NO: 107511 - DNA, 957 bp, Glycine max
  Peptide Sequence Number=SeqID_224289
atggattttatcactggtctccctccttcccacgggctctccgttatcctggtcgtggtggaccgcttcacaaaaggggcgcattttggtgctctaccggcgacatacaccgcccacaaggttaacctactattcattgatatcgtctgtaaattacatggcttttcgagaaacattgtctccgatcgtgacccaatatttattagtcgcttttggtgcgaattattccgcatttccggtaccaaactgcgcatgagcacctcataccaccctgagacggacgaccaaacagagtacttagcaggtacctccctcatcgaggccgtggactctctcatgatgtcaagaacccaactacactcttcctttcagcgtcgcctcgccaaggcacaagttgcaatggaaaggacagcaaattctcaccgtcgggacgtccactttgatgtcggagattgggtttttgttcggctccggccttaccgccaaacttcccttcagtccgcatactccaaactctccaaacgtttttacgggcctttttgtatcttggaacgcattggccctgtcgcttatcgtctgcaacttcccacttcctccaaaattcatatagtgttccatgtctccctgttgaagccatatcggggagatacacccactactctggatcctttacctcctctccagtctgataatcatcccgtagtcgaacctctctctatcctggactggaaatgggatactaattacactccccctgttcaaaaagtcttggtgcagtggacaggtttggctccggaggacactacatgggaagattgggattctatttgcacctcctacaaccttggggacaaggttgttctgccagaggagggtattggtagcaaaaacaacccaacaagcagcagacccacaagagcacacaggaaaccaacatacctgctggactatgagtga

SEQ ID NO: 107512 - DNA, 270 bp, Glycine max
  Peptide Sequence Number=SeqID_224290
atgattcttgtgcggtttatcatgggggatagtcagtattcgttttctctcaccacatttagcccttctggaaagcttgttcagattgagcatgctttgacagccgttggctctggacaaacgtctttgggaataaaagcaaaaacaacccaacaagcagcagacccacaagagcacataggaaaccaacatacttgctggactatgagtgactgcatccctcggggagaccttgcccgacaaacattatcttttttatccttctgttag

SEQ ID NO: 107513 - DNA, 534 bp, Glycine max
  Peptide Sequence Number=SeqID_224291
atgttggatagtctgttggttgctaacgaggtgttggatgatgctagaaggagaaagaaacatagcttgatattcaaggtagactttggaaaggcgtacaattgtgttaactgtgagttcttgttttacatgaggaggatgattgtgagagtcatcgagaagtcgacattcaggggaattacatttaatggtatcagagcaaatctctctcctagtgcggtgtggttcaaggacaatccaagcaaaagctgcatgaaagccgccaaaaagtcaacattcaggggcatcacacttggggagggaggtttgggtttgggcgaaatcgaaggatacaaggttgttgaggttggttgcagaaagaggtttggagtggaggagggttgggatgacatagaggggttcaacatagggagggaggttaagggtttgatgaaggttttctcacagatagggagagggggggaggaaaagatgagtatgtcgggggtggttgtggagggatgttgggggcggaggaatgtagggtcaccatga

SEQ ID NO: 107514 - DNA, 390 bp, Glycine max
  Peptide Sequence Number=SeqID_224292
atgtctggttgggagacttacaagtcaataactgtagctgctggctatggaaaaaagaaaggtcggatggggatgaagactcggcaggtagcatggctgccatggattatgtttcatcttgttcagaatgctctgaagacttgtttgtttgtgaccgacacaaggatggaggtggttctagagatgtcaacaggggcggagggcagagagttgttagaagctgaaaaaggaaatgggacagctgggaagggggaatttcaaattcaaaagagtcagactaatcatgacggacaaggtatggaagaaggcctaaagaggatattggatctagatgtagaactactgccagaagcatgcaggtctcaaggagaaggtggagtatattggtga

SEQ ID NO: 107515 - DNA, 1935 bp, Glycine max
  Peptide Sequence Number=SeqID_224293
atgcccaaaagaaattatcttgtagcctgcgcagagtctttgcaacacctaagtgaccgcccaacaggcgcgaatagtcacagaactcttgggtatcctgcaaggagagtcttaattgttcgaggaattcgaaattggccatggataaggcaaaatgttgactttccgaggtgtggatgcgtgacaaggcatcaacagccacgttactggagccagacctgtactgaatggagtaatcaaaaccaagaagcttggagagggatacccgagaaggtagtgccgccatttgcggactaccgaggtaatagcatggagttcccgtatgtaagtcgaggcatgttgcagtcgtggacagaataccttgctgaagaaggcaatgggatgagagtgttgttgaagcactgctcccatggccgtacccgaagcatcggcttcgaggatgaagggcaatgcaatggaggcgtaatggcggatgaaacgacgataaaaaccggagtgcgccagtcaagcatggcactgatcttggagggatcaggggccactcccgctgccgagactacatggcccaagatgtcatcgaaaaagactgcaacagacttgcaaagaaacggtttaagcaattcgttcatcgtggcttggaacgttgtcggggcgtgtagaggccgaagggcattactttgtattcgtaatgtccttgatgggggcgcaaagcagttttgggcatgtcgtcggtggccatggggatttgatgaaatccctgacggaggtccaatttggaaaaataggaggcattggctaactcatccaagagctcgtcaatggtgggcatgggaaaacgacgggagaggaaaatgggttgtgactcaattggatgaagctggtttgcagcatattggctatctgacactcaagctcagctttttgactgtgggggtatcggtagggtcgtatgttgacgggttgggaatcagggtgattcctggaagaggtgattgtaacgggaaaggaggtgtagtaggggagggtatgtatcaaggcaattgggaaagggatttggtgagcagaggccggggtggggtagaggggaacatcggcggtgagttggattggacggcccaacaaggagcagctcatggtgcgggagtgaccctggaccgtcagtggaacattagggcagacttgttggcaaatgagggtgccaccatcgccaatcataacttggagagggttgatggcggtggtgtgcagggcgagaaattgggcgacccgagcttgaacaaagttgtggagccatacatgcggaaggttgtcggggcaagcatgcccgacagggcattgagactgagctgcggggtttccggtagcggcggaagaggaaactccaagatcggtccgcagtctctgcgagaagcgagctcctccggggaaaggcgtttcaccggaagcttgggtggtggtggtgaagtggtcgtggtggagagtgggcaaggagttgcaggtggtggtgcagcagaaaatctcggaggacggcaacggtcgggcacgaggccagaaacaaagcaacttaaaagaatagggtgggcgagtccgaccgcccggttggctaacctctcaaattcagagaggaagaaaggagaccgttgcggctcatccactggaaccagcatagagtcggtccttccatgtagaaggaagccacagtcagacgctcattgggcgtcgagcttcatgtgcggccggggaattggagaggaaggttgtgatggaggcggggagtgtttaggagagggagggggaagggattgcatggttctggacgagggactgttgaccctgttgaaggtggagcacagcctcttcaagtcgctctgtggtcgcttgcctggtattgtgctcaagcatggaggaacgatagggcaggtcggaccaagttga

SEQ ID NO: 107516 - DNA, 414 bp, Glycine max
  Peptide Sequence Number=SeqID_224294
atgtcccttgagatatctgagaatcatcttaactgccacccagtgagaatcaagaggtttactgcaaaacttatatcaggtctagaagtagaaccagaatcagcaggggcagtaactggttcagcagaaccaggctcaggagagtgtcatgaacaggttcatcctacaccttcatcatccacttcttcccttcccccagcctctatacccattgtgtcgcctgttcaggttaatcaaactttatcccctcaggtcactacaccaccttccaacacttctactggttcatctaagccctctactgttcctcattcccccgaagtatctgccacagatgctcggcctctcaattctgatagagtcagtccctctgataccatcttaagaaaacttagatggagagaaagaaaatga

SEQ ID NO: 107517 - DNA, 252 bp, Glycine max
  Peptide Sequence Number=SeqID_224295
atggttggttccatcgaggtacattatcacagtgattggttacctcctatattgagtttgtggttgtcattatggtgggtgttgtggtggcaacatcgaaggagtaaaaaaaacacagttgtgaagacaggtgtactcacgaccacagcaagaggcgagactaccaagaagatgaaccataaattcaacaaccacagaacggtgaagatgaacggaggagagagattcacggtgcagtggggaggaagatga

SEQ ID NO: 107518 - DNA, 285 bp, Glycine max
  Peptide Sequence Number=SeqID_224296
atgccgatctccccctgcaaaaggatcgcacccacaaagacacccagtggacccggagaagtccaacagggccctggggtttccagctctgggatcccgcccataagacagctagtggacctgaaaaagtccaatagggtcttggagttgccagctctgattacgggcctctgtcagttctacggagttcctgtcacccccagcaaggttatcaggccccctactaatcgagctttcatcaagaagtactgcgccctcaggcaggcacagggcgagacaccatag

SEQ ID NO: 107519 - DNA, 204 bp, Glycine max
  Peptide Sequence Number=SeqID_224297
atggtcattgtgcttgatggtgcccattttcatacctcatatgacacgggaaatattccttatgcggaggaatacttgtacaagggggtgtgtcactcggtttggaactcccttgagactcaggctgatcaccgtgggggagggggggagcttccttgcgcaacagggtggcctcgacacttactgcctagttttcctaagtga

SEQ ID NO: 107520 - DNA, 2208 bp, Glycine max
  Peptide Sequence Number=SeqID_224298
atgtgtgcagaactcaggaaattagttgatagaatcttgcggataattccacagatagaagcagcacgccctagtggaatgcaggctctgtgtttgctgaacgaggcaattgataaagccaaacaactcctgttatactgctccgaatctagtaaactctacctggcaataacaggggattccatactctcaaaattccagaaggcaagaaaatcattaacgcaaagcttagtccagattctgaatatggttccagttatgttggccgcagagatttctcgactaattggtgattttgagtgtgtgacatttgtcctcaactctgctgaacaagcagctgggaaggttatgaaacaattgctccagcaagatccttcaacatcagataaagattcaatggaggaatctgaactaaaagattttcagtttgtagcagcaagacttggtattacatccccaacggccatcttaatagagagacgatctattcagaagttgttagaaaaactcaaaccaaatgaccagacaaaagagatcatcttgaaaaatcttttgtttctcctgataaagcaccgaaaatcaatcacaggggaacaaatggaggtctactctcaaagtgaaggaccaatcacaactcagaactcagatcatgagtctcaaaaaaaccttcatgtcaagtcatacctgtacttgaaccatggtcagtatagaactcatgccagtgagttgagcagacttacacctcctgaggaatatacatgcccaatatctttaaggttgatgtatgaccctgttgtcattgcttcaggaaaaacatatgaaaggatgtggatacaaaagtggtttgatgagggtaatactatatgcccaaaaactaaaaaggaattggctcatatggcattgactccaaatgttgccttaaaggacttgatattaaactggtgcaaaactaatggagtctccattcctgacccgcgtaggcatgtgcaagattttcactcatgggaagcttcctccaactccattaggagttttggaagttctttgtatgatttgaacttcccaatggattttagtaacatgtctcttggatcattagataccagttataattcagattcctcccacactaaggccaaccatagcttaaatttgatgttgaacaagagcagtgacaattcgcgcaggcatcaatctcatgtacggatacatgacgctgatcggatgcatttgtctaaactccatgagcgtcaatgggaatctcaatgccaagtcattgaaaatatgaaaatagatttcaaatgcaattaccaagctttttgctctgtgtcatctgagagtttcattgacccactcacaagatttctgagcactgcatgtgagaggcacgatgtaaaagctctgcgagcaggaactaagttgctaatggaatttatgaagtgttgcagaaatggtatgaccaatttaagtgaagatacatgcattatgttggcaagtcttcttgacacagaagcgattggtgaagctctcaccataatggaagaactgacagggaattggtatgaaaaagctaacgttgcagcttccagtgtgctcacttctgtttcaaagatccttgattcaggtaatgaagagttccaacgaaaagctattaaaataatgtataatttttcatccaatggtcaaatttgtccctacatggtgtctctcgggtgcatccctaaattactgccattttttgaagacagaacccttttgagagacagtatacatatcttgaaaaacctttgtgatactgaagagggtagggttactgttgtagaaacaaaaggatgcatatcttctgttgttgaaatacttgggactggcagtgatgaggaaaaagaacctgcactgattattcttctctctttatgctctcaacgtgtggaatactgtcagttggttgtgtctgaggggattattccttctcttgtcaacatctccaacaaaggaagtgatatggcaaaggcttatgcattagaattactccgtcttttgaaggacgacgagtttcagtatgaagattgttgtgagccaaatctcggtgcctctcaagaacctaacaatcactatcaagaaaagaaatcatcaaagaaaccgtcaattttgaagaaactatcactgttctcaaaatccagttcagttgcaccaaaaaccaaaagatga

SEQ ID NO: 107521 - DNA, 372 bp, Glycine max
  Peptide Sequence Number=SeqID_224299
atggactttgatgcaaaacttaaaaagttatcaaatattttcttcttcacttacttcttcttcctcaaattagggtttctaaaggcagtcctcaactttgtgccgtcagaggggcggagattcagctccaacggcgaagagaggagggttgttggattcggctccaacggcggtgcggattccgacaattggaacaataagaagagtgagtccaacattggtagcagcgagagtgttggtgttggtgggatgccgaagcttgtgttgcaacctcggacactgtcggtgagcaatgaaggggataatgtggtgaagcctaaaggagttaatctgtttggagaggtgagaccgagggatgttgaattttcgtag

SEQ ID NO: 107522 - DNA, 210 bp, Glycine max
  Peptide Sequence Number=SeqID_224300
atggagaaaattgacataggaaaggaccaagtcgacgaaagggtaaggaaacagcgtggcaatcccagtggcgtgccgtcaaacaagagcaaagaacagtcttcgtcattgggctacctgcctgtgagggctgtgatggatgtgaaccgtccacctggacacacatgtggtctctgtgggtcccaggctggtggctgtgacgaaaagtag

SEQ ID NO: 107523 - DNA, 1017 bp, Glycine max
  Peptide Sequence Number=SeqID_224301
atgcctgcaacgccattctcgtgttcgttcctcactcttcaaccgcgcttcaactcctacgttaaccccatcttccgttcactcaccttccaactctcttcttcgccgctcccattcaatgccaacttctccagcgtcagactccactcttcgctctcgcgagcggcggagaccgattctccgaccggcggaaggtccggcgcgctaactcccggtcccgccgtcgccggtgaagttcaaaagatcgacgtgaatcctcccaaggggacgcgcgacttcccgcccgaggacatgcgcttgcgcaactggctcttcaatcatttcaaagaggtttcgcggttgtatggatttgaagaggttgattacccggtgcttgagtcggaggcattgttcactaggaaagcaggagaagaaattaaggatcagccctggcgcagcagtaaagttgcgctttggggactagttggtcatgagtttgaatcccgaaacaacctctttgcatatgcaaggctttattgttttgaagatcgaggcaatcgccgtgttgcattgaggcctgaacttactccttctttggcaaggctggtgatccagaaagggaagtccgtgtcattaccaataaagtggttcactgttggacaatgttggcggtacgagagaatgacaagggggcgtcgtcgtgagcactaccaatggaacatggatattattggtgttcccggggttatggctgaagcagagcttatagcttctatcgtcactttgtttaagcgaataggaattacagaatcagatgtcggatttaaggtttccagtcgaaagaacgtgagttttgagcctaactcaaccctacaaaaccagtttaactttcaacacactcttctatttagaggtgaccacaatttaggtggcttttcctacatccccctcaagctcaaggctactttcctagagcgtgacagacacatggactcatctaggataggctctgatatcatgtcagaatgtgggttttga

SEQ ID NO: 107524 - DNA, 282 bp, Glycine max
  Peptide Sequence Number=SeqID_224302
atgaagaaagtgaagaaggaagaagagcaagtacctagcaagtttcaaaaaagtattttgattggttgcagaaaagcattgagaagagataagacgaagaaaaagaacacatgggtttcaaatttgggagtggaccaaaaaagcttggagggtggagggatagaggttgagggcaaggagaaagtggtcaaggaggaaggaaaggtcatggtagaggcggtgttgggaagtgatggtgtggaggatggaagggtaaagcaaaagaaaaagggtatagggtaa

SEQ ID NO: 107525 - DNA, 591 bp, Glycine max
  Peptide Sequence Number=SeqID_224303
attgagaaaattccagctgacgagataaagaaagagttgaaagctgttggtctatctcaagaggctgtccaggagctattgcaagtcctttctgtgaagtcattgaccgagttagaagagagacttgggagcagtggggaagcagttgctgatctgaaacagctattctcccttgctgaaaaaattggttactctaaatggcttcaatttgatgcatcagttgttcgaggtcttgcttactacactggcattgtatttgaggatgtaggttcaggcaaccaccctttctccagccccttcaccttcacgaaccccaacaaccaccctccttccttagcctcttcgtcactttgttcccttgccgccaccgtcatcgcaacctcttcctcccctctctacccatttgatcaatttgatttggcgaacccagatcctaacaacatagagaaagaaaatgcacacaaagacagacttagaggaaagctgcgagctatctgtggtggtggtcgatatgatcatttgttctcaacttttggtgctgatgacattgctgcatgtggttttggatttggtgatgcagtcatagtggaa

SEQ ID NO: 107526 - DNA, 771 bp, Glycine max
  Peptide Sequence Number=SeqID_224304
atgatatcagtgttgatcctcttaaacatccaaagcactcttggcacagagcctctccgggccttttacagtccctacctattcctaacagggtatgcaaagacaatcgagtctgatggcatgcagagacaaattatggtcatctgcccccttttgtcgaagaattcaatgtctttcgaccgagactattacagtctcccctcgccaaccagagacaaagacaatcgagtccgatggcatgcagagacaaattatggtcatctgtccctttttgtcgaagacttcaatgtctttcgaccgaaactattagagtctcccctttgccaaccagagacaagtgagtccgttggcatccgaagacaaattatggtcatccgccacctttgctatctagagacaatcgagtccgatagcatgcagaggcaaattatggtcatccgccacccttaccaaccagagacaagcaagtacgttggcatgcagagacaaattatggtcacccgcttccgttgccatccagagacaatcgagtccgatggcacgcagagacaaattatggtcatctgctcccttttgtcgaagactttaatgtctttcgaccgagactattacagtctcccctttgtcaaccaaagacaacaaaatggtgaaagatatcaaccatttaacgtaaagcaatcaggggtagaagcggcaaagactcaattcttggtgggaaaacgaaggattaagtcgttacagttcaaaagttcaaaacaaaacagcgagtag

SEQ ID NO: 107527 - DNA, 1734 bp, Glycine max
  Peptide Sequence Number=SeqID_224305
atgatgatatcctttattctattagggaagtacttggaaattgtggctaaagggaaaacatcagatgctttaggaaagctgactcaacttgttcctgataaagcttatttagtagcaattgatactgatggaaatatcatgacagagacagaaattgacactcaacttatacaaaaaaatgacataattaagattgtttatgggtccaaaattcctgttgacagtatagttataaaagggcaaagctatgccaatgaaagtatgatcactggggaggcaagacctgttgataaaagcccaggagacaaggttatcagtggaaccatcaatgagaatggctgcttattggttaaagccacacatgttggatccgacactgcactttctcaaatagttcaactcgtagaagctgctcaactggccaaagcaccagttcaacaacttgctgaccatatttcaagggtttttgttccaatagtggttgttgcagctctaataacttggcttggatggttcattcccggggaagctggtatttaccctaaacattggataccaaaagcaatggatgcatttgagcttgctttgcagtttgctatttctgtgctggttgttgcttgcccatgtgctctgggtcttgcaacaccaactgcagtcatggttgcttcaggcatgggtgcttctcaaggtgttctgatcaagggtggagatgcactggaaaaggcacacaaggtaaaaattgttgtgtttgataagactgggacactaacaattgggaagccagaggtagttagtgcagtgctgttttctgaattttctatggaggaattatgtgacatgacaatttatgtagaggcaagtagcgagcacccgatagcaaaagctgttgtggcacatgcgaagaggctgcgccagaaatttggttcttgcattgaggaagtcccagatgtggatgattttgaggtacacatgggagctggtgtaagtggaaaagttggtgatagaacagttgtggttggaaacaagagactcatgcatgcttgtaatgttccaatatgttccgaggttgagaagtacatctctgaaaatgaaattctggctagaacttgcattttagtttcaattgatggaaagattgctggtgcattctctgtaactgatcctgtaaaaccagaggctaaacgtgtcatatcttttctccattctatgggcatctcaagcatcatagtgactggtgataactgtgctactgcaactgctattgcaaatgaagtgggtattgatgaggtctttgctgagacagatcctgtgggcaaagctgataaggtgaaagacttgcagatgaaaggaatgactgtggcaatggtaggtgatggaataaacgactcaccagccctggttgctgctgatgttggcatggcaattggtgctggaactgacatagcgatagaagcagctgacatagttcttgtcaaaagcagtttcgaagatgtgatcacagccatagacttatccagaaagaccatgtcgcgcatccggctgaactacatctgggctcttggttacaacattcttggcctgccaattgcggctggagtcttatatcccattgctggaatcagattgcccccatggcttgctggtgcttgcatggctgcttcctctcttagcgtggtttcttcgtctcttttgctgcagttctataaaaaacctcttcatatagaatcctcctga

SEQ ID NO: 107528 - DNA, 1815 bp, Glycine max
  Peptide Sequence Number=SeqID_224306
atggacgaggatttcgacatggcggcggcggagcccatgggcgaggacttcgacttcgccggcagcggcagcaaccccgtcctgaaggtcggcgaggagaaggagattgggaaagagggtttgaagaagaagctcctgaaagaaggtgaaggatgggacacccctgaagctggtgacgaagttcaagttcactatactgggacgttgcttgatggcacgaagtttgactctagcagagataggggaactcctttcagtttcacgcttggacaagggcaagttattaaaggatgggatcaaggtattataacaatgaagaaaggtgaaaatgcccttttcaccatcccagctgagctagcttatggtgaatctggttctcctccaacaatcccccccaatgcaactcttcaatttgatgtggagctgttgtcttggactagtgtgaaggacatatgtaaggatggaggcttatttaagaagatacttaccgagggagagaaatgggaaaaccccaaggatcctgatgaagttttagtgaagtatgaagcacatcttgaggatggaactcttgtggctaaatctgatggagtggagttcacagtcaacgatggtcatttttgtcctgctttttccaaggctgttaaaaccatgaagaagggagagaaagtgcttttgacagtgaagccacaatatggatttggtgagaagggtaagccagcgcatggtgatgaaggtgcagttccaccaaatgcaactttgcagattactcttgagctagtttcttggaagactgtgtctgaagtaactgatgacaagaaggtcattaagaagatcctcaaggaaggggaaggatatgagcatccaaatgagggagccattgtgaaattgaaagtaattggtaaactgcaagatggtactttatttttgaaaaagggtcatgatgatgaaggagggctgtttgaattcaaaactgatgaggagcaagtaattgatgggcttgacagagctgtgttgactatgaagaagggtgaggtagcattgttgactatagcacctgaatatgcttttggttcatcagagtctcaacaggaacttgcagtagttccacctaactccacattatattacgagattgagctagtatcatttgagaagaaattgttattggaaaggaatgctaatcaccatgcagttttaattaaacaaaactcatttgagaaggagaaggagtcctgggacatggacacaccagagaagattgaagctgctggtaagaagaaagaagaaggaaatgcattatttaaagctggtaaatatgcaagagcttctaaaagatatgagaaggctgtaaagttcatagagtacgatactgcctttagtgaagaggagaagaagagctccaaatccttgaaggttgcctgtaatttaaacaatgcagcatgcaagttaaaattaaaagattacaaacaagcagagaaattgtgcacaaaggtactggaccttgagagtactaacgtgaaggctctttatagacggacccaggcatatatccagttggctgatttagatttggctgaatttgatattaagaaagctcttgagcttgaacctaacaacagggatgtcaagcttgagtacgtgactctgaaggaaaagatgaaggagtacaacaagaaagaggcaaaattttatggaaatatgttcaacaaactgcacaagctagattctcttgacaatagtggtatgttaggaaaattcaattttgtatctcaaggattggtggttcctagttctatggaacgaaagaagaagtag

SEQ ID NO: 107529 - DNA, 312 bp, Glycine max
  Peptide Sequence Number=SeqID_224307
atgacatccgaaaatgttgattggaagctgagagttggtttagagtttgaaaatatagaggtatgggaattttggactggatatagtaggaaagtaggttatggagttagaagacacttccaaaacaagccaaagaaaatgatcattggagtcttttgcaactgggtacctcggagaaggagttcgccgatcaagtttgagatttctggtggctattttgtcgtggttgctgcaaagggcatcactgggttgtcatcaacacatctgcagttatggagaatagtgaaacagtcaaagaaaaggtggttttaa

SEQ ID NO: 107530 - DNA, 894 bp, Glycine max
  Peptide Sequence Number=SeqID_224308
atggtctttatgccttattctagggaacaacaagaggaaggtttgatgtttgacaaagactgggagaaggatataacccaggaaacgatggatgtcatgctatatggaaagccatgcccaaatactactaacaggaaggcctttgttagcctcttgaggactacgaacctcatgtatatatgcagactcatccatagctttctgttcaacatagtaatgcctagactaggatcaagagactatgtatgtgatagggacaaattgtgcatgtataaggtgatggtgagtgagaaagtgaatcttcctgaaatcataaggaacgatagggtggatgtgtttgtgttagaaccacctgtagatatcacacagctaaagggtgttacctttgttaagatggggatagccaacaacttcccagaatatgctcaaaacaagaaagaagatgttgcatttgctaaggcaaagaagaagtccttggcagagtctaggaagaaggacaagataggcaaaactcttgagatgaaggatgctatagaagaagaagatggcatcattacctttgtggaagctctgtctatcaaagagcataagaagaagttggttaaagatgcaaggatagtaacagaagaggctaccatggttgatgttgatggtgatccagtgcctgtagaagtgattgttgaatcaatccagacacaatttaaactcaaagttgaagtggctatcattcctgaagacttggacccaaaagagaaagaagctcttgaaaaagctatggtccaatctattttagaagtttctctcaatgaatatgaggataacattattgagacagaccctggtgctgcagctattgtaacgacctgcctcatcgctacgatatcactactctaa

SEQ ID NO: 107531 - DNA, 993 bp, Glycine max
  Peptide Sequence Number=SeqID_224309
atgggtgtcaagttcctcgaagcggtcaagcgaaggtttcattccatcaaacaatggtccccagatgaaattagggagaagccaaaaggaggccatttccaccatttacttattgctagtttgagttggctaaggagaaacccgtacacatgtaagtttggggttgcttggtgggatcctgtacctagtgtaggagaggttaatggaggatgtatttcctttgggatggatggacaggtgactctgcatcttaggccaagattgttgcagatcttgtgttgcagtaagccactgcccacgtgctttgatcctgactggaccactatattgctccacagattagtcattcgggatggctcaaatagtttttggcacatgctagtgttgttgcccgattggggtgttgttgattttactatgattaagggattatctagcctaatcactcgaccatatgaatctccatggagtagtcattgcattgtgaacaagaaaggtcctgatgctaggttgaggagtcgtctccgcattgtgatcggcttggcggtgggcatcgtgggtcgtcacaactgcaacccatgttgttgtggatgtggacaacagaatgacgatggtgttgaaggggtttggttcacgaaggcaatagaggagaaaaatgacacaaaaccatggagtggagaaaggagaagaacatggagtaaatacacaaagggaaaactcactgatggaactgttttcgattctagctttgaaagaaataatccaattgaatttgagcttggtactggtcaagtgatcaaaggttgggaccagggattattgggaatgtgtcttggtgagaagcgtaagctgaaaataccatcaaaacttggctatggagagcagggttccccacccactattccaggtggtgctacactcatatttgacgctgagcttgtgggagtgaacgacaaaagtttaggcgaaggaaaaggaaacaacgaactgtag

SEQ ID NO: 107532 - DNA, 1222 bp, Glycine max
  Peptide Sequence Number=SeqID_224310
ctcgcaaatgtcaaactcaggcgtggaaggagagatagagaagaaagcactgtggtttagaggagctgttttggtagcaaaggaaggggcttccaacaggatggcctttagaatttcaattgattcttttgcgtatgcccttggggcagcgctgccactgcttattgcaatctttttctccgtgttttttgctggttataagccggcttgcgagcgaaagaggttgtccagtgttgaagaagcccccaagtatgaacaagtgttgtccggtgttgagagcgataaccttgacaagtgtgagagttgcaggtctgtgaagcttattaagcccccgagcctagacaaagtccatgttgcttctatcaagttggcaggggtggacacgtttttggttttacaggcgaggtatgacgtgtcaggcgtgtgcggcgcatgcatagtactcttgcatacatgtcactcgtggagtggggacatactagagttgtggtgtgtaggggttcgattcaaaaaccctagatggactaggaggttatttccattggcggttcctcctcggagaatactcatcatggggcctctaacagtgaatcctcttcctcagaaaggtggcttcgtgttgtactggtggaggcacctctcgcctttgtgggaggcaaggagatgcggtggggacgttagggtgtctccccgtgggcgatgtaaccatagtgttgggttgccatcacctttgcggagtgatgacttccctttcttgagggttacgttgggtagtctgcccttcttcttcatgtataaatgtttgtttgaggtcttgggtctcattcttctcttgaccgcttttcagtgtgctcttctcgagcacttgaatgtggccccttcccaactccacccgaatagttgggccatgccgagggcctttaaaattttgtgccccttcttgaacattcggcctaatgtgtcggtcttcctatttttcctccaaatgaagctaaatggcaagattggttgggcctccttgaatagtgtgtccaataagttgtttaagtttgactcaaacatctttcgccgcttcaaggactatttcgttagggtcctagctactgatgtcgtggctaatggatctattgactcttgtgaagagggtcaacagatctattttggaacaacttccggcctcgctagacgcgcgggccatcatgtctcttccctcgacgagtga

SEQ ID NO: 107533 - DNA, 1488 bp, Glycine max
  Peptide Sequence Number=SeqID_224311
atgagaaacctaatctttgaagagcctgaagtcagggttccaggagacacttcaagcagtctgcgctatgcctgggaatcaatacgagccccagtgataataccactcctaaaactagctgtcatactatgttcaattatgtcaatcatgctatttgttgaaagggtagcaatggcaattgtaattttagttgtcaaagtgctggggaagaaaagatacaccaagtacaacttggaagccatgaaacagaagcttgagagaaacaaaagattccccatggtgttgatccaaatacctatgtataatgagaaagaggtctacaagctttcaattggagcagtatgtgggctgtcatggccagctgacagatttatagttcaggttcttgatgactcaacaaatcaatccttaagggaatgtgtccaaatggagtgtcaaagatggatacaaaaaggtgtgaatgtcaaatatgaaacaaggacaaatcgcaatggttacaaggcaggtgccatgaaggagggtttggagaaggaatatgtcgaggattgcgagtatgtagcaatatttgatgcagatttccagccagatgcagattttctatggaatacaatcccttatctgcttgagaacccaaaattgggtttggttcaagcaagatggaaatttgtgaattccaaggaatgcatgatgacaaagcttcaagagatgtcactcgattatcactttagtgttgaacaggaagtgggctcttcaacatactcattctttggtttcaatgggacagcaggaatttggcggattcaagcaataaaagatgctggaggatggaaagaccgaaccacagtagaagatatggaccttgcagtaagggcaagcctgcaaggttgggaatttgttttcgtgggtgacataaaagtaaaaaatgaactgccaagtacatttaaagcataccgatatcagcagcacagatggtcatgtggtccagctaatctctttaagaaaatgaccatggaaatcctctattgccatagggtaccgcttctcaagagacttcatcttgtctatgctttcttctttgtgaggaaaatagttgcacattgggtcactttcttcttttactgcatagttataccagcttgtgtgatagttcctgaagtcagtctcaaaaagcagattgccatatacatcccagcaaccattacaattctaaatgcagtctccaccccaagatccatgcatctactagtactctggatactctttgagaatgttatgtccctccatcgaactaaagcagcaattattggactcttggaagcaaatcgtgtcaatgaatgggttgtgactgaaaagcttggaaatgccatgaaacagagaaagaatgctaagccatcaagaacttcatggttccgaattatagacaggcaggagctttctttacaatgggatttgggcaagtgggaacaattgtaccctactaaagcttaa

SEQ ID NO: 107534 - DNA, 1017 bp, Glycine max
  Peptide Sequence Number=SeqID_224312
atgggggttggggatatccttaggtcctcttcctccatggtttttggatggtgtaggaggaagactttggcccctatgcatcattctagaagcagtcagctgagattgcatatctcgggctcagatatcaggagatgcaacaattgtttacgagtgtgtatagagagcaatattacaaagaaaatttggacttggtgcaggctggggtggttgcacataccaattagcttctcacaatggaagttagggataaggaggctcaggagaatattgggggtgatatcaatggaatgtaaagattattattttcaatgtcagagggttgcaggatggcttaagagatcgaggctgagatcctttcttgtgtccaataaagtcgacatgtgcatgatccaggaaaccaaggtcggagttatgaaggaaatggtggtgagggaaatctggggcaaaaagggttaccactgggtagcagctccatcaattggtatgtcaggagagtataaatggggggccaaaccgtttaagttcttcaacttctggtctcaacatccgagcttaaagaaagtagatttggaaagttggtctcaaccatgtggggtgcaatggaaactctatgctttcaaggaaaagctaaaagctcttaagctttccttgaaggcatggtgtaaacaagagtttcaaaaggtggattctcaaattgagacaatagagagggatttgaatgatttggatgccaaattgatagcagggaaagagatttttggaggtttctatagaagcaagcttcataatgaatcaagattgattcaaagaattttttatgataacaaaggtgatgaaaaaaagctcaaagaatcaaggaatgagttcaagatgttcaagattgaatcaagaacacttcaaggttcaagaggaaatttgatttcaagaatcaagaatcaagattcaaggttcaagcttccaagaatcaagatcaagattcaagactcaagattcaagaatcaagagaagaattaa

SEQ ID NO: 107535 - DNA, 4113 bp, Glycine max
  Peptide Sequence Number=SeqID_224313
atgtcaaaagattctgaggagataaaaaccattgagcagtggaaatggaccgaaatgcaaggccttgagcttgttcctgaagagggtgctgctgctgcaccttcacaacatcaccaacttccaatggaaatgaacacttctgaaccacccaacaaagatgttgttggtgcttcttcttcttctgcagcagttactaatggggagaagaaagagaaagagaaagagagtgttccctctgttgggtttggagagcttttcagattcgctgatgggttggactacgttctcatgggaattggaaccgttggagcagttgtgcacggttgttctctgcctctctttcttcgcttctttgcggatcttgtcaattcctttggctccaatgctaatgatgtcgacaagatgactcaggaagtggtcaagtatgcattttacttcctggtggtgggggctgctatatgggcttcttcatgggcagagatttcgtgttggatgtggagcggggagcggcaatcgaccacgatgagaatcaagtatctagaggctgcgttgaaccaggacattcagttcttcgacaccgaggttcggacatccgacgtggttttcgccatcaacaccgatgctgtcatggtccaggatgccattagtgagaagttggggaatttcattcactacatggccacctttgtttctggctttgttgtgggtttcactgctgtgtggcaattggctttggtgactcttgctgttgtccctatgatagctgtgattggaggcattcacaccgccaccttggctaagctctctggcaagagccaggaagctctttctcaagctggcaacattgtggaacagacggttgcacaaatccgggtagtgttagcctttgttggggagtccagagcattgcagtcttattcatcagccttgaggatcgcacagaagattggctacaaaactgggtttgcaaagggaatgggattgggtgctacttactttgttgttttctgctgttacgcgcttctgctgtggtatggaggctatctggttaggcaccacgccaccaacggaggacttgccattgcaaccatgtttgctgttatgattggtggattgggtttggggcaatctgcaccaagcatggctgcgtttacaaaggccagagttgctgctgcgaagattttccgtataattgatcacaagccgaatattgatcgaaatagtgaatctggcatcgaactagacacagttactggacttgtggagctgaaaaatgttgacttttcttatccatctaggcccgaggttcagatcctcaatgacttctccttgaatgtacctgccggcaagaccatagctttggtgggtagcagtggctctggcaagagcaccgttgtatccctcattgagagattctatgacccaacttcaggacaagttctgttagatgggcatgacattaaaactttgaagcttagatggttgaggcagcagataggactagtgagccaagagcctgcattgtttgcgaccacaatacgagaaaatatactgttgggtaggcctgatgcagaccaagttgagattgaagaagctgccagggttgctaatgctcattccttcatcattaaacttcctgatggctatgaaacacagatgagatttgttcagaagtcaaagccaggaaatgcctgtttatgcattgcatctgcaaaagaccaagaggaagtggatgaaatggtaggagaaagagggctgcaactttctggagggcaaaaacagagaatagcaatagcaagggcaatgctgaaaaaccctgcaattcttctcctagacgaggcaacaagtgcattggactcagagtcagaaaagcttgtgcaagaagcccttgaccggttcatgattggccgaacaactcttgtaattgcccatcgtctctccacaattcgcaaagctgaccttgtagctgtacttcagctaggaagtgtttctgaaattggaactcatgatgagctcttctcgaaaggtgaaaatggagtctatgccaagcttataaagatgcaggagatggctcatgaaactgccgtgaataatgctagaaagagtagtgcaaggccttcaagtgccagaaactccgtaagctcaccaataattgctaggaattcttcttatggacggtcaccatactcgcgtaggctatctgatttctctacatctgattttagtctttcccttgatgcttcacatccaagttacaggcttgaaaagcttgctttcaaagagcaagctagttccttctggagacttgcaaaaatgaactctcctgaatggctttatgctttaattggctctatagggtctgtagtttgtggatcccttagtgccttctttgcttatgttctaagtgctgtcctcagtgtgtattacaatccagaccacagatacatgatccgcgaaatagaaaagtactgctacttgttgattggcctttcatcaactgcacttctcttcaacacattgcaacacttcttctgggacattgttggggaaaatcttaccaaacgtgtgagagagaaaatgctgatggcagtgctcaaaaatgaaatggcatggtttgatcaggaggaaaatgagagtgccaggattgctgcaaggctggctcttgatgccaacaatgtcagatcagccattggagatcgaatttctgtaattgtgcagaacactgcacttatgctagttgcctgtacagcaggatttgtgttgcagtggcgccttgcccttgtcctcgtagctgtctttcctgttgttgttgcagccactgttttgcagaaaatgttcatgaccggtttctctggtgacctggaagctgctcatgccaaggctacacaacttgcaggagaagctatagccaatgtaaggacagttgcagccttcaattcagaaacaaaaattgttggccttttcaccaccaatctccaagctccactacagcgttgtttttggaagggacaaatttctggaagtggatatggtgtagctcagtttgcactttatgcttcctatgcacttggtctttggtatgcttcttggctagtgaagcatggcatctctgacttctctaaaacaatccgagtttttatggtcctaatggtttctgcaaatggtgctgctgaaactttaacactggctcctgactttatcaaaggaggccaggccatgaggtcagttttcgaactccttgaccgcagaactgaaattgagcctgatgatcaagatgctactcttgttcctgatcgtcttcgtggtgaagttgaacttaagcatgtagacttctcgtatccaactcgcccggatatgccagtttttcgtgacctcagtcttcgtgcaagagctggtaaaactcttgcccttgtaggacctagtggctgtggtaagagctcaattattgcacttatacaaagattctatgatccaacatctggtcgggtcatgattgatggcaaggacatcaggaaatacaacctcaagtccttaagaaggcacatttctgtggtacctcaggagccatgcttgtttgctactactatttatgaaaacatcgcttatgggcatgagtcagccactgaagctgagataattgaagctgcaactcttgccaatgcacacaagttcatatctggtttgccagatggatacaaaacatttgttggggagagaggtgttcaactatccgggggacaaaagcagagaatagccgttgctcgggcttttttgaggaaggctgaacttatgcttcttgatgaggccacaagtgcacttgatgctgaatcagagaggtctgttcaggaggctctagaccgcgcctcctcaggaaaaacaactatcatcgttgcacataggctatcaacagtcaggaatgccaatctgattgctgtgattgatgatgggaaagtagccgagcaaggctcccattcacagttgttgaaaaatcacccggatgggatttatgcgcgcatgattcagttacaaaggttcacacacagccaagtcattggaatggcctcaggttcaagctcttcaacaagaccaaaagatgatgaaagagaaggctag

SEQ ID NO: 107536 - DNA, 321 bp, Glycine max
  Peptide Sequence Number=SeqID_224314
atggcatcatcttggaccccaaggcaaaataaacaatttgaaagagccctggctaaatatgatagagaaaccccagatagatggcagaatgttgctaacgaggtgggaaaatcggttgaggaggttaaaaggcactatgagatcctcaaagaagatatcagacgcattgagcgtggtcaagtggcattcccctacagaacaaacaattctaacaggagatggaatttggaagcgatggcggggaaaagtggagcaccgtatctgaagaaatctgagtcaatgggaacagataagttcatcctagaagggaacaaatggtga

SEQ ID NO: 107537 - DNA, 291 bp, Glycine max
  Peptide Sequence Number=SeqID_224315
atggaatcatcttggacaccaaggcaaaacaaaatatttgaacatgccctagctatatatgatagggaaacaccggataggtggcagaatattgcgaaaatggtgggaaaatctatagaggaggttaagatgcactacgagatcctcaaagaagatatcaagcgcattgagcaagatcaagtgccatttccttatgcaggctatgtacaagtagcacattctgctaacttgaattccttatttcatgcttggcaggctcatgatacttatatatccagaaccccaaattag

SEQ ID NO: 107538 - DNA, 303 bp, Glycine max
  Peptide Sequence Number=SeqID_224316
atgatcttggaggagagggagaaactaatcaaggtcatcaatgagaaaaaccttttgttgactaagaagattgagattgttgatgaccttgccaattatgagaagatgatgcaacaagtcttcatgatgggtcatgaaaatggcttccaaaaagctcttcaccaagttgctctatttgcttctatgataatcttgaagaattttgatgtgttgaaggatgtgaagaataaagagatagcgagggaatctcaaatggagagttttgaggatgcttatggaaatggggcaaactctaaggaatga

SEQ ID NO: 107539 - DNA, 333 bp, Glycine max
  Peptide Sequence Number=SeqID_224317
atggcaagcaatttacaaataaggggtacaaaaaatttctgcaatagctcagaattaaacacttggtgtcctcagctgagcatccccagaccaatgggcatgctaaagcagcaaacaagacttacctatgccactaatgccatgatccaagttgaaattggagaacccttagcaagaaaagcacactttgaagaagcactcaacgatgaaggattaacctttaagttgcatatgattgaagagatgagggagcatgctcagattcaagaaaaagcttgcaagaggagagaaactcggaaacatcaatcaaagttgaagagaagaaaattttga

SEQ ID NO: 107540 - DNA, 321 bp, Glycine max
  Peptide Sequence Number=SeqID_224318
atggtggatggtattaatgccttggatgtaaaggatgaaagtgaaggtcttcagaagatacctttttctatggacccatcaccatttaatgtgctttgtattaaggctttgttgagatactttgaacttgtgttaggactaaaggttaattttagggagagttgtttggcaaatgtgggagtggaggaaagttgtattagtagatatccaaggtggcttaactattgtgttatggatattccttttgtctaccttggcattttcattggtgttaatctaaggaatgaaatggcatgggtacctatcattaagaagttatga

SEQ ID NO: 107541 - DNA, 944 bp, Glycine max
  Peptide Sequence Number=SeqID_224319
atgagagagcaagataaggtcatagagatgcctagcactttggattataacaactcctcttctagtcccaagctatcatcaccaataggtgaaagatgtgatcaattacctcctcatcaatctcacacattagttttcactgatccaccacaaacttcttcacatcatcataatctctatcccccttcactcccaccaaaccctcttcaacttccacaacctcatcacagacccagaagagatccagatccaagtcctattatttctcctccaagaacaacaccacctcaaccacaaccacacacaacaacaacattattcagataccgagaatgtctgaagaatcatgctgcaagcatggggggtcatgtcacagatgggtgtggagagttcatgccaaatggagaagagggcaccccagaatccttcaagtgtgcagcttgcgagtgccaccgcaatttccacagaaaagaacctcatcaaggagtagtactagagtcacaactactacaacatgttctcaacaaaaacagtaggaacataaacattcttcattctccacactctcatcatgttcttcatggggttgttggtgggccagttcagcccgtgatgttgggctttgggggatcaggcccagctgagtcctcaagcgaagatctcaacatgtttcagacccttgatcatagaggaggagggaacttgttatcatcatcagtgcagcagccaccactctcatcatcatcttcaaagaagaggttcaggaccaagttcacacagcaacagaaagataggatgatggagtttgctgagaaacttgggtggaagatccagaagcaagatgaacaggaactgcatcagttttgctcccaggttggtgtaagaagacaggttttcaaggtttggatgcacaacagcaagcaagccatgaagaagaagcaatt

SEQ ID NO: 107542 - DNA, 321 bp, Glycine max
  Peptide Sequence Number=SeqID_224320
atgacacatcacaatgatttccaagattattttgatgatgccaaagaatcaagagttaagcaagttccaaagaatcaggcttcaggaatcaagtctcaaataatcaagattcaagaacaattaagtttcaagattcaagattcaagaacaatcaagatcaagattcaagaacaatcaaaatcaagattaaagactcaggattcaagagaaattgatttcaagattcaagagaggaaatcgagaagcaacaatcaagacttcacaagggaagttataactcttccaatgcttttcttgacccgacatgaagagtttatgtaa

SEQ ID NO: 107543 - DNA, 297 bp, Glycine max
  Peptide Sequence Number=SeqID_224321
atgcttcaacactttgatgcaagaatttcttcaccttgggtggtgccatgggagcttgctatggtggctaaactggctatggtggctgaagtggatgtggtggctgcaactcttcatgaaggttgtcagaatcaacttcaatggaggaggaggtccaaaagtaacatgtacatgaataaagtaaacaacaccaacatagaaatccacaagtggcctcaagatagtaacaacatcgataacatggttgaaagtacgaccaacagtttccaacacaaaaaggaatggaatcaccaatag

SEQ ID NO: 107544 - DNA, 1149 bp, Glycine max
  Peptide Sequence Number=SeqID_224322
atgaggaggaggaaaacgaaaaatgaagaattcttgaagcacctaaagacattgaaggaagtcccttcggaagaagaagttgaaaatgatggcaacaaacccgtgattattagtggctctatctttcctatggaggaagaaaaattaattgatgttttgaaggccaacaaagaatcgatcactcaacctcaaaggcagctcaatcctatcatgaagaaggaggtgagaaaagaagtgctcaagattttggaagtcaatatgatttatccaatcttggataacttatgggttagctcagtccaagtggttcccaagaaaggaggcatgatgattgtctgcaataccaagaatgagttaattccaacaagaatcatcaccggatggagaatgtgcattgactattgcaagctaaatcaagctacaaggaaggatcattttccttttcctttcatgaatcaaatgcttgagaggttagccagccaagcattctattgctttcttgatggctacaaccaaattgcggtggatcctaaagatcaagagaaaatttccttcacatccccctttgttgtttttgcttataagagaatgtcatttgggttgtgtaatgctcttaccactttccaaagagggaattgccttggtcataagatctcttcaaaagggataaaggtagataaagcaaagttgatgttattgagaaactacctcattctatcaatgttaagggtatttgaagctttctcaagcatgtggggttctatagacgagtttgacttggagatcaaggaaaaaaagggttgtgagaatgtagtagccgatcatctatctagattggtgaatgaagaagtcacccttatagaaaaggattttcttgacaaatttcctgatgggttcttgttggtggtgcatgaacgcccttgtttttccaacatggaaaatttcaaagtgacaggtgttattcctaaagattttaattggcaccagagaaagatgtttttccatgatgctcatcaatatgtgtgggatgatctacacttgttcaagattggagccaacaatctcttgagaagatgtgtatccaaagtggactatgttttcaagtgggttgaagccattagagcccctaaaagttatgcaaaacggtga

SEQ ID NO: 107545 - DNA, 249 bp, Glycine max
  Peptide Sequence Number=SeqID_224323
atgacgctcaattcttatgagtcctcaaagcattacaagccaaaggtgaagacatatcatgacaagaagatcttgcataaagagtttaggcctggccaacaagttcttttatgcaattccaaccttaaagtctttcctgagaagctcaagtcaaagtggtatggacctttcattgtcaaggagttgaaagagttaccaccattatgcttctcaattacccttgaggtctttggtacatcaagctcgtga

SEQ ID NO: 107546 - DNA, 345 bp, Glycine max
  Peptide Sequence Number=SeqID_224324
atggcattcaaattcaagaaggatgcattgagaaccattactcagatttggatgtcctttgcattatccaacgttgctccaaccttgcacactttcaacctcaacagacaacatgcttctctcatctattgcatcttggctaatatccttattaacatagggaaagtaatttctgacaaaattcatagccttccctcgtccaaaaatttcggggaagaggattcaactgacaagcctttggtatttccagctttgatcattgctctatgtgcctatcaaagggccaaaatgtttgttcgttctttgaagtctctcaagaaactcatcacaaaagaagaagattga

SEQ ID NO: 107547 - DNA, 1167 bp, Glycine max
  Peptide Sequence Number=SeqID_224325
atggccagaagagctttatggattaatctgtacaacatcagtgcagctatgagctatccttggctcctcattggcaacttcaattccatcctttctccctttgatcggttcaatggagctgaagctagtgcctatgagctgaaggattttgcagagtgttatgcagaccttggtccagggggcaataacagtcatggccccggccatcaaatgaatggcagtggcatattcaaggtctgcaagagattaaaatctctcaaagctcctttgaagcttctgtacaagcaagagttcagtcatatctctaacagagtggagctagctgaagctaattatagtagtctactttgctccctcaggcagaatcctcatgactcttctcttcttgctcaagcaaatcgagctagagggcagcttatcatgcttagaaaagcaaagactatgaagatagctcaactcatcacgaacaagtatctcttgcaagctgacaaatgctctaaatttttccatgccttaatcaagcgcaataggcatcaccattttattgctgctattaggctggataatgagcacctccaacctgcatctatgtctatctgcaagctgggcccaaaagtctcccctgagtgctttgctgccttacttaggccaattacaaagcaagatgtctgggatgttatctttgtgatggataataataaatcctctgggcctaatggctataatgtctttttctttaaaaaggcttggaacattataggggatgatatctttgcagccatcaatgaattcttcattattggtaagattttaaagcagattaaccacgcaatcattgctctcatccttaagacagatcatgcttcccaggtgaaccactttaggcctatttcttgttgcaacttgctatacaagattgtgtctaagattttggctaatcgtatagcccctgtcctagagaatattattggtgaatcccaatcagcttttcttaagaacaggaaaatgatggacaatatcttccatattcaagagcttctgcgtaaatacacccgcaagaggatttcccccaaatgccttttgaaaattgatttgcataaggcttatgattctatctcttgggagtttttggattggatgctcaaatctgttgggttcccagcttag

SEQ ID NO: 107548 - DNA, 582 bp, Glycine max
  Peptide Sequence Number=SeqID_224326
atgtctcagggttatcaattagctccagtaaatctaccatctactcagctggagtgggtccaaaagtgctttctgatatccagcagctttagcttggccaactttcctttcagatacttgggtgttccctttttatcatctaggctgaatgtctgccactatgctcccttactttctcatattacttgtctcattcaaggatggagcagaaaatctctatcctatgcagggaaggtggagcttataagggctgttattcaaggtattgctaacttctggatgagtatcttccccttgccccaatctgttttggacacaatcattgctacatgccgcaactttctttggggaaaagctgatggtggtaagatcaaacctttggtggcttggtctgaagtttgcactcccaaaaaagagggcggacgcttgcggggaagatgtatgattacatcagagggaccagacctgttgtccactggagttctattatttggaatccagtcattccgtcaaagatgtcctttattctgtggcttgctaccaagaaccgtctgctcgctcttgacagagctgccttcctga

SEQ ID NO: 107549 - DNA, 330 bp, Glycine max
  Peptide Sequence Number=SeqID_224327
atggcatcagcaaatgcaatcgacctcaatcttctgaagtttgagacagaagaggatttgaatcaggtcctatcagaaggtccctatttcattttccaaaggcctctcttgctgaaagttatgcacgctttctttgactttgggaatgaggaactcagcaaaattcctgtatgggttaagctcagaaattttcctctggaactatggaacccacaagctttaggaaaaatcctatccaagattggtccccccccccccccccattcgcacagaccacttgacaacatccaagggatctatctcatttgcccatgctctggtggaaattga

SEQ ID NO: 107550 - DNA, 174 bp, Glycine max
  Peptide Sequence Number=SeqID_224328
atggctcaggaggaggagacttccacagaccagatgccagagccatctcctgcatctgttcctgaggagacccagccatctgcaccagtcatggagccagagcaacctattcaggattcatcagcagctctaacactggatcttaatgaagatcaatcaccggatgagcatgat

SEQ ID NO: 107551 - DNA, 771 bp, Glycine max
  Peptide Sequence Number=SeqID_224329
atgatttatgttccggcaacaggaaaaaataatcatgcggcggtgctaatcattcccggtgggggtttttcttatattatgaaagatctcgaagggctggatgtggccaacgtgctcagcaagcagggctacgcttcatttgtgttaatttatcgtctgccacacgacggttcagcgcagtatcgccagcaggcttttgccgacacccagcgagcgctgcggctgattcgggccaatgcgcagcagtaccgggtggcgcctgaccgcattggcgtgatgggcttttccgccggtgcctttctcgccgccaatctgagcaacactcccgatgaagctaactatcaggcggtcgatgcgcaggataaggtgtcggcgcgcccggatttcagcgcgctaatctatccggtgctgtcgctgaaacagggcgtgacccatccaggcacgcgcgcggcgctgtacggaaaagatcttagtgcccaacaaatggcgcagctttcgcaggaagatcgcgtcagcgcacacacgccgccgacttttctggtgcaggcgctgaatgatggcaccgcctcaccgcaaaacacgctgggcatgttcagcgcactgcggcagaacaaggtcaacgtggagctgcatctgttccagcagggcggtcacggctttggcaccggccagaagcaacatctgccggtgcaaaactggctcaccctgttccacgcctggcaaagcagcctggtgaagcgcacaccgtcagttagcctgccaaggatttga

SEQ ID NO: 107552 - DNA, 651 bp, Glycine max
  Peptide Sequence Number=SeqID_224330
atggtcatagaccagtcccttttctttgaactcactcaattatccagtgatggtgtaccatttaagggtacacttgatgatgagtggaagtttgacttttctgtgtctgatgcccgtcagatggtttgcaccaaccaagcggatatgattggaaggcttcttgccggttcattggcatttgaatgccgcatcatgcactacttgattgtgcgtatcctactccctagatcttccaaccttgcacaggtttctgaggaagatttgataattatgtgggttttcttaaccggtcgtcaaatcgactgggcccatcttccctttgtcaaagtcaagagatccttctctatcagtgcaaatgtagtctcttcctttggttaccgcaaaaagcgtgatggctcttgggtaaaaaagggtgctcaaccaaatgatgatgaaggacacttaccggttgaagggaactcttctctccttcagagcattttggacaggtttgatggacttcaaacctatgttggtgagaggtttgactccttggaacgtcaagtggatacacaattcgaggagataaactcaaggattgcaaaggttgaagaatatgtcaccatcattcacgactgccttgatttacctccaccaccaccatcctcgtag

SEQ ID NO: 107553 - DNA, 345 bp, Glycine max
  Peptide Sequence Number=SeqID_224331
atgacctattcatcatggcagaacaagctaaacaagtattttatgttcaagacccttgtgatgaaaggtggtctgtggcaaatgactacaccacccagttttcctcttcctcatcctaatgatgcagcactacattccccttataccttgaagcggacaaggccaattagggcagagagacctctggtccatgtggatcttgcaatggggaaagctgacggtccccacagaaagaagttaagaacatatttagggatcgtcgctcgcgataaggtagatgtgacatacaagaattggaaacaagtccctgctgcccagaaggatttgatatgggaggatatttag

SEQ ID NO: 107554 - DNA, 834 bp, Glycine max
  Peptide Sequence Number=SeqID_224332
atgatgcacacgtcgatttggcagagaggcgtggcagtttgggttgtattgttattgctgtcaggtgcgggtggatggatattgtataccgcatcaaacaccctttcagccaggcacctcatgatgcagaaaacgatcacgtcgcttgcactggcgcaacaggcattattggcttatgcccagcagccattaggtgtgacgcaatgcgaatcaaattgtccgcggcccggcgacttgccatgtcctgaccgtaataatgatggtattgctgaaacttcatgcagtaatacggcccgccttggacgattgccatggaagacgctaggtattggcgatgtgcgcgatggcagtggagagcgattatggtatgccgtctctgagcgttacaaaaacaatccgcgcattttgcccctaaatcttgatacttctggtacctggagcatgctatctgcggaaggtgtgctgtgggatgcgacccaaggtgatgggcttgtcgctgtgctgattgcgcccatgcagccattggtacgtgaagatggctgggttcagcaacgtgaagaagcttccagtgaaatagccaagcattatcttgatatccatggcctggataatgccaaccctgttgaaaaaacagtgaatggctttgtcatggcggtttccagtccccacttcaatgatgtggtttggcctatcacgacagggcacatgcaccagcaaatgcaaaaacaggttttgagtgaactcaagcgcagcctgcgctgtgcagtagcgccgtgcacggcctatccatctcccgctgcgacagaggatgaccgttgcttggggtttcaatcg

SEQ ID NO: 107555 - DNA, 147 bp, Glycine max
  Peptide Sequence Number=SeqID_224333
atggggttgaatcaatttagattttcaacatggtccatgacatctttgtcaagaggaaaacgcaaagatcggtcgggtgtcaagtacttcgaagtggtcaagcgaaggtcgcatcccaccaaacagatggtccccggacgaaattag

SEQ ID NO: 107556 - DNA, 213 bp, Glycine max
  Peptide Sequence Number=SeqID_224334
atgttattgcttagggttgttcatgtgtcctccactatcaagtgcgaagcttctggtgactgggaagcacgttattctgttgttttccagatcggttccttcgccaaaagaaaaaaagaagaagtagagatgagagtcatcatcacggaaagagcaggactgacgaaatcagtgtcctatctttgctttcctcttatttccgatgagaggtaa

SEQ ID NO: 107557 - DNA, 345 bp, Glycine max
  Peptide Sequence Number=SeqID_224335
atgtcccatgctgtcaaggaccatcgagggaaatgggccccgaactacgaagggccttttgtcgtgaagagggctttttccggaggagctttggtgcttaccaacatggatggcgaagagctaccttcacccgggcaggatcaccttgggctaccttctggaggggagacaaaacatgaacggcagaaaccaatcaaggtactacgggacgaacgcaagcggggatggggtcacgaccgaccaatcgttgcttttctctgtgcgaaacgagcagagaatgtcgctgcaaggcagccccgtatcctttgtattttgcagctttcttttactatttgtttgttttaa

SEQ ID NO: 107558 - DNA, 114 bp, Glycine max
  Peptide Sequence Number=SeqID_224336
atgtcagcagagggttggaaggaacctgatatttataggagtggaatgaagctgcagattatgtgtagccttgagaataatgaaaagatgttagagatagacggtttgttgtga

SEQ ID NO: 107559 - DNA, 702 bp, Glycine max
  Peptide Sequence Number=SeqID_224337
atggcctcggaatcagacgatgattttgaaacagatatgcaaaaacaaatccaaaaggccaaacagacaaaaactgtctacaaccaaagaccaagccaatcgttgactcaacaagaatcaacatcacaacccagcaacagttatatttcaaaaaacaagtttttcaatgttttacaaatggaaccagaatactgggacaagaatcccttcaaggcaaccgccaaagtattccccccaggattccattacaggccaatagccacaaacaaaacccgcaaattctatgaattcattctaatagatacgaactcagtatctattaaacacttcaaagaccccaaagatccaaatctaaatactcattccacaatccaaatcctaaaggttatgcagccacgacattatggctcaaacctaaaccaacccaaaaaattttctgctccatttgaccccgcaggatataattattgggattacatcgacgcctggaccaatgtgttctggcatcaaaatagtaaattcaagcattcatggctaatttacttcaaaaataatactgtgtataattttccaaattggttcctccaatggtggaactacttcggaccaattccacagatattcccagaagaagtccaacagggatccaacaattcaacaagctctataatagcaaggaatcacgtattccagcagatttaa

SEQ ID NO: 107560 - DNA, 877 bp, Glycine max
  Peptide Sequence Number=SeqID_224338
atggcggctgttgaacctggacgacaccgccgcgctgaagctgcgcaagtacgcgtggggcgcggcggcactggcctggctgagtacggtgctggtcgccctcgatcaggccacgcgtaccagcgacgtcaccacggtggcgctggatggcctgattgccctgacctacctcggcctgatcatggccatgctggtgaccctggcacgcctgcatcgccggcagaccgccgaggccgaggccaagctggaggcacaggccgatggcgtgggcgcggccacgccggtgcgccgcagcagttggctggtattggcacgcgtggcgggcaacgtcgcggtggtggccgccatcgtcgcgacgttgctgggctacctgaatttcgccaagttcgtgaaccagcagttgattggcggcagcatcgtggtgctggcggcgaccctgctgttcaacaaggtgggccagaccatcctgctcagcaccggcctgagcgtgtcgcgcctggagcaggccggcgtgctgctgtcggcggcgctgcgtaccgtggttgtgctgctcacgctgcttgcactggtggcaccgttcggcaacatcggcgcagtggtggatcgattcacttctctgttcacgaccggcttcgatatcggtggtaccaagctggcaccggcagggatcgtgatggcggtactggcgctgctggccggcctggcgatcacccagctggtgcagcgctggctgaccgacacctacctgcccaagaccgaactggatctgggcgcacgcaattcggtcagcaccgtcgcccgttacgtcggcatcatcatcgcggtgatctgggccctgagcgcgatgggactgcagctgagcaagctggcactgctg

SEQ ID NO: 107561 - DNA, 405 bp, Glycine max
  Peptide Sequence Number=SeqID_224339
atggatatgaggagaaatggttgctcaacatcatggtcattgatacacgtggtgcacaagataagaaagcctgcactcaatgacaacttacaatgcaagcaaatagagggttttcaaggttcaaggagaatggtttccttaagatacaaaattagttgggttgattggaacatataccaaataccagttaaggtttacatacttgattccaccgacaaagtgaggtcaaatggttccaaaatacttcatgattgtctggcagagtataccattccagctggtggtggtggtgattctcctcatgtccaaaaagcaaacatcccaatggaaaatggaggttatctaatttatggcactgctcatatgcattcaggtgatgaacagtatttttcgccattcttataa

SEQ ID NO: 107562 - DNA, 177 bp, Glycine max
  Peptide Sequence Number=SeqID_224340
atggtgtgtaacctaactagcgcaattctgaaccgcttagcgcgcattagtgaattttggcttagcgcggcttttctcgctcagcaaatggactgcaacggtgggcttagcgggatggactttcactcaacgaacatgcacagctcatccttcttccagattcttcctcgcacttaa

SEQ ID NO: 107563 - DNA, 843 bp, Glycine max
  Peptide Sequence Number=SeqID_224341
atgagacctctccaaaggcaagccttccacaaagtgtacgggaagattctagatttggccacagcagaggtatttacggaagctgtcgtatccctcgcccaatactatgaccagccgttgaggtgtttcacgtttggggatttccaaatggtaccaactattgaagagtttgaggaaatattaggatgccctcttggggggagaaaaccgtatctttactccggctttcttccttccttgagcaagattgcggctgtggttggtgattcagcaaaggagttggatcgcacgaagcaaactcggaacgacgtagtgggcctgcctcggaaatacttggaaggtaaggcaagggatatgccgagccaagagaagtggggcccgtttgcagatattttagctttgctgatttttggggttgtcctcttcccgaacgtcgacggtttggtagacttagccgccattgatgctttccttgcatatcaccatagcaaggaaagtccagtggtggctatcttggcagatttgtttgacacctttgactggaggtgtgagaaaaatagtgcgcgaattgtctgttgtttacccgctctctgtgtgtggttgatttcacacctattccaacaagacacgagacacccgtgtcaccatagcaatattgaatacttacgaaggcttgcggttcttgctccctcaagccacttttggttgccttttgctttcatttttggtgttattgttcactccaacaacaatggggcatgccacattgcccccattctcttgcaatttatgtccaaacgtgcgcccaccaagtgctcggtgaaatgccccaatgatatatga

SEQ ID NO: 107564 - DNA, 459 bp, Glycine max
  Peptide Sequence Number=SeqID_224342
atgtggtttgatcttatttctttcagatggcatcaaagaagagcatggcacctgccacaccttcccaagtctgatatgacagatcaagtggtgcctagaaagatacttcaagagagaaatatggtgatataccacactgagtttgatgatttcaaagaagagcttgagagaagaaattggcatgaagagttgaccaactttgcacaaggcagcattgatgttgccattgtaaaagaattttatgctaacctctatgatctagaggataaatcaccaaaacaggtgagggtcagaggtcatctagtgaagtttgatgaagacgccctcaacatattcttgaagactcctatgatcaccgaggagggggaaacactatctgcttattccatatttgcactcttgaggcctgatcctcaggaattggcagctaatgtgccatcattttcttatatttcttaa

SEQ ID NO: 107565 - DNA, 309 bp, Glycine max
  Peptide Sequence Number=SeqID_224343
atgcctcgtattcatgacgcgatcctgtattacaacgggaaatggaacatgccaccgcagaacaaatttgttggatgcgcgttcacaggaaaaaatcctaagaaatttcaaattccttcaacatgtaccatcgatgaactgaagaatttaatcaagcaagttgcacctaaagggattccccctcttggaattcacgaatcacaaacggtaagacgattgtttttctgccaaccagctcagtttgagtattcagatacggttataaaatatgaaataaatgagctgatcaccaacgaagaactgctgaag

SEQ ID NO: 107566 - DNA, 444 bp, Glycine max
  Peptide Sequence Number=SeqID_224344
atggccacagctgaagccttggaacgagaaaccaagaaagcccgaaaggaagaacacgacgagctaaaggcttaccttaggtcgaaaagaaatttgtcccaacagttaagcgagactgaagggaatatgtgggccgtcatcgatgagtgcaaagagaagctaaatctagcagcgactcacgagcaaaggctagaggatgagtacgccaagatatcagcagaaagcgaagcaagggagagggtaattgattcatggcaccaagaggcaacaatgtggacggaccgatttgctcttactttgaacaggagtcaagaacttccccgattgctagccaaggccaaagcaatggcggacacctactccgcccccaagaagatccacagacttctcagctattgtcaacagatgatagacttaatggaccatatgattagaaaccgctag

SEQ ID NO: 107567 - DNA, 282 bp, Glycine max
  Peptide Sequence Number=SeqID_224345
atgaaagataagtgggactttcaagcaaggccggcatgggctacgcgggcccctaagaccgtccaatatcttatatcgatcttggttccgcgtatcgcgctttatcgggcaaagcactttgtgagcatatatatctggtcatccctttcatttaaattaggaatctcacatcccgatctctttttccgcctttcgtctttccagtcaagcagtggttcctgctcttgcctctctattctatgtccgttgcttgttcccttctctttcaccatggagatgtga

SEQ ID NO: 107568 - DNA, 408 bp, Glycine max
  Peptide Sequence Number=SeqID_224346
atgcagagggagtcccaatgtgaaccagttgatgtacaaatgggagattgcttagaggaaatgaaagtgaaggatgatgacaaatggagcaatgatgaaatcaccatgaaaggtcccccagcaaagattgaagacttgataaagttgtggaacgaggtggttgttgtgtttgatgggtatccaaatgagacattcaagttgtgtgcaatgctattttgtaccattaatgactttccagcatatgggaatttgagtggatacaattttaagggtcatcgtgcatgtcctatctatgaagaagacacaagctacatgcaactgaaacatggaagaaaaatagtatgcactcggcatcgacgtttcctgaaagcttatcacccttactggcaattgaaaaaatcttttaat

SEQ ID NO: 107569 - DNA, 237 bp, Glycine max
  Peptide Sequence Number=SeqID_224347
atgactaatgttggttggggttgcatggaggttgcgacggttacagagggggcgatggtgtgcttgaagtggagattcgctgaggctctggcagaagtagaaggaagagcacacgaagcaaagctagcagaagatgttaacatgcgaatattggttgatcgtgctaatgctgaacaagaaaaatgggttgcagccataaatactacttttgaacatatcggaggaacattttgttag

SEQ ID NO: 107570 - DNA, 627 bp, Glycine max
  Peptide Sequence Number=SeqID_224348
atgaccagccctctcaatgagtcaatctcttgctttcacataagggtggaccattgggtactagtaccctcgccttcagaggactacacgtcctcactttcagaggactacacgtcctcgccttcagtgggctgcacgccctcgccttcagagggctacacgtccttaccttcaacagactatattcactcgcctttagaggactacacagggctacacgccctcgccttcagagggctacacgccctcaccttcaaaggactacacgtcctcacattcaaaggactacacgtcctaaccttcagagggctacacgccctcgcctttagaggactagacatcctcgcctacagagggctgcacgccctcgccttcagagggctacatgccctcgcctttagaggactatacgtcctcgccttcagaggacaacacgtcctaaccttcagagggctgcacgccctcacctttagaggactacacgtcctcgcctttagagggttgcacaccctcgcttttagagggttacactccctcgccttcagaggactacacgtcctcacctgcagaggactacacatcctcacctgcagaggactacacgtcctcacctgcagaggactacac

SEQ ID NO: 107571 - DNA, 255 bp, Glycine max
  Peptide Sequence Number=SeqID_224349
ggtacatcctctaggttcaaagagaacaaggaagggtacatcccttgtggatattttctttttctcttctactcctcatacaaaggacaactcgcaaggtgcttgactgtggtttctattgacccaccatcttcaaggatgcatggagaatctgtagcacttgtgagccttgtcagagagcaggcggctcactttcatggagacagcaaatgcctcaacaagccatattattctgtgaggtgtttgatgtctggg

SEQ ID NO: 107572 - DNA, 281 bp, Glycine max
  Peptide Sequence Number=SeqID_224350
gattcacaagcgattctcctcaaatttcagctagcccgcatcaattagaccttgcaccttatgcttcagggccctacaatgctcaatggaatgccccggggcttctccatgataagcacatgttgtgttcgagtcgtatcctcgaagaaatggaggttgaggaaccttggttgggattatggctaccattgaattatcgagtagatatgggagcaagctttgtggttgatttagggatggccttcgtggatgattgggtgagagggactgttattggctga

SEQ ID NO: 107573 - DNA, 201 bp, Glycine max
  Peptide Sequence Number=SeqID_224351
atggtgagtggaaaaagggccctacacccgggtccatgggaacataggaagtggaggtgtcgcaacctccccttcggtgggagggctatgcgagactcacgggtgcgtcttccaagaaaggaaaatgcgcggagttgccaccaacgtttattcgaggaaaacgtcggaaaaaccggaaaaggtgtggtctatgaactttaa

SEQ ID NO: 107574 - DNA, 549 bp, Glycine max
  Peptide Sequence Number=SeqID_224352
gctagtatgcaagagaagactagctccatgaagtgctttaaatgtcttggaagaggacacattacttctcaatgccccaccaagaaaaccatgattatgaggggccaagacatttatagtagccaagatgaggctactacatcaccttcctctagtaaaagtgaagaagcaaaatgggaagaatctagtgaagagatctgcccccaagaagaaggacaacctttaatggttaaggaggagtgtaaggagacacttgttagcattgccacatctcttaggcttgagtttattcctcaagtaaaggagttgttggatgagggggttcccatgaaccctaagagaataaaggtcattcctgagtggcttgctccaccaagtgtgttgaggaaaaaagcccagagtttcaagaacctcgggattcgaggtcaaatccttttcaagggggagggaatgatgcaatcctaccccgcaagggcattggatagaaaactccaagtagattgggccagagatgcaagagaaggccctagggttctaatgagccttagg

SEQ ID NO: 107575 - DNA, 192 bp, Glycine max
  Peptide Sequence Number=SeqID_224353
atgggccccgacgggtgcagagaaacgcgaagaattggaaccgaagaggcggcacgcaaaccgaggcaggattttagcatccaaaaaggagtctacctctacctcgtgggaccttcaatttcagatagagaactggtagagaggatggggagagttagcttagagttaaatgtgacaatggtagtgttgtaa

SEQ ID NO: 107576 - DNA, 462 bp, Glycine max
  Peptide Sequence Number=SeqID_224354
atgacatcttttaagctgaatgagtccacccctacaagctcagtgattcaggctccattgacaataaatgttccagtctttcgttcatctagaattgctaatatggaaagttcacagtcatctagttcggggatgcaagagacaaacattgtttttccagttaccgttaagagacaagcactgccaaatgtaccctcaacgagagctgtggaaaccagaggatcaggtagtggctacacatccatgaaaaagaaaagagaaccatggtctgaggaagaggacttgcaactaagagctgctgttcggaggtggggtgaaggtaattgggcaaccatggctaaaagtgatgactttcctattcagagaagtaccacgcagttgtccaaggttaagatgctggtgaatcatccacttttcccaaacctgaattttttgggaaaatattgtcatagggatgtctaa

SEQ ID NO: 107577 - DNA, 268 bp, Glycine max
  Peptide Sequence Number=SeqID_224355
cagaagcatctagtaatttcttggtttgtggtctcaacccatctatgaacatattcagttggattggctcagagaatccatgggtgggagttcttctcatggtcttagattctggaaagtacttgtcgcaacctacccttcagcgggagggcgacgcgggggctcacggggaggtggttgccgcccagcttgcccaggcgagctgggttgcttccaccaaaaggcaccaccttctgttggaaccccctggaagtcccaagtgggccag

SEQ ID NO: 107578 - DNA, 1035 bp, Glycine max
  Peptide Sequence Number=SeqID_224356
gataaagagatacaggttttacatcagaagctggacaatccagatgcaaatcctgatgaaagtccctacaccatcaccacagaatacaaatatacaccacaggaagcacttcttcgaaaagcaggtcaaggtgctaatgtgttggactccgaaaattcgccttcaaatttagatgcaaatgcagccgcatcccctttggcagaacaagttgaaactgaaagcacaggaaaaaatgccttctcatctgtgagaatgacactagagaagctcatggcacaccaagataagtgccaagacctttctaacttggaacagaagtttcgctcagacattgacaacttgctggaagagaacctagagttctggttgaggtttagcacttcagtacatcagattcaaaaattccaaaactctattcaggacttaaaagctgagctgaaaacaataagggataaaaacaagaagtctgaagggtattcacattctaaacaacagcctattcaatctcagctcaggccaatattcagacacctgagagagataagaaccgagttatcgctgtgggtggaacacaatgcagtgttgcatgatgaactgcaaggaaggtacgcgtctttgagcaacatccaagatgagatagcaagagcagggaacacggaatccggcgctgacactgcagagctaattagtaagtaccaagttgcaaagtttcagggtgagattctcaacatgaagcaagagaacagcaaggttgcaagtgaactgcaagcaggccttacacttgtgaagggaatgaaaactgatgttgagaagacacttgatgagctagatgaagctattggtgttaacagtggtgttcctaagaataatggtgagatgaatcactccactagtcgtgctcgaatacccttgaggtctttcttgtttggagtcaagttaaagaagcaaaagcatcatccttcactatttgcatgtgtaaatccagcattgcaaagacaatacagtgtcaatgatgaagcaccagccccaatatag

SEQ ID NO: 107579 - DNA, 219 bp, Glycine max
  Peptide Sequence Number=SeqID_224357
atgattggaaatcatgtcaacgtggtacctaatgcatggttaactacgaaagtgatggttcctagggcatctcatgtcaatctcgtaattgcatttgtcgtgcatagcataagaaaggttcatcaagtcaaggtcaagtatggaagtatccagcttgcaaaaatcggggcagaagaggaatctagttacatcgcttctttgtctactgccaacatatga

SEQ ID NO: 107580 - DNA, 1162 bp, Glycine max
  Peptide Sequence Number=SeqID_224358
cttgcaagatgagtttggtgttggcacagtgatagaagacaatgatgctagagctttgatggcggccacagctctaaaatcatgccaagagaccctgaacaagttgaaagagatacaggcacaatcatctaatgatgctaaagaggagtatcaaagggttaagaaagctcatgagaagtttgagacccttagagaccaattcatttctaaatatatgaatcaacaaaaccaagatgatgtggacaagtctgagaatgtaggaacagataaaaaatgcatagatgaagacatggagcaagaggagcatgacgtggggatgttgagagagaagatcaaacaaaagttggaggaagattcaagtaattccctcaccgtgactgaaatggctgagtgcattgatgagcttgtaaataaggtttgtaccttggaaactgcggtttcatctcagactggaatggtaaagagactaaaatcagaaacagatggacttcacacaaatataaagaagttggaagaagacagggaaatgctcatagaaggctcagaagttaccaacaagaagctaatggaattggaagaagagttgcggagagttaaaatgctcaaccaaagtgtcagaactcaagacaacaccctccaaacacactttactgaagctagctgtaaccttgagcacctttctggaaaattgaataacatgaagccagatgaggaggaggagaacttggtactttacaagaagaagagaactgcttctgatgataaatcagggaaaaaatctgaaaaacatcatgataacttgtctgttgataacacagatgtcaagacaataaaggaagacgatggtgaaaatgttgatactaacaagtccaatttgaatgatgggtcttttatgaatgaaaggattcagaagctggtacaacaggataaggatgatttatctgatacagtgagcaatcttgacactgaatcacaggatctggacattagtgaggaagatcaacctaactggaggcagatgtttataagtggattagatgacagagaaaagattctgttggaggagtacacatcagttttagtgaactataaggatgtcaggctgaagctcaatgatgtggaaaagaaaaaccgtgacagcatttttgagttgactcttcag

SEQ ID NO: 107581 - DNA, 339 bp, Glycine max
  Peptide Sequence Number=SeqID_224359
atggaccctgacttcgccggagcaccgccggacacggcgttccatcagattaaggagaagcggcgtcaccggaacagctataccgttgcggcgtgtgggccagtggtatctcgggggaagagggccatggactctgaggagcttgctgaacttgctagggttgatcccaagaggttggctctacaacagtttcataaccctccgtctcatgatcagcaacatcttgaccctcagcaagcacagctctccatgcctaatcctcttccttcctctagtactcagagttttggtggggaatatggccttaataacttctccaacttcagtcagctaaactag

SEQ ID NO: 107582 - DNA, 213 bp, Glycine max
  Peptide Sequence Number=SeqID_224360
atgggttgtgggctagattgtgaaggaggaggaggaaaggagggaggtggtggtggaaacactgttggcggtgatggccacggtggagagtggaggcacctgaaggagaattcggtcacaactatggcgatgcagatgaacatgtctgatgatggtggaggcacacaaaccaagacaaaggagttatggcagcatggtggtatttggacatga

SEQ ID NO: 107583 - DNA, 864 bp, Glycine max
  Peptide Sequence Number=SeqID_224361
atggctttcatttcagcagttcatgccacggaactgttgccaaatgttgtcaggggtgctaaggttactactagaagagaaaaatatgagaataacaacagtcatatgaaccttgctatcacccagtgcagtggcgacacacaagccaatttagcttctgctactgcttactgcgtggaaactctaaatcagtacagcttgtgcaacttgggtaccatcgacgttgacacagacattggacacggacacgtggacacctcacattttgaaaaagttaatgagatgctgatttacttgtcagtgtccgtgtcggatacggacacatgtcggacacccggacacggcaaggggatggagtgtccatatttcatagggacgactatgaaaggagctattgatgaccttgatcttgtaatacaaacgcttgagggatgtggtttcactcgtgatcgattctacattcattgtgatggagctctatttggaatgatgttgccttttgtcaaacaaacactgaggattaccttcaagaaacctattggaagtgtgactatttctggtcataagttcttgggatgcccaattccttgtggtgttgtaataactcatttagaatatacatcaatgcattgtctaaagatgttgaaattattgcttcaagagataccacaatcacaggtagccgttgtcagcatgctccaatatttctttggtgatgctggaattggtacaatactaaacaagtttagcaacattgtcatctttgagaggcctctagatcatgactttactcgtacaatgctggaatttggcatgcaatgggaatattgcacatgtgatggtgatgcaacacattaccgttaa

SEQ ID NO: 107584 - DNA, 660 bp, Glycine max
  Peptide Sequence Number=SeqID_224362
atggcatcagatcactcgtccgtcaaccaacccaaatttgtctatccaaacaatgaacttgagcaacaagaagccctagaggtcgaaaccaaggactttgactactcaaagagatctcaatggctacgtgctgctgttttaggtgccaatgacgggttggtctcaacagcatcactaatgatgggtgtgggagcagtgaagcaagacatcaaagtcatgatcctaacaggttttgcagggctagttgctggggcatgcagcatggccattggggagtttgtgtcggtttactcgcagctggacatagaagttgctcaaatgaaaagagagaaagaaagggacaacatagatcaagaggaagatggttatgagaaagagaaattgccaaaccctatacatgctgcagcagcatcagctcttgcattttcagttggtgcattggtgcctctccttgcagcctcttttataagggactataaggtgaggcttggtgtgattttgggagcagtgagtttagctcttgtggtgtttggttggttgggggcagtgttgggtaaggctccaacatttaggtcttgtgtgagagtcttgcttggggggtggctagccatggctattacttttgggctaaccaagttgattgggtcaagtggtctttag

SEQ ID NO: 107585 - DNA, 318 bp, Glycine max
  Peptide Sequence Number=SeqID_224363
atggcgacaacgacgatgaaagtgggagaggacaccaccaactataatggtgaagatgaacaagggagaaggaagggagatcgcgatgcaacaaagggaatgagaagagaaacacgagatgaaggagataggaagaaaatccttccaaactaccaggtagcatacaacaatgaaatgtttgacccaaatccttactattggtcccaactccattcgttactaacccctacaaatatctgtgagtgcatgacccctcaccggcctagccaacaccacatgtcctcaccatcatgtccaaataccaccatgctgccataa

SEQ ID NO: 107586 - DNA, 253 bp, Glycine max
  Peptide Sequence Number=SeqID_224364
atggaggagaaggtggctgagaccctcaacatcctgtgtgatgagggagactcatttgctaagagggcagaaatgtattacaagaagagaccagagctggtggattttgtggaagaagcctttcgagcttatagagccttagcagaaaaatatgatcatttatcaaaggaactccaaagcgcgaaccgcactatagccagtgtcttcccagaccaagttccatgtcatattgaagaagatgatgaagaagaaa

SEQ ID NO: 107587 - DNA, 1344 bp, Glycine max
  Peptide Sequence Number=SeqID_224365
atggatttggtggaaggcgttggagagagttcctcgccgccgcgcgccttcagcggctgcagcaactacgacgtccataacaacgtctacaaccgcctcgttgaaaccggccacgaccaagccgtttccaaccccaacttccgcgaacacttggaggctcacttcaatcgcttgccaccgagttatggactggatgtgaatatcgatagagctgaagatgttctgttgcatcaaacccttcttgctttggctaaggaccctcacaagcgccctgtataccatatacgcttcctcgagaatatttcaactagaacagatggtgaagatgaacaaattttaagtactcattatagccctggatcaacttctcatgcaacaaatgggggagctgtatcacctggtaaaagtaagatgagggatattgcaaatgagtttgagccttgctcgaagctcgaggacctaaatttggatgtcagaaagaactcaaaggtgacagaggaaaaatttctcactgacaattttttccagaggcacgaacattcaagtgtccctgttcatgaaataatattttccactgttgacaagccaaagctcttaagccagctgtccgctttgctgtctgatattggacttaacatacgtgaagctcatgttttctccacaactgatggctattcccttgacgtgtttgtggtagatggatggccagtagaggggtcatggtctcgttcttcaaattctcattcagctgtggagaaagccttagcaactgaaggaaaatcaggagattgggaaatagataggaggttgctaaagttaggagaaaaaatagcatctggatcctctggagatttgtatcgtggagtttatcttggtgaagatgttgctgttaaggttctgagatcagagcaattgaatgatgctttagaggatgagtttgctcaagaagtggccattctgaggcaggtgcatcataaaaatgttgttcgtttcattggtgcatgtacaaagtgtccacatttgtgcataataacagagtatatgcctggaggaagtctgtatgattacatgcatagaaatcataatgtcttggagctgtctcaattactaaattttgcaattgatgtctgcaagggtatgaagtatttgcatcaaaacaacataattcacagagatctgaagacggctaatttgctgatggatacgcacaatgttgttaaagtcgcagattttggagttgctcgattcctaaatcaggggggagtgatgacagcagaaactggaacatatagatggatggcaccagagaatattggtatgtttacctatctgttgcctttttga

SEQ ID NO: 107588 - DNA, 468 bp, Glycine max
  Peptide Sequence Number=SeqID_224366
atggatttagtcctctgttactcctgcaaactttttctgaagctaatcagaagttgctcaaaactcccccaccctgggttcagcaacaggccaaaatccttattcctaatagcaatttctgaattaaccaatggattttctcacaaggttataaaccatcagccttatgatcagaaagcagatgtattcagtttttccattgtactgtgggaattagtgacggcaaaggtaccatatgacaccatgactccactacaagctgccttgggtgtgagacagggtctgcgtccagaacttccgaaggatgggcaccctaaactattagagttgatgcaaagatgttgggaagcaattccaagccaccgtccatcctttaatgagataaccattgaacttgaaaatcttttgcaagaaatggagtttattacgtgcaaattgcagaaagattcagaagcgaatggtgcttga

SEQ ID NO: 107589 - DNA, 1026 bp, Glycine max
  Peptide Sequence Number=SeqID_224367
atggctaaagcctacatttatgctcgcatgtacaaagatgttcgagctgcagttgacttgtgccaccgtgatggaacattgaagcaaatggttgctatagaaccaaagcggtatattaatgaagactcctcaatagtgcccatgcttgaaatgctcagagactctggacaagcaacgtttttagtgacaaatagtttatgggactatacaaacattgtcatgaatttcctctgtggatccagtatggcagatgtcagtaacaatttcggctggcttcaatactttgatgttgttatcactggcagtgcaaagccaggattttttcatgaggaaaatcgtgccaccctatttgaggttgtgcctgagactggaatgctactcaatacagataatggctctcctataccccaggtgggtaatacctcagcaaggctattcacagaagcaaagaatcatgcttgtccagttttccagggaggcaatgtttctcatctgcataaactgctttccattgaatcaagttcacaggttctctatgttggggatcacatttatggagatatactacgcagcaaaaaggttcttggatggagaacaatgcttgtaatcccagagctggagaaggaggttaaactactctgggaatctagggattcccgcaagggagatttttacatgaatagtcttgtgcaggaacttcaattcttgaggagtgagcgtgactgcattgaggatgaaatacatcatttgaaatggtctctcaaattcaagaatccagatgctgattccaagcagaagttatcttctgaacttgataaattaaagtttcacgagccatggggacagcttatgaaaactggttatcagaattctcgctttgctcatcaggttgagagatttgcttgcctttatactagtcaagtatctaacctgggcttatactctccagacaagtattacagacctagtgaagatttcatgcaacatgaatttggcattatggcttgtgagacgccagacatttaa

SEQ ID NO: 107590 - DNA, 1524 bp, Glycine max
  Peptide Sequence Number=SeqID_224368
atggccaacgagattgcaagattaaaggaagaagcagatatgatgaagcttaacaattcaagtgctggccttgcatcaatgtctccgggtgcaagaaattcaaggatatttgcccttgaaaaaatgattgctacttcttctacaacattgctgtcaatggcatctcatttgtcagaggcagaagagcgggaacgggttttcagtggcaagggacgttggaaccaagtccgttcccttcctgaagccaagaatttgatgaatcatttgttcaatctggcatcttcctccaggtgttcattgcgagataaagaagttacctgcagagagaaggacatggaaataagagatctaaaggaaaaagtagtaaggttgagctgttcacttcgacagttggaaatgcagaagtctgaacttattcatcagttgaaattgctgagtgcaaagagatattcagaatctgtgggtgattcagtgtatgctgacataaatggaggacataagtatgacttgcgcaagatggaaaatcggcgatctacaattttactggaggatatggatttatcagtatcagatacagaaacagatgattatgttgcagatgcaactgatgatgaatgggtagcatcagaaaaaattcacgttaggaaaagaaaatctagaagcagacatgtaagcatggaaaacaatcagtcaaatatcagttcagaagatgtaaaagataattcaacagaaggagttggaggtgcttctggggaaactgcatcagatatctgctgctcttgtagtaaatcttcgtcatgcaagacaaataaatgcaaatgcagaactctgggtggcacttgtgggagttcttgtggttgcctagcatccaagtgtgccaacagatcatcagtctcaaatgaggcacaagttgaaggggctggtaatgattccagtattgacgaagcagacaaagatcggcttcttgttgctcaaggtgctgagttgcttcagggtgcactggttgaggggcctgctgaggtgcacagtgatcatgggccaagaaagcctctttcagatattggaaatacactggctaaatcaaatgctcagaatgctaatcaaagaaggaaatgggcgaagaagagaaataagtccacagtcccagtcccagtgctcaccacaaacgttgttgttcctgatactccacctttctcacagtcagataattctgaagttcccaagaaagaaaataatagcattagtgaagcgaatgtatctatgaacataccacagaaaattcaatcatctagacctgaaaatgcgccgcttgctccaaaagtagagaaaagtgtaattgagacagatcgttggatgaaattaccacgagctatgcgaaagtcaccaaatggcggtggccttcctctgggggacatgaatgctagtaagccagatgagcctgtcaataaggagtctgaagtcatagaagctagaactccggtgaaacaaaaaagaacacttgagaaagagaacaatggacgttaa

SEQ ID NO: 107591 - DNA, 1029 bp, Glycine max
  Peptide Sequence Number=SeqID_224369
atggattatgacctcgtgaaatcttatgtgtcaaagatccaagatctggaaggtgaattgcagcgtttgaaaaatttgaatgcaaaatctagacatgttgactgggttgattcagatgatagtggattccggtcaaagaatgtgttatttgcaagtggtaatgaatattcttctgattgtgatgccaaatcagtggacataacagatgacatggaagatcatgcaaaggagatagaacactcttctcttcaagaaaagttggatagggagctcaaagaattggataagaaacttgaacaaaaggaggctgaaatgaagatgtttaataatgctgatacttcagttcttaagcatcattatgaaaagaaagttcttgagttagaacaagagaagaaatttttgcagaaagaaatcgaggaacttaagtacaatcttgcaaatatttcatccacttctgatgacggtgctcaaaagttaaaggaggaatatcttcaaaagttaaatgctcttgaagcacaggtctctgtgctgaagaagaaacaagaatctcaggctcaactgttgagacaaaaacataaaagtgatgaggctgcaaaacgactacaggatgagatccagagaattaaatctcataaggttcaattgcaacataaaattaaacaggaatcagaacaattcaggttatggaaagcttcacgcgagaaagaagttctccagcttaaaaaagaaggaagaaggaatgaatatgagatgcataagctgttagcgttgaatcagaggcaaaagatggtattgcaaaggaagacagaagaagctaccttggctacaaaaaggctgaaagaacttttggaatctagaaagacttcacgtgaaagtgctgccggtgggaatggtccaggaattcaggctttgatgcaggcaattgagcatgaacttgaggtcactgtccgagtgcatgaagtacgttcagcacatgagcgtcaaatggaagagtatgttcctctttttacatttagattcttcatctga

SEQ ID NO: 107592 - DNA, 1173 bp, Glycine max
  Peptide Sequence Number=SeqID_224370
atggaaaattcggattcggcgcagtgtgttcgagttgccgtcaacgttcggcctttgattacgtcggagcttatgcttggatgcaccgattgcatctccgtggttcccggtgaacctcaggtgcaaattgggtcgcatgctttcacttatgactatgtttatagctcgggatctccgtcgtctgcaatatatgatgattgtgtagctccactcgtagatgcacttttccatggctataatgcaactgttctcgcttatggacagactggatctgggaagacatacaccatgggcaccaattacacgggagaggacaatgccggtggaattatacccaaggtgatggagacaatattcaagagggttcagactatgaaggaatcctcagagtttttgattagggtatcttttatcgagatattcaaggaagaggtattcgatttgctcgatcccaattctgccagaggagatatggcttctactgcgaagcctgcagcgcccagcagagttcccatacagattagagaaacagtgaatgggggaataacactggctggtgtgactgaggctgaagttaagactaaagaagaaatgtcatcttatctttctcgaggttcactttcacgtgccacagggagtacaaacatgaacagccaatcaagtcggtcacatgctatattcacaatcactatggagcaaaagaatggtgatgatgtcttgtgtgcaaaactacatttggtagaccttgctggttctgagcgtgcaaaaagaaccggtgcagatggcatgcgtttaaaagaaggcattcatatcaataagggtttattagctcttgggaatgttataagtgcactgggagatgaaagaaagcgaaaagaaggtggccatgtgccatatcgcgatagcaaattaacaaggctactacaggattctcttggaggaaacagcaaaaccgtcatgatagcatgtgttagtcctgctgacaccaatgctgaagagacattgaacactctgaagtatgctaaccgtgctcgtaacattcagaacaaagcagttatcaatcgtgatccagtgggagctcagatgcagagaatgcgaagtcagattgagcaattgcagtctgagcttctattatacagaggtgatgctggtggggcatttgaggaacttcag

SEQ ID NO: 107593 - DNA, 672 bp, Glycine max
  Peptide Sequence Number=SeqID_224371
atgacatactactacatgggtgatgcaacttctttcaacccattccaagctctcacattcctcattctcataaccacccctttcatcctcggtgacgacggcaccgccgccacgtcatcatccccggttatctcaaccggtccctattcctattcggaccccttcaatctaagcatgggcgttatattggccgtgttaatcaccacgttctgtctcaccttccttttcctcatctacatcaagcactgctacgacaccaacaccaacacattaaagcttaccacgaactcccggccttcgcacgtgcggaagaactccggcattgaccgtgatgttctggaatctttgccggtttttaggtttgggtcgctgagggggcaaaagaacggtcttgattgcgcggtctgtgtcgccagcacgcgttccacgtggctcgacgcatactccacgtgcccgctctgccgctacaaggtcgagccggacgacgtcgttgttttcgtgaaagacgacgacgccagagcgaaatctccagagggagaattggacgtcgatcgaaagaggccaaaacgacgtcgtcacgggagcaacggcctcgacgacttcgttggacggtgcggaacactgtttttgctccaacatgtgcagaacacaaaatttttagtcttaggttag

SEQ ID NO: 107594 - DNA, 966 bp, Glycine max
  Peptide Sequence Number=SeqID_224372
atgcttggaacaagtgtccaaaggagtatgagtcgactatttggtaaagaaatcggtctaagatgggacaatgccaaaagtagtgctgatgcaagtgatgagtggtgggtgaaaaaacaattggaaaatcctttatatggaaaatttaagaacaaaggactttcatttactcacaagttgactgaactttttgagaatgtagttgctaatagagagttccaatgggcacccttatctaggatttttccagctggtgttgaggttgacatgaatgatgtgtatcgctcaagtcttgatggcattggtgtagatgtagaggaaagttcaagggagagtgaagatacaagtgtcaatgcaacaaatacaagtgttagtgcaactgatgcttttgggaaaattaatttgaatgattcacaaggaattgtcaaccaagaaattggttgccaaaagaatgcatctaagtcctgcaatgaagttgtggcaagtgcatctattcaagaagtgatgaatgagcttaaggcactacctgaattacaaaatgattgtgtatttcatatacaatgttgcaacttgatgttgttcaagccagcaaaaaaaatgttcattgccatgcgaggtttagatgagcaaaggatgcattggcttaaggatgcatttaaaacccctttactattcaaggtcaaaatgaatgacttacttgaacaatttgaatcaaataacaatgaagatgatgaacttatggagcatgcatcttatgtgggtgtgcttgttgacgaatatgcaataaaacatctatgcaaaaagccatgtagaacttgtgaacaaacatgtcatatatgggtgcaaaaactttactctgaattggttgatcatggtttaaaacccactaactacataggagttgaagaaatggttgcattgtttttaaacatggttggccatgcgagaggaaataggaatctttaa

SEQ ID NO: 107595 - DNA, 649 bp, Glycine max
  Peptide Sequence Number=SeqID_224373
ggataaggattcggcgaacaggatcaagaggaggagaggctctcactcgcaaagcactgaagagagtgtcagaaacgaacaagacattgacgttgtggatgatggcgtttctaagattcgttccgctaattatatgacattgtcgttcgcctccgatcacaaccatcactggagcttcatgccggtgaaacctctgccgttcaagataacagatgagatgatcgaccggtcgaattcccccggaggacacagtgttgaaccggcctcaccttcttcttcgaatgtttctcttaggaagaagatgaaagagattgaagttgtttctaagacatcaaaatcatcttcgtcagacctcgagattgagatagctaagcttttgtatggtttaaagacttcgaagagccacgagtcttctaaaaagtttgaagcaagcgtctatccctctgatgatggtgaggcaccaaaagaggacattggggaagatagaatgaattcaagtgctgggtttggggatgcttcagcagatggaagattgggggttgaagaaattggtgcatttgtggcttcaaggggtggctttagcttctgggatcttttggatttggagaaaattccagggaaaggatgggattgtggcaaatttctatag

SEQ ID NO: 107596 - DNA, 207 bp, Glycine max
  Peptide Sequence Number=SeqID_224374
atgaagataaaaatttcaagaggtgttgtgtcccaaggcaatggatttgcatcaaagtttgttatggcagataaaaagatggataacaagattcctatggtaacaaagaaagaaggattcctccataaaaaccatgttgatgatgtggaatcgaaaagacaacttctgaagcagcaaatgctctttaatcagcaaagagatattcaa

SEQ ID NO: 107597 - DNA, 222 bp, Glycine max
  Peptide Sequence Number=SeqID_224375
atgacagtgacttcgcccaggaaagatgaccgacgggggtctaaaaaagaagcatcatcggatgccgccgatcgaacctttccaaatcgacatcatgcaaatttcgttcacggaatgaatgaaaactcaatagccgacatcggtcgtgaaatagccggcgcgactgatatttttcagccgacattgcgcaatttttatttaaaaaccctcgctggcagataa

SEQ ID NO: 107598 - DNA, 459 bp, Glycine max
  Peptide Sequence Number=SeqID_224376
atgtgtacgcgctactcttacattattctctgtgttatcattgctgtatttgcgaaaaccctaattccttatattgttgcgcagcaggaccgaagaattggcttaaagaccaaaaaaagaaggcctccaagtacctattggcccctatcgatgcctcccgtcaaatccttcgctctgcctatctcacgctcagtttcatttgcagcggaaactgacgctgcttatacggatgaggatttggagaagattcagcagctctttatatctgctgccagggattgcgtcccacaggaccggaactcattcgtcactttccaagccaacaccggagtagaggtgtgcacgtttcggttgattgtgaagaatgcagcttcgttgcttggaaataaggatcctgtaaagttgaaagctgaagctttgctagataatcttataaggacaaaggcatgtccagtataa

SEQ ID NO: 107599 - DNA, 108 bp, Glycine max
  Peptide Sequence Number=SeqID_224377
atggcaaggaaccaaggtttctttacggaggacggggcaagagaatcttcctcggagcatataaaagttgcatatgagttggcacaaaaggagtacgagaaagcataa

SEQ ID NO: 107600 - DNA, 195 bp, Glycine max
  Peptide Sequence Number=SeqID_224378
atggagagcccaatgcttattgtgagctcaatgactggccgtgataaaaaatttcaagagtcctataggaaagatccaactatcaccctactcatcgacgttgacgacgcatcaaattctccacttggagggaaaaggtggtgtttaggggcatcgggatatggggttgagaaggagaaggaaggtggtctgtaa

SEQ ID NO: 107601 - DNA, 126 bp, Glycine max
  Peptide Sequence Number=SeqID_224379
atgaacaacctctcgcagtacaagctccctcgcgacgccgctggatacgcctcagccgacgacgcagctccgatcgactccggcaagaaccgcgaccgcaagcgagacctaagtagctattattga

SEQ ID NO: 107602 - DNA, 273 bp, Glycine max
  Peptide Sequence Number=SeqID_224380
atgggatccaagtgtggtggcagccagcaagtcactgacttggtgcgatggtgcaacgagcttgcagtgggtgatgtgaggacgagcgtgaagatgaagagaaaggaagagcgcgaccatgaagatgaagagaagggagctgccaatgttggaggattaaggttgtccctagtactaggaggggaagctgaaggggaagaagatggaataggaggtgatgccttacatgaaggttcagtgctattaacacatggaagtagaggaacaccatag

SEQ ID NO: 107603 - DNA, 936 bp, Glycine max
  Peptide Sequence Number=SeqID_224381
atgtacaaagaacgagagcgagttggtgtttctgtttccgcttccaaatcggaggatcggaagcgaatcaacgacgttctcgataagcacttggaacgatcctctccttccacttctcgccccatcacctccgcctccaagaattccaacctccaagtggaggaatctgaaacggagagtgaagagtctgatgttagtggctctgatggggatgacacctcttggatctcgtggttctgtaatctcagagggaatgagttcttttgtgaggtggatgatgattacatacaggatgactttaacctatgtgggttgagcagtcaagtgccctactatgattatgcccttgatttgattctcgacgtcgagtcgtcccatggtgacatgttcacggaggaacagaatgagttgattgaatcagcggcggaaatgctttatggtctgattcatgccagatatgtgttgaccagcaaaggaatggctgccatgcttgacaaatacaagaactatgattttggcagatgcccaagagtttactgctctggacagccctgccttccagttggtcaatcagacattcctaggtcaagtactgtgaaaatatactgccctaggtgtgaagatctttactatccacgttccaaccacagaaaccagcacaaggctatgttccaagagtttttgggttcaaagttcacaagccataaagctgaagttgaagctttcatgaaagagcttgttgtaaagaaatatgcagacatgcgaagcaagtgcttagtttcagcttcagattcaatgagaaagtgcttagcctttgaatttgtggatttgctcccaatggattcatacattactaatttccaagttcacttgcttggatgttatactcagctatccaacattattggttatttggaatgtgaatgcacaatatga

SEQ ID NO: 107604 - DNA, 570 bp, Glycine max
  Peptide Sequence Number=SeqID_224382
atgggaaataacatgttcacgatggtattcctcatattgatgttgatttcatcagccaccccaacagaaattgatgcaaagaacccagaacttgttgcagccactaaggagatgcaaagggcaaattactctacatttgtaatgctcatcaacatgtctccacttgacacaattaaggggaatgtgacattcttgatgcccaatgatagaatgttggataacatggcgttggttgaacctcgcttgcggtcgcggttcttgccggagtcgatcggagctgcgtcgtcggctgaggcgtatccagcggcgtcgcgagggagcttgtactgcgagaggttgttcatacttactcttcctcatggagtctaccacgactctgacgccgaacagcatgatctcgccggagacgacggagttggcggttcttcaaatcgaagtagcggcgagtataggaagattttcctaagatgctgtgactcttcgcagagagagggaagagaaagaggaagagagagggaagagaaaaaggcagagcgagggaaagcagaggcaaggaaggggaagaggtag

SEQ ID NO: 107605 - DNA, 174 bp, Glycine max
  Peptide Sequence Number=SeqID_224383
atgaaggaaaggcttagtcatcacttgattggcatgttgaagattcgttttaattccggtgagtcgacaccagtggatacaaaacaacttgcctacactcacagcaagcgagataagggtaaatgccgtgccgactaccgccctacaacgcatgaagacgtggcctcctcctag

SEQ ID NO: 107606 - DNA, 335 bp, Glycine max
  Peptide Sequence Number=SeqID_224384
atggggacatatatgctggtgaatattttgcagacaagatgcatggttttggagtgtatcaatttcagaatgaatgggattcttgaagatcctaaaagacataatagtcctactgggtctccatgtgctgtagaccataccaaggtttctaatgcagtacaggacgcacattctgctgctgaaaaagcttacaatatggcaaaggtggatggcggggtgaataaagtagtggctgtagctaataaagcagcaaacacggccagagttgcagctctgcgaggtgtcagcttggaaccactttctgtcattgaactcgatggcagattgtggaacaa

SEQ ID NO: 107607 - DNA, 381 bp, Glycine max
  Peptide Sequence Number=SeqID_224385
atgttggaggacacactcaagtggagatcaacgtataagcctgaggatattcgctggaaaaagtttcaggatgagattgtggtggaaggggagacagggaagttgtacagagctagtgttcatgaccgtgaaggaaggatagtccttgtattgaggcctggaatgcagtggttgttgctgaacacatcttcaaaagagaatcagatgcgacatctggtgtatatgctggaaaatgctatgcttaaccttccacatggtcaagaacaaatgtcatggttgatagacttcactgagtggtcgtttagaaatagtgtgcccattaaatcagccaaagagaccattaacacctacagaatcactaccctgagagacttgccatag

SEQ ID NO: 107608 - DNA, 5421 bp, Glycine max
  Peptide Sequence Number=SeqID_224386
atggctgaccgtgcctccgccaccactcgcctccacatctccgccgcacctccctttccgatctccaaagattttcatggccctgacaatccaattccactctcaccacagtggcttctgccaaagccaggggagagtaaacctgcaataggaactgtggaaaaccatgtaatctcaactccaccaaatggcaatcgctcagagactgttaagacatctggagatggagaggatgcgaatgatggccataagcgaaaggatgtctttcggccatccatgcttgactccgaaagtggacgccgtgatcgttggcgcgatgaagagagagatactaagtcttccatacacaaggatcgttggaggaatggagataaaaacctaagtgacactcagagaatggatcggtggactgaaaatgtatccatgaggcactttggagaagcacgtcgtgccacatctgatagatggaatggttcaagcaatagagatacaaactttgaacagcggcgtgagagtaagtggaacacacgctggggtcctgatgataaggcgccagaaggtctttgtgaaaaatggaacgaccctggtaaagatagtgatctgcatgtagacaaaggtttgtctaacatttccaatcttgttaaggatgaaaaggaaggggatcattatcggccatggaggcccaactcctcacaaagccgtggaagggtagagcctacccaccaccagaatgtgatgccaaacaaacaagtgtctgcattgtcatatcggcggggccgtggggaagatacaactccaggcattgctttcgggcgtgctcggcttagctctggtggtagctccattaatagcacatatatgcattctcaataccctggaactttattggataaagttgaaagtgaacagggagaagctcatccctttagatatagtagggcaaatttgcttgatgatgaaccattggagcctctagctcttggcgcaccaaattcggaggaactgatgccactgtcatctctagtggtttattacattgtttttccgtttgaacagtctgtattaaaggatattgacaaaggggaaataattagtagcagtgcacctcaggtgccaaaagatggactgaactcgacagaatttacgcattcaagacaaatgaagcttgtaaaagcatctttccaagatagagttgaagataatgattcttacagaatggctgatgaggtgcctagtaatagggaatcaacctttgaagaaagtcattctgttcatcatggtgctacatggcttggcacgccactgggtgaacatgcgggcacactcatgcatgatagcagagatgtgtccagtgatatcaaatcaagaaactctgatatgagctggtcacaccagccaaaagatactcatgctcagtgggagcgtaatttggattatttatctgaaaccagagatgtggctaagtggcacgatggtggagatcccattaagaggcagctatctggcactttggacagtgaatttgaatctaggaaagttcaacagatttgtccagaggagttatcgctcctctataaagatcctcagggtcgcattcagggcccatttaaaggaattgatattattagttggtttgaggctggatactttggtatagatttacctgttcgtctggaaaatgcagcatttgactcaccatggttacaacttggtgatgccatgccccatttacgagctaaggctcgaccaccacctggattttctgcagcaaaacttgactctacagagacacctggtcggcaatattccagtacctttgggaatatgcattctggtttaagtgagattgagatgatgagaaatgattctatgcataggagttctagtacagaagctgaaaataggtttttggagtcactcatgtctggtaccaagagcagttccccacttgatagtctcacattatcagaaggtttacaagggtttcttggtaataattatggtaatttgggcccatcaggagtagatagcggaaacaaccttcacttgctggccaagagaatggcacttgaacgtcaaagatccttgcccaatgcttatccatactggccaggaagggatgcaggatcccttccaccaaaatcagatatttttccagatgcatcaccacattcaaatatcttgtcttctttgagtgacaattctcgtcagcttcagtcccaaaattccgaattgatgtcaataatccaaggattatctgataggtcgtccacaggcttaaatagtggcattgctggatggctaaattttcctttgcaaggtggattggatccccttcagaataagactgacttgcatcatgatcaaaattatgttcaaatgccatttggaattcaacaacaaagattccaaacaccgaaccaattgcccttaaataacttaattgctcaaacttcagatattccgtctagtattttgactgcagagaagttgctttcttctggattatcccaagatccccaaatgttgaatatgttgcagcagcaacacttgctgcagttgcattctcaggcagcagcggctccttcacaaccaatgcctttgatagataaacttctattgctgaagcagcaacagcagcaggaggagcaacagctgttattacgccaacaacaacagcaggaggagcaacagctgttattgcgccaacaacagcagctgctttctcaagtgcttcaggagcatcagtctcaccagcgctttggcaatttatctcatcaacagctgcagggaggtggaataccccttgggaatttgcatgtgaatctttctcaaattcaacaaccgaaagagatttttcccatgagctctcagacaccaattcccactgttcagggtgagcttactactaattctttggatttgcctctgcaagtaagccaggacactagctataatataagcagtgaatcttctgcccagatgtctgaccaattatttgagaatattagtcatcagaaaagctggagtgctacacttcctgagcaaattaatgacaattaccagaaggaagcattgcctgtatcagcttctgttgaaggctcactattgcttgagcagaacagagctaaagaggaacctgccattgcccagaaacttcttcctttttctaactatactgccaaaaccttggagcagatgccagacaatacttgtagggatgatgatactcttgtaagtgcaacttctgagtctggtgagaattctcagccgatacagtgtgttgcacctgttgttgctatgtcttcagctggatcttgtggtaccgagttaccactagttagtcaactgagtgaagatttagagattaactcagatagtcttgaagagcagcagggtggaaggccctctgtggtggatgtaagaagtgttgaagtacatgaacccaaaaagactactgagaagaaatctaagaagcaaaaatcttctaaatctcagtcttctgataaggttaagggattgctaaaaaatgtgattttgcagcagtcaaagaagtcagaatcttgggagtcaaattatagtgaagccaacaagggtgaaccagctcatgaaacatgtctgcaacaaacaatggataagggtaaacaatctgcaactgctactgcagaaacagatgatcatcaagaaggtagtggtctccctactaacattcaaggaagcaacactgaaacagttattgagaatgagttgaaggcagtcagttctgttgccacacagaatactgaattaccttcagtgagagcttggaaacctgctcctggtttcaaggcaaaatctctcttagaaattcaattggaagaacaaaaaaaggtacagacagaaaagcttgtatctgaggttgctactcctgtcaattccatgagctcaactccctgggttggagttgtggccaatccagactctatgaaggtgtctagtgatagtaacagagaagcagaaaatactgaatatctggctaaagctgaaaaatctcaaaatagtaaaagcaagaaaagcccattacatgatctattggcagaagatcttgtacccaaatctagtgaaagagatgacaaggttccagacagtatgctccccccacaaaatatagctgttcactcagaaccagtagatgatggagactttattgaagctaaagacactaaaagaagccggaaaaaatctgcgaagttgaagagttcgggagctaaggtttcaatgccagttgcttctaatgaagtgcccataagttcaagccacattgaaaaggtaaaaagctcccgttctgttcagcaggagaaagaactactgccttccgttccttcaggaccctctttgggagattttgttctttggaaaggagagacaacaagcccatctcctcctccagcatggactaccgattctgctaggattcctaaaccaacatcattaagggacattttaaaggagcaggagaagaagtcctatgcagtactaccaaaccaactgcctacccctcaaaaatcacagcctgcccaagctgcacggaatagtggttcttcacgcccaatttcagcttcatctccatcaaaaactgcaccttctagccagataaactcccaagcttctctgtcaaaatacagaggggatgatgatttgttttggggtccagtcgagcaatctaagcaagaaaataagcagtatgaattctgtctcttcattgtgcctatgattctgctttatatattggctcgacttatcttacttcctaaactgaaattgtcaggtttccctcagcttgctagcctggggagctggggttctaaaagtgttcccatgaatggtaattcacctggatcattgagtcaacaaaaatctgggagtggcaaaccaactgagcaatctctatcatcatcacctgcctcttctcaaaagctgctaaaactgaaaaaaaatgccatgaccaagaattctgaagccatggacttcagagtctggtgtgagaatgaatgtgtgaggcttgttgggacaaaagatacaagtttccttgagttttgcttgaagcagacaagatctgaagcagagatgtttctcacagaaaacctgggatcatatgaccctgatcgtgaattcattgataaattcctcaattacatggacttgctaccatcagatgttttggaaatagcttttcaaactgggaatgatcagaaagctgctggaggcatgatatctgcaaatacggatgtacaggagctaggttacactgatggatccttctcaaaagttggaaagaagaaaggcggcaagaaaggaaaaaaggtcagctcttcagttttgggattcaatgtcgtgagtaacaggatcatgatgggtgagatccagacggtagaagactaa

SEQ ID NO: 107609 - DNA, 246 bp, Glycine max
  Peptide Sequence Number=SeqID_224387
atgggcgagttgtggtttataaaggagctcaaatcgccattgggaatggctacttcaagctcaaatcgccagtgctactggctactcccaactgcagcgcaaatcgccagtagtactggcgctttccactgcaaaaaagttgtccctccctcctgcaacgctgctgcacgtagtctgaggacaacaatcccctaccctcaactcgccagtcaaactggcgtgtccaagcctgcaaaatgccattga

SEQ ID NO: 107610 - DNA, 345 bp, Glycine max
  Peptide Sequence Number=SeqID_224388
atgacttggattctaccattcttgaagacctcgatgtgctggtacgaagtggaagagagagagaaggtggtgaggcacatgtgggatttgtacagtcacacgaacacgaagtccgttggattacccaagttttggtgggaagcttttgaagctgcttaccagcaattggtgagtgatgtccctgccgtccgagacgccgccgtttcagaaattgccaagatgtctctgcgatctcttcctattcaaattcaatcacactcggttttctcttttcatgatgagcatgtgcagagcatcacggcttcaagaaaaataaagcaagcaaagagtaggacaggacagtga

SEQ ID NO: 107611 - DNA, 2448 bp, Glycine max
  Peptide Sequence Number=SeqID_224389
atggaagttgttcttcatcctgattatgttgtatatcaggataattattatacgggaacaaagttatgcttttcacaatgttacatccaaatcagtgattcaactgcatgtgcaaagcaaggggaagggacctttgaatgggcagttgatgatcttattcatatcgactgtcttttgtttccaaaaagtggaatggtagtaatgaagctctgtgcagtatcaagtaatgcaggtccatcaattcatattagctgcacttcagatattgaagaattgaagattgtatttgttgatgacaattggtccttgagacaagaacagatcacatctcttaatgggaaatacttggctatttggaatactgtgtccgatatggatgtggaagacggcaaaaaaattccacttggaccaagatgctacttctcaaattttcaggagtcttttgagaaagttgactatccaaaaggggaccttaattctgtttgcataactaagagcgattttgatcttttaaaaccagacacattcatcaatgacacgattattgatttttacatccaaaatccatccagtgcttcggatggaaaagcagcatttcaacgtgttcgtagatggacaagaaaagttaatttattcgaaaaggattatatttttatacctgtgaatttcaagcttcactggagtttaatcgtgatttgtcatcctggtgaagtggttaaatttaatgataaagagccggacaaggcacttaaggtaccctgtgtattgcatatggattctatgagaggatatcatagtgatctgaaaaacatttttcaaagttatttgtgggaagaatggaaagagaggcagaaggatacatgtggagaagacctttcatcaagattcttgaatatgcattttctctcagtcccgtcgccgcaacaagataacatgtttgattgtggtctctttctacttcactgtattgagctcttcctggatgaagctccatttaatttcaaccccttcaaactaaccaagttctccaactttctcaatttggactggtttcatcctgtggaagtttctctcaagcgaccttttatccagaggttaatctttgaacttgcggaaaacgaaaaccacagtttgcatgaaggttttccctctgactacaatgaagaccatcgctattcagaaaataataagaacagaactaacagtcttcgtcctgaagtcaatggggactcatcactttcccattctgtccagggaaagcaattcactctattgtcagcaccatcccctttggatcctcaatcttttaacccgtcagacatggttcttaaggagcattttaaaccggggactatggctggaacttcgcggggacattgccaatctttggaccagcaatcatctgatcattatctcaatggttcaattttttcaacgaaggatggcactgatctcaatgaggagctcatgcatataatggcaaatcccaactttcagcaagtttcaccacaatcattttcattgacatacttaactgggggttgtgagacggagatttctcacggaccaagaatcggtatacaatcagagcatgacaagattgagtcatttatagctacaccaagttgtgcatcaggtgactcggacatagagatcattgaaaatttcccaactagaaatgaaacaagatcatcttatgaagatgaacgaggtgaaaacaataatacagccatagaaaactacattgagcaagtttcagatattcctggttctctcatggaaaattctcaatggccaaatacaaattgtgttggccacaacaatggagatcaacatttgtcttatatacagtcagagcacagcaagactaagccgtctcaagctacatcaacttgtgcatatgcttcagacgacatagcgatgattggaaacttcccaattataaatgaaacaagatcaccctatgaagatgaacaaggtgaaaaaaataatacagccatagaagactactttgagcattttccagaaattcctgattctcacatggaattttctcaatggccaaatacatcgacttatgcatccgctaatccagacaacatagctatcactgaaagtttcccaattagaaatgaaacaggattatcttatgatgaccaaagagctgaatacaataatgcagccatggaaaacttcttcgagcatcttccagaaattcctgattctctcgtggaattttctcaaaggtcaaatccgatgtgtgtcagcgacaacaatggagatcaaggcttgtattgtcaagagacaccagcaatgcaaatggatcaagtttctaatgcattagatgacaaattcacatgtgatgatgatgatcttgtgataattgacagcatggaacctgatcattggaagaatcaacctattaaaaagaggcggatgctaaggtga

SEQ ID NO: 107612 - DNA, 432 bp, Glycine max
  Peptide Sequence Number=SeqID_224390
atggtgccacctttagaggctccacacgaagggagtgccctagaacccaccatcgaaggaggaggactcgtcattgctattgtcatcctccgccctcagatgtgttgtcttgcggctctctcacggcggcgagatctccgccaacgaaaactgcttgttcaagtcttggaggtcctccgtcgtgttaacgctggcgtggtcggagccaggtgtcagagggctgctacagctggcggcgaatacatagccactgtggaggaagataggggtgttggtggaggatttggcgtcactgccatcactcaacatggcggcggagaagtgaatcaaggggctagtgatgaaggtcggagagaatattttcaatttcatacaattgttttgcggcgtgagcgggtcgaagctagttgttctaatgagattgatggttga

SEQ ID NO: 107613 - DNA, 348 bp, Glycine max
  Peptide Sequence Number=SeqID_224391
atggaagaactagaggagcaagcaatatccgttgttgcttgtgctgttgatatactttttggtgtaatgacttttgggtgcaagaatagagataaaaagaggataattttcttaatgaaagaagtgactaagtcattgaaagaattcgtacaagaggagatggagatagaagatgctcaagaagttgtacatgaagtgctgaatgagttgaagaatatactcaatcttcatagtgctaatcgatataaagtaattgattggttgacagaaaatcccgataaattagtgattctaaaagctcttccattgaaggagaaggaggattacatcttggcttttatgtcttga

SEQ ID NO: 107614 - DNA, 624 bp, Glycine max
  Peptide Sequence Number=SeqID_224392
atggggaggcatgccgagagattctactgcaaagtacatagttcagcagtacgtggcggcgacgggaggagtagctgcattgaattcactggaaagcataagaaccctgatctatggtgcttggaattggttgtttccggtttcaaggtcggtgctggcattaacggtaagctagcttggaaccactcttcttctcaaccttttcatgctaacaaaggcccttctagaccccttcgccgcttctttcagggactggactcaagttacaaacgtcttcaagcacagagcacgtctaatacagaaattgcctttaaaggaaaagggtcagtgttttgggaaacaagcatcgagtccatgattgatgattatagatacatagacggcattaacatagcgcacggtgggaggacaattgccacgctttataggtacggtgtggcgcataatcacaaacatatgattgaggaaacatggacgattgaagaggttgattttaacattgttgggttatctatggattgctttctgcctccctccggtggagagcgagagcacgaaggtgcagagcaagcatgggataggattttgcttcggttttccttgttttgctcccctcagccatag

SEQ ID NO: 107615 - DNA, 501 bp, Glycine max
  Peptide Sequence Number=SeqID_224393
atgcaaatcgcagaagtcattggcgagtttggccaagctttgacacgtggcactgggactcgtcagtttgactggcgagttgaggtaggggagttccgagggttgcaggcggttgcaggaagaaacagagttgcagcagaagaaagcactgcacattggactcgccagtttgactggcgagttgagccaggtgatctcgtttctgagaattgcagagaaagcagcaggttccaattaaagcttctgctgggtgagtccctgcatgctgaaactggcgagtccctgcattttgaaactgacagacaaactggtgaatctcttcatgttgaaatcgtcaataacactggcgagaccaatgccacctaccctgtcatatcaacaactgtagaagctaacgataacggttctaggaaccgtatcgatgtggtccacaatttcactgacacgttgaattcgttttggctctgtattgctaatcctgaatttggaaagaagctttga

SEQ ID NO: 107616 - DNA, 780 bp, Glycine max
  Peptide Sequence Number=SeqID_224394
atggccaaacgcttcaaattgaagttcaatatcccttcatttcaaatgtgtcgctcaaaagacccttcctctttccctggaaatcccgttcctgccatataccgtctttctcccgttaaccacaacgcgcgtcacacgagacatccaagcattccttctccgtcaccgtcaaagataacgtccatcgcgcagggatgcaaaatgtgccatgacaagcagagtttgaagaaactgaaatccatcagaggccggaaaagcacgtccagcgttccgtcgaggcgaagcgattttcgaatcgacaacatcgaggaagaggagagcgagactctgatttcttgcatgacaagtttctccgacgagttttgtctcggcgaggagaaggagctaagtactggtagtagcagccagagaaggaagatgagcagcgtaaagaaggttcggagtgtgaggtttcagagttcggagaaacggagaggagcggaggtgaagaagacgacggtgacacggaaaagtgtggaggggaaggtgagggagagttttgcggtagtgaagaagtcaaaggatccttatgaagacttcaagaaatcgatgatggagatgataacggagatggagatgtctgaggccgaagatttggagcagcttttgcagtgtttcttggctttgaactctcggagtcatcatgcagttattgtgcgggctttcatggagatttggcaacaaatgttcttttggaaccctacgtcaatgaaaaatctccaaacagatctggaaaagtaa

SEQ ID NO: 107617 - DNA, 562 bp, Glycine max
  Peptide Sequence Number=SeqID_224395
tttccaaagcccccgacttggtgttacttatggaaaccaagaaagtagtaaaagagttggaaagacattgaaacgtgttgttgggatctcaaattgttgtggtgttgattgctttcgacatgagggagtggaagtagaggttatttcagcatctcggaaccacatatatgtcaaagtctcatttctgcatcaagcacattctttttatttatccttgatctatggattttcggaagcaagtaacaagattttgacttgggacctaattcacacactttgtccagggccaggtctcttttggatgtgtgtcagggatttcaaagagatcttatgccctgatgataaaaatggaggaaatgaggcaaatatcaacctcattgcttggtttagaatggtactagagcaatgcagtgagcccaaaggcctagggcaacttggcttgattatggagacaaaaactcaaaattcttctatcatatggctcgacaaaggaggaagaggaatacaattgacaggatcaagaatgatcagggagtatgcttcgaggaagaggaaaatatag

SEQ ID NO: 107618 - DNA, 273 bp, Glycine max
  Peptide Sequence Number=SeqID_224396
atgggtgaaaggatgaatggaaatggtgagtcatcatcgtcatcctcatctcttgggatggtgaagtgcaaatgcgaggaatcaagttcttgtagattttttcaatggattgatggtattgaggctggcaataatgtgtctgcagaagggagtgagttggtccggtatgttcaggaaaatgaagagctgaagctgaaacttgtttcattaatggaggaagctaaagcatatgcagaagaaataacttatttgaggaaaaaatttattgcataa

SEQ ID NO: 107619 - DNA, 534 bp, Glycine max
  Peptide Sequence Number=SeqID_224397
atggaggcggatgttccaaattcacactgggaagcgatgagaaaccaatgtttggacgaggctgcggattcggcatccacgaccgcagtgtctcatcgtcacatgtccttcgaacttgactattcagacttagaggatgctaatgttgtttcattcgaagtaatgaggaagaaccccttttgggtgtacgacagagaagcacttcggctcttcagcaagttcaacaaaggtcgcttgcaacttggacacattttattgggtaatgttgatgtcctgatggctgcacacttgggtgttgtttttatgccacaaggtctgaggcatttccatcgtattgacacatttgaccctggaggctacttaagggacggtggtaagtggactgttcagcaagctgctgaattatcaattgttgctcccactatcgaagcatcattggatgcaaggttcctaagtgggttgaaggaggaaagagttgaagctgcaaaggtctctaaatcaggtggcattggtgttattgtgactgatcaacct

SEQ ID NO: 107620 - DNA, 1113 bp, Glycine max
  Peptide Sequence Number=SeqID_224398
atggagcagaagaaagagacggtgacaacgacgatgagtgatgaagcgaaagagagaatttcagagagactgtcatgtttggagaacctctactttccgcgtgctctcgaatccaccgtcactctcccttctcaacgcaaggccatcttccgcgaccttctctctagagacgttgctcttttcttagaacgatatgggtccaaactcacgtgcagcgagcttagtgaatttgattcgatgaaagacgattatgagattaattggcacataaagcggttaaggagcataatgagtccgacgtcggaggagctgaggatgaggtcggtgacggtgaagaaccggaggcgcgcctacttggataaactggtgtgccaagggcattacttctctgaggaggcaatgagggagagagagccgtatctgcatcatgagtatgtgggtaggtttcaggaccagagtggcagacgcatggcgaggccgggggagcggtggtcggagacgctgatgaggaggtgcgaggaggcggcgctggtggcaaagattagaggggagcagcagaggatgggtgtgccggaaagggactgggttggtaatgagaggtttcaagaagaagaagaagaagaagaggaagaggaggaggaggaggaggaggaaaaggaagaggaggtggtattggatgaagaaaggagaagaattagtagcaatggacaacctgtagagaattggagcctttgggcatttggagcattggtgatcgctaaggaacaaccagaattagaggtcttgggagggctaagacaggtggtgaaatacagcagtattgttttcggatccaatgctcctcattcttttggacttggggactttagtgctataatgagacacctgaatgaggctgatccaaccaaagtgagtgaggaaccaactttatctgcagaagaactggaggaccggatgaatcaattcacctacattatgcagcagaagtttctattaggagaagatcacgaacatcaagattactctaaaatagataatgacgagacccttgacgatcattggcagagggaggccaatattgatgcagaggagagatattttgctgatgactga

SEQ ID NO: 107621 - DNA, 1776 bp, Glycine max
  Peptide Sequence Number=SeqID_224399
atgacttctggggtgttacaatttaactggtcgatgcaattggcaggaaatcctcaagatgtggttgtgccacctgttgaaggtgttgcaggaggtggtacggcttatgggtggaatgatggtggcacacatggcttgaatgtcaagggaccaattgaccccacagaaattccaactaaggatttagtgcatgtatggtgcatgccaaacacagcaaatgttggacctcaagatatgcccagacatttggagcctataaacctgctggctgctagaaatgagagggagagtgtgcaaatagctatccgaccaaaggtttcatggggtggttctagtgttgcagggactgtgcagattcagtgtagtgacctatgttccacatctggagacagactgattgttgggcaatcactgctgttgcggcgggtggtgcccattttaggtgtacctgatgctcttgttcccgttgatcttccagtcagtcaaataaacctatttcctggggagactaccgctctttggatatccattgacgttccaagttctcaacctccaggacaatatgaaggagagattgtcattactgctataaaatcagatgcagaatctcctgttcaaagtataagcaaggttgagaaacatcagctgtatagggacctaaagggatgtcttgacattgttgagcccattgatggaaaaccattagatgaagtggttgaaagggtgaaatctacaactacatctttgagaaggattcttctgtctccatcattttctgaattcttttcagataatggaccagtagacgtaatggatgaggatgccatttcaagtctctctttacggatgaagttaaatctgactgtttgggaatttgtacttcctgaaactccttcgctccctgctgtatttggtgtatcctcttcccatacattaaatgtcaaacaaatatctgatactgtaattgaggatcgctttggtgttcaacaagggacagctgagtggtatgaagcattggatcagcatttcaaatggcttcttcagtatagaatcagcccttatttttgtaaatgggctgatggtatgcgtgttttgacgtacacatctccatggccagcggatcatccaaagtcggatgaatatttttcagatccacggttggcagcatatgctgtaccatataaacaagtagtctccggtaacaattcggcggaggattacttgcagaaacaagttgagatattgaggaccaagaatcactggaggaaagcttacttttacttgtgggatgagccactgaatttggaacaatatgattctgttcgaaatatggccagtgagattcatgcttatgctccagatgctcgtattttaactacttactattgtggaccaaatgatgcacctctcgcacctactccatttgacgcttttgtaaaagttccaagttttctgcgtcctcataatcaaatttattgtactagtgagtgggttctgggcaatcaagaggacctggttaaggatattattgctgaattacaaccagagaatggcgagagaggagagttgaccgggagaagaaaaaatgaggagtggtggacatatgtctgtatgggaccatcagatcctcatccaaattggcatcttggaatgcgaggtacccaacaccgtgccgtcatgtggcgtgtgtggaaagagggtggcacaggatttttgtactggggagccaactgctatgagaaggcaactgtagccagtgcagaggtgattgtatag

SEQ ID NO: 107622 - DNA, 1047 bp, Glycine max
  Peptide Sequence Number=SeqID_224400
atgcagagcgcaacacgcgccgaggcggagcgtctcctggggatcgcggagaagctcctccagaaccgcgatctggtggggtctcgagagttcgccttcctcgcccaggaaaccgagcctctcctcgaaggctccgaccagatcctggccatagttgacgtcctcctcgccgccgacaagcgcgtcaacaaccaccccgactggtacgccgtcctccaggtggaccgccgctccgacgacctggacctgatcaagaaacagtaccgccgccttgccctcctcctccaccccgacaagtcccgcttccacttcgccgaccacgccttccagctcgtcgccgatgcgtgggccctactctccgaccctattaagaaatctgtttatgacaaggagctctctttcttctcccgcgtcgatttgtccgtccctggatgggtccagcagcaggagaagctccccgtccggaggactgggcctgggcccggtcccggtcccgggcccactgcgggccgcaatagcgctgcttcggcccgcgaggacatccacgcggacgagaattcgaggaggaggaggagctctactttctggaccgcgtgtccttactgttaccgtttgtatgagtaccctagggtttatgagggttgttgcttgcggtgccagaattgtgatagatcctttcacggcgtaacggttccgtcgctgccgccgcttgttcccggtcaggatgcttattattgctgctgggggttcttccccatggggtttgttgttggcagcttcggttctcctccgcagccggaggaagaagctgctccttcggcggcggaggcgccaccgtcaccgcctcctccgccacagcaaccggcttcttcgctgcctaattggatgccggtggcggcggagaatggcgtggggagtgtgacaccggtggcggcggccaccaggttgacgaggtcgggggcggcggtgccgaacggggtaggatcggggaatgggacggggaagaagaaacgggggcggccgaggaagtatccattgccgtcgtga

SEQ ID NO: 107623 - DNA, 473 bp, Glycine max
  Peptide Sequence Number=SeqID_224401
gaaggctttcatgcagccaaaatctgcagttatgcacagggaatgaatttgatctgtgcaaagagtattgaaaagggttgggatttgaagttggagtttgcaaaggaaataattgatcaccaatctgcctggaagatagttgtttgtcttgctatcaattctggtattagcactccagagacaaatctaaagctgaaacaagcacccaaagcaacttcaaagttgcaagaagactcgaactttcaaaattttagggctgtcatcaaatgtgaagacccaaatgctgggattgcttatggacgaggagttactgaagttgagagagctctatctaggagacatgaatcacatccaggccaagagttaaaaaagattagtgaatcaaagtcatccattaaaggttttaactttatggatgaaagggtagttgtcgcaacctacccttcggcgagagggcgacgcgtgactcgcgg

SEQ ID NO: 107624 - DNA, 756 bp, Glycine max
  Peptide Sequence Number=SeqID_224402
atgacggaacctcagaatccttcaccattgacacattctccagcgttagaaatcacacctcaaccactgctacctcccaaaaggaaacgaagcctccctggaatgccagatccagatgctgaagtgattgctttgtcaccgaagacgctgttggcgacgaaccgtttcgtgtgcgagatctgcaacaaaggcttccagcgcgaccagaacctacagcttcaccggcgtggccacaacttgccgtggaagctgcggcagcgagggagcacagagccgcggaagaaagcttacgtgtgtcccgaaccttcctgcgtccaccacaaccccgcaagggcgctcggcgacctcaccggcatcaagaagcacttctgcagaaaacacggtgagaaaaagtggcaatgcgaacgctgttctaagaaatacgccgtacactccgattggaaggctcatatgaaaacttgcggcagcagagaataccgatgcgactgcggaaccttgttctctaggagggatagtttcatcacgcacagagcattttgcgatgtcttagcgcaagagagcgcgagggcccaggcccaggcccaaggccaaggtggtagcaatagcaaagtggttgaggcttcttcgccgcctacgcctccacttactccctccgcgtctgtggtgcctccaactttgtccattcagagctcaggttcaagctgcgtgaatttctcagatacgttttcgactttcgtcaactttttaattatataa

SEQ ID NO: 107625 - DNA, 459 bp, Glycine max
  Peptide Sequence Number=SeqID_224403
atggtgattgcttgtgcagactctagggtatgcccctctaacatattaggattccaacctggagaagtctttatgatacgtaacattgccaatcttgttcctgtgatgaagaatggaccatcagaatgtaatgctgctcttcagtttgcagtaactactcttcaggttgagaatatattagtcattggtcatagtagctgcgctggaattgaagctttgatgaatatgcaagaagatgcagaatcaagaaacttcatacacaagtgggttgccaatggaaaacttgccaaacaaaggacaaaagctgccacagctcatcttagctttgatcagcaatgcaaattctgtgagaagaaggaagcagttatgttgtcaaagaacaagaattctggtgctgactgttgctataccaggaagcttgaaacaacattcatgacaatgaagtcaaattcaatttga

SEQ ID NO: 107626 - DNA, 1788 bp, Glycine max
  Peptide Sequence Number=SeqID_224404
atgctgagtttgccagacaagcaaagactagtccatgagattgctcgacagtcaaaagatgcctcaagtatgcttcagtcatttacacgtagggaacttctagaaataatctgtgctgaattaggcaaagagaggaagtacacaggatataccaagagtcaaatgatagaacatcttctgaagataatttctaagaactccaacttgcacatcaatggaaatacacctcctcaatctcctgccaaaagttgcattggaactaaaaggaaaaagaaacctgcgactcaggatttacatcatgctcctctagggaacagtaaagaaacagtgaaaacctttttgtgtcaaaatgttgcttgcaaagctaaattgaatccagaagattctttttgcaagagatgttcttgttgtatatgtcatcattatgatgataacaaggatcctagtttgtggttgacctgcagctctgatcttcccaatgaggagtcatgtggaatgtcctgtcatttgcaatgtgctttgagtaatcaaatgtctggcattttgaagggtagttgtggtggtgttaagttggatggaaccttctgttgtgtttcctgtggaaaaattaatgaactaatgaagacatggcgaaagcaattgttggttgccaaagaagcaagaagaacggatatactctctttgcgattatccctggcccacagaattcttttaggaacagaagtctacaaggaagtgcagaaaattgtagaaactgctctcaaattactggagaatgaagtgggatcactatatgctagtatgacgcgtggaattgtgagcaggctttcatgtggtgctgaggttcagagattgtgcactactgcacttgaatgttttgattcaaagttttctgtccttttctctatttgtttggaaaacaaagatgcaccaacttgctcaattcgttttgaagagtgtcttcctacatcagtggttattgtgctagagtacaaagacaaacttttgcagaactttctaggctgcaggctttggcaccgactatcaacaatggactaccctgaacaacccaccttcattgtcttgaggcctgagaaaagattcaagttagaaaacctccatccttcaactgaatacttttgcaaggcttctctgttcagcagcacagggattttgggtgctgcagaagctacatgggtgacaccttgtgaaccaactaatccttcaaaagttattaattgtggtgggaatagatttagatggtcccctcaaagaccctcaggtacaggagtgaacatgtgtgcacagaaccgaataactgctgaaattcatcccacagaatctgccaactccgaaatgaagttatcatccggagaacatcccgggaagaaacacatcattttgaacatcaggagcaggtttgaagagttcctctccaagcctcaaccagtagagcctttttcatataaaaatcttgctgcagtttcaccttcaacaccttctaaatcctatgaaatgaggcaaattcctggcttgaattctaggaagttctcgaaggagaacgattacgagtattccgtcagggtagtcaaatggttagagcatcaagggcatatagatgaaatcttcagagtaaggtttctcacttggttcagcctcaaggctactcagcaggagagaagggtggttagtgcttttgttgatgcattgattgatgacccagcaagcttagcagaccagctcatacacactttcagcgacgagatatgttgcgagccaaaatcttag

SEQ ID NO: 107627 - DNA, 270 bp, Glycine max
  Peptide Sequence Number=SeqID_224405
atgtatatggtttcattccatgtaagcgaagaactagttgtagaaagctcgatctttgaaattctaaaaatcaaaacagctttctacattacagttcagaggaattctatagtttgtgatggttgtggcatttcatcaaacataacgacacaaagattcacaaacccacagaaacagaacagacctaatgtgaagttagaggtagaagaacatggaagccgtgttgatgagagaaagaaagaggtgcaagatggcttttaccaagagtga

SEQ ID NO: 107628 - DNA, 1690 bp, Glycine max
  Peptide Sequence Number=SeqID_224406
atgagaaagttgtgttttaaccccaaaacggagtcgtttgctttggcacgcagttctccttcttcgccactatccttaacctcaagcccaacgcttccgaggctgagcttttccgaacctagcagcttccacgaagatattttcatcgaagaagctgaggcactgatactcaaatggaacccagactcttccgcttacgcaaaagtcacttccctcttctaccaagacagaaacgaagccaaacaatatattagctgtgttaaccagcttcagaaaactatgcattcgttgctctctcagaacctttcctctgacaaactcatcctcgctcataacctaatgcagattgctatgaagaggctcacgaaagagttctaccagatcttatccatgaaccgcgcacaccttgatcctgaatccgtctccgccagatcctctcgcacctccgccaattccagcgcctccgattatgacgacgattttgcggcggaggacgacgatatccgcgccgccggcgactctatctccgaagtcgagcaggtttcctccggcgccatggcggatctgaaattaatcgctgactgcatgatatcttccggttatgcgaaggaatgcgtcagcgtctacatcttaattcgaaaatctatcatcgacgaaggaatctaccgcctcggcgtggagaaacttagctcctcgcgcgctaacaagatggattgggaagttcttgatttgaagatcaagagttggttagaggcgacaaggatttccgttagaacactctttaacggagagagaatactctgcgaccacgtcttcagttactcagattccgtcagagaatcatgcttcgccgagatttcaagagacggtgccgctctccttttcggattccctgaactcgttgccaaaacaaagaaatcttcgccggagaagctgttccgcgtgctcgatatgcatgctgtggcttccgaactgttgccggagatcgagtctatcttttcctccgattacaactccggcgttcgttctcaattcctggtttcgcttcaacgactcaccgaatcggcgcaaatcttgctcgcggagttcgagtccacgatccagaaaggcacttcaaagccggcggtgaacggcggcggcgtgcactcgctcacgattcagacgatgaattacctttcagtcctcgccgattatctcaacgtgctctcggatatatttccgcgcgactggcttccaccgcagaagtcgtcatctctgccggaatcttatttatacagcccagaatctgattactcggcgtcgacgccggcgctgacagcgcgttttgcgtggctgattctcgtcctcctttgcaagctcgacggcaaagcgaagcattgcaaggacgtttcgctttcttatctgtttctcgcgaacaatctctggtacgtggtggccagagtccgaagctcgaacctgcagtacgtgcttggcgacgattggatccttaagcacgaagctaaagcgaaacggttcgtttcgaactacgagaaggtggcgtggggagaagtggtttcgtcattggcggaaaatccagccgcggcggaggcgagggcggtgttcgagaacttcaaccgcaaattcgaggaagcgtatcggaaacagaactcattcgtcgtagctgacagagaattaagagacgaaataaaag

SEQ ID NO: 107629 - DNA, 378 bp, Glycine max
  Peptide Sequence Number=SeqID_224407
atggaactaattggtactagttcagatgccgttccccatcagaatcactcttcaaggggctcaagcaatgctggcaacaagaatttaactgagaaagaagtctatgtaaaccatgctgagttagcctggcatcaaatgaggacagaatgggttggtgatcaatcaaaaaaattacggaggtcacctaaaggttcaacattaagcgtcacaaggacttatgaagaggtgcttgcatctagagaaccttttaaacgaccaatactattatctgagatgattacagacagcacaggtaggcttcatagcagtttatgtctgcaacaccttggattttttggtcaaattgtggctgctgcagctaaacattcatcggactag

SEQ ID NO: 107630 - DNA, 1707 bp, Glycine max
  Peptide Sequence Number=SeqID_224408
atgccaccggtcaagaaaacgacgatcaaacagatggaagctaaggtcgaagctctagaaagtgagatctcagaagtacgtaccacacttgctaacgtacagaatgcggtgagggagaaccatgcgaatctgcttgcaatgcttgagaagtgtctggggaagacgatgtttgaggaggaaggtcctggaggatcggtgaagggaacaccggcgaatacgccgttgttggagacgaaggagtcaaagagggtgcataccaacaggatccgggaagaatcgctagcggagtttcgtcacgcagtgaagaagatagaattaccatctttcaccggcgaggatccgacagggtggatctcacgcgccgagatctattttcgagttcaggataccacaccggagatcaaggtgaggttggcgcaactatgtatggagggtccgacgatccattttttcaattcactaattggggaaaatgaggatctgtcttgggaaaatctgaaggatgaactgctcggaaggtatggaggtcatggggaaggtgacgtgtatgaacagctgacggagttgaagcaagaagggactgtggatgaatatatcactgagtttgagtatctcacagcacagatacctagacttccagataaacagttcctggggtattttttacatgggttgaagacggagatccgtgggaaggtgaggagtttggcagcgatgggggagatgagtagaacgaagctcttgcaagtgacaagagcagtggagaaggagattaagggcaccgggtcgggtttttaccgtgggtccaaatctgggaatgggtcacaccggcccagttcccatgggtcgggtaaaggaagcactgactgggtcatggtaaaaggacaggaagaagagaaaagaagtggagttgggcctaagggagataaaatggcccataatcataagaggcgcaatggaccacgagaaaggggattcacacatttatcttatcaggagatgatggaaaggaaacagaaaggactttgtttcaaatgtggaggcgctttccaccccatgcacaagtgtcctgaaaaacatctgaagattctggtgttggaggatgacgacgacgaggaggcggaggcgaaggtaatagcagtagaggtggaagagtctgatgaagacgataaggctgaaatgtgtgttctgaacttgaatcacattgcgtatgagaaccataaaacggtcaagctgcaggggaggatatgtggtgtaccggtgttaatcttggtggatagtggtgcgacgcacaacttcgtttcccagaagttggtacacaagatggagtggtccatagaagaaaccccatccatgagcatcaagcttggagatggctctcggtctcaatctcaaggcgtggttaaagggttggaattgaacattggtgagttcaagttatctccagagatgcacctgtttgaattgggaggaatagatgtcgtgctgggaatggagtggctcaagaccttaggggatatgattgtgaattggcgtcagcagacgatgagtttttggagcaataagaaatggtgcatcctgtctaagccaaagttcaacaaaccaaaggagttatgggggatggagaagagaggagtagaaggagggacaatgctgactgcacaccaacaaaaggagttgggtttacttttagaacaatatgcacaa

SEQ ID NO: 107631 - DNA, 1599 bp, Glycine max
  Peptide Sequence Number=SeqID_224409
atggagatcgataaggcaattagagagtgtgacgatcgaagacttcagaccaagtacaacaacgctacctatgttgttcagagagctttggctttgtattctattgaggaggttgccttcagtttcaatggaggaaaggattcaacagttttgttgcacatactcagggctggctatttcttgcataaaaaggggcaaaatagtgtcaatggggatctaaaagattttccaattcgaacaatatattttgagagtccttgtgcattcccagaaatcaactcatttacctatgatactgctgccatctatgggttgcaaattgacaccattagcttagatttcaagtctggtttggaggctttgctaaaggaaaaaccgattcgagctatcttccttggagttcgaattggagaccctactgcggttggtcaagaacaattctcccctagttcacctgggtggccacctttcatgaggctgaatcccattttagattggtcatacagagacgtgtgggccttccttttaacttgcaaggtgaactattgcagcctttatgatcaaggttatacttcaattgggagcatatacgacacagttcccaactcattattatgcattagcaattcttccaataaattcaaacctgcatatttacttgctgacggaagattagagagggcagggagggctaaaaggccatctacttcaactggtggacaaattcctgcagagagcaatggcctgactagccaggattcatataaaaacagcatgctcacagcatcaatcattgctgtgggagatgagattctgtttggcaatcttgaggatctgttgggaccttatttgtgtaggaagctgcattcaattggttggtctgtgttacaacattctgctgtgcacaacaatatagattctgtggccgaagaagttgagagacaaaaatctaaaagtgatatggtatttatatatggaggtgtaggtccactgcattcagatgttaccatagcaggcattgcaaaagcttttggtgttcgtttggctcctgatgaagaatttgaagaatatctcaggcatattattggtgatcagtgtactggtgaccgaaatgagatggctcaattgcctgagggcataactgaattgtggcatcatgacaaattgtctgtgcccttgatcaagtgcgaaaatgtaataattcttagtgcaacaaatgttccggagatggaaaagcagtgggactgttggattgaattagcaaaatctagtgacctactagcattgctggaaccatatgtatcaaagcatgtgacaactagtctttcagatgctttgtctatggttgaaattgctcaacctctgtcaaagctttgccttgaatttccagatctttatattggctgttaccgcaatgccagatatggatctcttatagtaagcttcaaaggaaagaatgaaaacctttcatggctgggtcatatcattctcatattacctacaaatataagatgcattgggataaagatggagagggaagaaaatcaaggtgctgctgtattggtagaagaaagaacaatggcacaaggaggtggctga

SEQ ID NO: 107632 - DNA, 489 bp, Glycine max
  Peptide Sequence Number=SeqID_224410
atggctaatgaaaacggtttccaacttagtgtgaagctaagtgaaccaactctagttcctcctgctgaagaaacaaagaagggtttgtatttcctatctaaccttgaccagaacattgccgtgattgtgagaaccgtttattgcttcaaaactgctgagagggggaatgagaaggctggggaagtgatcaagaatgcattgaagaaggttcttgtctattattaccctcttgccgggaggcttacaataagctcagagggtaaactcattgtggactgcacaggggagggtgccttgcttgtggaggctgaagcaaactgttcaatggaagagattggtgacatcacaaagccagaccctgggactcttggtaagcttgtttatgacattcctggagcaaaacacattcttcagatgcctcctttggttgctcagtacaacttttttaatgctaaggatagccagtttatgcattttgcaagtacttga

SEQ ID NO: 107633 - DNA, 360 bp, Glycine max
  Peptide Sequence Number=SeqID_224411
atgtatcctggattaccaagccgattggaaaaagaaatacttgatcgttatcttgatgttgtcctgaagggtaacagagatggattgaagaaattgcgactaagaatagaggatccaccacgtaggaagcacatggtataccttggaggtgctgtgcttgcaggaataatgaaggtgtggccaggcatgactttgaggtccatgatcgctctgaaaatgggatatcaattttgggaagcaaaagcgcaccagaggctgagtgatgaatattcaaagctgttaaaactgcctcctcctaaaatagcttgcattaattgctgctggccttgtatagctgtccctatggctactagaggctag

SEQ ID NO: 107634 - DNA, 1740 bp, Glycine max
  Peptide Sequence Number=SeqID_224412
atgtccattttggtctcaaaagctactgcgggaatgcaaatgcaggctttccctgtcattcccattccaacttccacttccatgcgttcaatctctcactcctctcctttccgtcttcattcagctgcaagcatcaccaccctcctcaaagcctgcaagaaacgtgaacacctcgaacaagtgcacgcgtgcatcatccatcgcggcctcgagcaagaccacttcctcgttttcctcttcatttcccgcgcgcacaccctcctctccactctctcctacgcctcctccgtcttccaccgcgttctcgccccttccaccgtcctctggaacactctcatcaaatcccactgccaaaagaatctcttttcccacaccctctccgccttcgctcgcatgaaggcacatggggcactccccgatagcttcacctacccttctgtcattaaggcctgttccggcacgtgcaaggcaagggagggaaaatcgcttcatggctccgcgttccggtgcggcgtcgaccaggatctctacgtgggcaccagtttgatcgacatgtatgggaagtgcggggagattgctgatgctcgtaaggtgtttgatggaatgtctgacaggaatgtggtttcctggactgctatgcttgttgggtacgttgctgttggggatgttgttgaggccaggaagctgtttgatgagatgcctcacagaaatgtggcttcttggaactcaatgttgcagggctttgtgaaaatgggggatttgagcggtgctagaggcgtgtttgacgcaatgcctgagaagaatgttgtttctttcaccaccatgattgatgggtatgccaaggctggtgacatggcggcggcgaggttcttgtttgattgttctctggagaaggatgttgttgcttggtctgctttgatatcaggttatgtccagaatgggctgcctaatcaggcgttgcgagtgtttctcgagatggaattgatgaatgtgaagcctgatgagtttatattggttagcttgatgtcggcttccgcacagttgggtcatttagaacttgctcagtgggttgattcttatgtaagcaagatctgtattgatcttcagcaggaccatgtaattgcagcgcttttggatatgaatgcaaagtgtggaaacatggaaagggcgttgaaattgtttgatgaaaaacctaggcgagatgtagtcttgtattgttcgatgatacaagggttgtcaattcatggacgcggtgaagaggccgtgaatctgtttaacaggatgctgatggaagggctaactccggatgaggtggccttcacagtcatcctcacagcttgtagtcgtgctgggcttgttgatgagggacggaactacttccagtccatgaagcaaaaatactgcattagtccattgcctgatcactatgcatgtatggtggatcttctaagccggtcagggcacataagggatgcttatgaacttataaaattaatcccctgggagcctcatgctggagcctggggtgcacttcttggggcatgtaaactatacggtgattcagagttgggagagattgttgctaatcgactttttgagcttgagcctctaaatgcagctaattatgtgctgttgtccgacatctatgcagcagcagagcgatggatagatgtttcccttgtgagaagtaagatgagggaaaggagagtgcggaagatacctggttccagtaaaatttag

SEQ ID NO: 107635 - DNA, 1320 bp, Glycine max
  Peptide Sequence Number=SeqID_224413
atggcccctcactttgaattggtgagtattgcagttttgaaagaaagtgtcaactctatattccaggtgaccaagttcaaatgtggaggctttgctcttgggctgtgcatgaaccactgcatgtttgatggcattggtgcaatggaatttgtgaactcttggggagaagcagccagagacttgccactctcaatccccccagtgatagacagaagcatactcaaggcaagaagccctccaaagatagagcacctgcaccaagaatttgctgacattgaagacaagtccaacacaaatagcttatatgaagatgagatggtctacaggtccttctgcattgaacctgagaggctaaagcagctgaagatgaaagccatggaagatggagcacttgagaaatgcacaacatttgaagtcctctcagcatttgtgtggatagcaagaaccaaggcactgaagatgctgcctgaccaacaaacaaagcttctttttgctgtagatgggagggccaagttcaaccccactctcccaaaagggtactttgggaatggaattgtgctaacaaattctgtgtgccaagctggtgagctaacagaaaagcccttctcatttggagtgaggctcattcaagatgcaatcaagatggtcacagacagttacatgagatcagctattgattactttgaggtgacaagagcaaggccttctcttgcttgcacccttctcatcacaacttggtctaggctttcctttcacaccactgattttggatggggtgaacctgctctgtcagggccagtgtcactgccagagaaggaagtgattctgtttctctctcatggccaagagaggagaaacatcaatgtgcttcttggtttgcctgctcctgtcatgaagattttccaagatttgatgcagatatatatgcaatgtaatggtgacaaggatgcagtgttttcttcttcttctttccttttttttaagtactacatcatatatgccgagggcgctgcaccaaacagcatcgtggtgacagaggatgtttcaccaaaaggcaatgcaacgaaggacattgttgccccaaataacgtcgtcattgtggaagacgaagaagcatcaaacgacatcgttgtgacactgaaaagtgcagaaaaggaagaggaagccaaggagaaggagggtgcacaggaagaagaagcggaggagaaagagagaggggatggagaagaggacatggcttatgtagggtttgcggagaagaggacacgcacggacaattttgtaattagagagaataaaaaccacaacagtttgacgtaa

SEQ ID NO: 107636 - DNA, 885 bp, Glycine max
  Peptide Sequence Number=SeqID_224414
atggggacacctgctaggtggcattccccgtttatggtactgcacggggaggaggacgggataggtatagccgggggagggctaggggacgtcgttaacttattggatacggctgaccaagacggggacattggcttcattttgtgggggcgtattggggacaatgacattgttggagaggttgaggtagcggaggctggagaaggtggagaaagcaggaggaatggggccgaagaatttgtttgcggcgagggagaggttgaagaggaatgggaggtgggcaacgttggcggagagcgtggtggagaggtccatttcggtgaagttgagggtggtgacgtggtggtggttgtcgctgatgacgtcgaactaggagcaataagggatggaggcattccacgaagacagaacgggctgatggttgcttctctacgaagtcggcttataaaacgtagtctgggcagcatagtggggtccaaaattcgtgttggatggatatttggaaagagagatgttgtgcggactgatagttgtcctttgtgtgcctcgacatctgagaatattttccatatcatcagggattgtccctttgctcgtcaaatttgggagaggctggggattttagagtgtgactctagagtggctgtctatttggtcttgcatctcgataatacccaacaccgtttttggaactcggtttccaacatcagagattggttgtctcgagattggactgtgaggattcatgtgtatggggagcgttctgagagtgtgaacgacgacgctgtggaggctgaaaatcccggtggcgccgcatatgaaggtcggaaatcatggcagcgtcacatttggaggtcggaaatgcggcggcaacgcttcacggag

SEQ ID NO: 107637 - DNA, 363 bp, Glycine max
  Peptide Sequence Number=SeqID_224415
atggtatctgggcatgccgttgctccattcttagaaattgacctttaccactttatcttggataatgccaagaagaggcttggtagttggagggctcgttccttatcttttgctagtagagctactttgatccaggttgtgatgtcagctctccctacttacacgatgcaaacacttttgctgcccatacatatttgtaaggagttggaaaagatgatgcgttgttttctttgggggatgaaaatgtggttcatgaatgccagtgtctcttggaaggacattggtaactccaaggactttggtggaatgggctttaaagatatttatcttttcaataaggcgatggtgatgaagttaggttag

SEQ ID NO: 107638 - DNA, 114 bp, Glycine max
  Peptide Sequence Number=SeqID_224416
ctgtgaatctattaaaaattactgaggaactgttacaaaagtcattcggcttcaaccgctcaatcgagatcagtggtcgttggatcgctcatgtattggacacgggatggtctg

SEQ ID NO: 107639 - DNA, 174 bp, Glycine max
  Peptide Sequence Number=SeqID_224417
atggaggaggaccggtcctgcattaatgagaattcagaaccagaagaaatgcaagatgaatccagaaggcaagtcatcagtttcacatatataaaaaaagccattgacaattgttacacttgttttcgagacccaagtaacctccctaaagaaatagacgagagtgagagatag

SEQ ID NO: 107640 - DNA, 1263 bp, Glycine max
  Peptide Sequence Number=SeqID_224418
gttccttcctacctcctatccgtacgacaccgctgctctacgcttcattcttcctcgatcgctttgtgttttctaccgcgccgctgtcgcccaaagcgtccattgctgtcgttcaggcagtcttcgccattgtcgtcctgtttccgccgtcgaggcaacgggaagctgcacctattgctgaagatgttcaacacgtggatcattcaactaacgaggtccatgaacagcctgaagaagcagctgttgatgatgtagttcctgatgccgagggttttccaagaggtccccgtgacacatcagttttgattggctatgttgattatgttgcagtgattgtttggaatggagaggaacgtcctgagttgaagttatcctcccatggaaggaaggttcacaaatttggcaggcctactccagagattgaaggcttagtggttgccataggattaagtcctctgacttcatgttccttggacactggcgattgggaacttatatcggcttatatggagaggtggcataaggaaactagtagtttccatcttcctataggagtgcccatcacaggcgccttccatagcttcgaggctcttcatatggatgaagcggtgttggtgttaattgaattgcttgaagtaagtgcagatgaagcaagagctgagacagtacaatgccattggacatatgttcaattatcatggctacgagacatttatcatagcaaatgtgatgtcgcacaatggactgtagcagctcgagcttatctgttgcatctgggtacatcctttgtggtacaagaagagggtacatctacttggcttgttgtaactgagaacaagaaagggtacatctcttatggatcagttcaagtggagggtacatccacttggttgttcaaagtgaacaaggaagggtacatcccttgtggatctttgcttttatttgaataccttgcaccagtgggtcagatatgtgttgttcctggacagtgtgcagcagactacatggaatggttctacatgatttttcagcccttcatgagtccgacacaacttggggatccacctagacatccatctgtcatgcataatgacacatttgttgaacttgatattcctcagcacccggtggtggcaacaactatggacacagcacctgtagatgcacctggtcatgcagagcagcctagacatgtattggaggcttgtcaagaaatagttgaaaggttggaacggttgttcaacctaaggatagtgactaaag

SEQ ID NO: 107641 - DNA, 585 bp, Glycine max
  Peptide Sequence Number=SeqID_224419
atgcaaagcatagccaataaaagctcttctcagttttttcatcttccacttgttctcaacaagtcttctgagaaaagcagagatgaccattcgcagaatgggggaattcatacagataaaattttgttggataattttggaagatcaagtgaagatccagcactgattttgtacactagtgggactacaggtaaacctaagggagttgttcatacacacaaaagcatcatttcccaggttgagtttttgccaaaatttagtgtgagaggagtttggcagagatggcgtgagtcatatccaactgatggttctaaggccgaagatgctataactgtgttcactggagtaagtgtaattcttattagcattgttcttgtatctgatatggttcactctcatggtaccttggtttgtgtatataacctaagcttggctgaaaataattatgtttactgctataatcatacaaagacagcatttatagtccatatgatggcgataaaactaatagaggcaagtggcataacaaccaaaatctccacaacccatacaaattgttcagaagagtttcgttcacatttttga

SEQ ID NO: 107642 - DNA, 336 bp, Glycine max
  Peptide Sequence Number=SeqID_224420
atggtttatagtagaaatagaaaacagaaaggggaaatcgggcctttgaagtccggtggtggtataggaagggaaaataacatagtgaccagaaaggagaattgggccaactctgaagatccagttgcatcaaaagagaatggatcacctattttaaaggtgggaatgggcttaaagaggtggtctcgtgggacagaaataacagaaaaaaggatgctggaggcaacaaacacttggactatagcaaaagacatggggtccgttatgaagcagaggaaggaaaatggtgtccaagattgctatcttagaaggaaaaaacaaaggagcaatggaaag

SEQ ID NO: 107643 - DNA, 387 bp, Glycine max
  Peptide Sequence Number=SeqID_224421
atgcccccgactgtccctgttaatcattactccgatcccgaaggccaacacaataggatcagaatcctgtggtgttatcccatgctaatgtatacagagcgtaggcttgctttgagcactctaatttcttcaaagagcgcatcgccggcagaagggacgagccgaccggtgcacaccggaggcggaccgatcgacccaacccaagctggaattaccgcggctgctggcaccagacttgccctccaatggatcctcgttaagggatttagattgtactcattccaattaccagactcaatgagcccggattgggtaatttgcgcgcctgctgccttccttggatgtggtagccgtttctcaggctccctctccggaatcgaaccctaa

SEQ ID NO: 107644 - DNA, 306 bp, Glycine max
  Peptide Sequence Number=SeqID_224422
atggagtttgatttaaataagacagaaagtgataatgaagaacaatttaaatttgatgaaagaaaggatgggagtaatctcaagattaacagctctaaattgcagcagaggatcaaccgaaacataacaaccatgttcaactgttcagaattgttttatttaattcataagaaaaggaagtttacaacaattcccataccctgtaaaccaactaagatagacctgcctgttgataactggtcagaatttttgttaagtatcagaactcaggtgctagtaaggaagactgagtcaaagagagtgtga

SEQ ID NO: 107645 - DNA, 4585 bp, Glycine max
  Peptide Sequence Number=SeqID_224423
atgattggatattatccatctacttggctttttactcaggtcaactcaactgatcccatactgaaagacagttggcgtttggaggggtctcaggacaagaaagactggaggaggacagctcctgatgttgacatcagtcgccgctggcgtgaagaggagagagaaacaagcttgcttgggagaagggatcgcagaaaagaagatcgtcagaatacttcaacctcggagaatagatccttgccctctgatcgctggcatgagagccgtggttctggccatgactctagaagggagaataagtggtcatcaagatggggtcctgaagataaagagaaggattctcgtagtgagaaaagacatgatgttgagaaggaagatggtcacactgaaaaaccttctcctggagttgggaatcgcatggggcctgatcgtgacactgattctcgtgataaatggaggccgcgacatcgattggaagctcaagctgctggtgtggccacataccgtgctgcacctggatttgggctggagaaaggacgtaccgaaggctccaatgtgcgattttcaccaggaagaggaagggcaaatattaacggaaacctacaaattgtaaggcctcctattggttctggttctggatctgcacttgtggataggaataaaaccatattggggaagtctagtcttggtgctgattcatattactacccaaggggcaagctccttgacttatatcgcaagcgaaaggttgatccaagttttgatagcttgccttctgagatggagcatacatcacctataactcaacagggttctgttgaaccattagcatttgttgctccagctgctgaggaggaggctgtccttaaagaaatatggaaaggaaaaattactagcagtgaagtctcaggctactcctttagaggaaaggatggagggtcaaatgatgatatttcaggtcctggtattataagtgagggaaaacaaccttccattggcagtggtgcaaaggttatatcaggaagtgatgtctcagatgattctgatcaaattctaattggttcagcatcaattgctggtggtttattgagaaatatagttgaggaagttgcaacttttcaagaaggcaagcagcaacatatggaaactattggtgtgcatgggagagccgagagttctgttaacagcattggggagggaagcattcctggaaacaaagttgctgaatcagcaaattttgattaccatcagggacaaacttctggctttcgggatcatgctaaccggaatggtgttgactcaattgctgcttctgaactcagtagtaatctacctaatgattctcgctctctctttgatttttcatctctgcagcaaacttcaagcattaatcaacaggacttgaaaattaatgagaagtcgtatccatctgaaagtgttattgctcttgaggagttgagtttgtgctatctggaccctcaaggggaaattcaaggaccctttcttgggattgacatcattttgtggtttgaacaaggattttttgggatggacttaccagttcgcttgtcagatgctcccgaaggatcaccatttcatgaacttggtgacattatgcctcatttgaaagtcaagtcaggactaggttcaggtagtaacagggttattcaatcagaaccgtctgatgccattggaaggaacctaaaagtagatgtacataattttgactatgatggatcttctgttagcgatgatcaaccttggtcttcttcccgacctgatacttcctcaagtgttggcattacttcccaattacccaatcaaagttatcactctgaggtcaagttctctgacgatcagtgcttcagtaatattgttgcacatgatgaggatgtcactttgtcaaaattggctggaagcataaatgaaaaacctatgatgaggcccatggatgtcagcgcttcgtatccccattctactggaaaacctgttgcaaatgaagttgcagtgaatgatactcataataatgaggccgataagttgcacccctttgggttattgatgtctgaactcagagatggttctcatttaaggcgtgcacaatcttctaatagttctatgagattgggtgaccagagtcattttctagatccattaattgatagagatgctgcttttgctgatcaaagctctattggtggcatggttaatcagcctcctttcagggagacatgggctgatgaatatgggttaaataggcattttaatggtaatccacatgtaggctccttagaagatcagttcttgtcccatatgggaccaaaatttaataattttgatgtggcagagcaactcatgttgcagaagcttcagaaagaaaggcttcagcagcagagtaatatatccaatcatttccctgctcatcttggtgggtcagatttagagcgatttcctggttttgctcttgctcagaacaagagctccaacattcagcagatgatgcagaatcctggatcagattttgaacgtattctggaacttcagattcaacaacgccagcttgagcttcaacaacagcaagatatgcatcatcaacaactacttcaccaacaaatgaaacttcagccccagcaacagtctcaagttcagcagttgcttcttgaacagtttatgcatcagcagatccctgatcccaattttgggcagtcaaaacatgatatttctagggataacctgttagatcaggttcaaatgaggagatatgtgcatgacttgcagcagaatccacattcttcaaggcaccttgatccatcagtggaacagattatccaagcaaatatgggcctcaatgctgcccaaggaaggcaagctgatttgtcagacctcttgttgcaagcaaggcatggaaatgtattgccttctgaacaacagcttcattttcagcaagatcagctgcaggcacagcaattatctttggctcttagacagcagttagggttggatggagaaaggcattttggtaggtcatggcccatgaatgaaactggacagttggttagaaatccagcaacccacccactgggtcattcagctggatttaatgtttcagatatccataaacagcagcagaggcttgggactcaagaggagcaattaaattatttggggaggaatcttccagagcagaaccagagagggttctatgataatcctatgatgtttgagaggtctgcacctatttcccaaggaagggaattacatgaccgccatcgctatttacatccaggtgatcaaatgagttctttatcctctcatcatctacgatcatctgatgatctttttggtcatcatcctgatgctttcaagagttcactccatggcaacaatggacatgtggaaaatagctggattgatccccgggtgcaaatacagcaacaccttgaagctgtgaggcagagaagagagttaggagatactgttacatcagcagatctaaacttgtctgcatctgctggtgctcacgaagagagttcagcacgaggttttatggacctacttcatcaaaaactgggtgttcaatccacacaaccatcaactgttgataaatggcatccgctttcatcaagaagtgacaaatcttggcatgttcctgaggcaacttcaatgatgcattcttttgagcatccatcagatcagcaagtccatctgaatgacccttttttagaaaggactcaaagtgctaattccaatgccttaatccatgatcatttaaacagcatgcatatcactgaccaatacaacaatctaggaaatactgaaagaatgcctcttcggtctagatctggttcattacttgaagaacaatcactgttatctgctaataaggatactttacatcccaattacagaattccttttcagattggtaaatcatctatggaaaaagacttacttgagttagaagcaaatcagagacatgactatatgggcacgatgaacaatttggttcctgggatgtcagacatgtcagagcaagtggaaagcataacaaattccatggaactgcccgcaattgcccatagtagacatagctcactgagcagtgcaggtggtgatggtggttcatttggtcgtgagatgggtttgaataatccacgtggagatgaggtttctggtgacaggataccttcttctacaaaagggtttgataatgctttccataagcgcccccatgtatctcgggttttatcctcacctgatgtccagtcggaccagccatccataccccatgtcaatcaaaataatctaataaatctcgcttctagtgaaggttctatggtagggagacgagaaatgactggaaattcgtcaatcagtagcatcacagatgctcagacttctgggaaaaaagaggttcggtttagatcttcttccttcagtgaaggtgctgtgtctgagacatcatttatagacatgcttaaaaagcctgttcttcctgaagtggtggcagactctcatgctgccagtggaatcgggaccgagtcattggatgcagcacaagcagggcgaagcgggaaaaagaaag

SEQ ID NO: 107646 - DNA, 1020 bp, Glycine max
  Peptide Sequence Number=SeqID_224424
atggccacaaaaaaggtctcatcggttcatgtagatgaagactacattgacattgaaccaatattttcttcccccaacatcttctcttcttattccctcgacattccacaacagaacaacaacaacaacagagaattcgagttccaaaacaaggaagagtccataacttccccagctgatgaactcttttacaaaggaaaactccttcctcttcacctccctcctcgcttagaaatggtggaaaagcttcttgaaaacgctggttccacctttggcttttcaagatcacagtcatcattggaagacagtagatttaggatgttgcagtcaacacctcttgagtcctgcaacatctctccctcggaatcacgcagggtttgttcctgcgaatcacttccatctgagtatcaatttgaatggtgctctaagatagaagggttggttagtgatcttcatcatcatcatcaccaacaacaacatgttcctaagaaacagaccaagcagaagcagttctggctggctcaggggctcaaggcttcaaaaagttacttgaaatccttgttcagcaaatctggttgctctgataagagctgtgccagtgatgctgcaacgagcaaagtgggggaaagttcgatagaacacaggaggcagagatcctgcgcggtgaagaacagtgacatgctcgaagatggtttccttaacagcagcagcagaaggtctttctctggggtgattcagcgacattatgcttccaaggcttcatctttgtccacctcttcatctgggtcatcttcttcgtcttcgtctttttcactcagttcagctgggtcctatgagttgcaattgttcaataggagtatcagtgcggagctggagaattctattgagagtgccattgctcattgtaaaaagtcccagcaaaagggtggtttaaacaaggtttgttcacaatctgccgtttgtgggaaaaagggaataatggagaagaccctggttagaaaggatgagtttctcatttga

SEQ ID NO: 107647 - DNA, 624 bp, Glycine max
  Peptide Sequence Number=SeqID_224425
atgacctttgctagcggcaatgtgcaaggtgtcaaagccggagcggtttttagaggaaagcgcgtcgtggctggtgtgagggaggagctcctttacgacgtcgaggtggcccttttcagctgcggtgaagagggcggtttctcccagctcattcacctcattaaagatggcggacctgacactggcaacctcggcgtcgaactcgaagctccccatcatgatggagtcgatctcggcgaggatctggcggacggaggccgcgtcgccgcgctgcgcggcgaggtggagctcggtgtcgttatggcggccggtgacttgcttgacatattttttcctcggggtgtcgaggcgtttgctggagttggagaggaggagggatttgttggagttggagaggaggagggccttgccggaggtggagaggaagagggtggggcgaggggtggtgggggtggtgggctcggagagaggggtggtgtgatgagggtgacgatgatgatccatgatcgcccgcaccaacgaccaagatggtgggggtgggggggggtgcctaccccattccacaatcttctcaacaccacaacaccgcaacactgcgtcgttttggtttgctttgcaccataa

SEQ ID NO: 107648 - DNA, 510 bp, Glycine max
  Peptide Sequence Number=SeqID_224426
atggtggaaaagctcattgagaatgccgatgccaccacacctctccaagcttggaccatctctccctcagaatcacgcaagaccaagcgattcaggctggctcaaaggcttaaagcttcaaaaacttacgtaaaaactttgttcaacaaatatggttgctatgataatagttgtgccaatgatgccgcaacaagccataagaagaacgtgaaggatgatgctaggaaaaacaaaaacccatttgagttttttggccacaacaagcatcaaaggcaaagatcttgtgtggttaagaacaatgatgatatgcttgaagatggcttcattaatagcaataaaaggtcatgcgagttgcaattgttaaataagagtaccagggcagagcaagaaaattcaattaatagtgccatctctaattgtaagaagtcacaacaacagggtagttcaaacaaggtttgttcacaatctctagtttgtggaaataaagaaataactgggttgattcactaa

SEQ ID NO: 107649 - DNA, 321 bp, Glycine max
  Peptide Sequence Number=SeqID_224427
atgggcgacggcaaggtcaatctccccgacgatctcttctctggcaagctctccgattccctcagagtgtggcttgctgagaggtggccttttataaggccgtgtttggatggattgggtggtgttcagtttgctgttgttgttaatctgaatctggaattatcatatgaagcatccggaggacatggcggggagaaagggattgtggcactacttgatgattcgaaagatcaattgttgtctgacaacagcataccattatccccacagtggctttattccaaacctgttgatgcaaagacaactgccaacccagtgggg

SEQ ID NO: 107650 - DNA, 1335 bp, Glycine max
  Peptide Sequence Number=SeqID_224428
atggccatggccaaaatgcgaccagcattgtcccttctcctcctcctcctcctcctcctcttcctcctctccccctccgcggcggagataaagtccctgaagataaactccgacacccgccccatgatcctgttcgagaaattcgggttcacccacaagggccacgtgtccatcgccgtctcctcggtctccgtcggcgtgctctcctccgcagtgcaaccagaatcctcgcgcctgggtttcttcctcctgaacgaagaatccctcctccaggtcctgatggagatccagcagaacccttcgttctgcgtcctggactcccactacatcctcctcctcttcaccttccgcgacctctcccctccccccgttgcctccttcaaccgctcctaccccgtcacctcccccaacgaatactccctcttcttcgccaactgcgcccccgaaacctccgtcaccatgtccgtccacaccgaagcctacaatctcgacgctgacggttcacgcgactacctctccgccggccaaaccctcctcccttccctctactttctcttctttttaacctacctctccttcttctccttctggctctacatctgctacaccaacaaactctccgttcaccgcattcacctcttaatgtctctccttcttctcatgaaggctttgaatctaatctgcgccgctgaggataagcattacgtcaaggccaccggcctccctcacggatgggatgttctcttctacatcttccagtttatccgcgtcgttttgctctttactgtcatcgttttgatagggacaggatggtcttttctcaaaccgtttttgcaggacagggagaagaaggtgttgatgattgtcatcccgcttcaggttctcgccaatttggcttccgttgtgatcggggaaacaggtcctttcatcaaagactgggttacttggaatcaggttttcttgcttgtggatattatctgctgctgtgccattattttccctattgtgtggtccataaggtcgttgagggaaacttcgaaaactgatgggaaggcttcgaggaatttggccaagttgactctgtttagacaattctacattgttgtcattggatacttgtatttcaccagaatagtggtgtttgctttgaggaccattgcggcttataagtaccaatgggtgagcaatgctgccgaggagaccgcgagtcttgcgttttatgttgtcatgttctatatgtttagaccattggagaagaatgagtactttgtgcttgatgaggaggaagaggaggctgcggaaatggcgctcaaggatgaagactttgagctttga

SEQ ID NO: 107651 - DNA, 450 bp, Glycine max
  Peptide Sequence Number=SeqID_224429
gtgccgttaaccataaggcaatcccgcgtgtcacctgacttcacgggtaaccctgcatgtcacctgacttcacgggtcaggacgacagaaggtgcaggagacgatgttgtctgcgcggaagacaacgtaaatctgcgcgtgtcaacgggcttgttggccgcgattgacaaagggtgcagaagacgacaggttgtctgcgcggaagacgacgtaaatctccgcgtgtcaacgggcttgttgaccgcgaatgacaaagggtgctgtcgcaacgtgccctctagcgggcgagcgagggcgaggctcacaggtgcgctttccaaaggaggaaagatgcgaggagtcgccaccaacgaaggtattagcacctcttacgtcgacaaaagcgggactcttgctcctacgtaccctccatcaaagaggaaatcagacctacgtagttctttcctaagg

SEQ ID NO: 107652 - DNA, 855 bp, Glycine max
  Peptide Sequence Number=SeqID_224430
atgtctttttccttgttttatgctctcgaactttttcttctttttttttttcacctttgtttacctttttcgacattggcactagaaattccggaaaacccatcaacgaagctgtcaccgacgtctccaaacgcaacagcgtgtttcgtgacaagcagcagcagcaccccttccaattcgactacttgcaccactgtttttgctagtgtgttggcaccgtccccaacaacaccatcaactccacaatcaccatcaaattcaacttcctctttcaccaacctcatctcaaacttggctcgctcgcagaaccccaataccattatgagagaatccacgtccctctccctctccacaccactctatctctccaacaatgaccctcttcattacactgcatcaccccaacctgcactatctgccactgcactactccagaaggcagcgcaaatgggtgcttcaaatgcatcccttcttcgtggcctaggcttagcaacaacaacatcatcatcatcatccttcggtaaagacgagggttttaacattaatgcaaccacaacactacaatggaacggacaagtgaagcaagagaatcatccagtggtggataaccttgggcttgggcttctctgtgggagtggaagtgtgccagatgtgatgatggccccttctaccccatttgtgggccagcccatgacccgtgatcttcttggtctgagcatcggtggcggaggaagcaggggtggtctctctgctttactcacttcttttggaggaaactttgattcacccggtgaaggaggagttcaccgttgcttccaatgctctgctcaaacggataaacaaacgcgcccttaa

SEQ ID NO: 107653 - DNA, 195 bp, Glycine max
  Peptide Sequence Number=SeqID_224431
atggctacaccatcaagctcccctcctcctaagtcagtaccttcatcgtctacgtcgaagaggactagaaaagtcacactactcagatcattggatgccagatccgttgaggtggagagaccagtggctcatgtggatcctatgcctgagaaagttgatgaagtaggaatagtgggggcaagatatgcgggttag

SEQ ID NO: 107654 - DNA, 477 bp, Glycine max
  Peptide Sequence Number=SeqID_224432
atggagcggttttattcttctcaacgagagagcattcttttagggtatagtaatgacaataataattctctaattcaagggtcgaacttggaggttgatttcaccgacgtgtttggggggccgccgcggcggtcgtcggtgaatgaagtgcggcagagtgtgggtgagtttagtgaagaggaaagaggttggtgtaggtggccgccggagcgtgagaaaccggtgtttggggaggatagtggaaaccggagacgtaatcacagcgacttcttcgatgacatattcggaggggaggaatcagcgagcgtgtgttccacgccaaagaagcgcgttggggacgctttcgcgttgtcccgagtatccagccctctgcctcctgcggctgatcccgtttttggctctctccctgcaaccttcaggttttcttctttcccacctaactacttagcattaggttcactttgcttcaatttttaa

SEQ ID NO: 107655 - DNA, 1510 bp, Glycine max
  Peptide Sequence Number=SeqID_224433
ccttcctgccaaattgacaaatggagcggaccttccaacatttggttcccccactaggagtaggaacctcctcaacaacatcaacgatggcattgttgcttcaaatggattaaaaccttaccgacaaagtcttttatcacaggagttttcaaactcgagcacatttgataaaacagacaaaggaagcattatgaaacaagacatatctattagtgaagttttgcctagtgctagtaatggccagttccatttctcaatatacaaatgggcaagtaaaggggtgccaatggtgatgcctcttaggacagagagaaactcaaggaataaagataaggctaaacttgagagatgctcaggtgctaaggaatggatagtcagtgaaattaccacacagaatcctatagaatacaatagaaaacaagattccaatcagattgtagaacaaatagtttctgccaaaactcaattagatacatcaaccagccctcaaactgttagtaaagatgttcctgctagttctatctcacgtgacactagagaagtagaatcaagtattcgttctacaagtgataagaagcttgagcccaaaccattacagtttctgttcaaagaaagtgataagaaacaagataatgatgagatgattacaagggagagagaagaaaacaggatgatgaaaagcacaaaaaagtcgtctgctgtttttgatgttaccgtgaatccaatgaaacaagaagaaaaggcagttcccttgagagatgtaggacgtagcaaagccacttcccagggttcggtaagcttaggcgaaaatttggggaaaggcctagtgaaaggaaaggtcaaagaatttgctcgaattttcaaccaagaagctgtaaataaacccaaagttgactccaaatctcaacctcagggttctacatacaagaagagagatgctttaaggacaaagaatgaagtggaagctggtccagaacaacccaagaaggataactccgtcacagagaccaccaacatctctgctaataatttgtttcatcaagatgatatatcagaaccagaaattcctgatatatcatttaccgttattggagataaagacgagtccttccctgggagtttcatgatacaagtattagcccaagatgagggtgaggtcttacaaacccaaaaaaatcaagaaatccaaacaattgacaacaagataaaacaatggtctaaagggaaggaaggaaacatacgctccctgctatcgacattacaatatgtactttggccggagtgcggatggaagcctgtgcctcttgttgatataattgaagggaacgcagttaaaagatcttatcaaagagctttactctgtctgcatccagacaagttgcaacaaaagggtgcttcttcagaccaaaaatatattgcagaaaaagtttttgatattttacaggatctatgtctagattccataaaattggtcacacgcattccattgcatcatgttcttcaattttga

SEQ ID NO: 107656 - DNA, 1188 bp, Glycine max
  Peptide Sequence Number=SeqID_224434
atgttgtggtggaccagcaaggtaagcctaggtggaggttttatgggtttttatggctttcctgaatgtaggaggaagatagattcttgggatttactccacaacttagcgaaggataattccttattgtggtgcatgataggtcatttcagcgatatgctaactattgaagataaatatagaggacaaaaacaacctcagtggttgattagtggatttagggaagttgtcaaagattgtaaacttgtagatcttcctttggaggggtaccaatatacctggatccagaagagagggacgatggatgttactaaagaaaggttagagaaaccacttgctaatcaagcattgatttattcttttcctcagtgtagattgacaaacataatgatggacagaagtgaattggagaaatatagaggtagaagacatgttgagggtattagaaaatatgttgaagttagagagatcatgggttcatggctagccaaggaggatggtttttggaggcaaagggagaagactcactggtttagagatgagtgtgtcaatcctaggctttctgaagatagcaaccacgagatcactaggcctttcctcattgatgagttcagagaagccctcttcaatatgaactcagataaggcttcatgccctgacaagttcaatcctactttttataagaggttttggagcacaagtggcactggtttacctcctaatctaaatgatactagcattgtccttatcccgaaaaaggaaaacccaaaatctatgaaagacctctatcccattttgttatgcaatgtggtgtacaaagttctagcaaaggaaatccaccatataaagttgaagttgaaggggaaggtaggggaggtaaataggcatggagtgggtttggttgttcctcatagaggattaaaacagggtgatcccttgtcaccctatccatttatcctcgattgtgaagatctcacatctatcattaagaaagccgaggcgaagaggatttgcaagaaattaaaggttgattataaggaaaacatctatatgaagatcttgtctttgtatgaaaaggcatatggtcaagctattagtttggcaaaatcaaaagtcttttttagcaggaacacccctccaaatatcaaagatgaagtcacctctattttgggagtgcttaggtactag

SEQ ID NO: 107657 - DNA, 573 bp, Glycine max
  Peptide Sequence Number=SeqID_224435
atggtacactgccaattacaggtaccaccggatggtgaatttccagtcatgaattaccgtttgacacaggaatttagtcctccttttcgtattaatgctttgattgaagaagcagggtcacttaagtcaccaacacttttgaagttgctattgcaggcagaagtaattcttaaagtaagtgccgagtttccctcaagtgtaacagctaacactatcaaagtgcagatgccactaccaaaatgtacctccagagttagttttgagctggaacctggagctgtaggacaaacaactgattttaaggaagcaaataagaggctagaatggagtttaagaaagatcgtcgggggatcggagcacactctacatgcaaaactaaccttttctcaggaatctcacgttaatataacaaaagaatcaggacctgtgagcatgacatttactataccaatgcataacgtttcacggcttcaggtaaagtatttgcagatagcaaagaaatctgcaacgcatgaaccataccggtgggttagatatgttacacaggcgaattcctacgtcgctcgtatatga

SEQ ID NO: 107658 - DNA, 771 bp, Glycine max
  Peptide Sequence Number=SeqID_224436
atggagtccgaactcaaagacctcaattcgaagccgccgaacggcaacggcaacagcgttcgcgatgaccgtcctctgctgaagccggagcctccggtctccgccgacagcatcgccgatatggagaagaagttcgccgcttacgtccgccgcgacgtgtacggcaccatgggacgcggcgagttgccgaccaaggagaagctcttgctcggtttcgcgttggtcactcttctccccattcgagtcgttctcgccgtcaccatattgctcttttattacttaatttgtagggtttgcactctcttctctgcgcccactggcgaagaggaacaggaagattacgctcacatgagtgggtggaggagaaccattattgtttcgtgtggacgcgccctctccagactcatgcttttcattttcggcttttattggatccccgaatcgaactctgcctctcaggaagacaagagtcggcagcccgaagagttgaggagacctggcgtaataatttctaatcatgtgtcgtacttggatattttgtatcacatgtcttcctcattccctagttttgttgctaagagatcagtggctaaacttccgctagtcggtctcatcagcaagtgccttggttgtgtctatgttcagcgggaatcaaggtcatcagacttcaagggtgtttcaggtggcaccatggtggaatggtgtggccaatttttttgccaaccgccattggcaaattttgaagggagtcctcctatggcggcgccatag

SEQ ID NO: 107659 - DNA, 486 bp, Glycine max
  Peptide Sequence Number=SeqID_224437
atggacatggacgctagggctcggggaccctcaaacactcctgctttttccacttctacctctgctccagcttcgacatcaacacctccaacaccaacacctccaccatcctccggcacctccgctcaaagaatagacgtcctgagtattcacgatctggctcagcatcgtccaatcataagtatggaggatttcatggcccaggtggtctggctaggagtccagccttctcctgtgggggaaggtgaggctcctatagcccaggagccacagccagagccggaggcgacaactgaggagactccagaggtcacgcctactgccacacccatggatgtcgtcgaggacacagattatgcagcagatatggctgcagcgcagagcacctgggatccctggcctactccagctcaggacatacatctgctagctcaggatgctccttccttacctcaggatgaccctacaccagcacaggagggttga

SEQ ID NO: 107660 - DNA, 381 bp, Glycine max
  Peptide Sequence Number=SeqID_224438
gcagtgcacatgttatgcaaggcctccaatcacgcccgttcatcctttaacggtgctgatcacgcatcaccctcaggagattgcgtgagggtgcgacgcggtgtagagagtggcggtggtgtcgccgtggcggaagtgagaatgacttcggacggagcaacgtcggcggcgactaaccggaggaagccgtcttggagggagagggagaacaaccggaggagagagagaagaaggagagccatttcggcgaagatatactccggtcttagggcgcaagggaactacaatttgcccaaacactgcgacaacaacgaagtcttgaaggctctctgcgctgaagctggttgggccgtcgaagaagacggcaccacctatcgcaag

SEQ ID NO: 107661 - DNA, 252 bp, Glycine max
  Peptide Sequence Number=SeqID_224439
atgaaggaagctccgcagtttgcagagctagagtggcttacagatgtgggtattttcggtgaacaatttgctcaggaagccttggctgcagctgaagtacctcaacttctagttactcataacaatagtagtgttgcttcaaacagaacctccaaatcctacatttcccacaaaaagcctaggattgaagtcctaaatgaccaagatgatgatgatgagtttagtatttttattgtgcctgatcttggctga

SEQ ID NO: 107662 - DNA, 492 bp, Glycine max
  Peptide Sequence Number=SeqID_224440
atggcatctgcaaagtttgacgttgagaaatttactagtaaaaataattgcaatctatggcgggtgaaaatgctcgctctcctcacacaacaagcatatgagttggcgttggaaggagaagtgatgaagttttgggagaagtctctggagaaaagactgtcgacatgctttgggcaaagcttgaaagttggtgaagatctaatggtaagaggaagaatggaggaaaggaagaagatttccaaagaagaggttgaaggtggcaaagttctggtggggaacgatggtgcttgtagcatagttggtaaaggtacaatgcaaattaagatggttgatggtactgtgagaacattaactgacgtgagagttcctaaaggtgacttaacaattatgaagggaaagttgaataatgaactatatatcttgcaagtggatgtggaatggatgagcttagcaagagaggcttacttgatagacaatggactagaaagctag

SEQ ID NO: 107663 - DNA, 258 bp, Glycine max
  Peptide Sequence Number=SeqID_224441
atggagaacgatggtgtagaaagattaggacatggcgtagagatgagaacaaaagaagaagaagaacataaaactattgaagacaaaaaaggaagtgactggatgaggattgagagcaggtggggatgcgaagataaggaattggatgttgcatatcagttaactgtaagaacaataaaaacaacacggattagtggggttaatttgtcaaacatgtgtgtggctgtggaggcatcaacaagtacaaaccatgtttaa

SEQ ID NO: 107664 - DNA, 2410 bp, Glycine max
  Peptide Sequence Number=SeqID_224442
gagtttggaatcatttggaatctcaaagatgatatacaacggatgaagaggacagtgtctgcaataaaagctgtatgccaggatgcaggggcaaaggctaacaaccttcaagttagtaattggttggaggagctgaaagatgtactctatgatgcagatgacttgctagaggatatctctattaaagttttggaaagaaaagcgatgggtggtaacagcctcttaagagaggttaagattttcttctcccactcaaataaaattgtctatggttttaaattgggacatgaaatgaaagaaatccggaagaggctagaggatattgctaaaaacaagactacattgcaattgactgactgcccaagggagactccaattggatgtacggagcagagacaaacttactcttttgtgcgtaaagatgaagtcattgggagagaggaggaaaagaaacttcttaccagttatttactacaccccgatgcaagtgtggcagacaatgtttgtgtagttcccatagttgggattggaggactaggtaagactacccttgctcaacttgtttataatgataatgctgtccaacgctattttgaggaaaaactgtgggtgtgtgtctcggatgaatttgacataaagaaaatagctcaaaagatgattggggatgacaagaatagtgagattgagcaagtacaacaggatctcagaaacaaaattcaggggaggaagtatctacttgtgctggatgatgtgtggaatgaggatcgtgagctgtggcttaaactgaagagcttagtcatggaaggaggtaaagggagcatcataatagtaacaacacgtagtaggaccgtggcaaaaataatggccacacatcctcccattttcttaaaaggtctggatttagaaagatctttgaagcttttctctcatgtggcttttgatggggggaaagaaccaaatgatagggagttgttagccattggaagggatattgttaaaaaatgtgctggggttccccttgccataagaactattggcagcctcttgtattctcgaaacttgggccggagtgattggctatattttaaggaagttgagttttcacagatagatctgcagaaggataagatctttgcaatcctaaaactgagttatgaccatcttccttcatttttgaaacaatgttttgcttactgttcattatttcccaaaggttttgagtttgacaagaaaacactcattcaattatggttagctgaggggttcattcgaccatcaaatgacaatagatgtgaagaagatgttggacatgagtacttcatgaatttgttgttaatgtcacttttccaagaggtgactacagatgattatggtgacataagtacttgcaaaatgcatgacctgatacatgatctagcacaactagtggttggaaaagaatatgccatttttgaggggaaaaaagagaacctcggaaacagaacacgttatttatcatctcgtacttcgttacattttgcaaagacatcatcttcctacaagttaaggacagttattgtgcttcaacagccactttatggaagcaaaaatttggacccgttacatgttcattttccttttcttttgagcctgaagtgcttacgggtgttaacaatttgtgggtcggatattataaaaattccaaagagcattagagagttgaagcatttgagatatcttgatctttcaaggaatcattttctagtaaatcttcccccagatgttactagcctacataatttgcaaactctgaaactttctcgatgtttaaaactcaaagaattaccctcagatatcaacaaaagtcttaggcatctcgaattgaatgaatgtgaggaattgacatgtatgccctgtgggttgggacagttgacccatcttcaaacattgacacattttttattgggccataaaaatgaaaacggtgatataagtgaattgagtgggctaaacagccttaaagggaaattagtaattaaatggttggattccctgcgagataatgctgaagaggttgagtctgcaaaggtacttctcgagaagaaacatcttcaagaattggaattatggtggtggcatgatgagaatgtggaaccgccactacagtgggaggatcctattgcagaagggaggatcctattccagaagaactgggtagggaatctctcgtcactcttgagtcttgaaatcagcaattgctctgactggccgaaaatagctcatatcccaaaagttatggtgtctgcgtatacgccatctgctctcaaagagcttaaaaattcacccccatcatttgacttgcttgcacttattcagcctcattcagtgtccattcttctcttgcctcaagcttcacttccgtattctgcaa

SEQ ID NO: 107665 - DNA, 111 bp, Glycine max
  Peptide Sequence Number=SeqID_224443
atggtgtggacttgtggagtgaaacggtggcgttttgcctggagtggacccacgagttccaaggcaagcgcattcgcgtcgatgacatgtgacgtgctacactttgagtaa

SEQ ID NO: 107666 - DNA, 216 bp, Glycine max
  Peptide Sequence Number=SeqID_224444
atggctttggtagaggagatcaaggctaggtatgaaaaaacagctgtcaaagttgttgacctgaaagtcttccaaactagtgactcgtggaattattctatagaaactccaaaaggtgcacccagcattattgctgatgcaccctgcattttaagtgaatgggcaaaaatgtccttcactcaagttgatccgtatgactcatatggatcaacttga

SEQ ID NO: 107667 - DNA, 327 bp, Glycine max
  Peptide Sequence Number=SeqID_224445
atgatgtggttgtacttatatgaaactgctgacaatgtgggtgtttttgctgaaaacgatgatgaagctgttgaagaagctggaaagttgctgggtcaggatttggatttggtgttttcccttctcactgataatgaggatggtactcctcttggaggttctctgcctcctccttttcttggcccttgcacactgggctttgttttggcacattatgcagatctcttgaaccctccacgcaaggctgctttagtggctctggctgcacatacttcagaaccaagtgaagcagatagattaacgttcctttcatctcctcaggggaag

SEQ ID NO: 107668 - DNA, 267 bp, Glycine max
  Peptide Sequence Number=SeqID_224446
atgaaaaagacaagtaatgttttcttcagtgaggatgaagctgctgttctattgcaaaggtacaacgcacaaacaattttgacgttgcttcaggaattggccaattatccagactcgaagttcgactgggatgatttggtggccaaaacctcaactggaatttccaatgccagagagtatcagatgctgtggcgtcatctagcgtatggtcactcctttgatgaaaattcggacctcgataatcaacctctgattagtagaatttaa

SEQ ID NO: 107669 - DNA, 327 bp, Glycine max
  Peptide Sequence Number=SeqID_224447
atggaaagattggtcctcaaagaggatggcgttcaacttggtcctgcattactcttctttggatgtaggaatcgacaaatggattttatttatgaggatgagctaaagaattttgtggaacaaggtgctttgtcagagttgatagtcgcattctcgagagagggacctgaaaaggagtatgttcaacacaagatgatggataaaggcatggccagagatgttcatcggactcttcttaccattgtccagcagcagagagagagagagaaggaatcaaggtactccaagagtaactttaaaagaattaccctccatcctcaccattga

SEQ ID NO: 107670 - DNA, 3183 bp, Glycine max
  Peptide Sequence Number=SeqID_224448
atggggaagggaggccaagattatgggaaacgagagaacacgagtaccgcgccttcggaccgtgaaatcttcaaggcgtgggcgaaggacgtgcgggagtgcgaggagcaattcaaggtgaatgtgaaggttggtttgaatcccgacgaggtcgagaatcgccgcaagatccatggattgaacgagttggagaagcacgacgggcaatccatatggagtttggttctggagcagttcaatgacacgctggttcggattctcctcgtcgccgccatcatatcctttgtcctcgcgtggtacgacggcgacgagggcggcgagatggagataacggcgttcgtggagcctctggtgattttcctgatactaatcgtgaacgcaattgttggcgtgtggcaggaaagcaatgcggagaaggcgcttgatgcacttaaagagattcaatcggagcacgctgtggtgattcgagaaggcgcgaaaatccctaatttgccggcgaaggaacttgttcccggcgacatcgtggagcttaaggttggggataaggtgcctgcggatatgcgtgttgtggaattaatcagttccactttgcgattggagcagggttctttgactggagagagtgaagctgtgaataagactaacaagcgtgtggatgaggatgctgatattcaggggaagaggtgtatggttttcgcagggaccactgttgttaatgggaatagcatatgcttggtcactcagactggcatggataccgaaatcgggaaggtgcatatgcagatacacgtagcctcgcagagcgaggaggataccccattgaagaagaaactcaatgagtttggagagaagctgaccttgataattggactgatatgtattttggtttggctcatcaatgttaagtacttcctttcttgggagtatgtggatggatggcccaggaacttcaagttttcgttcgagaagtgtacctattactttgagattgctgtggcgctggctgtggccgccattccggaaggtttgcctgcagtcatcacgacttgccttgctcttggtacccgtaagatggcccagaagaatgccctcgtccggaagctgccgagcgtggagactctgggttgtaccactgttatttgttcggataaaactggaacattgactactaaccagatggctgtggcaaaattagttgcagttggccataatgtggacacactaagggccttcaaggtggaaggaactacatacaatccagccgatggtcaaatagagaactggccaactggtggattggatgctaatcttcagatgatagcgaaaatagctgcggtctgtaacgatgctggagtggcgcagtcagagcataagtttgttgctcatggaatgcctactgaagcagccttgaaggttttggtagaaaagatgggacttcctgaaggatccaaggttgcaccgtcagcaagcacacgtaccttgctgcgttgttgtgaatggtggagtgagcatgaccgtcgacttgctactcttgagtttgaccgtgataggaagtcaatgggtgttattgtggactctggtctaggcaaaaggtcgcttctagttaagggtgctgtggaaaatgtattggacagaagctctaaaattcagttgcgcgatggttctatagtgaatctagatgataatgctaggaaccttgtattgcaagctcttcatgaaatgtcaactagcgcactgcgctgtttgggatttgcatacaaggatgaactccccaaatttgaaaactacagtggtaatgatgatcatccagctcaccagcttatgcttaacccttccaactattcatcaattgaaagtgaacttatttttgttggcttggttggattgagggatcctcctagggaggaagtataccaagcaattgaagactgcagagatgctggaattcgtgttatggttattactggagacaacaagaacaccgctgaagctatatgccgtgaaataggtgtattttctccagatgaagacattagttctaaaagtttaacaggtagagattttatggaactgcatgataaaaaggcatatctgagacagcatggcgggcttttgttttcaagggctgaacctaggcacaagcaagaaattgtgaggctgctcaaagaggaaggggaagtggtggccatgactggggatggtgttaatgatgctcctgccttgaagcttgcagacattggtattgcaatgggcattgcagggacagaggtggcaaaggaagcttcagatatggtgttggcagatgataattttagttcaattgttgctgctgttggtgagggtagatctatctacaataatatgaaggcttttatcaggtatatgatctcttccaatattggcgaggtcgcttctatatttttaacagctgcattaggtattcctgaaggattgatacctgtccagcttctgtgggtcaatcttgtcactgatgggccccctgcaacagctttgggatttaatcctccagataaggatataatgaaaaagcctcctcgtcacagtgatgactcattaattaatttgtggattttattccgctatctggttattgggatttatgttggattagctacagttggtatcttcatcatatggtatacacatggttccttctttggtattgaccttagtggggatggacatactcttgtgacttacacccaacttgccaactggggtcaatgctcctcatggcagaacttcactgcttctccattcactgctggtgctaaaacaatcacgtttgacaacagctgtgattacttttcgactggtaaagtgaaagctatgacactgtctctttctgtgttggtagccattgaaatgttcaactctctcaatgccctgtctgaggatggaagccttttgacaatgcccccttgggtcaacccttggcttcttttggcaatgtcagtgtcatttggtctgcactttttgatcttgtacgtgccattcttagcacaagtatttggtattgtgcccctgagcttcaacgagtggcttttggttttggttgttgcacttccggtcattctaattgacgagattctgaaatttgtggggaggtgtacaagttctcgagcatcaagtgcaagaaaatcaaagcaaaaatcagagtag

SEQ ID NO: 107671 - DNA, 1008 bp, Glycine max
  Peptide Sequence Number=SeqID_224449
atggtggtctttggcgatgacgacgggtactgctcacccgtgaaaaagcagaaaggttgctggaaagagacgaagcacgatagttcggtcgctggattgtggatcagccaaacaacgacaaaacagaggcaaataacagccaaatgggcccaaacaaaggccaaacaggttcgtcaaaggagaaggaggatggtgaggaggtcatcggagaaagggttgtgcaaaaacaatgccacgtgccagaaaggggatcgcgggaatgctgtggcgaaaaggggaaaaattgttggaaagagggacgttagcagagaggtccactggaatgcagaaacagtcaccgcaagacgtagacaagcagaaaaccattggggaccaagtggaaacaggtcgtcggaaggcgaacaaagcagagaggttccagttgttgatggctattctttccctcatctaactaaacgaatgaatgttgctggtcgacatataacctcctatcttgttgatttgctttcaaggaggggttatgactacaagagggaatatcagttggggcttgagaccactatccttgttaagaattatactcttccagatggaagggtcattaaagtaggcactgaaaggttccaggctcccgaggctcttttcactccggtaggagttgagaatcctgcatacgaggcgtgggaacagcaagaccaggttcttcttgcctggttgcaatcgactctgtccacgtcgttcctatctcggatcattggatgcgtccattcctatgaggtttgggaatggatccatgattatttccacaaacagatgcaagccagagcaaggcaacttcgaactgagttgcttgcaatgatccttgaagataagtccatgtgcgagtttctgctcaggatcaaagcaatttccgatgcacttgtgttacgaaccagaaacagagaactaaatgtaacagtgaaaaaaaaagaagatcacagggctttattgattgtaataaaaagatga

SEQ ID NO: 107672 - DNA, 255 bp, Glycine max
  Peptide Sequence Number=SeqID_224450
atggcttctgccggagtgccgtacaaatgcggcaaggggtcggtgaagtatttccgtaaacttttcggaacaagcttttccggaaagtttccggaaaaagacttcttccggaaaaagaatttgggaattccggaagtagtcacaaacttcgtccggaagatcgtcatccggaagtttccggaagaaggttcttccggaaacttccggaagaaggttcttccggaaacttccggaagaaccttcttccggaactga

SEQ ID NO: 107673 - DNA, 785 bp, Glycine max
  Peptide Sequence Number=SeqID_224451
gctctgagacaattgaaaaccaactgctaaaggcacaagaaaggatgaagaaccaagcagacaagaagaggctggacaagagctttgctgtgggggagtgggtgtttgttaagctcagagcgcataggcagaaatcagtggtgacaaggattaatgccaaattgtcagcaaggtattatgggccttaccctattttagaaaggattggtgctgttgcctataagttgaagctacctgtagggtccagagtacacccggtgttccatgtgtctctacttaagaaggcagtgggaaattatcaggaagaggaggaattacctgaactgctggaggaagatcagatggaagagtatgaacctgcagctgttttggccactaggaaagtacgacaacagggagaggagagcaagcaagtactgattcaatggaagggaaaaactgctgaagaagccacatgggaagaagcaatcatgatgaaaagtcagttccctaaattcaatcttgaggacaagattgcagctgaagaggggagtattgataggtcccaggcagcattgccacgtgagcagctgattcataatgagacaaataagcctaggatatggcagtgcatcggaaattgctttgatcctgagcagaaactcgcacatggacttatcttcaaggatcattgcaagcaactcagttcgaagttgccttgctctggcttgcatctgtttgtggaaataatcatggatccattcccaaacctcataggaatggacgcatccaatgatccgagatag

SEQ ID NO: 107674 - DNA, 414 bp, Glycine max
  Peptide Sequence Number=SeqID_224452
atgagagaacccgcccacaacgctaccgtcgctcgtcctacgtgtcgtgcacgcaatcatttcctccttcctgccttttctctccctagcattcgcggccacacgttctgggcccgggttcttcatcagcagggacaggatccctccgtactggatatggttccactacctttcgctggtgaagtatccgtacgagggagtgctgcagaacgagttcgatgtgaggtctccgaggtgcttcgtaagagggattcagatgttcgacaacacgccgctggggatggtgccggaggcgttgaaggtggagctgctgaagagtatgagcgagacgctgggaatgaacatctcgaggtcgacgtgcgtagttactggagaggatgtgctgaagcagcaggggattacgcagctgagtaa

SEQ ID NO: 107675 - DNA, 1506 bp, Glycine max
  Peptide Sequence Number=SeqID_224453
atgccttttgggctcatgaatgctccttcaactttccaaagcctcatgaatgatgtttttcgtccgttactgagaaagtgtgtgctggtgttttttgatgacatactaatttatagtagaggatgggaggctcacgcgaagcatttgaaggaggtgttgcagttgctggctcaacacagcctagtagctaacaaaaagaaatgctatttcgctcagaaaacggtggagtatttgggtcatatgataactgaagagggagtggctgtagatccaaacaaggtgaagagtgtgatggcatggcctactcctaagaatgtaaagggagtgagaggatttttggggctcactggttattacagaaagttcataagggattatgggaagatagctaaacccctaactgaattaaccaagaaagataatttcaagtggggagcggaagcgcagaaggcatttgatgagttgaaggagagattgactacatctccagttctgtctttaccagacttttcaaaagggtttgtgattgagtgtgatgcctctggtggtggtataggagcaattttaatgcaagacaagaagcccgttgcatactttagtaaggcgttgggagcgaggaatttgacgaaatctgcttatgagaaagaattgatggcagtagtgttagcaatacagcactggagaccttatcttttagggaggaagtttatagtttccactgatcaaaaaagtctgaaacaactgatgcagcagagaattgtgacagcagagcaacagaattgggcagccaagttgttgggctacgattttgagattgtgtataaacaaggaaaattgaataaaggagctgatgcgttgtccaggatgcatgaagggacagaattgaatcaaatcacatcttgtgcacaatgggatcaggagcagcaagttaaggaggaaattaaccaagatcccaagttacaggacatcattaggcagttgcagcaagattctggagccaaaccaggatatgagtataagcagggagttttattttatgatggcagattggtcatatctagcaaatcacagctcatccctactcttttgagagagttccatgctaccccacaaggaggccattctggattttacaagacttacaggagaattgctgctaatgtgtattggattgggatgaagggagctgtacaggaatatgtcaggagctgtgatgtatgtcaaaggcaaaaatatttagctacatctccaggagggctattacagcctttaccggtgcctgaacaggtatgggaggacatctccatggactttatctctggattacccaagtctaaggggtttgaggccatattggtggtggtggacaggctgtccaaatactcacacttcgtccctctcaaacacccttatacagccagaagtatagctgagattttctgcaaagaggtggtgaagttgcatgggataccactttccattgtcagtgggatcccctgttcatga

SEQ ID NO: 107676 - DNA, 360 bp, Glycine max
  Peptide Sequence Number=SeqID_224454
atgcctcgctatgatgataaatacggcaatacccgcctctatgtggggcacttatcttcgaggactcgttcccgggatctggagcgtgccttcagcagatatggaaggtttctggggttttggctaaacctggagaggtctgtggtgggaggtttgccatggtggaattggtggaaattcctgtcgagtgttgactttggcgattctttctgtaatgttattgcttgtttttatggaaatggcatcaatcacaaactggattttagtgatcctcgagatgctgatgatgcaagatataacttggatggtcgggatgttgatggaagtcgtattattgtggaatttgcaaaaggggtatga

SEQ ID NO: 107677 - DNA, 507 bp, Glycine max
  Peptide Sequence Number=SeqID_224455
atggagtctctgagctctaaactgacgatgctaatctgtctgattcaagcacaaggcgaggacggagttattcacggtcaccagtcaggtcacattcacctcgtcgtggcagaagccgtgatcgcagttacagccgagatcgcagctacagttttgggtgccttcggccttgctagtcgatcacgatcccctgtcagaagagaagaaagccccgttcgtgaagataggtcacaaagccctcaacacaaaaatagtcctcagccctccaagacaaggaagcatagtccatcacctgaccgtagcccacagagaagaggtgacacatctcctgacaatgataggttgagcagaagccctgcaagggaccgcgaagataggggctatgacagccctaaagttaatggtcgtagtggcagccctagccgtagccccagggatgatgacaggagccccattgatgatgaagacaaccaccgccactcaccaagaggcagcgagtcaccttaa

SEQ ID NO: 107678 - DNA, 486 bp, Glycine max
  Peptide Sequence Number=SeqID_224456
atgtcacttgtacagtatttagtgaaaagggactattgcaatatgcaattccctgagcctttaactaatttctcaggtaaaaagtgcaagagatgtggaatctatgaggaagacattttttcagatgatgtgtttgatgagtgggaattgtgtccttctgattttaccacccctgatggaagatacgcccacttcaaggaaaaagaattcaatgctagttttctgtgtccagagtgcttatctttttctggtgtttctgtctctgcaccacctgccgagaatgacaatcccaataaaaaaggaatgaatgtagcagttatcattttgctaagtattttgggctcaaccatattgattctgggaatgttgggtacatacaagtattggcaaaagaggaagagggagcaggatcaggctcggtttttgaagctctttgaagaaggagatgatattgaggatgagctcggccttggcactataatatga

SEQ ID NO: 107679 - DNA, 774 bp, Glycine max
  Peptide Sequence Number=SeqID_224457
atggagttcctgaagggtatggtgaagccagtggctgccactgcagtggtgtgtttggctgtggccttgtccttctaccagaagctggggctggagctagagatggttgttgccattgtgagggcatttattcaactttctatcattggctttgtgttggagttcattttccgccaggacaacgctggatggatcctcctagcataccttttcatggtatcaatagcgggttacactgcgggtcagcgtgcgaaacatgttcctcgtgggaagtatgtggcaggggcctccattctcacaggaactgcagtgaccatgttggtgctggtagctttgagcgtgttccctttcactcctagatatatcatacctgtggctggcatgatggttgggaactcaatgacagttaccggtgttaccatgaaaagactcagagacgacatcaaaactcaaatgaacttggttgagacagcattgtctcttggtgcaaccccacgacaagcaacgcatgaacaagtgaaaagggctctgatattggccctttctccggtggtggacaacaccaaaacagtgggtctaatatcccttcctggggcaatgactggtctcattatgggtggggcatcgccgttggaagcaattcaactacagattgtggtgatgaatatgatgattggtgcagcaactgttagcagcataatggctacatacctctgttggccagcattcttcaccaaggcctaccaattggaaaccaaagtcttctcaagttga

SEQ ID NO: 107680 - DNA, 957 bp, Glycine max
  Peptide Sequence Number=SeqID_224458
atgcaaagagtgttgaatgggaagaaccaattcagatttgtcgatggaagtattgacgtttcattggagttaggcaatctcattcacatatctgaaattcagcaacagataaatggattgaagcaaggctcaatgtcagtgactaaaattttcactgagttgaaggttctacagaaggaacttgagagccaaagaccggttccaacttgtagttctctggatctaagttcatgtgtatccatgagaaatgcacacatgttccaacttcaagatcaagtcatccagttcttaacaggattcagtgaccaattctctgttttaaaatcgcgagtcattggtggatccatttccaccactccgtggtgttgcaacaagaaaggcaaggaaatcttgctaatcttgatgattcaaaggttctggtcagtgcagttgagactccttgatactcgaaagccacaaggccaaggaagacgagcaaatagcaacaattatattggaagaaattcgaactggggttgtatatactgtaggaaaactggacacaccagtgaaacatgctatagaaagcatggtttcccaccaaattatgggaaaggtgttcaacttgtagcaaatgctacacaacaactgcagaaaactgagtcaaaggatgaagttatgccaagattgcattgtcacactcctgctgggacacttgtaacattagagaatgtccttaataagcaattcagttttgttgtcccctttgcacagaaaatagacagttggagtggctttaagcaactcgtgggttgtgaagatctcaatcgagctcagcgtcatgtccgcagatataatcaatcctgtgctaccaacatggaaaattggaaaataacctgggaaataggtgaagaagaatatgaaggtgaaaagaaggagaagagaattgcgcgacatggacatggcaacacaggttga

SEQ ID NO: 107681 - DNA, 963 bp, Glycine max
  Peptide Sequence Number=SeqID_224459
atgcctcgctatgatgataaatatggtaatacccgcctctatgttggacggttgtcttcgaggactcgttcccgtgacctggagcgtgtcttcagcagatatggaaggtttctgaggttttctctaaacctggaggtctttgttgggaggttggccttggtggaatttgtggaaattcctgtcgataatgatggccttattgtttctggaaaccatttccgcagagttcgaggcgtagatatgaagaatgatttcgcctttgttgaatttagtgatcctcgagatgctgatgatgctagatacaacctggatggtcgtgatgttgaaggaagtcgtattattgtggaatttgccaaggggggtcctcgtggttcccgggaccgggaatatatgggtcggggtccacctcctggatctgggcgatgctttaactgtggcattgatggtcattgggcccgagattgcaaagccggggattggaagaacaagtgttaccgttgtggggaaagaggtcacgttctcctcgtcgtggaagaagcagggatcgaagctacagccgagaccacagctacagttttggttaccttggttcttgccagccgatcgagatctcctgtcagaagagaacgaagcccagtttctgaagatagatcacagagtcgtgagccctccaagataaggaagcatagtgcatcacctgaccaaagcagcccacggaagagaggtgacacatctcctggcaatgataggttggccactcatcaagatgggtctgactacagtgatggtcctagagggaaaagtagaagccctgctagccctgcaagggaccgtgatgagggtggctatgatagccctaaagctaatggacatagccgcagccccagccggagccctagggatgatgacaggagccccattgatgaagatgatgacaaccaccgtcgctcacagtcaccttga

SEQ ID NO: 107682 - DNA, 672 bp, Glycine max
  Peptide Sequence Number=SeqID_224460
atgaaggtgggagcttatgagggagaaagaatgaaggtttatggtgtggtgtgttgggatcattatgagggatggaggggtctagaaaaagaggagatatcaaaatcattttctatatggtggagggatttgtgtaaaacttgtggtggattaaatgagtccaaatggtttgatgatatggttgtgaggaaagtgggaaaaggagacaaaactcagttttggaaggatatttgggtgggaaatcaatcgttggcaagtgagtacccaagattgttcttaaattctcttcaaaaggacgagtatggagccaattcaatatggggtagtgagatgagggagtctggaggtggaattgtgcttggcggagagagtggtttgtgggagggtgacatggttgagaacagttatgggggtgggggggtcgtgttggttgagggagcggaggattcttggttgtggccacatgaacaatctgggttaagtcttcatataaggctttgtgcgaaaggatcgaggattcaaatattaatgcacactttagttgatatgtggaaagtgaaacttgctcctaaggaaacaaaattctggtattgccggaattcaaccacgtgcaaaaggagtaacaggggatgtcgggtggtgaagttagagaaattaaaggtgcaacagtag

SEQ ID NO: 107683 - DNA, 384 bp, Glycine max
  Peptide Sequence Number=SeqID_224461
atgaacgaacacctcagaacttttgcacttcaactcagctactcaacaacgacgccaaaatcctcttccacaccgcacactgcttcttccgttctctcaagttgtcgtaagtggtgggtgagtgaagcacgagtaattggagagttcgattcaatgagcgccaattgttttggtgaagatctccgttggtggcaagatgacttcaagttgggactgacggtggagcacaacagtggctttggcagagcagatggtggtggtgctcctgcagagactatgatgccgaagtcacaagatagaggaaaaacggatattctgttatcaagcatgtggcaagtcggtcattcttacatgtggtggcgtggcaacgagataagtggatga

SEQ ID NO: 107684 - DNA, 624 bp, Glycine max
  Peptide Sequence Number=SeqID_224462
atggcaacttgctgtggcctaaggtccgataataagccaataacagctgccactattaagcagaaccacgcatggagtggcaagaacatggaaggacataatggtttggatactctagagtgcctcagagggagattactagcagagagacatgcttcaagggtggcaaaagaagaagcagaatcattgggcaacaagtttgttgagctggaaaagaagcttaaagaagagataaaactaagagacaaagcagaaagaaagcttaagcttttgaagaagaagcttgagtgtttcaataatgtgaccaccccatcatggcaaaaatctccttcgtctgagatatgtgaagattcttgcggatcatccttatgtagtgctgtttctagagattcagaagcaaatgaaacgaagctagttcatacagtgaatccagctttgttagaaaatgaagtccacaaccactatgtagcagaagaatgtgtactcgttcagacccataatagtccattgactaccaaagattgtaattcagaccaaagtaacttcctccctcaaattttgggcaataatccaaatcaaagctcagataatttgaagaatgatggaaacaggtgtccaagatga

SEQ ID NO: 107685 - DNA, 482 bp, Glycine max
  Peptide Sequence Number=SeqID_224463
agactaacatcgtcatctgcaccctttgtcaaccaggggcaagcgagcccgttgacacacagagactaatgtcgtcttttgcacctttgtcatccagagacggcgagtccaatgacatgcagagatacccaagtgtttttccgtacaaaacgatttctgttaatcctgacccgagaagtcaagtggcagagactaacgtcatcatctgcaccctttgtcaaccaggggcaagcgagcccattgacacgcagagactaacgtcgtcttctacacctttgtcatccagagacggtggcaggcggagatacccaagtggttatccatacaaaatgatttctgttaatcctgacctgagaagtcagactaacatcgtcatctacaccctttgtcaaccaggggcaagcaagcctgttgacaagccgagactaatgtcatcttctgcacctttgtcatccagaggcagtgagtctgatgacaagtga

SEQ ID NO: 107686 - DNA, 150 bp, Glycine max
  Peptide Sequence Number=SeqID_224464
atgatggagacctggatggcccaagatctagacagcattggcatcatcaccgaagacagagatctaggtggtagagatgagaatggtgaagaagttaggctccatggtgaccgaaaaggtgaaatgatgctaaaggctactagacgttag

SEQ ID NO: 107687 - DNA, 228 bp, Glycine max
  Peptide Sequence Number=SeqID_224465
atggcgataaaccctagagaagagagaagaaaagacaatgagagtggcagtgacggagaggaagagagcgttgctttgctccgtgattgtgatttgattggtagagagagaacgtgcaaaaagaaggaaaaatgttgtctgtcataccctaatttcgtccggggacctttgcttgatgacatgcgacctttctttggtccttgtgaggtgcttggcacccatcattag

SEQ ID NO: 107688 - DNA, 477 bp, Glycine max
  Peptide Sequence Number=SeqID_224466
atggaaaattccgatgcgcggtgtgttcgagttgccgtcaatgttcggcctctgattacgttggagcttatgcttggatgcaccaattgcatctttgtgcttcccggtgaacctctggttgtgcagatcactaaaggaagcaaggttaagtatgaacttgacaaaaagactggattgattaaggttgatcgggttttgtattcatcatttgtttatccatataactatggttttatccctcgcacactgtgtgaagacaatgatccaattgatgttttggttctcatgcaggagccagttcttcctggatgtttcctgcgagccagggccattgtactgatgcccatgattgacgggggagagaaagatgataaaatcattgcagtgtgtgctgatgacctagaatataagcactttaccaactataaagaacttgtacctcacgcatctccgagatccgacatttctttgaagatt

SEQ ID NO: 107689 - DNA, 204 bp, Glycine max
  Peptide Sequence Number=SeqID_224467
atggaaagttcggtcaatggtggcttctcccatttgcagagctgtggagatagtagcgaagaagagttatcggtgcttcctcgtcacaccaaagttgtcgtaaccggaaataaccgcaccaaatcggtgctcgttggtcttcaaggtgtcgttaagaaagccgttggactaggcggatggcattggctgggggaacaattctga

SEQ ID NO: 107690 - DNA, 294 bp, Glycine max
  Peptide Sequence Number=SeqID_224468
atgaatgtcgatatggaggcattgaaggatcaaacggcttccatgatggaagccatgttaagcatgaagagaatgatggacccagggctttcttctaatgctcttttaaaaatgaaatgcgaatgtcccaaatctcattttgtggttatgagaaattctatcagcatgccttcattctctaagacaatcatggtcatctgtcacttttcgaagacttcaatgtctttcgaccaagactattacagtctttttttccttccagagacaatcaagtccgttgacatgcggagataa

SEQ ID NO: 107691 - DNA, 234 bp, Glycine max
  Peptide Sequence Number=SeqID_224469
atgaccgaaactcacttaaggtggtttggtcttatgagaagaaagtcaacagaggctccaatgagaaaaatggatcaaatggaagatggcagcattgtgctctgcaagaatcataaagaaagttccagactcggcagaaaattttgtcaatcctgctactgccttactaagggagaagcaccatggagttatgattactggggttcagctttgtacagagctgtgcaaaattag

SEQ ID NO: 107692 - DNA, 216 bp, Glycine max
  Peptide Sequence Number=SeqID_224470
atgattcaggccatacgtgcttgcaaaactgcagcagaagaacgtgctgttgtaagaaaagaatgtgctaccattcacgctgcaatagatgaaaatgatccagactataggcactggaatctggctaagctaatgttcatccacatgcttggctaccccactcattttggtcaaatggagtgcctcaagttgatagcatctcctggatttccatag

SEQ ID NO: 107693 - DNA, 600 bp, Glycine max
  Peptide Sequence Number=SeqID_224471
atgggacctgttgggtactataatgcccatacctgcacctattcccatttttattttgcggctaaatccttggctccagactcatctctgttgagcggttgtttactctacctgtggtggattttttcttttttaattttgtgggttcttacaaatggtattgaagttaagctacaaaggaatgctcttagcgtgattgaagcacccaccggtaatgaggaagacgatgaccttgagtttgaaaatatgccgtggaatggatcagatatggcatcggacgacacacacaagttccacaagtcgaggcatagaatgcatagaacattgggatcatctcacaaaaccacgagtaggtccttctctgccgattcacagtcaaaggggtccgtttctatgccgcttcatggctccacgaaggtggacttgagcaaacttgaaatggctgcactgtggagatattggcgacattttaatctagtggatgcgttcccaaacccatcaaaagagcagctagtagacgttgttcagaggcatttcatgtcgcaggtgattgtgggatttgtccaagctgcaaagaggcttaagacagtgtggaaatga

SEQ ID NO: 107694 - DNA, 216 bp, Glycine max
  Peptide Sequence Number=SeqID_224472
atggaacttcaacacctgaggagtgagcgagaccgcattgagaatgaagtgcatcatctgagcgagtctctcagagaaatcattgagaacaatacttcaaactcttggggaaggaatgaaatgaagaccttgaatgatgaaggaatgaaattgggggttaccaggggaggggttgattggggttggtgtcattttgtacatagcaaattttactga

SEQ ID NO: 107695 - DNA, 1026 bp, Glycine max
  Peptide Sequence Number=SeqID_224473
atgaggaaccaaaaattaaactcagaagaagaactttggaggcaaaatttgagtgaaaattttgagccaaaatttgaaattcgatcttcggtcgatggcactcttgttcttgatctcaatacggatggaaatcatcattatcctgtgtttgacctgaacctcaattatttgcaactagatgctaacgatgattcaaatattgaagacactgattccatcctcaatgaaggagaagacgctgattctgtccttgatacggttgatgacactaattccttcctcaatgagggtgatgacactgattccttcctcaatgatggaaatgttaatgcatcacatgaagatgctacagtaaggaaaaaaaagttcttatcgaatgagcaaagatgggcaatatatactgcattacttaagaaaaatgtcaacgacaaattgaaacgcactacaaccaatgaggtggccactttatttttagtttctttacgaactgttcggaaacgggcaaaggatactccacacggtacaaatgtcaatgtgtcccataaaaagaccaaaaattatggtcggaagagagaccaagtagaccttaacaaaattattgacgttcctttgcacaaaagaaccactttgagatcacttgcatctgctctaaatatgaatcataacactttgttcaaacttttgaaagagggtctcattcgacgatactcaaatgctataaaacctcatctaaaaaaccatcacaagagagctcaactacagttttgcttatccgtgatagaccacactagtctacctgatgaaacaaaattcatcgatatgtataatattgtgcatatcaacgagaaatggttctacatgagtataaacactgaaaagtactacttgcttcccgtggaagaagatcctcttattcaatgtcaaagttcacattatatagggaaagtgatgtttttagttgttatgggttgtccaaaatttgataatgaaaggaatgaaattttctctgggaaaataggcgtctga

SEQ ID NO: 107696 - DNA, 450 bp, Glycine max
  Peptide Sequence Number=SeqID_224474
atggtggtatctcatcgagggttcgaccaaccattattcgatttgggcattgatgatgatgataacgaagaagttgatgatgcggtagtggtcgaggagtcacaagagaacaacaacgatgagccagagtacaattacaatcatgttgtgtatcaagattcacaagggtataatagtgagaatctttcgcttgaagacttgtttgataatgatggattgactcaagatagttgctttgagttcagctttaaagagaatagagaagtcatggcaaatagaacaaagcctttgagtgaggttgaaaatggagcatttggagagtctcaaaatgaagaagcaatgaaatcaagagtcaatgaaatccagaacgaacgggtggaagatgtaaagactgaagatctcaaatgtgtttttgatttgaatgaagtcccaattgaagggtgcaagtaa

SEQ ID NO: 107697 - DNA, 279 bp, Glycine max
  Peptide Sequence Number=SeqID_224475
atgatgttaaacatattggagacacgaagaataaggcccttgccactaccacgaagatctgtagtaacccaaaccaagaaactgatcgagatttggattcaagaatggtgttgttcctcgagctctggctcttggctcagtgggatatcacgtgatggctccagagcttgggcaagacgactccaataccggcacgacattcgtggtggtggatgtcgtggagtcgtcgaaggaacaattagggtcctacatgatcctctcaacagtgtcgagggatga

SEQ ID NO: 107698 - DNA, 179 bp, Glycine max
  Peptide Sequence Number=SeqID_224476
atgatcatcggtgggaaagaagtcgtcaccactagaatgatagtcatgggaaaatgtggtgatagtcatgctggaaagaagacactcaagggaagaggtgacaaaattagagttccaaatttttgggaacccaatgcaaatgggacatgtgacagaggatggtaccactctaataccat

SEQ ID NO: 107699 - DNA, 561 bp, Glycine max
  Peptide Sequence Number=SeqID_224477
atggctttggttgccctattaaagctgtcttcacggttcccttcttgttcagagagaatcagggaaataatcgttcagtgcaaagggaaccttgtgttggagttgcagcaaagatccatagaattcaatttgattattgcaaagcatcaaaatatcaggcatacacttgtagagaggatgccagttttggatgaggcaactttccttgctaggagggctggatctttaccagatgtagctttaacatcgacaggaccttcagttggtcttccaaatggagcaggcaaacctgtggctcctattgtagatcttcttgatataaattcagatgatgcccctgtaccaacctcttctggtggcgatcttcttcaggaccttcttggagttgatctgtcactggcatcacaacagtctgggtgtgccaatctctttgcatgtttaacaaagaaaagagaccatgagcagcacatcataggaaagataaaaatacctatcccaaatgttctctacatcagagcactgtctgagaatcttagctttacaaaagccaaaagaaactag

SEQ ID NO: 107700 - DNA, 2223 bp, Glycine max
  Peptide Sequence Number=SeqID_224478
atggtacaggttagattccatccattgcatccacatatacttgctagtgggagcttggatcaagaagttcgtttatgggatgctaacacatcagagtgcataatatctcatcatttctaccgtcccattgcatctattgcttttcatgccaaaggtgaaataattgctgttgcatctggccacaagttgtacatatggttccacaacaagaaaggtgaagcatcctcaccaatatttgtgttaaagacaaagcgctcccttcgtgctgtgcattttcaccctcacgctgcaccatatcttttaactgcagaggtcaatgatcttgagtcttcagattcctcaatgacggaggcgacatctcttggttatttacaatatcctccgcctgctgtttttgtcacaaatattcatcctacagaacatattagtttgtccagcgaactaccttatgtgtcattacctttctatgttatgccggcatatactgttgatgagtcaagagcagaactacagcatgctagtcatgatgttggctcaggtagcatgcaaattgagtctgctgccatggtacagttacatgcagacccaagtgcagcagcgcattatgagactaccgtgtctcccatggatacattctctgagatgccctctagctctcaaactggtgcagaatatcctgctcatactgctttctctaatggaatgggaattggcctcagtaatctcacaatggatggtatggagactgatgaaaccagacctgctgaaggaagccaacatgggaacttgactaatacctattctcttaatggcatgctacacggactgtcgaggcaaactgcaaaccgtggggttctctcggagtttggtcaatttcatcagttttttccttcaagagacccaagtggatgggagattccttttctccatggatggataatgggtcaaagccaagttggtgttccttcaatgcttcctcacatgggtgctagtcgtgataatctatcccaacacattggttcttcttccataaaggcatctaatccttccacttctaatgttgatgcagcgatgccatcttcagcaatacctggcagcatcagcataccgggttcttcaatgagatcaggtttacggaatcatttttcacagtcccgtgtacctgtatctgaatctggcaatcttgctgcttctattaatgccccacatgatggattcgatatccaaaccattgtaagtcgaattcagtcagaacttgccacatcagtggctgcaacagctgcagagttgccttgtactgtgaagttaagagtatggtcacatgacataaaaaatccctgtgccccacttaatgctgatagatgtcgtctaaccataccacatgctgtcctctgcagtgaaatgggtgctcatttttcaccatgtggtagatttttagctgcctgtgttgcatgtgtgcttcctcatatagaagcagatccaggattacaaactccagtacaccaagatcctggtgttgcaacatcaccaacccggcatccaatttcagcacaccaagttatgtatgagctgcggatatattctctcgaggaggcaacatttggttcggtgcttgcttcacgagcaattagagcagctcattgtctgacttcaattcagttctcgcctacatctgagcacatactacttgcgtatggtcggcgtcatggttctcttcttaaaagtattgttatcgatggagaaacaacattgcctatatatacagtgttagaggtatacaaagtgtcagatatggaacttgttagggtgcttcctagtgcagaagacgaggtcaatgtggcatgctttcatccttttgctgggggaggactagtttatggaacaaaggaaggaaagcttagggtcctccagtatgacggtgctcatgcagtgaatggcactggaccaagttactttcctgaggagaccatcgttggtgtcagtcatgggctgtctatgaaagttggaggacccgtgttagatgtaaaaaggaggggatggggccgatggtctctttggaagtcctgtgtgaatttggttggagtatatcagaaggataattatagagagaggtggacctcccaagcagttgagctttctcaccataagcgattctctcaccttgattttttaatgaacaacacaaccagtgaagttattgaaaaaccaattcaactcatttaa

SEQ ID NO: 107701 - DNA, 1410 bp, Glycine max
  Peptide Sequence Number=SeqID_224479
atgacgatggaagagaatgagaagatcgctgacttctttgcacgagtaaaggtagtcatcaatcagatggccacacaagtaacaagaattctggcgacagtaacagaggaagaagtcgtggtaggaacaatagaggaagaagtggctatgtttctagtagtggaagaggccagaataatgttgaaaataaacctgatcagtcgcagagaggcaggggcagaggctactatcgaggtggtagcaatggtagaggaagaggtggtaggaaaagatgagtgttatgcgaagaaggattcccaaggtgatgaggcaaatcttgccaaaggtgatgatgaagaaaatgagctagtgatgctcatggtggctactgcagatgaaatgtgcaccattgatgaatggtaccttgacacaggatgttctacacatatgactggtcataaagaatggcttgtcaactttgatgcaagcaagaaaaatagaatcaagtttgctgatggtagagctatgctagcagaaggagttggaaatgtgatgattaagatgtcgaatggtacacagtactgcatatcaggtgtattctatgtacctggactagaaagcaatttgctcagtctaggacaattagtggagaaaggccataaggtgattatggaagataaaaaacttaaactgtttgattcaggtgataaaaagaatttgatatttgatgtttctatgtctagaaacaggacatttagagccaatctggaagcactttgccataaatgcctagctacagtagtgagtgaagatgattgggtgtggcatcacagatatggtcacttgaattttagagacttgcatgacttgaatactcacaacatggttagggggctgccattgataaatgtaccaaaagaattatgtaaaaattgtgttgagtctaaacaacacagagagtcttttaagaattttgttgaaactaaggcaagagaaaagcttgaagtgatatactctgatgtgtgtggcccaatgcagtgtgaatctcttggtgagagtagatactttgtatcattcctagatgatttcactaggaagatgtgggtgtatatcttgaagagaaagagtgaagtgctaggagtattcaagaagttcaagagaatggtggtgagacaaacaggtttcttgataaaaaaaactatagtcactgatggaggaggagagtatactagcaatgaatttgatgaattctgtgaactggaaggtattgtgcatgatgtgacacctccctacactccccaacataacggtgcagcagatagaagaaatcgaacaatgatgaatatggtcagatgcatgcttaatggaaagaagctaccaaaatttctttgggcagaggctgtctccactgcagtgtatgtgctaaactga

SEQ ID NO: 107702 - DNA, 258 bp, Glycine max
  Peptide Sequence Number=SeqID_224480
atggtggaagcacttttgctaggtcttcatccagatggaaaggagaggaatgattggagaggagtaagcaatggattgtgcgagggcaacactgagcactgtagaggtcatgagcgtggtggtggttgccggtctgcatcgccaatctcccttcgcttccagatcgatttgcacctacgattcctccctcagtttccagatctgcactacatgaacataccatgggctttgatggcgctgcatatcaaagatgattga

SEQ ID NO: 107703 - DNA, 625 bp, Glycine max
  Peptide Sequence Number=SeqID_224481
atggcatctaagaaaaggaaagctccttctacaccgacccaggccatatttgatagatccaggtttacatcccaagaggcttaggagagaactcaagcatagaaattggcacaaggagttgacaaactttgtggatggtagtattgatgtggccatcataaaggaattttatgcgatcctctatgaccccgaggataaaccacctaagcaggtgagggtgagaggtcatctgatcaaattcgatgcagacaccttgaacgcattcttgaagacaccagtgatacttgaggagggggagaactttccagtatattccaggttttgtcgttcaaagtcagagttgcaggaattggcaactcgattgtgcatccctggaaggggattcgagttaaacgccaatggactgtcattaaagatatttcaaaagaatctgaccacactcgcttatacatggagcgttctttctttctctaacttggtccctacctctcacacctctgatatcacattagacagggccaggttgatttatggaatcattcagaagatggatatgaacctgggctatattatttcagctcaaatttctatgatcgctaatcaaggccgtacccgaaccaaataa

SEQ ID NO: 107704 - DNA, 2583 bp, Glycine max
  Peptide Sequence Number=SeqID_224482
atggactcaaaagaagaggccgaacatcatgaggataggccaacatcgccaatgcgggtcctgcagcagttatctgaaggggcattcagagttgctggggaagcatttcacaatatgtattctggtggtgggtcaagtatgccacaaatggggcctggtgcacatagacgatgtcaaagtgaacttgttactagagaaggagttcagcgtaataatagctttcagaaattaagatctcatgtgcacaaggcttggcggtggggtggcagattccgcgaagaagtttcaccggcgagtttcaaccctgaggtcatggccaaccagaaacggcagtggtatcggcttcatcctaaaaatctggagccagaatcgctctttgaacattttgtgattgtggggctgcatccagatgctaatttggaagccgtggagcatgcatttgcaagaaggaaaaagtgggaaaaggaaaaacctgcatctctagattacaaaatgttacagcaacaaaggccaccggaaccaactttggaacctcaggcatggttgttggagaggactccatctctaagcgaactaaatgaacttgtctatggacaggagcatttaggaaaagatgatctttcatttgtctttacaatcaaggcagcagacaatgcaacactttatggagtttgcttacatgtgcctgaaattgttcagaggccccctggtatcttaggcatatcatctcctttttctcatccctctggggcatgcagccgttttctggtttctgcacctcgctgttactgtcttctaactaaagttcctttctttgagttacactttgagatgttaaacagtagaacttactatgccttacttggatgtagtctcattgcacaagagcgcctgaatcggataactcagtttataaatgaggtgactctcactggcagcactccatcaacacccaaattagatgatcaaatgagttcaaatgctaactccccggatagggagtcattcagtgactggatggattgtgcaataccccttgatgctgcagctgttattactgctgctgctgcggggattatatctgatgatgaaatcatacagttgtcccctaaaagatgggattctcgctgtcaatctcctgtaagtgtgaccgccagtgatgcttcagatcattggcaggtcagggatatagataaggatggcaggaagaatctacaagatcatgataattgtacttttggggcaccagaaactcttggttctatagaaagaatgcatggaaattacaaaaatgaccaagtttctccgaaagttggaacacctttttctgctcagaatcgtgtcttggagcgtcttggaagttccgaatcacttttcagtccagttagaagcatggcatcagaagatgaggacgattttttctcaaacaatgaaagagattacggggacgaattgttaatagaatgggccatggaaaataagaatgatttgctacagatagtgtgtagatatcatgctgaacctattccacctcgaggaagtgaatttgtcttccaccctctcgaacatctacaggctattcagtacatacgacattcagttgcttcacttggcttcggggatgattgttcaaattgttctgaaccagctctggacaatgcaaagctggcagctgctgaggaagccctgtcattatcagtatggacaatggcaactacttgtcgagttctgtcccttgatagtatgctttactgcattttctttgcatcatgtggactgttacctatggcccctgcctttccacttcctattgaagattttgactcattccatttatccacgatgtttctggtaggtgatggcattaattacaggagtgttgttggaaaaacaggtggtaataatgtgtccaaatctggggattataacccaactttcattttggcaaattttgacataatgcagggtgttctatctgccacagtgctttctctgattcccatgattcgtccatttcagtggcagagtttattgctcccggttggcatacaacataaacctgatgacttgaatatgaaaactaagaatcttgttcttgttaatatgccaaaggatcaggttacaatgtgtcacttaccaagacttccacgacatagagagcttctctctcagttgactccaattcatgctagactttcaaatgaaagatcaattgctagaaagcatcctgtacataggtgcaacgaagtccaggctgaagcttcaactcagtttttgaatataatgtggcactatttggagtcactttgttcagatctgaaatctcacacgatcactagtgtacaatcaaataacgacagggtttctttacttcttaaagatagcttcattgattcatttcctgcaagggaccagccattcattaagactctcgtttgtcaagctttgagagtggtgagtcatagtcccatcatgtcacattattttagaccaaatggtgcaattcatctgttatacatgtttgatggcactgaggaagatatagttgttgatttcattggggaagacctccagtccagatga

SEQ ID NO: 107705 - DNA, 1899 bp, Glycine max
  Peptide Sequence Number=SeqID_224483
atggcggatttagaaaatttgcttttggaggcagcggggagaacacgacattcttgtcaaccttcaagaagaggacatggtggtggtggtgggagtgactctagggaggatgattcggaggatgaacatgattattcaggtcggaagccctctagcttgcaagttcccctaaagaagaggtttgatccaatcgaacgagatgatggtgagagaagtaaggatgaaggggatgatgatgttggtggccgatgttgtcacgagggcgatagcagtgatgaatctgattttggtgatgatctttataagaatgaagatgacaggcttaatctgtcggagatgactgaacttcaaagagagatgatattgtcagaaagggctaccaagaagcatgataaatatttcttggggaagatagcatcaaagcgtgagaagggaaagaaaactgtagccgggaaacagacttcacctctcccgccatctcgtgtgcgttcatcagccagatctgccgacaggtcaactgccaaggatggtgcattaaatgaattgcgtgcaaaacggttaaagcagcaagattcagaagcaaaccgcaggccaagtgaggcatctagaagttcagggcctgggcatttttcaccaaagcacaaacctttcccaaatctcagtagctcaagtgatagtgaaactgaaagtaagtccctgagtgataatgaagggttgagtgatgacgacagaatcatcgacagtgatgatgacaggataatgttaggatctgaagggctttcatttgaggatataaaagaaatcaccattcggagatcaaaacttgcaaaatggtttatggagcctttttttgaggagttaattgctgattgttttgtaagagttggtattggtcgcccgaagtcagggcctatctacaggctctgcatggtaaaaaatgttgatgccacagatcgtgctcggcagtataaattagaaaataaaaccacacacaagtacttaaatcttgtctggggaaatgaaacttctgctgcaaggtggcaaatggctatgattagcaactctcctccaaaggaggaagagttcatccagtgggttaaggaagtagagagaagaggtggccggatgccaacaaagcaagaagtggcagaaaaaaaagaagctatactaaagaccaacttgtttgtttactcagcagctactgtgaagcagatgttacaagagaaaaaatctgccaaaacaagaccactaaatattgcagctgagaaggataggttaaggacagaattggaaatagcacatagtaagaatagtaaagctgaagtgaagaggatcatgacaagattggaagaattggaggaatcacggaaagctaagaggatggatgccagggctttgaagcttgctgagatgaatagaaagaacaggtttgagaacttcaaaaatgcttctgaattgaagccagtaaataaagaattgaaagcaggggaggcaggttatgatcctttttcaaggagatggactagatcaaggaattactactctggaaaaccagctgaagagggtgcagctgaaaataatagtgcaggtggtgatacaggcagctaccacacaggagcagctgagaccgtgatggctggtacggcagctactactgcagctttgaaagctgctgccggtgctgggaagttagtagacacaagcgctccggtggatcaagccacagagtcaaatgtgctgcacaattttgagctgccaatatcattggctacactccaaaactttggtggagccaaaggagttcaggcaggatatatggcaaagaaacaaagaatagaagcaacagctggatttaaagtcctggaaaatgatcgtcagaagcatgcgctgacattaaca

SEQ ID NO: 107706 - DNA, 1920 bp, Glycine max
  Peptide Sequence Number=SeqID_224484
atggaacccgtgccggttgtgttgtatgtgagttcggacgaagaagaggaagtgccttgtttggaagagaacggagggaggaacaggatcattgactttgactgggtgaaggagtttcttgacatttcggacgaggaatcgaacgaggtgagcaaacatgaacacaagtcgaagtcgaattcttctttgatatcgacgccaagcgtggaggatgatgatgattgcgtagttctggatgttgatcctgaaagccgagtcagcaccgtggatggtgactcgccaactgagtcagacgagttggttgttgttggcgagaagggtcagtttgatttggatgtattggtaactgggaagtaccgtaatgtgctttcaattttcttagttttcaattccttgagcttgaactgtttggctgaaattctaatggttcttactgaacatattgcatgcagagactatcctcatccccggcatctttgtgtcatatttccttattcttccaccccccatgagaaacactgttaccagtgctactgttatgtgtgtgattctgtagcaccatgtccgaaatgggtcactggccttttaggtatggatcattgtcatgcaaccgatgaatccgagacatggagaacacggaggaaaattttcaagctgggcaagactgctccattaccgtcttcaaccaattatagtactttgagtgatgtcacgaatgcccaacagaacaatattctgcctttttgtgtgatgtctccatattccatgttgccgaatcagacatcaatgtcaactgcaacacatacatgctccccagtcaattccatacctcaaaatcaatcctcttcgccaattacaatgcgtacgtgctcctcgatacattctagcttccagaaccaggtatcctggccaaataatgtcccctccattgccaccaactttacaatcccgtctggtacaaaccgtggtagatatccagagtcaggatctactttggcgagaaacagataccagtctcaatccattccacagcactcgctaggcaatcgtgccatccaaagggtgcgacaacatggagttagcactttagtgcctcagttccattctcatacattgtttaacggtttaggcagtgttggtgttgggagcaccatgccaatgaaccattctactcatgatgcttctggtggcttcagtaatcatgtcaatctagcacagcaatttgccggatatcatgctgcaacaggattttcaaatgataacagaacttcttacggacaaaatgcttatgtcccccaaaatttatggtaccctaatccttgctctcaaccgaataacctcagctctgtcagcaattacgctactgctcatgaaacccaagtatcataccaatcaaatggtagccagaatttttatgctgttcaaggtaacaatgctccttcaagtaataatgtggctggtctgagtagaaatgaaaatgtttgtggaaatgtaacccaaagtggaactacaaggcaatattcttgccaacagaaacctcatgatgcgagtctaattgaatctgcattgaaggcagataggattgagcatagcaaacaaagcattccttatcagcaaagttcaggatctacgaacacctgtcttggctcagtcgatgatatcaagcgctggctttttggcgatgaaaactctttcctggttggagccgatgatgctttagcatcatcatcagctccatccggtcttggctcagtcgatgatatcaagcgctggctttttagcgatgaaaacactgtcccggttggagctgatgatgctttggcgtctgaactgaatacgccatctcctgatcttagcacatttgatgggggctcattctttgattttgaatcctcttgggaatgtcgtgctcgtgtctag

SEQ ID NO: 107707 - DNA, 504 bp, Glycine max
  Peptide Sequence Number=SeqID_224485
atgaagctgtgcagcctcaagagggtcatcgtacttcaacttctccgccagcaagttgcacccagtgaccacccaagcagccacgaacccacatatgattgcagcccacggatccacaaccgaacacccgtggagataaaggtcttctcttttccaaaacttgctggtttatctggaggtctaggaatgaagaaattttcaatgataatgttaaaccggtgtggcacattgctaaaccagattcacactctcgacaacattatctttaaggacgttactcaatcattgcaacagccttctcctatgcaagtgtgttggattgctcctcccggtgatgtcatgaagcttaatactgatgggagcgcttttggaaacccgggacaagcaggatttgccggaatcacaatggatagtcttgggaactgtgtcacacaggtttcatgggatcctgtggctttgcaacttcagttcatgcagagttactcgccatctatcatggtttga

SEQ ID NO: 107708 - DNA, 2613 bp, Glycine max
  Peptide Sequence Number=SeqID_224486
atggcgaaatcgagcgccgacgatgcggagctacggcgagcttgcgagcatgccattgaaggcacgaagcacaaggtcgttctctccattcgaaccgtcaagactcacggcacttggggaaaaactgctaagcttggtcgtcaaatggccaagcctagggttctcgctctctgcaccaaagccaaagttcagcggactaaagcttttctacgagttttaaagtattccaacggaggagttcttgagcctgctaagttatacaagctgaagcacctctcaaaaatggaagttgcaacaaatgatcccagtggatgtacatttacactggggtttgataaccttagaagccagagtgtggctcctccacagtggacaatgcgcaatgtcgatgacagtttggctcactgcatcgtctattacttctcttgtagaaatcgcctcctgtttggtatcttaaatatctgcaaagatatccttggtcgcctgcctaaggttgttggtattgatgttgtggagatggctctttgggctaaggaaaatacacccgcagtttccactcaaaataaccaacaagatggcacttctgttgaatctactgcggctgaaacagaattgaaagtctatgttgaaaaggaacttgtctcccaggcagaggaagaggacatggaggctcttcttggaacttatatcatgggtattggtgaagccgaggcattttctgaaaggttaaaaagagagctccaggctctggaagcagcaaatgtgcatgccattttagaaagtgaacctctgatagatgaggtgttgcaagggcttgaagcagcatcaaattgcgtggaagacatggatgaatggttaggcatgttcaatgtaaagcttcgacacatgagggaagatattgaatcagtaagtgcttgtagagttcaaattgaaacccgcaataacaagttggaaatgcaaaatgtgaataacagaactcttattcaagagcttgataagcttcttgagcaattgagtatcccttctgagtattcagcatgtttgacaggagattcatttgatgaagcacaaatgctgcaaaatatggaagcatgtgagtggttgacaactgccatgcgtggtcttgaagtgcctaacatagatcctacttatgcaaaaatgagagcagttaaagagaagcgaggagaacttcaaataataaagtctgtttttgttgggaaggcttctgaatacttgagaagttacttcgctagttttgtggatttcatgttaaatgataaaaattacttttctcagcggggacagttgaaaaggccagatcatgctgatttgaggtacaagtgcaggacatatgcacgccttctgaagcatttaaagattcttgataagaattgcttgggtccactgagaaaagcttattgcagttctctaaacttgcttcttcgcagggaggcccgcgagtttgctaatgaacttcgtgctagtgctaaaacttccaaaaccccaactgtttgggaaggcttcatgggttctggtcaaaatgtaaattctgctgacactgcagcagtttctgaagcgtatgcaaagatactcacaatttttatcccacttctggtggatgaggtgaaagttcttgatattctcagtcccggaacttttccctcacttgttgatggtaataaaactggacacaatgaccagaaaaatgatgatgatttgggaattatggacattgatgagaatgacagtaaatctggtaaaaattctgtggattttgcagctttaaatgaatcacttcaggatttgcttgatggaattcaagaagacttcgctgctgttgtggattgggcacacaaaattgatcctttatgctgcatatcaatgcatggaactacagaacgctatctctctggtcagaaagctgatgcagcaggatttgtacgcattttgcttggtgatctagagtctcgcatatctatgcagttcagccgttttgtggatgaagcttgccatcagattgaaagaagtgagcgcaatgctcgccaaacgggtgtcctaccgtacattcctagtttgtatgaccttgcaaatgtcgttcccactttggcgaagttttatcatcaggctagtgaagcctacgagcaagcttgcacacgccatattagtgtgattatctactatcaatttgaacgccttttccagtttgctcgaaagattgaggacttgatattgaataatgttgcacctgaagagattcctttccaagttgggctgtcaaaagcagatctacggaagacgttaaaatccagtttatccggggtggacaagtccattgctgcgatgtataagaagttgcataaaaacttgacttcggaggaactcttaccttccttgtggaataaatgcaagaatgattttcttgataagtacgaaacctttgtccaacttgtcgcgaggatttaccctgctgaatcagtcccttctgtagcagagttgcgagaccttttagcttccatgagggaggcattacagagtgttgctacgactacgaggattgaggggtctatggagagtgtatgcagggatgaaccaaggatcaactctatagcttaa

SEQ ID NO: 107709 - DNA, 849 bp, Glycine max
  Peptide Sequence Number=SeqID_224487
atggagagcatgaaatattggctaatagagcacccagccatggtctctttccggtggagtcccacccaatcatacggcggcacgtggtggttcctaatctccgccaccagcttttacgtcgcggccgccgtaacccttcacctactcctcaaatttttccgtcgccgccgcgccgtgccgttgggtcccatccccgccctccacagcctcgccatgtcgttgatctccgccgccatattcaccggcatgttcttctccgccgaagccgaagcccgcgacacgcggtggctgtggcggcgctcccgaaccacctcgtttgagtggctgctctgtttcccactcggcactcgcccttctggtcgtgtcttcttctggtcctacgttttctacctctcacgcttcctccacctgcttcgcaccttcttcgtcgttttgcgtcaccgaaggttgtcgtttttcaggctgttcaacaactccgtccttttaatcatgtcgtttctgtggctcgagttttcgcagtcgcttcaggtgctggcgattcttttttacacggcggtttattccgtcgtttacgcgtttcggttctggacggaaatcgggttgcctaccaaaacgccgttagcgttgtcgttcaccgcgaattttcagatagtgctgttgggttttaacttaatgtgccacgttggagtgctctcgttgcattacttgagaggagggtgtaatggaatcggggcttgggtttttaactccgtgttaaacgctgcttttctcgttcagttcttgaagtcctatgtgaaaacgcattgtcatagccaaagtattgttgcttgctcttcttccaaacgcgag

SEQ ID NO: 107710 - DNA, 1062 bp, Glycine max
  Peptide Sequence Number=SeqID_224488
atgaaattcaagtcaagaagactagaagcagaagcaggagcactggtcttattctttctcattttgtcatcgtcatcttcttccaattacgccaaaccaagcaccatcattcatcaattcaaggaagcccccgaattctacaactccccagaatgcgcctccctcacccacagcagcgacagctacatatgttcggaggaagcggtacacgtggcaatgacgctggacactacatacatccgaggatccatggcggcgatcctctcggtcatccaacactcgtcgtgcccgcagaacacattcttccacttcgtctgctcctctagcgcgtccctcctacgcgccgcgatctcccactcattcccttacctcaacttccacctctacaccttcgacgactcccaggtctcgggcctcatctccacctcaatccgctccgcactggattgccccttaaactacgcgcgctcctacttgcccagcctcctacccctctgcgtgcggcgcgtggtgtacctggactccgacctaatcctcgtcgacgacattgccaagctggcagccacaccactaggcgaaaacacggtcctggcagcccccgaatactgcaacgccaacttcacctcgtacttcaccccaacgttctggtccaacccttcgctgtctctcacgttcgcggataggaggccgtgctacttcaacacgggggttatggtcatcgatttggagcggtggcgggagggggattacaccaccaaaatccaggagtggatggagctgcagaagagaatgagaatctatgacttgggttctctgccgccgtttttgcttgtctttgctgggaacattgcttccgtggatcataggtggaaccagcacggcctcggtggtgataattttcgtggcctttgcagagatctgcaccctggtcctgttagtctcttgcattggagtgggaaaggtaaaccgtgggttcggttggacgctaataggccttgccctttggatgcgctttgggcaccctatgatctattgaacacacccttctctttggattcttga

SEQ ID NO: 107711 - DNA, 307 bp, Glycine max
  Peptide Sequence Number=SeqID_224489
agccaagtttctgagccacgaagggtccatcgcggtggtgacggagagaatactgaaggtttcggcatcggtggacgatagggccgtgtttgttctctcacaggtttcgaagttttcgggcacgaccatggtcttgcaggagatgttgagagtggggactgtggcgaagctttgcatggtgcttcaggctgatcgtgccaagtatttgaaggacaaagcgatggagattctcaaggggcactctgaggtttgggcgaactctccttgcattcccaatacgtcttttggtggatacgtgaaatactga

SEQ ID NO: 107712 - DNA, 795 bp, Glycine max
  Peptide Sequence Number=SeqID_224490
atggtgcagtgttcgcgcagatgcgagcttttcgatctgcatcaggaactgatcccttatgacgtggcatggtcttggcaaaaagacatcgtcagggaaaagaaatcacagattgagaacgaaggagattgcagcgacacacttattattctgcaacacccttctgtttacacattgggtaccgctagtacacaccacaacctcaactttgacatcgaaaatccaccctttcctatttatcgcactgaacgcggcggagaagttacgttccacggccctggccagctaattatgtaccctattatcaacctccgaagacacaagatggatcttcattggtacctccggacccttgaggaggtcgttattcgtgctctttcttcaacattttcaattcaggcttctcgggtagaaggtttaactggtgtttgggttggaaaccagaaactggcagctttaggtatacgagtggctcattggataacctatcatggcttagcgctgaatgtcacaacggatttgagcccctttaaatgggtcatcccatgcggaatacgtgaccgtcaagtggggagtataaagggcttgcttaaagaagctcaatcatgtattgctcatggaacatctgttttgcacgatttggatgataccagtcttattcatattacttacaggtccttgattgaagagttctcacgagcgtttcagcttgagtaccattataaaactatttctgtacctgttttgtgtaaaaggaaacctagctgtttttcaaaagaaacgcagcaaagttga

SEQ ID NO: 107713 - DNA, 1560 bp, Glycine max
  Peptide Sequence Number=SeqID_224491
atggtagagttacaacttaatacaaagatcaaggctctgcaaactgatggtgccaaggagtaccttgtgttaactaagtaccttgcagatcatggaatacaacactgcatctcttgtcctcatacacatgagcagaatggtgccctggaaaggaaacatcgacatttgactgaaacaggtctcaccttgctagctgcttcctcccttccttcaaaattctgggtagaagcatttagcactgccaccttcatcatcaatcgcataccctcttcgatgattaagtacaagtcttcctttgaggttctttttcacaaaacccctgactactccattttcaaaccgtttgggtgtctttgcgacccctatttacgaccctacaccaaaaccaaacttgattttcgatccaccccttgcatattccttggttgcaacaccaaatacaaaggctataaatgtataactaattctggaaaagagtacactgtcatcaatactaccatttgtccaaatcaaacaccaactgaactcacaactcccttaactaatcctattcctacttcatctcctattcatgacccattaccaccaaatattaatcctacaattcatgaccctgtcaactcagcccctaaacaacctcctcatcctactcctacaacaatgaaggctattggttctaaatggatatatcggctgaactacaattttgatggctctgtagccaaacataaagctagattggtagctcaggggtgtgatacatctctttttgtgcatgctacacccaaattcatcacatacattctggtatatgttgatgatatcataataacaggcagctcaaactctgcaatccaatctgtgatttccaaactccactctttgtatcctttcaaagaccttgctaccttacgttttttcttaggcattgaagccaaacacactactactggtgctcttctcctctctcaatccaaatacataactaatctcttatccaaagtcaacatgcataatgctaaacccataaagactcctctagcccctggttcgaaactgcaaatggatgttactgattctttttctgatccaactttatacaaatctgtggttggagcattgcagtatgccaccataacacgtccagacatagcttatgcattcaataaattatgtcagtttatgcatagcccacttgaaagtcattggaaagccacaaaacgtgttctacgatatctaaatggtactattgatcatggattttgtgtttatctgggaaataatcttgtttcttggcctacgaagaagcagcattcagtttctcggtctagcactcaagcagaattcagaagtttagcagctctagttgccgaaattaaatggataaagtcccttcttactgaattgcatgtcatccaaacgaagcctcctttactgtggtgtgataatcaaggtgcagctgtgaatggagaaatagttgtcaagcacataccctcacaattccaagttgctgatcttctaaccaaggatccctcaagtagtacttttctaagcccttga

SEQ ID NO: 107714 - DNA, 189 bp, Glycine max
  Peptide Sequence Number=SeqID_224492
atggatgatcagaccacaatcaataacaataaagtattgtgctgtgatcatgcgctgaggggggcgacgtttgggctttgcgagtatggcggggatcacgcgcttaatgcgggattcgcgctaagcacgcctttaggtttcttcgtgagtcttcttcgcactaagcttgagttgaccgctaagcgatga

SEQ ID NO: 107715 - DNA, 309 bp, Glycine max
  Peptide Sequence Number=SeqID_224493
atgcagagcttgcaagaattggcccaccaaaggccaatcatgagtgtcgagcagttcattaagcaggctgcttatcctgagccaataccagtaccagctgatccaccatctcctatggtggatccatcttctcccgcaccagaagcagctctcccatctacacctattattatatctgatgaccctacagtgcaagcacctggattagctcctactcttccagccacacctgagcttaaattttcagataaggaggggggacggattactactcctccggggacgccaatgttacatttcgatgattag

SEQ ID NO: 107716 - DNA, 345 bp, Glycine max
  Peptide Sequence Number=SeqID_224494
atggcggcttatcaagcaaagttgacactgatgacgggtacagaagattttcaagtgctcgattatatgcttcctgaggaaggtgacatatacgacggtgctccagctcagttccctatctcattcgggaagcaatcgaagcctcaaacccctcttgaagccatccacactgcgacacgtcgttccaattccaatcccaaaaccgccaacgaccttccttctatctcctcctcttccagggaatgcctcttggttgatcatgacttcaaattcttggttaatgtcttccaattgaaacgctacactctcattcttcctaatgaacttgatgcaaagttcacataa

SEQ ID NO: 107717 - DNA, 297 bp, Glycine max
  Peptide Sequence Number=SeqID_224495
atggcttctttttcggattggatggatggtgtcagagtcgcaattgccattcctacaatagaggtccgatttgagaacatgaacattggagcagaagttcatgtaggaagtagagctttgcccattttcacaaactacatggttaataagatagaggtaagagtaccacgtaccaaccttgtttggcttcttgatcagttcactggaaaggtgacttataatggtcatgggatgaatgagtttgggtatgctttacctgcatctcttgaacttcctttcatactttttgagagatag

SEQ ID NO: 107718 - DNA, 153 bp, Glycine max
  Peptide Sequence Number=SeqID_224496
atgggagttgcatataggtcagagatcagaatctgttatgccccttctaagcctctggaagttggtgagactcatgagtgcatgacaaataagagaccctacggccaggatctaattattcacccagaacctgattgtcttaccattgcctaa

SEQ ID NO: 107719 - DNA, 972 bp, Glycine max
  Peptide Sequence Number=SeqID_224497
atgccaacctttgcacccttgccagagccagatctctccttaaacataagcccacccttcacttcagattctgacgccaaaaaagtggaaataagctgcaacggattattaacattaactacaaaaacgctttacaacgatatgtgctcaacctcggattctggtagcagtggaagcgatttaagccacgaaaatggttttttcggccacacggacactgcctacaaccttggccatcatgaaccgacattgagcttaggcatcgaaacgacaaattcgaatccttatcctgtccaacaaggagcactctcgagaaacaacttcagtcacttccacaactaccaacctcacagcaatactctggatttcaagcgaaatgctagagtcattcatggcgtgaaaagaaacgccagagctcctagaatgcgatggactacgaccctccatgctcattttgttcatgcggttcagcttcttggtggtcatgaaagggcaactccgaagtcagtgttagagttgatgaatgttaaagatctaactctatctcacgtgaagagtcacttgcagatgtatagaacagtgaagagctctgacaaaggcagcgcaggatatgggcagacaggtatagggttgagccaaaagccaggaattgtcgatctgtatggagtcttagcttgtgagagagccaatttgccacagccgctgctaaaatcccaaagggcgtcatggcaatcatcaatagagacaaattcaataaattatacacagaaccccataatcaattcgatgtattctcatctcaaaggaaaccaaaccatggtgggtggacagcattatgaatgtctgtcaaattgcatgaaggagaaattggattcttgctctttgtcacgttccgatatgacgcttgacctagaatttacccttggaaggtccactagttgcaaacagaccacgctgaatcaagagaattaa

SEQ ID NO: 107720 - DNA, 2307 bp, Glycine max
  Peptide Sequence Number=SeqID_224498
atgatgttatggagtatgtggaaaagaaggaatattaaactcttggatgcaattgaagaagcaccagaagctttagctcgagccaattcagtacttcaagactggatttcagcccaaaatacacgtccaagggattatcaaggcaactttagacagatctttactggttgggttgattcatttatggaggttcaggagggtgaggcctatgcaatactttcagctttgagatggatggaagataagccttatcaggcagtgatttcgagtcaggctgcaaagtgccgccaaacatgcggttcctccaaacccgtcccttacccattcggattctcctccggctgcgcaatccgcctgaactgcaccgccggcgtggcctccgtcggagaattcccggtcaaagtcaacacagacagcttgatcgtgagcatcgaagcccaatgcaatcgctcattcgatagcttccaccatctgttcagccacaaatatgcacccacttcgcgaaacgtgatcctcttagacaactgcaccgctacgcctttaccctgctccattccggagactctggtgcggacccacttcgaatccgtgggctgtggcaacgcctccggcaccggcgaattgagctgctacttcgagaaaataaccaacggattcatggatcagagaatgttggatgaaatccggtgcaagtactttatgtcgtccctttcagtgccagatatcaaaaacatttcgggtactgcgcctttgtctttgggtgtaaatgtaatcgaacttggatggtggcttcagggagatcgatgtttatgttctgatcacgccaattgtaccacgcttcagtcgccggtggacagaaaaccagggttccggtgtcgctgccgtgacgggttcgtcggcgatgggtttttggtcggaactggttgccagaaagcctcgtcatgcaacccagcgaagtacatgtctggtcgatgtggaggaacaacgagattcatagtcttaattggtgggtttgttattggcgtttcactgatggttactttgggttcactatgttgtttctaccgccgacgctccaaattgagagtgacaaagagcacgaaaaggcgtttaaccgaagccactggcaacaatagtgttcctatctatccctacaaagacattgagaaagccacgaatagtttctcagagaagcaacggcttggaactggagcatacgggactgtttatgctgggaaactctacaacgatgaatgggttgccatcaaaaggataaaacacagagacactgacagtattgagcaagtaatgaacgagatcaagctcctttcttcagtgagccacaccaatttagttcgtttgttgggttgctccattgaatacggagaacaaatcctagtgtacgagttcatgcccaatggaacacggagtcagcatttgcagaaggagagagggagtggtcttccttggccagttcgactcacgattgccactgaaactgcacaagccatagcacatcttcattcagccatttgtccccccatttaccacagggacatcaagtccagtaacatactcttggactacaatttcaggtccaaagttgcagattttggtctttctagacttgggatgaccgaaatatcccacatttcgacagccccacaaggaacccccggctacgttgatccacagtaccatcaagactttcacctctctgacaagagcgacgtgtatagcttgggtgttgttcttgttgagatcataacgggacagaaagtggtggacttttcacgcccacataacgaagtgaacctggcttctcttgctgcggataggatcgggaaagggcttttaaatgagattatagacccattccttgaagccgaagcaagaagtgacgcatggactctttcctccatacacaaggtggctgagcttgcattcagatgccttgcgttccatagggacatgaggccttcgatgacagaagtggcttcagagttagagcaacttagtttgagtaggtggacaacaatgggagacaacaattgtgcaacctcaacggaattgtcctcttgctcttcctcctcaaatgaaagtgagaaaccactaagcaccggaatgaagaatgctggaggggcaaagggtaaaggccacctcaagctccaaactgggcctgttcatttaatgtcattacaaaggcccaatagtaactcaccggtctcggtgcaagaccaagagctgtggttgagtgagcagagttctccttcatcgaatagttttccaagcaagtcatttgattga

SEQ ID NO: 107721 - DNA, 1566 bp, Glycine max
  Peptide Sequence Number=SeqID_224499
atgacatcaattacctctgcatcccttcctttgctgcaactccaatcttcattgaagagaaaaccctgcaacttgaagagctccaccaccatgcgtcgttttacaaccaaagcctcagcctctgaaacgacgtcggcggctgcgccagcgcccgagcccagcaagcttcccatgcgaaagatcccaggagattacggtctccctttcataggacccatcaaagaccgccttgacttcttctacaaccaagggcgcgacaagttcttccaatcccgcgcccaaaaatacaactccaccgtgttccgcgccaacatgccccccggccccttcatcgcctccaatccaaacgtcatcgttttgctcgacgccaaaagcttccctgtccttttcgacgtcagcaaagtcgaaaagcgtgacgtcttcaccggcaccttcatgccctccacccaactcaccggcggttaccgaatcctctcctacctggacccctccgaacccagacacgaacaactcaagcgcctcttgttcttcctcctcaaatcccgaagcagccacgtcatccccgagtttcattcaagctacacaaccctctttgaaaccctggagaatgagcttgctaaggaaggcaaggctagcttccaaaccgccaacgaccaagctgcgtttaacttcctcgctcgcgcgctttatggcaccaacccctccgacacaaacctcggacgcgacggcccaagcataatccaaacatggcttttgttccagctcggcccaattatgaccttgggccttccaaaattcctggaagatcccactcttcacaccttccgcatccctccttttctgataaaaaaagattacaagagactctacgatttcttctacgagtcctccgggttcgcgcttgacgaagcggtgcgtttaggagttcccagagaagaagcgtgccacaaccttttattcgccacgtgctttaattccttcgggggaatgaagatattcttccccactattctgaaatgggttgggcgtgcgggggtgaaacttcacgctaggttggcggaggaagtgagggccgccgttaagtcaaacggcgggaaggtgacgatggcgtcgatggaggaaatgccgttgatgaagtcggtggtttacgaggcgtttcggatagagccgccagtgccgctgcagtacgggagggcgaagaaggagttggtgattgagagccacgagaatgcgttcgtggtgaaggaaggggagatgctgttcgggtttcagccgtttgcgacaaaggatccgaagatatttgagaatgcggaggaatttgtggcggatcggtttgtgggggagggagagaagttgctcaaacacgtgctttggtccaatgggcctgagaccgagggacccacccttgggaacaagcaatgtgcagggaaggattttgtggtgttgttctctcggcttctggtggtggagttctttcttcattatgattcctttgatgtccaagtggggaattcatctttgggttcttcccttaccttcacctccctcaagaaagcaagctattag

SEQ ID NO: 107722 - DNA, 546 bp, Glycine max
  Peptide Sequence Number=SeqID_224500
atgactagaaggcttcttgccggttcattggcttttgagagccgcatccttcattatctcattgtttgtatcttgcttccaagatcttcaaaccttgcacaggtttctgaagaagatcttattgttatgtgggcttttcataaaggcctacaaattgattgggcacacttagttcgatatcgcatgcataaggctttgcgattaaatgctccattgccatatccacacctaatcaccctcttccttcaacacttcaacatccctcttgattctgaaccttatgttccaatcaagagatcctttctaataggcgttgttgtgattgcatcctttggttatcaaaaagagcatgatggctcttgggtgaaaaagggtgctcgacccgttgatgaagaaggacatttacatggtggagaagattcctctcttcttcaaaagattttggataggttcgatggtcttcaatcctttgttggtgaaagggttgtcatcatcaaaaagggggagattgtagaagcaagcttcatgatgctgaatcaagattga

SEQ ID NO: 107723 - DNA, 1212 bp, Glycine max
  Peptide Sequence Number=SeqID_224501
atggaacttcagaccctttgttgcgctcttccctctcaaccacttcactcttccaatcatcgtattctatcatcaccagcgtttggaatccgcgctccattcacaaatcaaagacaaagatttcacttcggaaacgcctcaaaatgtatgggtgctgcattttccggtttaaaatgggtgattaaagagccttcacttttgggattgagcaaattccagaggcttcttgtacattcttctgattccaatttaaacggtggcttggaagttcatccaaaacaaagttctagtgtgcccgttactacatttaacggggcggaaccgtttcatggtaaatcaggttccgtctctttttgtggcctgacacaccaatctgtagaagaagggaaattggaatcttccccctttgaaggaaagggtggctctttcttatgggtcttagctcctgctgcgttcatagcgtctttgattttgccacagttttttgttgacaatgtggttgaagctttccttaataatgtgattttaatagtatttgtctgtctatgtactgggaaaatcgagaacctaaccctcactgattatcctaccaatctcaaaccaaacatacggggaagaacaatgtcaaagaactctgacattttatgtgaaaagaaattcttagacaaaagcacaaaagatgttgaaaaaatgacaatgtctcatgctattgcattccccttgcattttgctgtatttctggaggttattggtggtgtggatgtcctgttctacattggactagcgacattcttgcatgtgactgattgtgtccagaggccgtatttgcagtacagctcaaaaagatggggtcttattactggcctcagaggatacctattctctgctttcttcaccatgggtttgaagattattgctcctctcattcttttgtttgtgacatggtcagcaattcgcattgcagcatttgttgctataactccatttttagttggctgtgttgcacaaattgcatttgagaaagctttggacaatcgtgggtcatcttgctggcctctagtcccggttatatttgaggtatacagactatatcagcttacaaaagctgctaattttgccgagaagttgttattctctatgaaggggcttcctgcgggccctgaattggtagaacgaagtggagctttgttcgcaatgttaatcaccttccaa

SEQ ID NO: 107724 - DNA, 135 bp, Glycine max
  Peptide Sequence Number=SeqID_224502
atgtgtagagatcgagaaagagggaagcaggtacgtgcaatgcaggttttgtctggaatgattggaattggagaagaacaaaatgagtactattcaagggaagatattggaatgggaattggagtctccctgtaa

SEQ ID NO: 107725 - DNA, 1581 bp, Glycine max
  Peptide Sequence Number=SeqID_224503
atggattcctctttgcaattaactatcatagccatattggtgtccttgttagtgtttctctggcacactaagagaaatagaggaggtagcaagaacaagagtaaagaggctcctatcccagctggtgcatggccactaattggtcacctccaccttctgggtggcgatgatcaacttctctaccgaacacttggaacaatggctgaccaatatggaccagcattcaacatctggctcggcactcgccgcgcatttgtggtgagtagctgggaagtggcaaaagaatgtttcacatccaatgacaaggcacttgcctcacgccccactacggttgccgcaaagcacatgggctacaactacgctgtgtttggttttgctccttatagtcccttctggcgcgagatgagaaagattgcaactcttgaacttctctccaaccgcaggctcgaaatgctcaaacatgtgatggtgtccgaactcaacatggtgatgagggatttgtacaactcttgggtccaaaataggtctcggcctgtgctggttgaactgaaccgctggttggaggatttgactctgaacatggtggttagaatggtggcggggaaacgctactttggtgcctcggctagctgtgataatgatgatgaagcgaggaggtgccagaaggctattaatcagttttttcatctgattgggatttttgtggtttcggacgctcttccgtttttgcgttggttcgatgtgcaggggcatgagagggcaatgaagaagactgccaaggagttggatgccatacttgaagggtggctaaaggagcaccgtgagcaaagagttgatggtgaaattaaggcagagggtgaacaggatttcattgatatcatgctgtcgcttcagaagggtggtcacctatcaaatttccaatatgattcggataccagcatcaaatccacatgcctggctcttatacttggtggaagtgataccacagctggcacggttacttgggccatctcattactgctcaacaatcgccaagcattaaaaaaggcgcaagaagaattggacctgaatgttggcatggaacggcaagttgaggagtcagatattagaaaccttgcatatgttcaagcaattatcaaggaaaccttgcggctatacccagctggtcccctcctaggaccaagagaggcccaagaagattgcaatgttgctggctaccatgtccctgctgggacccgcttggtggttaacctgtggaagattcatagggatccaagggtgtggcaggagccttctgcttttagacccgagagatttctcacaagtgatgctgttgatgtgagaggccaaaactttgaactcattccctttggctctggtagaaggtcatgtcctggcatgtcctttgcactccaagttcttcacttgacactggctcgtctgcttcatgcatttgaattcgctaccccatcagatcaaccagttgacatgactgagagccctggtttgacaattcctaaggcaactcctttggaggttcttcttactccacgccttccagccaaattatatgcctgctaa

SEQ ID NO: 107726 - DNA, 1581 bp, Glycine max
  Peptide Sequence Number=SeqID_224504
atgggtctcacgattcagtacctggaggcatcagttgccgcaattattggcataatcttagtttcttacttcatcaaaagggctacagcaggttctgcccgcaagccaccggcagcaggcggtggctggcctttgatcggtcatcttcacctcttaggtggttccactcagccaccttacataaccttaggatccttggcagacaagtatggcccaatattcagcatgagaattggtgtgcatcatgctgttgtggtgagctcttgggagttagcaaaagagtgtttcaccactcttgacgtcgttatctcttctcgtccaaaattcaccgctgcaaaaatcttgggatacaactatgctaattttgggttcaccccttacggagacttctggcgtgtgatgcgcaagatagctgcttcagagttgctttccactgcccgctttgaacttcttcaacgtatcagagactccgagatgcagatctcgttgaaagaattatacagaacatgggtggacaaaagaggcgtgtcagatgatttgttggtggagatgaagcagtggtttggagacgtgaatctgaacgtcattctcaggatgatttcggggaagcgatactccgctaaaagtgaagatgatctgcaacaagtaaggagaattcggagggttttcagagagttctttcggttgacagggttgtttgtggttggggacgcaattccctttcttgggtggcttgatttgggaggggaagtgaaggagatgaaaaagacggctatagaaatggataacatcgtttctgaatggctagaagaacataagcagcagataacagattcaggtgacaccaaaacagaacaagacttcattgatgtcttgctcttcgtccttaaaggcgtcgaccttgccggttatgattttgacactgtcattaaagccacatgcacgatgctgattgccggagcaactgatactactgcagttaccatgacatgggcactgtcattgttgctgaataatcaccatgctttgaagaaagtaaaagatgaattggatgagcacgtgggcaaagaaagattagtgaatgaatctgacattaacaaattagtttaccttcaagctgtggttaaagagacactgcgattgtatccagctgggccattctcgggtccgcgtgaatttacagaaaactgtactttaggtggttacaaaatagaagcaggtactcgatttatgttgaatatttggaaattgcatagagatcctcgtgtatggtcaaatccattagagtttcagccagaaaggttcttgaacacccataagaatgttgatgtgaagggtcagcattttgagctccttccctttggtggtggaagaagatcgtgccctggcatatcatttggccttcaaatgtcacacttggcattagcttcttttttgcaggcatttgaaatcacaactccatccaatgctcaagttgatatgagcgccacatttggactcacaaatatgaaaactaccccgcttgaggttttagtcagacccgttttatcacatcagctactctttgtcgatgaagcttag

SEQ ID NO: 107727 - DNA, 660 bp, Glycine max
  Peptide Sequence Number=SeqID_224505
atggatagcattgtttctgaatggttagaacaacatcgccacaaacgagattcaggggacactgaaacagagcaagacttcattgatgtcttgttgtctgtcctcaatggcgtcgaacttgccggttatgatgttgacactgtcataaaaggaacctgcacgacactaattgctggagcaattgatactactacagttaccatgacatgggcactctctttattgctaaataatggtgatgctttgaagaaagtacaagatgaacttgatgagcacgtgggcagggaaagattagtgaatgaattagacattaataaattagtttaccttcaagcagtggttaaagagacgttgcgattgtatccaactaggccagtctcaggtccgcgtgaattcacaaaagaattgtacattaggtggctacaatatccaagcagggatcctcgtatatggtcaaatcctttagaatttcagccagagaggttcttgagcacccacaaggatatggatgtgaagggtcaagattttgagctcctttcctttggtggtggaagaagctactctttgtggatgaagtttagaaaaatccactgcattaaccaatgtctaccctacttaagtaacgagcaaggcttatgtgcttttaccttcccagcatga

SEQ ID NO: 107728 - DNA, 297 bp, Glycine max
  Peptide Sequence Number=SeqID_224506
atgatgctgccaccacttctcgccacgatcattttccaaatcttgactagttcaacgaggacgacttcggtgactttgttggcttcgaccactcgtcagaggaggtgttcaaggagctcgaggtggacgacaaggacgccgtcatcgagaacaaccgcttcgtcatggtcaagatctaggcgccttggtgcggccactaccaggcccttgtgccagagtacgttgtcgcctccaccgagctcaagcctgacagcgttgttcttgccaaggtcaatgccaccgtcgaaaacaaactag

SEQ ID NO: 107729 - DNA, 4662 bp, Glycine max
  Peptide Sequence Number=SeqID_224507
atggccgtcgatgaaattgaaatcttgtctcctacgttttcttcttcgggatcgtttgagaccctttggagtgcgatcctcggattgcctttgttggaactggtggcaatttgtgccaacttgacactgtctcttctctttctcttcgttgtttcggcgaggaaggtgcttgtgtgtgtagggagaggagtaagatttggtaaggagaacataaccggcaatgccagccccggttgtgttagtgttgatttggaaacacgtgacgtcgttcggattgaaacgtggttcaagttgtcggtgttgtcttgtttgtatgttctgttggtgcaagttttgctcttggggtttgatggggttgctttgattagaggaagggatttggatgtggatttggatttgggtttggctcttctttctgtgcctcttgtgcagggtttagcttgggttgtgttgagcttctcggctttgcaatgcaagttcaaggcgtctgagaggtttccaattttgctcagactttggtgggttatgctgtttggtatttgtttgtgtggtttgtatgttgatggtaagggggtttggatggagggttccaagcacctgcggtctcatgttgtggcgaatttcaccatcactcctgctcttgcctttttgtgtattgtggcaattaggggtgttactggtataaaggtttttaggaattccgaggagcaccagccattgcttgttgaggaggaaccggggtgtctcaaggttactccttatactgatgccggactttttagcttggccactttgtcttggttgaatccacttctttccataggggcaaaaaggccgcttgagcttaaggacattccccttgttgcggcgaaagaccgatccaagacaaattataaggttttgaattctaattgggagaggttgaaggctgaaaaccaatccgagcagccttccttggcttgggcacttctcaagtccttctggaaggaggcagcttgtaatgccgtatttgctggtgtcactactcttgtctcgtatgtcggtccgtacatgataagttactttgttgattacttggttggcaaagagattttcccacatgaggggtatgtccttgcaggggtattctttgtggcaaagcttgtggagacctttactactaggcagtggtatcttggggtggacatcttgggtatgcatgttaggtcggctctaactgcaatggtatatcgaaaggggctaaggatatcaagcttggccaagcaaagtcacacgagtggggaggttgttaactacatggctattgatgttcagagggtaggggactactcttggtatcttcatgacatgtggatgcttcctctgcagattgttcttgcccttgcaattttgtataagaatgttggaattgctgctattgcaacactgattgctacaataatttccatcgtcgtcactgttcctattgccagggtccaagaaaattatcaagacaaattaatggctgctaaggatgaaaggatgagaaaaacatctgagtgcctgaggaatatgaggattctcaaacttcaagcttgggaggacagatatagagtgaaattggaggaaatgcgtggagtagagttcaagtggcttcggaaagccctctattctcaggctttcataactttcatattctggagctcccctatatttgtttcggcggtcacttttgctacttccatattgttgggtggtcagctgactgctggtggtgtactttctgctctggctactttcaggatcctgcaagaacctttgaggaattttccggacttggtgtcaacaatggctcagacaaaggtttctcttgaccgattatctggtttcctgctggaggaggaattgcaggaagatgcaactattgtcttgccacaaggcattactaacattgctatagaaattaaggatggtatcttctgttgggacccttcttcatcttttaggcctaccctatcagggataagtatgaaagttgaaagaaggatgcgcgtggctgtttgtggtatggttggttcagggaaatcgagttttctttcgtgcatccttggagagattcctaaactttctggtgaagttagagtgtgtggctcttctgcttatgtctcccaatcagcgtggatacaatcaggaactatagaagaaaatatcctctttggaagcccaatggacaaagcaaagtacaagaatgttcttcatgcttgttcactgaaaaaggacctagaacttttctcacatggtgatcagacaattattggggatagaggtataaacctgagtggtggccagaagcagcgggttcagcttgcacgagcactctaccaagatgctgatatttatcttctggatgatcccttcagtgcagttgatgctcacactggatcagacttgtttagggagtatatattgacagcacttgcagataaaacagtcatttttgtgacccatcaagttgaatttcttcccgctgctgatttgattctggtatggctgtacggtttttcttccacattcaagcataatgcagttcttaaagaaggatgcatcatacagtcaggaaagtatgatgatcttttacaagcaggaacagattttaatactctggtttcagctcaccatgaagccatagaggctatggatatccctactcactcctctgaagagtcagatgaaaatttatccctggaggcatctgttatgaccagtaagaaatccatttgttcagcaaatgatatagacagtttagcaaaggaagtgcaagagggatcatctatttcagatcaaaaagcaattaaagagaagaagaagaaagcaaaacgatcgagaaagaaacagcttgttcaggaagaggagaggattagaggtagagtcagcatgaaggtgtatctttcatacatggcagcagcatataaaggcttattgattccactcataatcattgcacaaacattatttcagttccttcagattgcaagcaattggtggatggcttgggctaaccctcaaacagaaggagacctgcccaaagtaactccctcagttcttcttcttgtttatatggcccttgcttttggcagctcatggtttatatttgtaagggctgttctggtggctacatttggtcttgcagctgcccagaagctatttttgaaaatgcttagaagtgttttccatgcaccaatgtctttctttgactctacaccagctggaaggatcttgaatcgggtatcaattgatcaaagtgttgtggatcttgacattccttttagacttggtggatttgcttcaactacaatacagcttattggtattgttggtgtaatgacagaagttacatggcaagttttgctcttagttgtcccaatggctgttgcttgtttgtggatgcagaaatactacatggcttcctcaagggaactggttcgtattgttagcatacagaagtctccaattatacatctttttggtgaatcaattgctggagcatccaccatcaggggttttggacaagaaaaaaggttcatgaagcggaacctctatcttcttgattgctttgcacgaccattcttctgcagtctttctgcaattgagtggctctgcctgcggatggagttactgtcaacctttgtatttgctttctgtatggtattacttgtgagttttcctcgtggaagtatcgaccccagcatggctggacttgctgtgacatatggcctgaatttaaatgcacgcctatcacggtggatactcagcttttgcaagcttgaaaataaaattatatctattgagagaatttatcagtacagccaaattcctagtgaagcacccacaattattgaagattctcgccctccattctcatggccagaaaatgggacaattgaaataattgatttgaaggtccgttacaaggagaatcttcctatggtgcttcatggagtaacatgcacatttccaggtggaaagaagattggaatagttggacgtactggcagtggaaaatctactttaattcaggcgttatttcgattgattgaaccagcaagtgggagtatccttatagacaacattaatatttcagagattggccttcatgaccttcgaagccatctcagtatcatacctcaagatccaaccttatttgaaggtaccattcgaggcaatcttgatcctctggatgagcactcagataaagagatttgggaggcacttgataagtctcagcttggagaggttatccgtgagaaaggacaacagcttgacacaccagttctagaaaatggagataattggagtgtaggacagcgacaacttgttgctctgggccgagctctgctgcagcagtcaagaatacttgtactggatgaagcaacagcatcagttgatactgccacggataatcttatccagaagattatccgaagtgagttcaaagactgcactgtttgcaccattgcacatcgaatacctactgtcattgacagtgatctagttcttgtgctcagtgatggtctagtcgcagagttcgacactccttcaagactattagaggataagtcatccgtgtttctgaagttggtgaccgagtattcatcacgttcaagtggcataccagacttttag

SEQ ID NO: 107730 - DNA, 1098 bp, Glycine max
  Peptide Sequence Number=SeqID_224508
atggaagaagaaagtgcgttgaggccgatggacgctgagcaactgagagagcaggctcataagatggtcgacttcattgccgattactacaaaaccatcgaagacttccccgttctaagccaagttcagccaggttatcttgggaagcttttaccagattctgcacctgattctcctgagtcattgcaaaatgttttggatgatgtgcaggaaaaaatactgccaggggtgacgcactggcaaagcccaaattattttgcgtattttccttccaacagtagcattgctgggtttctaggagagatgctcagtgcgggtcttaacatcgtgggtttcagctggataacttctcctgctgcaactgaacttgagacgattgttctggattggcttgcaaaggctttccagctgcctgattatttctattctagtgggaaaggtggtggagttatacagggaactgcaagtgaagctgtactagttgtcttattagctgcccgtgacaagatcttaaggagggttggaaggaatgcccttcctaagcttgtgatgtatgcatctgatcaaacacactctgctttactaaaagcttgccagatagcaggaattaatccagagctatgcaggttgcttaaaactgattcttccacaaattatgcactttctcctgatgtgctttctgaagcaatttcaaatgacattgctggcggtcttgtaccctttttcttatgtgctactgttggtaccacttcatcaacagctgttgatcctctgcctgcattgggaaaaattgccaagaccaacaaactttggtttcatgtggatgctgcttatgctggaagtgcttgtgtatgtccagagtaccgccactgcattgatggtgttgaagaagccgactcatttaacatgaatgcacataaatggttcctgactaactttgactgttcattactttgggttaaggacagaagttctctgattcaatcattgtctacaaatcctgaatttctgaaaaacaaggcctctcaaggaaacatggtcatagattacaaagattggcaaattcctcttggacgtcgctttaggtggttcttttga

SEQ ID NO: 107731 - DNA, 923 bp, Glycine max
  Peptide Sequence Number=SeqID_224509
atgaagaagagcaagatgaaaatgaaaatccagattttcatattcttctgtttcattagttgtttctcttatggttttgctgctgcttccacaaatgatgaagtttcagctttgctttctataaaagaaggtctcgttgatccattgaatgcccttcaggattggaaactgcatggcaaagcaccaggaacggatgcagctcattgtaactggaccggcatcaaatgcaactcagatggagctgtagagatacttgatctctcccacaagaatctcagtggcagagtatccaatgatatacaaagactcaagagtcttacttctctcaacttgtgttgcaatgccttttcaacaccattgccaaaatccatagccaatctcaccacactcaacagccttgatgtaagccaaaatttcttcattggtaactttccattagcccttggaagagcatggagacttgtggccttaaatgcatccagcaatgagttttcaggttctcttcctgaggaccttgcaaatgcctcttccttggaggtgcttgatcttagaggcagcttctttgtagggtcagttccaaaatcattcagtaacttgcataagttgaagttccttggtctatctgggaacaacctcactggtaaaattcctggagagctgggacaactttcatcactggagtatatgatccttggatataatgaatttgaaggtggaattccagaagagtttggcaacctcaccaatcttaagtatcttgatttggcagtagctaatcttggtggtgagattccaggtggattgggagagctcaagttgttgaatacagttttcttatacaacaacaattttgaaggcagaattccaccagcaattagcaacatgacctctttgcagttgctggatctttcagataacatgtt

SEQ ID NO: 107732 - DNA, 456 bp, Glycine max
  Peptide Sequence Number=SeqID_224510
atgaagaaaccaaagaaaaagagagagagggaattcgcattaccttatggaacagaacagaacagatccaagacggagcttaagcgtcgtcatcacgacaccgctgccattgcgacaccacacgtgacggagctctacggcctgaacatgatggcggacggaatccaagacgatccgagtaatgtcacgcgattcgtgaagctggtgagagagattatcattccgcgcacgaaccatcctttcaagacgagcattatttttgcgcacgacaagggaacttctgtgctcttcaaagtgcttttcacgttcgcgttccgcaacatcaatctaacgaagttctctgttgattttgaggcctccatggctgaggttagggcaatggagaagtgtgagatgaaaagagtggtgggaagggaaaaagggaagatgcttggaggggagctcgagaggctttag

SEQ ID NO: 107733 - DNA, 2430 bp, Glycine max
  Peptide Sequence Number=SeqID_224511
atgggagattattttcataagcttttcaatgatggacaaggttcaggatgcattgaagatgaagaagggaaagttttggtcacaaataaggatatcaaagagagatgggagattattttcagaagcttttcaatgatggacaaggttcaggctatggagggactagaaatccaagaggggggaaatttggattattactacataatttgcattggagagctacaccctcatggcataaccagcacttccttctcctcaaagctcaaatggcacctttcattcatccaacaaaccatttcctctgatgaggacccttcttcgcgccttctctactcgtaccgttctgccatggacggttttgcagctcagttaactgagactgagcttgagtacctcaaaaacttgccagatgttatctcaatcaggccagacagcaagctccagattcagaccacttactcttacaagttcttggggctgaatcctgctagagaaaatggttggtaccaatccggtttcggccgcggaaccataattggtgtgcttgacactggagtgtggccagagagtcctagcttcaatgatcaaggaatgcccccaattccccaaaaatggaagggtatatgccaagctgggaaggcctttaactctaccaattgtaaccgaaaactcatcggtgcaaggtacttcacaaaaggccatttttcagtgtcacctttcagagatcctgagtatctctctccgagagactcctcaggacacggcacgcacaccgcatccaccgcgggaggcgtgcctgttccgctggcgagcgtgttcggttatgcgtctggcgtggcgagaggaatggctcctggtgcccacattgcggtgtacaaagtgtgttggttcaatggctgctataactcagacatcatggctgcaatggatgtggcaatcagggatggtgtggacattctgtccttgtctcttggtggctactctttgcctctatatgatgatagcattgccattggaagctatagagcaatggagcatgggatttcagttatatgtgcagcaggaaacaatggccctacggaaatgtctgttgccaatgaagctccttggatttccacaattggtgcaagcacactagacaggaaattcccagcaacagttcacataggaaatggacaaatgctctatggagaatccatgtatccactgaatcatcatccaatgagcaacggcaaagaaattgagctggtttatttgtctgaaggggacaccgagagccaattttgcctcagagggtctcttccaaaggacaaagttagaggcaaaatggtggtctgcgatcgaggcatcaacggaagagcagaaaagggacaagtggtgaaggaggcgggtggtgtcgctatgatcctcacaaacacggagataaacttgggagaggattcagttgatgttcatgtcttgcctgcaactttggtaggatttgatgaagcagtcaccctgaaggcttacataaactccacaaaaaggcctcttgcaaggatcgaattcggaggaactgtgatagggaagtctagagctccatcagtggcaagattttctgctagaggaccaagctatacaaacccttcaatcctaaaacctgatgttatagctccaggagtgaacatcattgcagcatggcctcagaacctcggtcctaccggccttccggaggatactagaagagttaacttctctgtgatgtccggtacctcaatggcatgccctcatgtcagtggaattgctgctctcattcgctcggttcacccgagatggagccctgcagccatcaaatctgcaatcatgacaacggccgaggtgactgaccacaccggaaggccaatactcgatgaagaccaaccagcgggagttttcgacatgggagccggacatgtgaatccacaaagagcattgaaccctggattggtgtatgacattaggccagatgactacatcacccatctttgcagccttggatacacaaagtcagaaatattcagcatcacacatagaaatgtgagttgcaatgcaatcatgaagatgaatagaggcttcagccttaactatccctcattctcagtaatttttaagggtggggtgaggagaaagatgttcagcaggagactaacaaatgtgggaagtgctaactccatctactcaatggaggttaaggcacctgaaggagtaaaagtgatagtgaaaccaaagaggttggtatttaagcaagtgaatcaaagcttgagttatagggtgtggtttatatcaagaaaaagggttaaaagaggtgatgatttggtgaactatgcagaagggagtttgacatgggtgcactcacaaaatggttcctacagggttagaagcccggtagcagtgacttggaagtcaaagtag

SEQ ID NO: 107734 - DNA, 294 bp, Glycine max
  Peptide Sequence Number=SeqID_224512
atggctagaattttgggatataggagccttccacctaaggcaaagaatttggttgttgggggtttgatagcttttgtctttggtgcctacttttacaccatgagggttgttggaggcactaatgaactgcaggtagcaattgataagtttgaagttgacaagaacaagaatgcgggtgatgccaacatgccatcaaagatattgcctcctgttgatggagttgatagcaccaaacaaaaacatgatgaaaaagaattatcatctcccctgctgaattccttttcaatatcgtga

SEQ ID NO: 107735 - DNA, 1554 bp, Glycine max
  Peptide Sequence Number=SeqID_224513
atgacatcttataacatcctactgaaagcatgctgtgttgctggaagagttgatctgactcaaggcatttatagggaacttaagcatttggaatcagtgggacagctaaaattagatgtccttacctacagcacaattataaaggtctttgcagatgtaaagttgtggcagatggctctaaaaatcaagcaagacatgctgtctgctggtgtttctcttaatattgttgcatggtcatcattaagcaatgcctgcgcacatgcagggcttgtagagcaggcaattcagttatttgaagaaatgcttttggcaggctgtgaacctaatacgcagtgtttcaacatcattttaaatgcatgtgttgaagcttaccaatatgacaggggttttcgctttttccattcttggaagggaaaaaagatgttggggtcatctggtgaaggctacaatagcaatttagggcagggacacatgcataatgttacttctatgccaaatggcatttctaattcacacatcttgagtttttctgagaggttccctttcacaccaactacaacaacatactatatcttgctgaagccctgtggtactgattattaccatgcaaaagcattaataaaagagatggaaacagtaggtctttcccctaatcagataagctggtcaattttgatagatatatgtggagcatcagcaaatgtggagggtgccattgagattttgaaaaccatgggtgatgctggaattaaacctggtgttattgcatatacaacagccatgaaggtttgtgttgaaagtaagaattttatgcaagcattaacattatatgaagaaatgaaatgctacgagatacgtccaagttgggtgacatataacacacttctgaaggcacgcagtaaatacggctccctacacgaggtgcaacaatgcctggctatataccaggatatgcgaaaggcagggtacaaacccaatgactactatctggaagaactgattgaggagtggtgtgaaggagtgatacaagataacagagagaagcaaggagaattttcttccagcaataaatctgaatcagagagaccccatagtttacttcttgaaaaaattgcagcccacctgctaaagagggtggctgacatcctagcaattgatgttcaagggctcacaaaggttgaagctcatttggttgttcttgcagttcttcgaatgatcaaagagaattacagtttaggacattcagtaaatgatgatatcttgatcatcataggagctactaaagtagatgaaaatccatccaaacacatattagaagtgcaagaggcaataataaaacttcttaggaatgagttggagcttgaagtttttccagccagaaccagactagcactatgtgacacagcaaagttagagtaccccaaccgttcaaatctcaacatcgaagcactaccaggagagaatgcattggggtttcagacaaggagacccggagttctagtaaggttgaaggtcacaaaaaaatcattgtacagttggttgcacaggaagtaa

SEQ ID NO: 107736 - DNA, 1140 bp, Glycine max
  Peptide Sequence Number=SeqID_224514
atgggttggattccctgttctggatattctggcactaagaacaaggttgagaagatggaagttcaggatagtctcgttggtcagatcaaagccaccccaggaaagttgaaaaggaattcatccacgaaatccaaagatacatctaaaaatgggaaccctgatcacattgcagcacagacatttgcgttccgtgagttggcaactgcaactagaaattttagaaatgattgtcttttgggagagggaggctttggtagagtatacaaagggcgtttggaaagtattaatcaggttgttgcgattaagcaacttgaccgaaatggactgcaagggaatagggaattccttgttgaagtgttgatgttaagtctacttcaccatcctaaccttgtcaaccttattggttattgtgctgatggagatcaaaggcttctagtttatgaatatatgccattaggatgcttggaagaccacttgcatgacattcctcctggcaagaaacgacttgactggaacacgcggatgaaaatagctgctggggcagcaaagggattggaatatctacatgacaaagctaatcctcctgtcatataccgagacttaaagtgctccaacattttgcttggtgaagggtatcatccaaagttatctgattttggtttggctaaacttggtccagttggggaaaacacccatgtatcaacaagggttatgggcacctatggatattgtgctccagagtatgcaatgactggtcaactgactctgaaatcagatgtttatagctttggagtagttcttctggaaataattaccggaaggaaggcaattgacaattcaaaatctgcaggagagcagaatcttgttgcatgggctagacccttgtttaaagatcgaagaaagttttcacaaatggccgatccaacactccacggtcaatatcctccaagagggctataccaggcccttgctgttgcagcaatgtgtgttcaggaacaggctaacttgcgtccagtcatagccgatgttgtcacagcactgtcttaccttgcttcacaaaaatatgaccccaatacacacacagtccaaagctctcgccatgctcccagtactcctcctagaaccaggagggggatatga

SEQ ID NO: 107737 - DNA, 1101 bp, Glycine max
  Peptide Sequence Number=SeqID_224515
atggttagattctgctggagaccagctgcggtgggtgatgatggagatgtgaatggtcgagttgaagggcttctatggtacaaggatttggggaaccatctttatggagatttctcaatggctgtgattcaagctaatagttcattagaggatcgtagccaacttgaatctggaccattgacttctgactatttgggtcctcaaggaacctttgtaggtgtatatgatggtcatggtggcaccgcagcctcgcagtttgtcagtgacaatcttttctgcaatttcaaagatttggctggtgaacatcaaggcatatcggagaatgttatacaaagtgccttttcagcaacagaagagggttttctgtctgttgtgaggaaacagtggctaagcaagccacagatagcatccgcaggtacatgttgtttggcggggataatttgcaacggcatgctatacgttgcaaatgccggagactcgagggcggtgttggggagagtggagagagcaacaagggaaacaacagctatccaattgtctgcagagcacaacgttaacatccaaactgagagagatgatgttcggaccaagcaccctcatgatccacaaatcgtggttatgaaacacaatgtttggcgtgtgaaaggcatcatacaggtttcaagatccataggtgatgcatatctgaagaaagacgaatttaatagggagcctctaccgaacaagtttagactacctgaacccttcttcaagccaattcttagttatgaaccagcaatatcagtgcataaacttcgccctgaagatcaatttatcatctttgcttctgatggtttatgggagcaactcagcaaccaagaggttgtgaatatagtcagcaacagccctcggaatgtaaggttcctttacctctccattaaaggaattgctaggcggcttgtgaaagcggcgcttcgagtagcggctaggaagagagaaatgagagtctcagaccttcaaaagattgaacaaggagtgaggagacacttccacgatgacattacagttattgttgtatttctaaatcacaaactcattgataatagctctctcttcaattag

SEQ ID NO: 107738 - DNA, 654 bp, Glycine max
  Peptide Sequence Number=SeqID_224516
atggttaaggtaactatagttggaagggtaagcgatggattacctctagcacaaggattgagatatatgaatgaagagaatggatatctttcatgttacaggcaacaagcagagttcatactccaagaattttcaaggggagcattaacagcttccaagatgactattcatattgataatttctgctttaactacttggtcgagaatggagttgttttcattgtgttgtgtgagttcacgtacccaagaaaactggccttccattacctacaagatatacaaaaggaatttgagaagtttgataaaaccctcataggcaaaatcacaaggccatacagctttgtcaaatttgatggtataattgcaaacattagcagacaatacatcgatacaagaactcaggccaacctatcaaaacttaatgctaaccggaaacaagatttagacattgccactgaagacatttacaacattttagaaaggaagagaaattcagaaacaatgagaagctcaccggttactcttctgcctgaatccacaatatggtgttccccacgccttgaggtgattgcgttgaaatggacacctgttatgatcattgtcattacttctatggctcttctatgggctagcttagccgactttattgtttaa

SEQ ID NO: 107739 - DNA, 1371 bp, Glycine max
  Peptide Sequence Number=SeqID_224517
atgatttggacatgtacacagaaggccctggtgagaagagtagattgtagggtttttaatcctatgaagagaaggagaggagtgccaagaactacattgaagaacgtggtcaagagggatctcatgaatggtctttttaacaatgttgttgtcaaaccaaatttacctcactgtgtagttcaaagggttactaaagaggagaaaggatacgaacttgactttcatgcgagcgagacgatccgcgacggaggtatccttctccatcttgggctccttcgtgccgaacgtgtagctggacaacggttatcaactgatgtaaaggttccttcaaactggatcaaggtaaatagcacaaagaaaacaattcggtatcaccctcctaaagtagtgacagcattagacaagttatcattagcagaagaggagctcactgttgcctgccgagctgcctggaatagctttcttagggacttcagtaaacactatgctgagttccaagctgctgttcaagcactagctgccttagattgtctgcattcatttgccattctttcaagaaataagggttatgttcgcccagtgtttgtagatgatcatgagcctgttcaaatacaaatttgttctggtagacatctggttttaaagactaccttacaagacaattttgtcccaaatgatacaaacatgcatgcagatggagagaactgtcagattgttactggacccaatatggggggaaaaagttgctacattcgccaggtggctctgattgctataatggctcaggttggttcctttgtaccagcatcatcagcaaaacttcatgtcctggatagaatctacacccggatgggtgcttctgacagtattcagcaagggagaagcaccttcctagaagaattaagtgagacttcacatatactccatagctgcacagaacattcactggttgtcatagatgagcttgggagaggtacaagtacacatgatggtatggccattgctcatgcgacgttattgccagtctggcaactgaatttcctggctctggcagcgtatcacgtgtcacatctgacctcacacgatgcaagtaaaaattccaacttggatcatgatatcacttatctatacaagctagtacctggtgtttcagagaggagttttggatttaaggttgcccagcttgcacagttaccatcacattgcataagtcgagctattgtcatggcttctaaattagaagcactagtaaacagtagaatacatggtagatcaagaaaggagctgttattggacacgctggtgattgatcaagaaaaagaacagcttatggctcaaccgcatgatcatccacataaagagaaagtatag

SEQ ID NO: 107740 - DNA, 1347 bp, Glycine max
  Peptide Sequence Number=SeqID_224518
atggatatcaaggaagcacaaagggtggtcatttccaaaccagttgcttcaaggccaacttgttctactttcaaatctttctcagagctcctagcaggtgcaatcaatgtttctcccgctattgaatcttctccaactacagtttctgccattagaccaaagacagtgaggttcaagccagcaatgaatcaaccccctgctgggtttgtttcttctcaggctgatacttttggagctgcactcgataattcttctgacatgagtcctaaacttgacaccaaacagtccctcatatacaagccaacagcaaaactcgtgtcaaagacaactgtgtctcttttggcaaatatgggaaattgcagtactaacacgagctcgaatctcgatcagagtattaccccgcaaacagaaacaaattatcagagcagtgaacctagtaagatggtgcagcagaacatagaggaggaccaaaaagctttaacatcctcagtgaattgtgatcgaccttcttatgatggatacaattggaggaaatatggtcagaagcaagtgaaagggagcgagtacccgcgaagttattacaagtgcacacatcctaattgtccagtgaaaaagaaggttgaaagatcatttgatgggaatattgcagaaattgtttataaaggtgaacacaaccattcgaagccacagcttcataagcgaaactcagcagcagggacacaaggatcaggggttatgtctgatggaatggttcaagatatgtggagtaatagtcacagtgagaggaacgaaggcaatgaagttagaattgagaacacaggattgtctatgcattcagattattatgtcaaagttccacagcctaatgattcttcattaaatattggtgcaactaatgctggtggaggaagcatggaaaactcttgtggtctaagtggggaatatgaggaaggaagcaagggatttgaggcacaggaagatgaacacagaagtaaaagaaggaaaaatgagaatcaatccaatgaagcagcattatcagaggaaggtttagtagagccgcggattgtgatgcaaagttttacggattctgaagttcttggagatggctttcgctggaggaaatatgggcagaaggtggtgaaaggcaatccataccccagaagttactttagatgtactaatatcatgtgtaacgttcgcaaacacgtggagagagcaatagatgacccgagatcatttgtgactacatatgagggaaagcacaatcatgagatgccactcaagaacacaggaactgtagcatctgaaagagattcacaggcttctcttagtaaagataaaccatga

SEQ ID NO: 107741 - DNA, 192 bp, Glycine max
  Peptide Sequence Number=SeqID_224519
atggggtggggttttgctgcatcgcagctggccgagctggttggctcaagtgtttgcaagccagaatacatggaatttgtgatggggtggggttttgctacatcgcagctggccgagctggttggcttaagtgtttgtgagccaggcacagtaccagctcttgactgctcaagtttttgtggtgcaagatag

SEQ ID NO: 107742 - DNA, 297 bp, Glycine max
  Peptide Sequence Number=SeqID_224520
atgccgccgaagcagcaatcaaaagctgatcttgcgaagaagcagaagatcgtagaggacaaaaccttcggtctcaaaaacaagaacaagagcaaaaatgtccagaaatacgtccaaaacctcaagcaatccgtgcaaccaaatcccgactcttcaaaactcgctgccaagaaaaagaaggaggaagagaaggccaaggataaggagttaaatgatttgttcaaaattgctgttagtcagcctaaggtgccagttggtaatatcatctcagtttcattgtggggaactgatatgtga

SEQ ID NO: 107743 - DNA, 294 bp, Glycine max
  Peptide Sequence Number=SeqID_224521
atggatgcatctggtgtggcacttgtattgattggacctgggagcattgatcaggccaaatccttttctgagaaatcaaaatttgaaggagctgttacaccgcaggcaggtcttaagataatacagctatatctggaaggttatcgacaacattggaagctttcatttgaaaaggatacagttagcagaggaggctggaaacaaggaggaactatagttgcaggccccgagcaggacaaagaagcaggggatgacccagaaattgaagatatcttcaaagcatgttgctcgtga

SEQ ID NO: 107744 - DNA, 597 bp, Glycine max
  Peptide Sequence Number=SeqID_224522
atggtgtaccttaattttgtatctgtttatcggaagctgctatcagaaattgttaatcaaggaaaattggtgtcagatgaaatcatcataagtttattgtcaaagaggctggctgatggggaagctaaaggagaatcgggatttattcttgatggttttccacgaacaataaagcaagcggaaatattggaaggggtaactgacattgacctggtggtcaatctgaagctccaagaagaagcactgcttgcaaaatgccttggtagaagaatttgcaatcaatgtggaggaaattttaatattgcctccattagcgtcaagggtgagaatgggcgtcctggaatggtcatggctccacttcttcctcctgcacactgtatgtcaaagctcattgctcggtcagatgatactgaatcagtagtcaaagaaaggcttcgtatatacaatgaaaagagtcagcctgtggagggattttaccgtagtagagggaaactgttggagtttgaactgccaggaggtatcccagaatcttggcctaagttgctgcaagctcttaatcttgatgattatgaggagaagcaatctgctgcagcataa

SEQ ID NO: 107745 - DNA, 1650 bp, Glycine max
  Peptide Sequence Number=SeqID_224523
atggcagtagcagcagctcgccctatcgtctccgtccaaaccctagagggcgatgcaacccctaccgttcctcttcccgacgtcatgaaagcctccattcggcctgacatcgtcaatttcgtccactccaacatttctcgcaacagccgccaaccctacgccgtcagcaagcgcgccggccaccaaacctccgccgagtcctggggcaccggccgcgccgtctcgcgtatcccgcgagtccccggcggtggtacccaccgcgccggccagggcaccttcggaaacatgtgccgtggcggccgcatgtttgctcccaccaagatctggcgccgctggcaccgcaagatcaacgttcaacagaagcgccacgccgtcgtctccgccatcgccgcctccgcaatcccctcgctcgtccaggctcgcggccaccgcatcgagtccgtcccggaactccccctcgtcgtcagcgacactgtcgaaagcgtcgagaaatccaaagaagccgtcaaaattctccagaaaatcggcgcattcacagacgcggagaaagctaaactcagccacggaattcgtcccgggaagggaaaaatgaggaaccgcaggtatatctctggcaagggtcctcttatagtgtacggaacagaaggtgctaaggccattaaagccttcaggaacattcccggtgtagaggtggcaaacgttgataggctcaaccttctgaagctggcacccggtggccaccttggaaggttcattatttggaccaagtccgcatttgagaaattggactctatctatggatccttcgataaggcctccgagaagaaaaatggctacttgcttcccaggcccaagatgatcaactctgacttggcccgtatcattaactccgacgaggtccagtccgtggtcaggcccattaagaaagatgttaagagagcacctctcaagaagaaccctctcacgaacctcaatgcgatgttgaagctcaatccctatgctaagaccgctaagagaatggctcttctcgctgagaagcagcgcattgtggctaagaaggagaagcttcataagaagcgcaacattgtctccaaggaggaggcttctgctatcaaagctgctggaaaatctgttgtcttagagagaaaaaggttttattttttcactttcttcttgcatagtctttttgcagtagcatcctattttatcaaaatgtccgccatggatatgattaagtccctttccagtaagcctgaaaaatttatgggtgaaatttttttctgttggcaacaacaaatgaaattctggcttactgaattggatttatactctgtgatttctaaaagagaaataaaaacttcaacttcctctactgatatagttcaaactgatgcaactattaagcatgatgtttctgataaagatattttatgtcatggacgcattttaagtgctttggctgataacatatataagattttttgccataccaaaacttctgttgagttatgggaagcacttgaattgaaatatggatctgctgaaaaaggtttaagtcgttactcttgtgaaaaaatgattgagtttcaaatgattgatggaaaatctatttcagatcagatccatgaatttgaaaacattattttatga

SEQ ID NO: 107746 - DNA, 1161 bp, Glycine max
  Peptide Sequence Number=SeqID_224524
atggcaatggtgggtctggaaagaaggttagaaagccttatactattaccaagtcaagggagagctggtccgaggaagaacacgacaagtttctcgaagctcttcaactatttgacagagattggaagaaaattgaagattttgttggttcaaaaacagttattcaggttaggaaacagctcttcagctaggtgttctaatttctatcttctgttatgccattatgttgtatctctcacagtctcactattaagttgtcttcagatcagaagtcatgcccagaagtacttcttgaaagttcaaaagaacggggcagtagcacacgtgcctcctcctcggcctaagcgcaaagcttctcatccttatccacaaaaggcatccaaaaatgttttgttgccattgccagcttccatggtttatgtttcttccactagtgcccttccacctgggtatgtcacatgggatgaaaattccttgctcatgaattctggatccaacaaatcagtgccttctgatattggatcaaaggggataacacgaattggtcacagcagtcttagtggtgttgggaactctactagaaatctgcctgctactgagatggcaaaacaagggaaacaggctcaggtgattcatggtttgccagattttgctgaagtttacagcttcattggaagtgtttttgatccagacacaaaaggtcatgtccagaagctgaaggaaatggatcctataaattttgaaactggcgtggctccttttggttccgttttccaagaaaccattaaaaaaacttcgtaccccattgcccggaggttcttcgctctgcgaaggtatgggagagggatgttgtacgcagccttacccttgcatatgcaaggaggctgtttccggattcgaacccatgaccaacaagtcatcaaggcacaactttaccgctgcaccagggttcgtcctctttccaagaaaccattgaaaaaaataaaagttcttttggttttgttgttaatgaaaaacctcactgtcaatttgtctagtcctgactttgagccagttaggaaggccatgtcatcatacgatgtcaatacaaatacagtaggagttaccgcaggaatcgacgtcaagaagcagacaaatgatctatcatgtcaaacagcttga

SEQ ID NO: 107747 - DNA, 669 bp, Glycine max
  Peptide Sequence Number=SeqID_224525
atggaggattgggatcaagagaccttggagaaggtagtagagtcgaagaaaaccgagtataatcagaacaaaccaactgacatagtctgtaaatactttttggacgcagtggagaagaagcaatatggttggttctgggtctgccccaatggtggtaagaattgccactatagacatgcccttccccctggatacgttttaaaatctcaaatgaaggctctattagaggaggaatctgaaaaaataacaatagaggaggagattgaaaatcagcgcgccaaagtgacaactacaactcctatgactcctgagttattcatgcaatggaagaaaaagaagatagaagaaagagatgccaatttggctgcacaacaggcagaaagagctaagaatgatcgcatgagtggtcgtgagctatttttgtcagatgctagcttgtttgtggatgatgatgaagcatacgacaagtaccaaagagaaccagaatctgaatctggcgacactgaacagaatgcgaatggtaatgctactgaagatggtcccagcaccttgatagctagtgctgatgttgatgatgacgacgaactggacatggacgagttggatgaattagaagcaagcttatcaaagacatcaatacaaataaaggagttaggagctgaaacttaa

SEQ ID NO: 107748 - DNA, 258 bp, Glycine max
  Peptide Sequence Number=SeqID_224526
atgtgtgtgaatagtcaaagtaaggctacggggaaccaaatattcttgcatgtggtggtagttgccaaggcaaccctgggcaagctgggtttggagggtggttgcgtgactcaaagggtggtgaagataaaggatttctttgcgaagttcaggtgttattctcacagagatagatgttcctcctatggagttgattgcaatagatgctttgggcaccaaggttatcactatgactcgacaatttacgtaaatttgtaa

SEQ ID NO: 107749 - DNA, 590 bp, Glycine max
  Peptide Sequence Number=SeqID_224527
gaggtccctacatcttacgtacatttccctttgtacagattcatccagttcttattgttattggcttactagttcatgggggtgaagctattataagttacaaagcttttcccctaaagaaggaagtgaagaaattgatacaccttgttttccatgccatcgcattaatacttggaatagttggaatttatactgccttcaagtttcacaatgaaagtgggattgccaatctctacagcttgcattcatggcttggaattggggttattgtcctttatggcattcagtggatatatgggtttgtgatctttttcttccctggtgggactccagacattagacgcgcctcacttccttggcacgcgctatttgggctgtttgtatttgtcttggctgtgggcactgctgctcttgggtttctggagaagctcactttccttgagaactcaggattggacaaatatggttctgaggctttgcttgtcaacttcactgccattatcacaatcttatttggtgcctttgttgtgttatctgctctagctgatgctcccccagcccctgcagcagatgactatgaagccatatag

SEQ ID NO: 107750 - DNA, 147 bp, Glycine max
  Peptide Sequence Number=SeqID_224528
atggccactgatggaatacaagtgacccatgaggccatgacctatttatcgacgctatccattatttattctcatctggcatcattgcccatggaaggtggctatgagcctacgttgacgatggctccacctccattcgaccagtag

SEQ ID NO: 107751 - DNA, 393 bp, Glycine max
  Peptide Sequence Number=SeqID_224529
atggaaggtgttgtcactcatgatggagatatatttaagctaactattgaaaataactcctattggaagccgatgatggaagaccatttatattgcaaagatttgcatgagccaaaggggaagatcaatgacaaagagttggtaaagttggagtacaaagatggccatagcatgattgagcacttaaacattttcaaggggcttgtgaatcaattgacgaagattgacatgaggattgatgatgaattgcaagctcttctacttcttagttccctaccggagagttgggacacattagtagttactctaagtaactcaacccctaaagggaagctcaccatggatatcgtcattgatagcttgttgaatgaagaagctaggaggaaggaatga

SEQ ID NO: 107752 - DNA, 207 bp, Glycine max
  Peptide Sequence Number=SeqID_224530
atggctttaggtgttcctgctcttccgttgacatacgtggctcacgttctggcagttgttgccagcgtcttggtcgtggtctgggtcgtcaatttcaggggtggcttggcttgggattctgataacaagtccctcatcttcaaccttattgctcaataccacaaactaacgcctggccctaactgtaagccgccttttgctgtttag

SEQ ID NO: 107753 - DNA, 1941 bp, Glycine max
  Peptide Sequence Number=SeqID_224531
atggcaacagatcaagatgacgatgtattcctcattggagaagataactatcttaatgttgcttgtgatgattgttcatggattgttgactcaagtgcgcctttccacgttagcctacatggaggatttttctcaacctatcaaagtggtgactttggtacggtaaaaatgggaaattgtgtcacatgcaaaatagtaagcattggtgacatcacttcaatgatcgacacagggcatgagctcgtgttgaaggaggtgagacacgtatctgacatacgtctcaaccttatctcaatcgggaaacttgatgatgttgggttggtcaatcactttgccaatgttgcccatggtgactcaaccatgaagttgtggcataaacgacttggccatatgagcaagaagggattacagatccttgctaggaaaaaccatcttcctaatggaaaagacgtttgctcaatgtctgaaaaatgccttggagcattcaaggaacgtgagaccgagagaaaattgaaatgtgtgcgagttgataatggtggagagtattgtggcccttttgaagcatattgcaagacatatggaattaaacttgagaagacatcgccaaagacacaacaattaaatgctgtgaagaccgttgtggatgttatcaatctatcattggcaagtcctttggatggagatatcctagaggaaatttggtcaggaaagagggtgtcatacaactacttgaaggaccagagcattgaagatttgaagcagtcaaagaaacctaaatgtagggttaactttgatcatgactcattccccacggcacacgatgttttaagggaacaagttgtagagataaatcaaaatgaagttgattatgggttcgaacacaacgaggcctctatggagcaatcaatagagacaaataatacagaacctattaaggcaaaagagagccttaaagttatgaagaagctatggccaacaatgatagagaagaatgggctcaaaattgaggagaatagctcgagaccaaggtataaggctcgaattgatgtcaaaggatgcaatcagaaaaagggcattgattttgaagaaatattttctcttgtggtgaagatgtcatccattatagttgtcttgcgtatagctgcaagcctagactatgagatcaaacaacttgacgtcaagacaaccttcttatatggagatttagaagaaaagttttatatggagcaacctaagggatttgaagttttgggtaaagaaaacttagtgcatgttagtggtgattttgtcatacttatgcttaatgttgatgatatgttaatcgttgggcatgataaaaagaaaatagttgcccttaaattggagttgagtaaatccttcgctatgaaatacttgggaccaacaaagaaaatccttgcgatgaagatcactcgagatcaatctaagagattattgtggctatctcgggaagaatacattgagaaaattcttgatagatttaatatgtacaaggccaagccagttagcattccacttgtcggacaatttaagttgagcaaaaaacaaagtccaacaagtgagggagacaaagaagaaatgaaaaatgttccttattcatatgttgttggtagtctcatgtatgctatgatatgtacaagatctgatattgcttatgcagtcagtgttgtgagtcgattcttgaaagtctgtgttagaaggatacacaaatgtggaatgattggagatgttgattctagaaaatcgacattcggatatctaactacttttgcaaggggagctatgtcatggcaagccaaacttcaaaagtgtatgcctctatcaattaccaaggctgaatatattgcagctactgaagcgtgcaaaaagatgttgtggatggagatttttcttcatcagttgtgccatgaacaacaaaattag

SEQ ID NO: 107754 - DNA, 2292 bp, Glycine max
  Peptide Sequence Number=SeqID_224532
atgttcaagtcatggagcaagaagaacaagatcaaagctctattcaaattggattttcaggcaactcaggtgccaaagatgaaaaagaatgcaataatggtgtctttggtgccagatgatgttgggaaaccaacagtgaaactagagaaaactgctgtccaagatgggacctgctcatgggaaaatccagtgtttgaaccagttaaacttgttagggattcaaaatcaggaaaagttcatgagaaaatctaccattttattgtttcaactgggtcttcaaaatctggctttcttggggaagcctcaattgattttgcggattttgttgcagaaactgagccaatgactatttctctacccctaaagtttgccaattcaggcatagttctacatgtgactattcagaacgtggaaggatatgctgctgaaagaaatggggaagataatgaagctgagggactttgcagtgaaggaaacttgaaacaccagctgagctatggcagtacggatcatgaaagttataatgttgatgaaaatgggcacacggcaaggactagatctgagtattctgagcaagatgcatctaatggcatcagtcctggtgtagcttcatgggaggatccttatagcttcagacaaaattcaattccatcaagaggaactgttaaggccactgcaaccgaaacccaagtgcataagaggtcaaacacaaactggtcaactggttcagcatcagatggaagtttaggtgactggactaacagcctggaagataatcttccaagagaaagattacaggagccttcaaataatgccactgaaagcctcaaaagtgaaattacttctttaaagaggcaggcagaagtatcagaaatagagttgcaatcacttcgaaggcaggtagaaaaagaaagcagtaggggacagaatttgtcaagacaaataattagtctcagagaggagagagatttgctcaagaccaagtatgagcaactcaagtcccagcagaacttcaataatgagagcaaaaccactaaaaccttgaagtctgagattgaagatactaggcttcagttagaggcaataaaggatgagcttgtttatgaaaaagatatgaaggccaatctccaattgcaattgcggaagacacaaaactcgaactctgaattacttttggctgtgacagaccttgaagcaatgctggaacaaaagaataatgaaatattggatctgtctaccaatacaaaatcccagaagattactaaagagcatgatgatgccacagaattagatcgcttgcggcaaaaaattgcagaccaggatgaagaaatagacaattactacaagcaacatgaagagctaagtgagcaaataaaagaactcactttggagtatgatcttcttaagaaggaaaatgtggatatctctttaaggttaaagcaagatgaagcacaacacatcaagttacagaatgaacattcatcttgtttagttacaatacaacaacttgaatctcaagtagagagattagatgaaaggctaaaggtgcaggaagaggaattttcagcatctctggtctgtatcaaggaacttgaaaatgaagtcaagtctttggagaaagaactgaaactacaggcagatcaatttgaagaagatctccatgctatgcaatgtgcaaaaactgagcaggaagaacgggccatccaagcagaagaggccttgagaaagataagacacaataatgttgtcgcatctgagcgttttgaggaggaatatagattgctttctgttgaaatgtcacaaaaagttgaagagaatgaaaagatgactatgaaagcagttgcggaagctgatgcgttgcggcaccagaacaaacttatagaagaaatgctccataaatgcaatgaagagctcaggcttatcacagatcagaatgaattgaaaatgaaagagcttttgaaccaaatagattctaaagccgaaacaatagaacagatgtcacaagaactagaagttaagtcgaaacaacttgaggatgcacagaggcaaaaggatgaaaaggatgcttcattttcaaagcaaattcaaatgctgagatctcaaattaagatgttgatggcagagggtgcattgtctgaaacaaacctaacaaagaacacgactgagacccagaaaggagaacgacttatgataccaaatgatgaggagaagatacttggaaccctactgtcagaagtagaaacctttaagaatcagcacaatgaaataaaacaaagtttgcgcaaagaacaa

SEQ ID NO: 107755 - DNA, 2931 bp, Glycine max
  Peptide Sequence Number=SeqID_224533
atggagagtatcttactcttcttctcatcattcaagttcgcactctcgctctcactcatactccactcacctttttcctctgctcagatcatgcaaggttttgtaagtttggactgtggaggtacagaaaaatttgctgatgaaattggtcttcattggactcctgatgataaacttacttatggacaaataagcactatatcagttgtaaatgagacaaggaagcaatatacaacacttcgacactttcccgctgattccaggaaatactgttatactcttgaagttgttagcaggacgagatacctattgagggccagcttcttatacgggaactttgacgataacaatgtttatccaaaatttgacatttctattgggcctacgcattggtctactattgttatatctgatgctaatagcatagaaatgcgagagcttatatttttggcttcaagtcctacagtaagtgtatgcttatcgaatgcaacaacaggacaaccattcatatctacgctagaacttcggcaattcaacggttcagtttactatacacaatttgaggaacacttttatcttagtgtctctgcaaggataaattttggtgcagagagtgatgctccaattaggtatcctgatgacccttttgatagaatttgggagtcagattctgtgaagaaagctaattatcttgttgatgttgctgctggaactgagaaaatttctacaacagtaccaatcgatgtcaacagagatgaaatgcctccggtaaaagtgatgcaaacagctgtagtgggtactaatggatctctaacttaccggttgaacttggatggttttccgggtactggttgggcattcacctattttgcagagattgaagatttggatcccaatgaatctagaaaattcaggctagtacttccgggtcagccagatattagcaaggctgttgtaaatattgaagaaaatgctcaagggaaatatcgtctttatgaaccaggatttaccaatatatctttaccctttgtgctttcttttagatttggcaagacatatgattcttctaggggacctctccttaatgccatggagataaacatgtatttggagaaaaatgatggttctctagatggagcaactatttccaatatactttcacactactctgcagaagactgggcccaagaaggtggtgatccatgtttgcctgttccatggtcatgggttcgatgtaactctgatccacaaccaagaatagtttcaatattgttatccaataaaaacttgactggaaatattcctatggatatcaccaagttggttggtttggttgaactatggcttgatggaaatatgttgactggtccatttccagattttactggatgcatggacttaaagatcattcatcttgaaaacaatcaattgacaggcgtgctcccaacctctttgacaaaccttcctagcttgagagaactccaacatgagactaaagtaggtgtagcggagatgaggatgttgcggtggatgtgtggtaagactcgacaggataaaattagaaacggagctattagagagagggttagagtagcgcctattgtagagaagatgatggaaaatagacttaggtggtttgggcatgtagagagaagaccggtagactctatagtgaggagagtagaccagatggagagaaggcaaacaattcgaggcagaggaagacccaaaaagtctataagagaggttatcaagaaggatctcgaacttaatgatttggatagaattggagcttctgttctacttttggctactattatatcttgcttgtatatgcgtaaagggaagagaagatatcatgagcaagatcgcattgattctctccctactcaaaggctggcttcttggaagagcgatgatcctgcagaagctgctcactgcttcagttttccggaaattgaaaatgctacaaataactttgagacaaaaattggttctggtggttttggaattgtatactatggcaagctaaaagatggaaaagagatagcagttaaagttttaaccagtaattcctatcaaggcaagcgagagttctccaacgaggttacccttctttcaagaatacatcacagaaatttggtacagctgcttgggtattgccgagatgaagagagtagtatgcttgtttatgagttcatgcataatggcactctcaaggaacatctttatgtgcatggacggagtatcaattggattaagcgcctagagattgcagaagatgctgccaaaggttgcattcctgtcgttatccatagagacttaaaaagcagcaatattcttctcgacaagcacatgagagccaaggtttcagattttggtctttcaaaacttgctgttgatggagtttcccatgtttcaagcatagttcgggggacagtaggatatttggatcctgagtactatatttcccagcagctgactgacaagagtgatgtttatagttttggtgtaattcttcttgaactcatatctggtcaagaagcaatatcgaatgaaagctttggtgtaaattgccgaaacatagtccaatgggcaaaattacacattgagagtggagatatacagggtattatcgaccccttgctgcggaatgactatgaccttcaatcgatgtggaaaatagcagagaaagcattgatgtgtgttcagccccacggacatatgcggccaacgatttcagaagttataaaggagatccaagatgcaatatctattgagagacaggcagaagcattaagagaaggcaattcagatgacatgtcaaaacattcttttcattcttccatgaacatggggtcaatggatctaggtggagctgagagttacctgtcaattgatgaatcaattgcacagcccacagcaagatag

SEQ ID NO: 107756 - DNA, 393 bp, Glycine max
  Peptide Sequence Number=SeqID_224534
atgactaataggtgggagaaaaaaccaatttcaaatagagaaacggtgaagctgccactgcttggtagaatagcagaaatgactcgcaggggatcaatgctggcaacacatgtgcttatgaggtttgggaaggacccaaatactgcaaaagctcaaggtgtggaaactttgtctccatgccaatctcatatgccactatctcccttgcctcaaaagtttgaggtgttatgggtcgttttgggtgacaaagaactgcaatattcaaagcaaagaacaaagatcatatttgtaagatttaaagtatccataacgactggtggcaatatcttggtatctaaagaaccttttggccgttgggatgcgttgtgcaataaatttatgacgataaaataa

SEQ ID NO: 107757 - DNA, 99 bp, Glycine max
  Peptide Sequence Number=SeqID_224535
atgagggtaagactgcgcaacgtgactggtttcctgggtatttatagaggaggacgaagtgtaatcgattacaaggtatggctgcctattcttgtgtaa

SEQ ID NO: 107758 - DNA, 177 bp, Glycine max
  Peptide Sequence Number=SeqID_224536
atggagttttgtaggaaaaaacccatatggattggtaatccgtatgacccatacggattaaggttcatacatatcagtgatccatatgaaccatacagattagcaatccatatgaatgatccgtacgatttatacagattgttgatcgatatgtgtagataccatacagattgttga

SEQ ID NO: 107759 - DNA, 246 bp, Glycine max
  Peptide Sequence Number=SeqID_224537
atgcctgtagaccctcctacaccagtgcatgaaatgccagtagaccctcctaccccagtacttgagatacaagaggaacctgccacaccagtactgagactgactattactcctccagtcactccttatgcatgtcctaaagcatactgtcgcaacctacccttcggcgggagggcgacgcgtgactcgcgggatgcgtgttccaagaaaggaatacgcgcggagtcgccaccaacgtttatttga

SEQ ID NO: 107760 - DNA, 135 bp, Glycine max
  Peptide Sequence Number=SeqID_224538
cacagtctaacgacggtgttgaaggttacgaggctttgcccatggaagagttgggataggctactaaagaataaagagaaggtggaaaaacacattaaagttgtgatttttatctcaaaaacttcatgggttcag

SEQ ID NO: 107761 - DNA, 695 bp, Glycine max
  Peptide Sequence Number=SeqID_224539
gttttgtggggttctcccaaaaagtttttccaagcttaagcttctttatgaggcagacatcagcaacaatcgctttgttgggcgattccctgagcctgtgcttccaattccagaccttaaattccttgaccttaggttcaataactttgaaggggaactaccttctgagcttttcaacaaaagcctcgacgctatctttttgaacaataatcgcttcacgtccacaattcctcagaacctgggatcttctccagcttcagttgtggtttttgccaataacaatctcacgggttgcgtgccttcaagcattggcaacatgacaaagacactgaacgagtttgttttgaccaataacaacctcactggttgcttgccggcagagatcggaaagctcgaaaaagttactgtgtttgacataagccaaaacaattttgttggcatgttgccaaggaccttaaatgggcttaagagcgtggagcacttatccattgaacacaataagctcacaggttttgtcccacgtaatgtttgcagcttgtccaatttggtcaacttcacattctcttataactatttcaatggtgaggaagaaggttgtgtgcctcctaagaaggatgttgtgttggatgatgagagcaattgcataccggataggccaaaacaaaaggtcgcaaacatttgcaatgtggtgataa

SEQ ID NO: 107762 - DNA, 213 bp, Glycine max
  Peptide Sequence Number=SeqID_224540
atggggtcatcgaaaagacaagttgagctgtggcaggttttgtggggagctgtgattttttgtgtatggaggaagaggaatgcagcaatatttaagcaggaagtggtgacagtttttgatattatgtgcgtctgggggacgcttttatacgtgatcctgcatgaccagaggaagtggtgtggtgtttgctggctggaagtggaatttctatga

SEQ ID NO: 107763 - DNA, 1032 bp, Glycine max
  Peptide Sequence Number=SeqID_224541
gtgtttgtggcagcctttagaaacagaaaacttctgattccagataatacagacgagctgcatgagattcatgaaaagcaaggaggagactattatgaaattattaaaagcacggatcaattcagaaacactgttttatcagttcctcatttggttttcttggaacaatggcttcccagattcttggaccgggcagcaattgctagaagcagcacaggtgcaagaacaacctcaggcccctggagactttgcacagtgacacaagtggaagaaacaaaaatcttagtccgcatgctaccaataatactcagcaccatatttatgaacacttgtttggctcaacttcagactttcactatacaacaaagcaccaccatggacaccaacctaggggggtttaaagtgccaggaccctctgtaccagtcatccctttgctgttcatgtttgtcctaatccctttatacgaccgtgttttcgtcccgcttgctcgaagaatcacagggattcccaccggaattcgacaccttcagaggattggaattggtttggttttgtctgctgtttccatggcagtggctggttttgtggaaacacgccgcaagtctgtggccatacaacacaacatggtggatagcactgagcctttgccaataagtgtgttctggctgggtttccaatatgctatttttggagctgcagacatgtttaccctgatagggcttttggagtttttctatgcagaaagttcagcaggaatgaagtcacttggcactgcaatctcgtggagttccgttgcattcggttactttacaagcacggtggtcgttgaggtggttaacaaagtgagtggaggctggctggctagtaacaacttgaatagagacaacctcaactacttctactggttattgtctgtgttaagcgttgtaaactttggattctatttggtttgtgcttcttggtatagatacaaaacggtggaaaacgagcaaggtgattcaaaagataatgttgacatggccaaggtttag

SEQ ID NO: 107764 - DNA, 291 bp, Glycine max
  Peptide Sequence Number=SeqID_224542
atggatagaggaagcacggctgcaaaaccaggggatctccatcaatacaccctcttcgaaataagtgagacaacttggcatgatgagaaaagatgcacagctgactcctctgcaagcttacaaagaggacatagtaaatcgttttgttatatgacattcctcctcctcaagttatctttagttgctagcctattcctcaaaagcttccaaataagctgtaagaaagtctcctttggttcttggacattagcttctaaagacaacaaagagtatgctgactttgttgtataa

SEQ ID NO: 107765 - DNA, 2163 bp, Glycine max
  Peptide Sequence Number=SeqID_224543
atgttgtcagggaaaattccagctgaaataagtcagctgaagaatttgaaacttctcaactttatgggaaacaagctgtctggtcctgtgcctcctggctttggagatttgccacaactagaagtacttgagctttggaacaattccttgtcagggccattgcctagtaaccttggcaagaattcacatttgcaatggttggacgtgtcgtccaattcactctctggagagattccagaaactctttgcagccagggcaatctcaccaagcttatactattcaacaatgcattcactggttcaattccatcaagcctatcaatgtgtccttcgcttgttcgtgttcgaattcagaacaattttctttctgggacagttcctgtgggtcttgggaagcttgggaagcttcaaaggttagaattagctaacaatagtctttctggtggaattccagatgacatatcctcttccacgtctctttccttcattgatctctcaagaaacaagctccattcttctcttccttccactgtcctttctattccaaatctgcaagctttcatggtctccaacaacaacttggaaggtgaaatcccagaccaattccaggactgtccatcacttgcagttcttgatctctcatcaaatcatctatctggaagcattccagcaagcattgcttcatgtcagaagttggtaaatttgaacctccaaaacaaccaattgactggtgaaatcccaaaagcattgggtaagatgcctacattggccatgcttgatctttccaacaattctctgacaggccaaatacctgaaagctttggaatttctccggctctggaagcactcaatgtctcattcaataagctagaaggtccagtcccagcaaatggaatactaagaactataaacccaaatgatcttctaggtaatactggcctatgtggtggtatcctccctccatgtgaccaaaactctccatactcttcaaggcatggaagcttgcatgcaaagcacattattacagcatggatcgctggaatatctacaatcctcgtcatcgggattgcaattgtggtagcaagatctttgtacataaggtggtacaccgacgggttttgtttccgagaaagattttacaagggtagcaaagggtggccatggagattggtggcatttcagaggcttggttttacaagtactgacattctagcttgcatcaaggaaaccaatgtgattggcatgggagccacaggggttgtttacaaagctgagataccacaatcaaacacaactgtggcagtgaaaaaattgtggagaacaggaactgatattgaagtaggaagcagtgatgaccttgttggagaggtgaatgttttagggaggctaaggcataggaacattgttagactattaggatttattcacaatgacattgatgtgatgatagtttatgaattcatgcacaatggcaacctgggagaagccttgcatggtagacaagcaacaagattgcttgtagactgggtttcgcggtacaacatagctctaggagttgcacaaggacttgcttatctccatcatgattgtcatccacctgttatccatcgagacatcaagtcgaataacatattgcttgatgcaaatcttgaggcaaggatagcagatttcggtttagccaagatgatgatccggaagaatgaaacagtctccatggttgctggatcctatggctacattgctcctgaatatggatatgccttgaaggtggatgaaaagattgatgtttacagttatggagtagttttgttggagcttctgacaggaaagaggccattagattcagactttggagagtcaatagacatagtagagtggcttagaatgaagattagagacaacaaatcactggaagaagtattagacccaagtgtaggaaacagcaggcatgttgtagaagaaatgcttttagttctgagaatagcaattctttgcactgccaagctcccaaaggaaagaccaaccatgagggatgtcataatgatgcttggagaggcaaagcctcggcgaaagagcagtagcaatagcaaagatgcagctaacaacaaagagataccagtttttagcacatcaccagttaacaataataatagccttgtgtag

SEQ ID NO: 107766 - DNA, 384 bp, Glycine max
  Peptide Sequence Number=SeqID_224544
atggcattgacatcattgtcagtaggatcaaatggagaagatcacggtactgaagttggagcagatgggcattcaaaattgctgcatggttcttctgaccttgtgctcacttatgaagacaaggaaggagactggatgcttgtgggagatgttccttggtggatgttccttaactctgtgaggaggctaagaatcatgaggacacctgaagctaatggacttgctctaatacagttacttatttgcagccccaagattgaaggaaaagaacagaagatcgaaatgcaagctcatatagataatgttattgtttgcacctttacatgtgctaggatacacaaaacttatgaactaaaatgtacaacacgaattgaaggaatataa

SEQ ID NO: 107767 - DNA, 186 bp, Glycine max
  Peptide Sequence Number=SeqID_224545
atgtcgagttcatcggaatactctcaattttccggccagaaaccggcgaggtcgccggagaaatcgagcttctctcagacttgtagcctgttgagtcaatacatcaaggagaagggtagcttcggagatcttaccctcggaatgacatcatgtgttttaggcttgaacctctatctcaattcttag

SEQ ID NO: 107768 - DNA, 813 bp, Glycine max
  Peptide Sequence Number=SeqID_224546
atggcgaatgaactactaatcctaaagaagctagcggcacgttctatcctaaagaagacactaacaatgggaatctgcagaaatatgggtacccaaccaagggtacaaagaaggctaggaggaaacagagctacactttttgtatatgctatggaagggctagagaacatggcttttgttgccaatgctgtgagcctagtaacttacttctttgggtacatgaacttcagcttaacaaaatctgccacaaccctgaccaactttatgggaactgcatttttactggcactggttggtggattaatcagtgacacatatctttctaggttcaagacttgtgttctgtttgcctgcatggaattgctgggatatggtatcctcacagttcaagcacgcttccaccaattaagacccatcccctgcaaagatctagcaacaacccaaatgagtcaatgtgaggctgctacaggtggccatgctgcaatactttatactggcctctaccttgttgctttaggaaccggtggtattaaggcagctttaccagccttaggggctgatcaatttgatgaaaaagatcccaaggaggcaactcaactttcaagctttttcaactggttcttgttcagccttaccataggagcaattattggtgttactttcattgtttggattggtgtcaacctgggatgggattggagctttattgtatgcacattaacaattctattcgcaattgtgttcatatgcatgggcaactcgttgtaccgaaacaatgtcccaaagggaagccctctagttcgaatcattcag

SEQ ID NO: 107769 - DNA, 1941 bp, Glycine max
  Peptide Sequence Number=SeqID_224547
atggcgcccaatccaagagtggtggcggcctttacggcaatggcgaatctcgggattcatgaatcaaaagtgaaaccagtgttgaagaaactgcttaaattgtatgataagaactgggcactcattgaagaagagagttatagggccctggctgatgcaatatttgaggaggaagagaataaggtgaatgagccagaccagaataataaaaacaagaacggagttgtggacgatgaagaagctcatacgcatggggagcctgtgcgacctttgaagaggttgcgtttgagaggccaagagggtcaatctttgcgccctctgactagcagtggccccagctcagctgcatttccgttgaaagcgcctaaattagaagatggggcagtgcccgagagtagttccagacggcagcctcaaagcatggctgcattatctgatggaaatgcaaggattggtgctcgtcatgttcccccacaagatgctgttgtcgacaagggaaagaaacctatatcacctcaacttactcccagagcgagaaggtcccttgcagagccaacagttgaagcaggagctgctctgttggcaaataacaaaatgcctcatccatttattttgatcaagcccaaggatgagcctgttgatggtataccagattatgagattccccttgcagtgattcctcctgaaccatcaagtggaggagactctctaatgggtgcagctggaaagaaagattgccatgacactgtggtatcacagtgcagagatgaaaacgttgaacatgaatatgtttttccttcctcaaatgaagaagcaacttctaatgtagatgtagctttgtcgtctatgggtgaggaacaatctgtaaagataacacaaactgatgatgtttcaaaggaatctgagaccaatgactcacctattgtcagaggaaacaaagattcggtcattgcaaatggatcaatcagtgttgagtcttctgccatggctgaacttcaagttcctagttctataccctgctcgagtgatctggataatgctgtaccagctcccaagaaggttggaatgaatggtttcttacaaagtgatagtggaaaggagctggagcatcctataatcccaaattcacgtactttagtggttgttccaaaacatcagcttactaatgatgatgtaagggcagttcatgatgttaatgacctaacaaagggagaagaaagagtgaaaatttcatgggtgaataacactactaatgatttcccaccaccctgtcactacataccccgaaaccttgtgttccgagaggcttatgttaatatttctctatctcgtattgggaatgaggattgttgttcaacttgtatgggcaattgtgtattgtcatctaaatcatgttcttgtacaaataaaactgggggtgaatttgcttacactgcaaaaggcctactaaaggaagagttcttggatgagtgtattgccctcaaccgtgatcctcaaaattatttctattgcaaagcctgtcctcttgaaagatcaaagaatgatgattgtttagaaccatgtaaaggacatttaaagagaaagtttattaaagagtgctggagcaaatgcggctgtgggaaacattgtggtaatcgggttgtccagcgtggaataacttgcaagttgcaggtgtttttgacttcagacagaaaagggtggggtcttcgtaccttagaagatcttcaaaaaggcgcatttgtatgtgagtttgttggggaaattttaaccatcaaggagttgcatgagaggcgcttgaaatatcccaaaaatgggaaatatacatacccaattttattggatgcagattggggttcaggaattgtgaaggatagagaagctctttgcttatatgcggcatcgtatggaaatgctgctagatttattaatcacaggtattaa

SEQ ID NO: 107770 - DNA, 564 bp, Glycine max
  Peptide Sequence Number=SeqID_224548
atggtgcttgattgtgaataccattttttaagctcttgcagttccatgaagaaagtggatgaagagactggcaaatactatggtagaaaggctgtgtcatttgtcttgattactattacaggtggtgttgctttgagtgcccttgatgaccttgccatctatcatggatgtagcagcaaggccatggagaaggtaagcaagaaccaggcaataatagattctattggagaaccaattgttaaaggtccatggtacaatgcatctcttgcagtagctcatgaaagacgttctgtttcatgctcatttcctgtttctggaccacaaggcaatggtgtcttgcagctgaaggctgttcgaaatggagatgacacttggtcttcctttttccttcctcgtgattgggacattttaatcatggatgctctcctccatatacctgagaatgagaagcaccgaaccttgcggatcaatcttgctgacaagcctctttcttgtactgcttgcaccgatagcacacctcatccatcagaaaattcaaaggcaaaattgagtgccaatcaataa

SEQ ID NO: 107771 - DNA, 153 bp, Glycine max
  Peptide Sequence Number=SeqID_224549
atgtcgagtgttgtcatcgtcggtgaagaaatcgtcgccgtagtcggagaagaagaagcttctgtctggggttccagaccgggaaaggatggggaaggagcgacgacgacggcggcgaagaacgtagttagcggtggaggaggaaagttataa

SEQ ID NO: 107772 - DNA, 1128 bp, Glycine max
  Peptide Sequence Number=SeqID_224550
atgatgctaagaagctcttcaacaccagttcttggatccctcctctcttccttcacagatagccctaacaacaatattcactcagaaacctgtcatgcactgaaacactttccaccaaccactgtcccacaacattatcacaaacttactttccaccaaactgggtcctctgcatgtggttcttctccaatctctccctcaattggtgagcttgaaaggcaaaacaaaggcttgatcagaagagtccaatctgatgggaacttgcaagacttggccttcttttcttgcaacaatgaagaaaggtttgagttttcagacccttccaagaggttttcagctagacacaggagcttggtgctggagaccattccttctttctctactgccaagcacaatggcttgagtgaagaagaggaagatgaagaaatggaaagtgagagtgaagatgggttcagtgtgctgaatggtgggaagggtgtaatattcagtgaagaagtgagggtgaaggatggagtttgtagggtgagttttggtgaccaggaagaggttagtagtggtaaagaaatgtatcttgcaaagggacttggtgtagagtgctgtggtgatggcataggtggttgtagaggtggtggtggaggtggtggtgatcataatcccttgggttctggaggaaatgatggagaaaggcatggagtggaagaatattacaagaaaatggttagggaaaatcctggggatcctttgtttctgaggaattatgccaattttttgtatcagtgcaaacaagaccgtgaaggagcagaggagtattattcccgtgccatacttgcagacccaaatgatggagaggttctatcacagtatgggaagttagtttgggaactacatcacaaccaagaacgtgcctccagctattttgaaagagcagtccaagcctctcctgaagacagccatgtacaagcagcatatgctagtttcctttgggacacagaggaagacgaggatggtatcaatgaaccacaaagtttaccgccacattctcatcaaggagctgtggctactgcagataacaggacaatgacacatgagacggaaagtaatcaaaacatgctccaaaagccagcttga

SEQ ID NO: 107773 - DNA, 879 bp, Glycine max
  Peptide Sequence Number=SeqID_224551
atgggtatactgaaatcaaaacaccacaagcacacgctcctcttttttcttagtatttcgtttcctctgtttcttcttacacctattactacctcagacaacacaaacttgatctacaaaggttgcgccgaccagaagatgcaaggccaatactcccagaaccttaaaccgctcttggattcactagtgtcggcgtcggcgcaaaagggcttcgccgcgactacacaaaacgcgctcacgggcgcgtaccaatgcagaggggacctctccaactccgaatgctacaactgcgtcagcaagattccaaacatgctggggcgcctctgcggcggtgatgacgtggcggcggcgcgggtgcagctgagcgggtgctacctgcggtacgaggtggtcgggttcaaggtggtcccggccacgcagctgctgtacaaggtgtgcggggcccgcaaggtggtcgacggcggagggttcgaggcgaggagggacgcggcgtttgggatggcggagaacggcgtgcagaacagcggaaatttgttctacacggggagttaccagagcctctatgtgttggggcagtgcgagggtagtttgggaaatgcggattgtgggggttgtatcaagagtgctgcggaacaggctggggatcagtgtgctgactccatctccgcgcaggtttatctccagagttgttttcttagttatagcttttaccccaatggtgttcccaccttgtcatcttcctcaggaggaggaggggggcatccacacacggagaggacagtggcacttgcggtgggaggggtggcggctctgggattcttgattgtttgtttgttatttctcaagtcggtgttgaagagaagaggtgggaagcgttga

SEQ ID NO: 107774 - DNA, 4710 bp, Glycine max
  Peptide Sequence Number=SeqID_224552
atggcaagttttctaaaggttcatgctcttctctttcatatactctttttcatatctcttcttccattcaaaattacttcatcacaaataacagaatcagaagcccttgtcaaatggaaaaacagtttatcccctcctcttccttcttctctaaactcatcatggtccctcaccaaccttggcaacctttgcaattgggatgccattgtttgtgacaacactaacacaacagtcttagagataaacttgtctgatgccaatctcactgggactctcactgccttggattttgcttccctccctaacctcacccaactcaacctcactgccaaccattttggtgggtcaataccatcagcaattggtaacctctccaagctcactttattggactttggtaacaacttatttgaaggaacactgccttatgaactaggtcagctaagggagcttcaatatcttagcttttacgacaacagtctcaatggaaccattccttatcagctcatgaatctccctaaggtatggtacatggaccttggatcaaactactttataactcctcctgactggttccaatattcatgcatgccttccttaactcgccttgctttgcatcaaaatccaacactcaccggtgaattccctagtttcatacttcagtgccataacttgacataccttgacatctctcagaataactggaatggaacaattccagaatccatgtatagcaaattagccaagctagaatacctcaacctcaccaattctgggctacaaggaaaactatcacccaacttgtccatgctttctaatctcaaagaacttcgcataggtaataacatgtttaatggttctgttcctactgagataggattgatatctgggcttcaaattcttgaattgaataacatttctgcccatgggaaaattccttcttccttaggccaactcagggagctatggagtcttgatctcagaaataattttttgaactctacaattccttctgagcttggccaatgcacaaaactaaccttcttgagtttagcagggaatagtttgtctggtcctttgcctatatccttagcgaatctggctaaaatatcagaattggggttatcagagaattccttttctggtcaactttctgttttgctcatctctaattggacccaattgatctccttgcaactccaaaacaataagtttacaggaaggattccttctcagatcggccttttgaaaaaaattaactacctatatatgtacaagaatctgttctctggtctcattcctttagagattggaaacctgaaggaaatgatagagttggacctttcacaaaacgcattctctggtccaattccatctacactttggaatttgacaaacattcaagtcatgaatcttttcttcaatgagctctctggaaccattcccatggatattggaaacttaacctcactgcaaatctttgatgtcaacactaataacttgtatggggaggttccagaatccattgttcaactacctgctttaagttatttttctgtgttcaccaataacttctctggcagcattccaggagcatttggaatgaataatcctttgacttatgtttacctttcaaacaacagcttctctggagtactacctcctgacttgtgcggtcatggcaacctaacttttttggcagccaataacaacagcttttccgggccactgccaaagtccttgagaaactgttcatcactaattagagtccggcttgatgataaccagttcactggaaacataacagatgcatttggggtgctcccaaatcttgtttttgtctcacttggtggaaatcagcttgttggtgacctctccccggagtggggtgaatgtgtcagtttaactgagatggaaatgggaagcaacaaactttctggaaaaattccatctgagctaagtaagttgagtcaattaaggcatctaagcctgcattccaatgaattcactggccatatcccacctgaaattggaaatctaagccaacttttattgttcaacatgagcagtaaccatttatcaggagaaatccccaaaagttatggcagattggctcagctaaattttcttgatttatcaaataacaacttcagtggaagcattcctagagagctcggtgattgcaatcgcttactgagactgaatttaagccataacaatctatccggggagataccatttgaacttggcaatctgttctcactccaaatcatgttagacctcagcagcaactatctttctggagcgattcccccaagccttgaaaagttagcatcattggaggttctcaatgtctcacacaaccatcttacagggacaatcccacaatcactttcagacatgatcagccttcaatctattgatttttcttacaacaacttgagtggttcaatccccacaggtcatgttttccagaccgtgacttctgaagcctatgttgggaactcaggtttgtgtggtgaggtaaaaggattaacttgtcccaaagtattttcctcacacaaatctggaggggttaataaaaatgttcttcttagtattctcataccagtttgtgtcttacttattgggattattggtgttggaatcctactttgctggcggcacaccaaaaataaccctgatgaagagtccaaaatcactgaaaaaagtgatctatctattagcatggtttggggaagagatggaaaattcacattttctgatcttgttaaagccacggatgacttcaatgacaagtactgcattggaaagggaggatttggaagtgtttatagagcgcaattactcacaggtcaagttgttgcagttaaaaggctcaacatatcagactctgatgacattccagcagtgaatcgccagagctttcagaatgagatagaatcacttactgaagtgaggcaccgcaatataataaagctttatgggttctgttcttgcaggggacaaatgttcttggtttatgaacatgtacacagaggaagtttggggaaagtattgtatggagaggaagaaaaatcggagctaagttgggctacaaggctgaaaattgtgaagggaatagcacatgcaatttcatacctgcactctgactgctccccaccaattgtgcaccgggatgtaacactgaataacatactactagactccgacttagaacctcgtcttgcagattttggcactgcaaagctgttaagctcaaacacttcaacatggacttcagttgctggatcctacggctacatggctccagaactagctcaaacaatgagggtcactaacaagtgtgacgtgtatagttttggagtggtggttttggagataatgatgggaaagcatcctggagaactcttgtttacaatgtcttcaaacaagtctttgtcatcaacagaggaaccacctgtgctactgaaggatgtgcttgaccaaaggcttccacctccaacgggcaatttagcagaagcagtagtgttcacggtgaccatggctatggcatgcacacgtgcggctccagagtccagacccatgatgcgttctgtggcacaacaactgtcattggctactaagcagccttgtcttacagagccatttggcatgataaccataagcaagcttacagcagggcctggtggcacagtgtgcaattctgggtcactagatgtgtttctgcagatctttttgcagcgtttcaagggtggtgttggaagtgagggaatcatcccaaagctcttgcattgtggtggagcaagtgaagtggcccaaactgaaccatttgaggatgctgcacctctcataggtcaagttgttgctgttaaaaggctcaacatatcagactctgatgacattccagcagtgaatcgccagagctttcagaatgagatagaatcacttactgaagtgaggcaccgcaatataataaagctttatgggttctgttcttggagtggacaaatgttcttggtttatgaacatgtacaaagaggaagcatggggaaagtgttgtatggagaggaaactaaattggagttaagttgggccacaaggctgaaaattgtgcagggaatagcacacgcaatttcatacctgcaaagtgactgctccccagcaattgtgcaccgggatgtaacactgaataacattctactagactccgacttagaacctcgtcttggcacagcaaagctgctaagctccaacacttcaacatggacctcagttgctgctggtttgtatggctacatggctccagaactcatacaaacaatgagggtgactgacaagtgtgacgtgtatagttttggagtagtggtgttggagatattcatgggaaagcatcccggagaactcttgactacaatgtcttcaaacaagtatttgacatcaatggaggaacctcagatgctactgaaggatgtgcttgaccaacggcttccacctccgactggccaattagcagtagcagtagtgttcacaatgacaatagatatggcatgcacatgtgatggattctgtggcacaactatcgtcggctactacgcaggcttgtctctccgagccatttgggatgataactataagcaagcttacagggttccagaaatagtgccatgtaggactgcggggtctgtggcaatgtggcataacttgtag

SEQ ID NO: 107775 - DNA, 318 bp, Glycine max
  Peptide Sequence Number=SeqID_224553
atgcagactagggcgggtgcttttaattccatcaccggcaaggcgaagaaggttgggtgggtgctcgcgagagtgaacagaacggtgacgaacgaatgggctttggctttggctccttttggttggaggaatagcagctggcaaccctacgcgccaaggtggcgcgtgaagctcactatcggtgattggattggtgatgatcctgttgcagtaccaggacaatttcaatcacagtcagagagtcaaggtcaaggaatccaaagtggaacccatcgatttttctgctggtattttcttcctacggctacttttacttga

SEQ ID NO: 107776 - DNA, 384 bp, Glycine max
  Peptide Sequence Number=SeqID_224554
atggaggcgtggcataaggcactatgtggaggcaagagtgggaacgagtttggttctgggttgctcaaggtagctagcaagaggaagaagaaggtgaagaagaaagtggcgcctacgacgaagaaggtgatggatgaagtggaagagggtgagctagggaccttggggtgtgagctggagaatgaagagtttgtattggagaagttgatcatgctgacgcggagaagtgaaattgagaatgaaaagattgatgatattgagaagggagaattcattccaagtaggtggcatgacataggggagacatggggagggatgattatggctatgccaggtagggataaagggtggaaaaatgaatgggagggtacactacttaaatga

SEQ ID NO: 107777 - DNA, 1267 bp, Glycine max
  Peptide Sequence Number=SeqID_224555
aacagaagcagaagcccttgtcaaatggaaaaacagtctatcccctcctcttcctccctctcttaactcatcatggtccctcaccaaccttgccaacctttgcatttgggatgccattgcttgtgacaacactaacacaacagtctcacagataaacctgtctggtgctaatctcactgggactctcactgccttggattttgctttcctccctcacctcacccaaatcaacctcaatggaaaccactttggtggcttcaatatcttagttttttcctacaacaatctcaatggcactattccctatcagcttatgaatctccctaatgtatggtacatggactttggatcaaaccactttataactcctcctgactggtctcattattcaagcatgccttccgtaactcaccttgctttggatttcaattacttcacagctgaattcccgagtttcatacttgagtgccataacttgacataccttgacatctctcagaatgactggaatggcacaataccagaatccatgtctagcaatttggccaagctggaatacctcaacctcaccaattctgggctagaaggaaaaattttgactggtcctttgcctatgtccttagctaatctggctaaaatatcagaattgggattatcagacaatttcttctctggtcaactttctgcttcactcatctctaattggactcaattgatctccttgcaaaatctgttctctggtcccattcctgaagagattggaaacctgaaggaactgataaagttagacctttcacaaaaccaattctccagtccaattccatcaacactttggaatctgacaaacattcaagttctgaatcttttctccaatgagttctctggaaccattcccatggatattgaaaacttagcctcactgcaaatctttgatgtcagcaccaattacttgcatggggtgttgccagagaccaaaaggcatgatgaggtgactgacaagtgtgacgtgtatagttttgaagtggtggtgttggagatattcatgggaaagcatcctggagaactcttgactacaatgtcttcaaacgagtatttgacatcaacggaggaacctcagatgctactgaaggatgtgcttgaccaacggcttccacctccagcaggccaattagcagaagcagtagtgttcatagtgaccattgctttggcatgcacacatgcggcaccagagtccagacccttgatgcgttttgtggcacaatcataa

SEQ ID NO: 107778 - DNA, 2727 bp, Glycine max
  Peptide Sequence Number=SeqID_224556
atgggagatagcgaagcggtggttacggaagcatctgctgctgaggcatatgcttcggctggttatgctgagaccgggtcgaatcctgctcccgaggcaggtgctactgttgatcaatctgctggagaagctgctcaggccagttcaacttatggttatggttattctaatgttggtgacgtgaattcgtatgctggggatccgaattccatcctacagcaagctcaattcagtgcaactggtgagtccaagccagctggtggagcggctgattctaacgaggcctctgctggggttggaagcacagctgctgactctactatggtatctgactacaattcatctgtaaatggtggtgttgccggtgcagtgacaaatacttctggacttgaaaacgggaatgcgttggagaatgctgatgggtcggctgatgagaaacagcaagcagatggttatgctgccttgtctgctgaagaagatcgactgtggaatatagtgagagctaattctttagatttcactgcctggacttccttgattgaagagacagagaaggcagcagaggacaatattttgaagattcgaagagtctatgatgcttttctagcagaatttcccttgtgctatggttattggaagaaatatgctgaccatgaggcacgccttggctctattgataaagttgtcgaagtctacgagcgtgcggttcaaggggttacatattcagtggacatgtggttgcattattgcatatttgctataaccacatatggggatccagacactgttcgtaggctttttgaacgaggattagcttatgttggaacagattatctttcttttcccctctgggataaatacattgaatatgagtatatgcagcaggactgggcccgccttgccgtgatctacaccagaatattagagaacccaaatcaacaattagatcggtatttcagcagcttcaaagagttagctggaaatcgacctttatcagagttacgaactgctgatgaagctgctgcagtggcaggagttgcttcagaggctactggccaagctactgagggagaggttcatcctgatggtgcagagcgttctcctaaatctgtaagtgctggcttaacagaagcagaagagttggagaagtatatcgccattagagaagagatgtataagaaagctaaagagttcgattctaagatcattggttttgaaacagctatcaggaggccctactttcatgtacggcccctcaatgttggagagcttgagaattggcataactatctggactttatagaaagggagggtgacttgagcaaggtgtcttcttatcttcctaatcatctgtcgcaggctaggagggtccctcctttcatatttgaggggcctctctgtcccgctaaggaattgtcaagttgtatgagagatgtgtcattgcatgtgccaattatcctgagtattggatacgctatgttttgtgtatggaagccagtggaagcatggatcttgcaaataatgttcttgctcgggcaacccaagtctttgttaagcttgcttcagtttgaagtatggattttaaaatgtatggacccattttaccttatgtttgaaattggacttttgaagaattgggttgggaataatttagttcctcacacttggtctttagagagacaaccagagatacatattttttgtgctcggttcaaggagcagactggagatatagatggtgctagagctgcatatcaacttgtgcatactgaaacttctcctggtcttcttgaagcaattatcaaacatgccaatatggaataccgactggaaaaaatggaggatgccttctctttgtatgaacaggccattgccattgagaaagggaaagaacattcacaaacattgccgatgttgtttgctcaatattctcgatttgtatatttggcttctgggaatgcagagaaggcaaggcagattctagttgaggggcttgagaatgttttgttgtcaaagccactacttgaggctatattgcattttgaggctattcaacccttgccaaagcgcgttgatattgactttctggagtcatgggttgtcaaattcataatgcctaactcagagagtcctggtgtagcaagtgcaacagagcgtgaggaactttctagtatttttctggaggcatgtgtgtgcatttgtgtcttaggagtgtggtttttaaatctctttggtgatgttcaatctatcaagagggctgaagataggcatgccaaattgtttttgccacacagaagcatgtcagagttgaaaaaacgtcatgctgaggatttcttagcttcagacaaaacaaaagcgccgagatcttattctgctcaatcacctgcccaatctgggatgggtgcatatccaaatgcacagaaccagtggtctaattatggagttcaacctcaaacttggcctccagttacacaagcacaagggcaacaatggactgctggctacacccaacaggcttcctacggggcttatgctggatatgggggcaactatgcgaattctcaattgcctacatcagttccacaaagtactgcatacggagcctatcctcctgcatatcctgcacagccggcggttcctcaacaaaactatgcacaacctgtggctgcagcccctgcacagcaacctgctgcggttcctcaagcttattacgggagttattattga

SEQ ID NO: 107779 - DNA, 1458 bp, Glycine max
  Peptide Sequence Number=SeqID_224557
atggaagcacattctgctttctctattgaaaggtcaaatgctaatgacatggggatgtctgaagtatttccttcatcgttgcctgtccttccatcgcctctagaagagacattccccaaattatctgattctcgaccagcttttatggaaaaagaacttaaaacaaaaccttttacacattcaagtcatttaacttccagcggagcagttgggcatatgttttcatcttctcctggatattcaactgatcttcatcactcatccttttcatcttatgaaaaacaacctagaaatactcattttatttcacaaccattgggtaacatggcttcattgccattatcttattcttcaaatagtgaaccaataccttctacaacgtcaaccccttattccaatggaaacagtgtttcctggcatacagattctctgcctagctttcttgatttcacagccaatacctccattgataatagtcaagtagaaaaccgtgcctgcaatatcatggcaactgaagagtattctaagcgaaatgattggcaggagtgggctgaccaattaatcagtgatgttgatcctttgacttctaactggaatgatcttcttgctgacaacattcaagatctggaaccaaaggcggtgtaccaggtcacaaaatcatcttcacaacttccaatagaacaccaatctcaaagccatcaacaactttgtgcttcatctggagaaaatcgtgttggtgttgccccaacttcctcagcaaattctgcacctgccaagccacggatgcgctggacacctgagcttcatgaggcatttgtggaggctgtcaaccaacttggtgggagtgaaagagctacccctaaaggtgtgctgaagctcatgaaagttgaaggattaactatataccatgttaaaagccacctacagaaatacaggacagctagatatagacctgagtcatctgaaggagctgcagagaaaaatctaagtcgaatcgaagagatgtcatctctagatttgaaaactggtattgagatcactgaagctctgaggttgcagatggaggttcagaagcggttgcatgaacagcttgagattcaaagaaatctacagttgcgaatagaagaacaaggaaggtaccttcagatgatgtttgagaagcagtgcaaacctggcattgaaacatttaaggcatcatcatctgtcatcgagagtcaatctggagtgtcttctgatgccatcaaagattctccagccaaaactgaatcagaaaccatcaaggtggaccactgcaagtcaggagctgatctggctaatggcagtaccacagttgaggaaagctcattggaagtggctgagaagcaggatgctcctgaaattcaagcttccgacaatcctgagcaacatgctagtgaagatagtggtaatgcctcaaagcgtccaaggacagaggagtaa

SEQ ID NO: 107780 - DNA, 309 bp, Glycine max
  Peptide Sequence Number=SeqID_224558
atggcggtctcctgggggtggacaaacgccaggtggcatgaaggatgcaggaaacgtagcatgaaaacgatcgacaagaacatgggacaagacaagaatgatgaacacgtgtcccacacgctcatgagtctgtctaagactcttgttaaccacgccacttttcttcttcttgatattccctcacttcacttcactcttgacaacttgagacttgagagcggagaaggctcttcaattcaatgtctaaagatgacaactcttcttcactggattcttcttcttctgaccttcaattatctctctctttaa

SEQ ID NO: 107781 - DNA, 321 bp, Glycine max
  Peptide Sequence Number=SeqID_224559
atggctacaacaccagttttagagttgtcccagtttgctcttccttttcatgaggaaacggatgcctttgccatggccataggtgcaatcctatcccaacaaggccacccgattgcatatttcagtaagatgctttgtcacaaggtgcgggtggcatttgagtatgccagggaaatgctcgccataaccgatgctataaaaaatgcaaaagaagatcccaagcctaagtctgagcctaaagatgaagccagtgatgcttcacatgattcagaggttgagcttcctcttgatcaagaggaggatgctcctcttactctctaa

SEQ ID NO: 107782 - DNA, 681 bp, Glycine max
  Peptide Sequence Number=SeqID_224560
atggtgtcttttcagttagacttactgaatcgaataggagatggctgttgcttgatggaagcagtgtcggggtgtggtggttacaaaagcctagggctagatggaaatgggaagattccacaagggggcaatcctttgttcattgctatggttatatctaaggttttatctaagaggatgaaagttatcttggagggaattattgacgagagacaatgtgcgtttgttggtggtaggaacatgttagatggtgttcttattgccaatgagatggagatttttgagacatggatatcttggatcaaaagggggttggagttagtgatggtgtcaatcctagtgaatgggagtccaattgaagagttccctactattaggagattcaggcaaagggatcctatcacacctttctttttcttagttgtggtggaaggcttgagtgtcctaatgaggatggctactcgtggaggcttgttcttagagtacaaggcaatcctaagatgttttgaattagtgtctgacttatgggtcaatattcacaagagtaagttggcaagtgtgggagtggagtcaagggcaataggaacttatgccagtctattgaattgtggaactacgaatatctcctttatgtacttgggaattcctatcaatgctaaccctcacaaggaagctgcttag

SEQ ID NO: 107783 - DNA, 939 bp, Glycine max
  Peptide Sequence Number=SeqID_224561
atgaagaaaacttttcagctgacaattttctctctggttttgtcttgtatacttggagagatttcagcacagaaagaagaagagtctcttagaacctggatgaacagcactgttgttgagataaagcttcacaattcaggcctagatggaacccttaacaggtttgacttctcagcctgctctaatctcagtaacttcaatgtcagtatgaataaccttgttggagagataccagctggaattggaaatgcaacaaagctgaaaatactttatttaagtagcaacaatttcacctttccaatccccccagaaatgggaaacatcctacaacttcaagttctttctctcaataataattcactcctaaatcaaataccagttcaacttagcaatttgcagaatttatggtttcttgatctaggggcaaattatttggagaatcctgacccggttcagtttaagggcatggcatccataactgaactcaatctcacctataactatctcacagaagttcccccatttgtgtctaaatgtccaaagcttgtgtctcttgatctatcactcaacacaatcactggacagattccaatacacttactgaccagtcttaggaatttgacaatcctagacatgacaaataactactttgaagggctaattctagcagaaattaagaaccttacaaacctcaaacacatgaagcttggaaaaaacaagcttaacggtactataccaaaggagattggtctcttgtcaaaccttgaggtgcttgaattgaatcaaaatgtcttccaaggaccaataccatcatcaattggaaatctccataggcttcggagattggatcttcacaagtcaggactaaattccagcatcccaaccaaccttacttatcttgatatgtcaggaaatagcctcacaggttccttatcttaa

SEQ ID NO: 107784 - DNA, 294 bp, Glycine max
  Peptide Sequence Number=SeqID_224562
atggtcaccgtggcagtcgttgagctccatgttgagatatgcggtggcaccgcggtagagtttgttggcggtgttgacagcttggacctctgtggcggtgattcccggggagtagaggtagcctttgccagtgactttgtcagagagggagacaatcacccagctgaagttggggtggggggaggtcgacttctactaatactgttgctttgggttattgtgtttcaaaccatcaaaggtaggaaatttctgaattcggatggtggcggagttatattcacgctaaaattgtga

SEQ ID NO: 107785 - DNA, 1176 bp, Glycine max
  Peptide Sequence Number=SeqID_224563
atgggttgttttcttcattgctttggttcctccaaaagcacaaaacctaggcgcaaggcacaacatcaccaccatcgaattgctagagacaggttggagcaacctacggcgtgttgttctgttcaggattactccgaaacagtggtacttagcactgcatcacaagaagtccaggctaaacctttggagcagataaacgtgagccctaaaaagaaagtaacttttgatgtcaatgtgaaaacgtacgagcccgagcctgatgaagttgctgattaccaacttgtgagaagtgaagagggtagagaggaaagtgcttttgttgaaaagttaagccaaacaaagtcttactctgaagtaagttcggtgacttcagcgaggtcttaccctacaaaccataggtaccacagttgcacgtgtagtgatgatgaagatggagcaatggagtattgggatagtgatgttactgatgaggatgaggatgatgatgatgatggtgatagtgacatgggagaagagtatgatgaagtggaagaggattttgaagatggaatagtgtactcaaggtcaagaaatggtgctaatcaagtggttgttggagaggtggaaagtccaattccaatgcatgataaggatctgaagtcaattgggttgaactccaatgttcgagataggagtgtgtatgttaatcctttgctgaaccctgtggagaacctcactcaatggaaaacagttaaagctaaaagggcacccccattggtgtctcagaaggagaatttggttttgaatcaagagtctagagctgcatttggagcagaaacagaaacaccaaagaagttgaaccgggaaattgcagttgatgctagcctttcgaattggttgggttcatcagaaactacacctgttgttagcaagggtttgtatgcgggtaccccggagaggagcagcagcagttcacaaggctcaaattcagtggtgagccatgaagataggcctattttaggtgcattgacagttgaagagctcaaacatttttcggcttcttctttgccaagaaaatcaccaagggatgagatgatgcccattataggcagtgttgggagctactggaattgtgggggctatgctgaggattctggctcagcaaaccgagtaagatcaagaaaagggtacatttga

SEQ ID NO: 107786 - DNA, 276 bp, Glycine max
  Peptide Sequence Number=SeqID_224564
atggtcttgatgtctggtcacatcaatcttattgtgcaccacaagggtagattagaaagggatgatcatggcacattggaatatgtggacaatgagttttacgtttgggagaattgtgaagtggatttgatgacattgtggattgttcttgacttgtgtaaatctcgtgggggttatcaaagatgtgttgtttttttttggatcctaacattaacaggaatggtggtgaatcaaattgaggatggaactgaaggtattgatactgaccttgactag

SEQ ID NO: 107787 - DNA, 1215 bp, Glycine max
  Peptide Sequence Number=SeqID_224565
atggaagaagttgaaatcccacaatattttgtttgtcccatttcgtttcagatcatggaggaccctgtgactactgtgacaggcataacatatgatagagaaagcatagagcagtggttgcttaaggccaaagattgtgtgtgtcctgtttccaagcaaccattgccaagaagctctcaatacttgacccctaatcacacacttcggaggctgattcaagcttggtgttcagcaaacacggccaatggtgttgatcgaattccgaccccgaaaacgcctttgagcatgatccaagttcagaagcttgtgaagggtcttgaggctccttgttcttatcaaacatcgttggagaagttgcatgccttggctacaattgagaggaacagaacttgcatggctgaggctagtgtggctaaggccatgatcaaattgattaacaagagtttcaaagaaggaaacacaaacaccacctgcatagaaaaggctttgagaattgttcatgttctttggagcaatgatcaatatagcatgaagactctagttggggaggacttagacttcatcaactctttgacttggattgtgaggcttcatttggatgaaaacaacatcaagatggtaaacgaagcaatgccccttttgaagttgacaattgaagttgttgattcaacccttttggggaatttaagccttgaattcttcaaggaaatggtgagagttttgagaaagaaaagactctctcaacaagccattaaatatgctttgtgggtgcttacagaaactagcactttgggtagaaacagaacaaggattgttgaagcaggtgcagtcacagaactcatagagcttgagcttgagaaaccagagaagaacatgacagagctcatattcaatcttctggcactcctgtgttcttgtgctgatggaagagaacagtttctgcgacacgctgccggcattgcagtgctttctaagagggttttcagggtttctgctgccactgatgacagagcaattcatgtgttttcagtgattgccaagttttcagcatcaaatgaggttgttctagagatgttgagggttggagctgtgtcaaagctttgcatggtgatgcaagcagattgtgcttcttatttgaaagagaaagcaagagacatccttaggttgcactccaaagtttggaacaattctccctgcatacaaaatgtgttataa

SEQ ID NO: 107788 - DNA, 1527 bp, Glycine max
  Peptide Sequence Number=SeqID_224566
atgagtgccaccaactctaagaagctttcttctccttcacctaccattcaccaacgtaggctcacccgacagaggaagcttcgttacctcactgacaaagacgctggtctgcattcaacttcctctctacccgcttctcctcttccttcctttaagtccgcttccagttccgaccattggtcttcctctgcggttcctcaaccccttccgcgtcccgattccccgttgacccgccgacacgaccatcatcacctcggatctccccctttcgaacatcctgctttcgcttttcacagaaggtcggttgatcatgatcctgtgaggagtttaaggtctgcgagcaatttgagtagaccttcttttgatccggcgactccaaatgctaaatttgatttgagagtaaatattccgcctgcaagagtgttggcaggcaatactagttcgtgtaaagatcatagagaactctctcatgacaatgactctgaaaatgtttccaacttgagattgcattttgcggccaagagtgcccccaacagcatattctccagtcctgttactagtccacgtagatccagcaatgtagatttctatgatccttccataatttttcctcaagattttaatgacattttgaaagtgtcaccggctaaaactgctcagagtccagacctgtctcctctgcgcagccctgggagtcacctcaatcaagaggggtctcagcttcgtaaatttagctccagagtgtggcctgaaaataatcatgtggatgcacatccacatccacatccactgccccttcctcctagagcttcaccacagaccacacactcatctccgcagcaacaaccaactatggcaaacctcaccactgaaaactcaccttcaatgaaagttactcacacgcattcctgttctgtttgcgtcagagagactggagcctcgtgtgcaatgaaagaggtggatctgttccctgatgatcctaaatctgctgactgcataaagcaacttgagcaggaaatcagaattctccgtcagttacaccaccccaacattgtgcagtattatggcagtgaaatagttggtgatcgattgtacatatatatggagtatgttcatcctggatcacttcataagtttatgcatgaacattgtggagctatgacagagtccgtggttcgcaatttcacacgacatattctctctggattggcatacttacatggtaccaagactattcacagggatatcaaaggtgcaaacttgttggtcgatgcatcaggcagtgttaagcttgcagattttggggtgtcaaaaattctgacagagaaatcatatgaactttcattgaagggaagtccctactggatggctcctgagctcatgaaggctgccataaagaaagaatccagtcctgacattgccatggccattgatatatggagcttagggtgcactatcatcgaaatgctgacaggaaaacctccttggagcgaatttgaaggggtgagcacctatttatgcatgtga

SEQ ID NO: 107789 - DNA, 569 bp, Glycine max
  Peptide Sequence Number=SeqID_224567
atggcagtggtagaagaaaagggctttgcaagtggaagagaggattacacccaagatggcacagtggacctcaaaggtagacccgttttaagatcaaatactggaagatggagagcttgttccttcatagtagggtatgaaatgattgaaagaatggcatattatgcgatagcatcaaacctagtgcagtatctaacaaagaagctccacgagggcactgtgaaatcttcaaacaacgttaccaactggtctggtacagtgtggattatgccagctgcaggggcttacatagccgatgcctatcttggccgttattggacctttgtaatagcatcagccatttaccttctgggaatgtgtttgttgactctagcagtgtcactaccagcattgagaccgccaccatgtgctcccggcatagcagacaaggattgccaacgagcatcgtcgtttcaagtgggaattttcttctttgccttgtacatcattgcagcaggcacagggggaaccaagcccaacatttccacaatgggagcagaccaatttgatgagtttgagcccaaggagag

SEQ ID NO: 107790 - DNA, 684 bp, Glycine max
  Peptide Sequence Number=SeqID_224568
atggttcttaactttaagaacctacacaagaactatgttagagatgctcttctagtgaaatttgaggatgatgtgtacttaccaacggatgagccacatgggtcaattcaagctagcttgagccgcctttggtactatttaaaggggcctgtggtatttactgatgttacatggttttgtgaggattgtgcaacaaagcttggggtgccacctgctcttgaccaatctacacctatctcatttaagcttaaaaagaagcagaaggaaggaaaaactaactctagcttagttgctaaaacaaagggagtgttatctagtcgtcacatttcacctgagcctaagcatcctcaatgtagtaacagatgtgaagaatgtgaggtgaaagatgactgtggaccaaaggatgtagctaattttgatgtaggcgaagaagaaagtgtggcaagggatttagctaattctgatgaagttgttggggtgaatatcatttggaggtacataaacgtgacagatgaggctgtccaaaagggaatcttctacccatccattgattgtatacgatatgttacaacagaggttgaggctgttgttgtacatgcaacgattgtagaaaagcagcctaaaggacatggtgatgtagggttcaaagacctatcaagaaatcaaaagtatggaaaattctga

SEQ ID NO: 107791 - DNA, 393 bp, Glycine max
  Peptide Sequence Number=SeqID_224569
atgttcaaggtactgcacaaatccccggatatacctgaaagtttgtcttcagagggacaggatttccttcagcagtgtttcaaaaggaatccagcagaacgaccatcagcagcagtgcttcttacacacgcctttgtacaaaatttgcatgagcaagatgttcaagttcattcacaagggcaaagctgtcccagaggagacgctggaccaggagatgattcacgtaggcatagtcccagtaacagttcaagaaacagccgtggcgtagtgtcagcatcctttcgcgcacgtcctcagtctcccttgaaacctagtgcccataaccacatgactgtaaccaatcccagcaacatccccctcagtgctgttatgaaaatcatcaggaacatgtga

SEQ ID NO: 107792 - DNA, 1278 bp, Glycine max
  Peptide Sequence Number=SeqID_224570
atgggaggtgcaggatacaatatgggaggtgtaggaaggaaatgttggggtacaatccaaatcggcccgtgcgctgcccaattgatacgcgtgtcctctcgggcagactcagtggtgcgaggtgttctacgaatgctgcaagggttttctggtcccccattcttttgggataaaaatgcaaacattttccgtgcaaagagcggagtgtacgttagtcatctctcacagaaaagtcttcactctctgctcaatcagtttatccacgcagccacgtgtctccaattggtggctattacactcaacaaagtcgaaaccgcagtgccaaaatctcctcctactttgaacgcatttgtgtgcctcaaggggttgcggaatattgccttgaaggaggaaacgtccaccagcaatgcagattgtgtaaccaccccaaccttgttaggattggctaattccttatcgagtctttgctcaggcgctgagttcctatttggagtggtgcatgaggctattcctgctgtatactttgagtttggtctgtctgtaccggcagcagaactcacagttcatgtgcttgactaccttcataagaagcttgacgaagtgtgtcttgtacaaggtggtgaggaagcttatcagatggtgctttatatgtatgttggaagcttgttgccatacattgagggtcttgattcctggctttttgaaggaattcttgatgatccttttggtgagatgtccttttttactgataaagaagtctcagttgatgaggctgagttctgggagaagagttatttgttaagaaggctacagcatagcaaattagattcagaattcttctcttccacgaattatgtcaatgatcctgtgccagcatcaaatgacaaggaaatggataggagaattccatctctttgtctagtacagttaaaggaaaagagcagggcatttgagatcgtccagcctgctatatttggtggagaaaatgctgcattttctgatagtgaaggaatgaactatacttttggctttcactttggtgaatctgaataccttcgctcacaggatgacagaaagctgttagaaatgttgtttccttttcccactatattgcctttgtttcaggatgatcttcccgtgtcagagctcttgccttttcagagaaacagcagtcttatttcaagagttcttcattggatgcaaaatgttgacctaagaactactccacttcctctggttattatgcagtactgcctaaccgtctacattcagaagcag

SEQ ID NO: 107793 - DNA, 546 bp, Glycine max
  Peptide Sequence Number=SeqID_224571
atggcccgcaccaagaaaattgcccaaatgatgtataaggcagcaaaggaaattactgacaagattgattccttggaggagcaggcctcacagggttcttttgtcagtcatggacgtcaggatatattggctgctaccattaggcgaccagaacacccttttcgtgtgcatcctactagagctggtccgataacagaaaaagtgactcaacaacgaatgttgtcctttagccaaatgcattctcagttccaatcgcacatgcaatcacagggactcacagtacctcctgagcctgaggttggtccttcagctgcttgtgttagcacaaaggagagttgtgttgatcactcagggaaaaattcagacacgggtgacttagagaaatacgggttgtacgtcaaagaaaattctcctcgcctggttgccctaggaagactttatgagtggccaacaaccgttcacaacatccctttgcgccatgatcaagtcaaggttggtattgaggaagttagagatgtagatgctcccattcatgtacccacttaa

SEQ ID NO: 107794 - DNA, 3687 bp, Glycine max
  Peptide Sequence Number=SeqID_224572
atgacaagttttcaaaaggttcatgctcttctctttcatatactcttcttcatacctttgcttccattgaaaatcacatcatcacaaagaacagaagcagaagcccttgtcaaatggaaaaacagtctatctcctcctcttcctccctctctaaactcatcatggtccctctccaaccttggaaccctttgcaattgggatgccattgtttgtgacaacactaacacaacagtgtcacagataaacttgtctgatgccaatctcactgggactctcactaccttcgattttgcttccctccctaaccttactcaactcaacctcaatggcaacaattttgaggggtcaataccatcagcaattggcaaactctcaaagctcactttattggactttggtaccaacttatttgaaggaacactgccttatgaactaggccagctaagggagcttcaatatcttagtttttacaacaacaatctcaacggcacaattccctatcagctcatgaatctccctaaggtatggcacctggaccttggatcaaactactttataactcctcccgactggtcccaatattcaggaatgccttccttaactcatcttgctctagatctcaatgtcttcaccggtggattccctagtttcatacttgagtgccataacttgacataccttgacatctctcagaataactggaatggcataataccagaatccatgtatagcaatttggcaaagcttgaatatctcaacctcaccaactctggcctaaaaggaaaactgtctccaaacttgtccaagctttctaatctcaaagaacttcgcataggtaataacatgtttaatggttctgttcccactgaaataggttttgtatctgggcttcaaattcttgaattgaataatatttctgcccatgggaaaattccttcttccttaggccaactcagggagctatggcgtcttgatctcagtataaatttttttaactctacaatcccttctgagcttggcctatgcacaaatctaaccttcttgagtttagcagggaataatttgtctggtcctttgcctatgtcattagctaatctggctaaaatatcagaattgggattatcagataattctttttctggtcaattttctgctccactgatcactaattggacccaaataatctccttacaattccaaaacaataaatttacaggaaatattcctccacagattggcctgttgaaaaaaattaactacctctatctgtacaataatctgttctctggttccattcctgtagagattggaaacctgaaggaaatgaaagagttagacctttcacaaaacagattctctggtccaattccatcaacactttggaatctgacaaacatccaagtcatgaatcttttcttcaatgagttctctggaaccattcccatggatattgaaaacttgacctcactggaaatctttgatgtcaacactaataacttgtatggggagttgccagaaaccattgttcaactacctgttttaagatatttttcggtgttcaccaataaattcactggcagcattcccagagaattgggaaagaataatcctttgactaatctctacctttcaaacaacagcttctctggagaactgcctcctgacttgtgcagtgatggcaagctagttattttggcagtcaataacaacagcttttcagggccattgccaaagtccttgagaaattgttcatcactaactagagtccggcttgataataatcagttaactggaaacatcacagacgcattcggagtactaccagatcttaattttatttcacttagtagaaataagttggttggtgagctctcccgggagtggggtgaatgtgtgaacttaactcgtatggatatggaaaacaacaaactttctggaaaaattccatctgagctaagtaagttgaataaattaaggtatctaagcctgcactcaaatgaattcacaggcaatatcccatctgaaattgggaatttaggcctgcttttcatgttcaacttgagcagtaaccatttttcaggagaaatccccaagagttatggcagattggctcagctaaattttcttgatttatcaaataacaacttcagtggaagcattcctagagagctcggtgattgcaatcgcttactgagtctgaatttaagccataacaatctatccggggagataccatttgaacttggcaatctgttcccactccaaatcatgttggacctcagcagcaactctctttctggagctattccccaaggccttgaaaagttagcatcgttggaggttctcaatgtctcacacaaccatcttacagggacaatcccacaatcactttcagacatgatcagccttcaatctattgatttttcttacaacaacttgagtggttcaatccccacaggtcgtgttttccagaccgcgacttccgaagcctatgttgggaactcaggtttgtgtggtgaggtaaaaggattaacttgttccaaagtgttttccccagacaaatccggagggatcaacgaaaaggttcttcttggtgttaccattccagtttgtgtcttatttattgggatgattggtgttggaatcctactttgccggtggcccccaaaaaagcatcttgatgaagaatccaaaagcattgaaaaaagtgatcagcctattagcatggtgtggggaaaagatggaaaattcacattttctgatcttgttaaggccaccgatgacttcaatgacaagtactgcaccggaaaaggaggatttggaagtgtctatagagcacaattactcacaggccaagttgttgctgttaaaaggctcaatatatcagactctgatgacattccagcagtgaaccgccagagctttcagaatgagataaaattgcttacaagattgaggcaccagaatataataaagctttatgggttctgttctaggagaggacaaatgttcttcgtttatgaacatgtagacaaaggaggtttgggggaagtattgtatggagaggaaggaaaattggaactaagttggactgcaaggcttaaaattgtgcagggaatagcacatgcaatttcatacctgcacactgactgctccccaccaattgttcacagggatataacattgaataacatactactagactccgactttgaacctcgtcttgcagatttcggcacggcaaagctgctaagctccaacacttcaacatggacctcggtagctggatcctatggctatgtggctccagaactagcacaaacaatgagggtgactgacaagtgtgacgtgtatagttttggagtggtggtattggagatattcatgggaaagcatcccggagaactcttgactacaatgtcttcaaacaagtatttgacatcaatggaggaacctcagatgctactgaaggatgtgcttgaccaacggcttccacctccgactggccaattagcagaagcagtagtgttgacagtgaccatagctttggcatgcacgcgtgcggctccagagtccagacccatgatgcgtgctgtggcacaagaactttcggctactacgcaggctactcttgcagagccatttggcacgattaccataagcaagcttactgggtttcagaaatag

SEQ ID NO: 107795 - DNA, 987 bp, Glycine max
  Peptide Sequence Number=SeqID_224573
tctattagcatgctgtggggaagagatggaaaattcacattttctgatcttgttaaggccaccaatggcttcaatgacatgtactgcattggaaaaggagcattcggaagtgtttatagagcacaagtactcacagaccaagttgttgctgttaaaaggctcaacatatcagactctgatgacattccagcagtgaatcgccagagctttcagaatgagatagaatcacttactgaagtgaggcaccacaatataataaagttttatgggttctgttcttgcaggggacaaatgttcttggtttatgaacatgtacacagaggaagtttggggaaagtattgtatggagaggaaggaaaatcggagctaagttgggccacaatgctgaaaattgtgcagggaatagcacatgcaatttcatacctgcactctgactgctccccaccaattgtgcaccgggacgtaacactgaatagcatactactagactccgacttagaacctcgtcttgcagtttccagcactgcaaagctgttaagctcaaacacttcaacatggacgtcagttgctggatcctatggctacatgactccagaactagctcaaacaaagagggtcactgacaagtgtgacgtgtatagttttggagtggtggttttggagataatgatgggaaagcatcctggagaactcttgtttacaatgtcttcaaacaagtctttgtcatcaacagaggaaccacccgtgctactgaaggatgtgcttgaccaaaggcttcgacctccaacgggcaatttagcagaagcagtagtgttcacggtgaccatggctatggcatacacacgtgcggctccagagtccagacccatgatgcgtcctgtggcacaacaactggcattggctactaagcagccttgtcttacagagccatttggcatgataaccttgcctgtgtcttctgactggaaagttcgtaatccccattga

SEQ ID NO: 107796 - DNA, 1149 bp, Glycine max
  Peptide Sequence Number=SeqID_224574
atggatgaaatagaggttcctacccttttcctctgcccaatttctttgcagcttatgagtgaccctgtcacagtgtgcacaggaatcacatacgacagagaaaacatagagagatggttattttcatcatgcaagaagaacaaaacctgccctgtcactaggcaatcacttccacacacagatcttactccaaaccacactctccaacgtttgatccaagcttggtgcaccaacaacaataatgcctggtttggcattgaaaccataatttcatctccaaagccaaccattgaccaaactcaaattgtgaaactcctcatggaagccaagaagttccctgaaaaacagctcaagtgtcttagaaggcttcaatccattgcctttgaaagtgaaagcaacaaaatctatttggagtctgcaggggcaatagatttcttggcttcaagtgttatgagtgaagcagctatagaactcttgtttcatctaaacccttctgaatctcacctaaaaaatttggtgaacagtgaggggattcaatttattgagtctttgtttcatgtcttgaagcatggaaagtgccaatctagagcttatgcaactgtgctattgaagtcatcatttgaagtggctggtccaacccaattgagcaatgtcacatcagagatgtttgtggaaatgtttagagtgttgagggatcagatttcacaagaagcttctaaggcagcattgaagcttcttgtggagttgtgttcatggagcaggaacaggatcaaagcagttgagggtggtggtgttctagccctcattgagctacttcttgatgtgctttgtggctgtgcagaaggaagagaagaattgatgaaccatggagctggagtggctgttgtggccaagaaaattctgagggtttctcatgtggcaagtgatagaggggtcaaaattttgacctccatttgtaggcattcagccacgcctagagtccttagtgaaatgctgctatttggggctgtgtctaagttgtgtttggtgcttcaaatggagggtagttgcaacgccaaggagagggcaagggagacactcaaattgcactctatggtttggaggaactccacgtgtattcctttctctttgcttgcatcctatccatga

SEQ ID NO: 107797 - DNA, 762 bp, Glycine max
  Peptide Sequence Number=SeqID_224575
atggcgaaaaaaccgttactctgctggctcctcctcctcgccgtgctcgccgaagccggagcttccgacgaagacggcgccgagctcgactactcgaagctctccggcattataatccctggcttcgcatccactcagctccgagcatggtccattctcgactgtccttactctccgctcgatttcaaccctctcgatttggtctggctcgacacaaccaaacttctttctgctgtcaattgctggcttaagtgtatggtgttggatccttacaatcagacagatcatcctgattgcaagtcccgtcctgatagtggtctttctggtattacagaacttgatccgggttatataacaggacctctttcatcggtttggaaagaatggattaagtggtgtattgaatttggcatagaagctaatgcaataattgctgttccatatgattggagattgtcgccctccaagcttgaagagcgggacctttactttcataagctaaaaataacatttgaaactgcttacaaacttcgtggtggcccctctttagtttttgcccattcattgggtaatcatgttttccgttatttcttggagtggttgaagctagagattgcaccaaaacattatatccagtggttggatcaacatattcgtgcctattttgctgttggagctccccttcttggtgcaatggaaaccattgaagcaacactttctggattcacatttggtcttcctatatccgaggttaccttttaa

SEQ ID NO: 107798 - DNA, 2652 bp, Glycine max
  Peptide Sequence Number=SeqID_224576
atggatgattctggaagtaaaactaaactactgaatccatggatgctccactttcagaaactcgctctcgaactcaagtgccctctctgttcatgtttggctgattgcataacggctgggtctgaatgcgctgtttgcaagacaacgtatgctcaaacagatgtaaggcacatacctttcgtggaaaacgtggtggcaatatatagaagcttggatgccactttttgtgctagtttgtttcagtcgcgttcttctggtggtgggagggttttggagccgtgccaaacaattcttaattcaacttctagtagtttaaaaactggcaagcttcctcggaacttaactaatttgaatgaggttggggttggccaaactttcaaatccaagagtgtggtgcatgataaagctgaggagcttgagttgtcttgtgggagagggaagcccaatccaatgcaatcttcccagatgggacttgggggccgagaacagtgtggagttatggaaatggatgtgaatcaagtaacacaatcagcacctgatagcccgcccttttgtgataccaaaggttcagataatgactgcagtgatcaagatagtgagcatccattacctcctggcagattggaaaattcttcactaaacagagcaagcgcaggaaatggaaatttgaaagaaagaatgggacagcttaggtctgaaagttcggtctctgaaactgagggtctggcaagggatctcaagagacagaagaatctggactttaaacctggaaaggaccctggcgcaccattgcccacaaatgcttcaattgacttgtgtccaattggaaggatctgctcattttgccaatcctctaaaatctcagaggttactggaccaatgctgcattatgcaaatgggaacttagttaccggagatgcagccatgaaaccaaatgttgtacctgtgcatagaatttgcattgactgggcaccacaagtgtactttgatggtgaagtggttaagaatttgaaggcagaggtggcaaggggagcaaaacttaaatgcagtaaatgtaatctaaagggagctgctcttggctgctatgtcaaatcctgtagaagaacttatcatgttccttgtgcaatggacatctcagattgccgttgggatcatgaggattttctcttgctctgtcctgtccattcaaatgtcaaatttccatgtgagaaaattaggtccaagaaacaggcaacacagaagcatcccactttgtctcatctgccatctcaccactcaaatcctcttgaagcttcccatgatgatgatgtaaaattagtattttgtggatctgctctatcaaatgaagaaaaggtacttttgatcaattatgcaagcaaggttggtgctactgtgaccaagttttggacctcaaatgtcactcatgtaattgcagcaactgatgcacatggagcatgctccaggacattgaaagttctgatggcaattctaaatggacgatgggttctaaaaatggattggataaaagcatgcatggaagaggtaaatcctgtggaggaagaaccatatgaaattaatcttgacaaccaagggtgtcaaggtggcccaaaagctggcagacttagggcattggccaatgagccaaagctattcaatggcttaaagttttatttttctggggattatgtgtcaacttataaggaagatctcgaagaattaattgaagtgggaggaggtactgttttgagaagcaaggaagaattggaatcacaaagacatgaatgcaaaggagattcttcacagttgctgattgtttacaaccttgatcctcctcaaggatgcaaattgggggaggaagtttcaattctttggcaaaggctaaacgatgcagaggatttagctgctaacactttacaagtcattggtcacacatggattcttgaatcaattgctgcatttcccactgagataggattgatatctgggcttcaaattcttgaatggaataacattgcggctaatgggaaaattccttcttccttgggccaactcaaggagctatggagtcttgatctcagaaattggaaacctgatggaaatcaagagttagacctttcacaaaacagattctctgttccaattccaccaacactttggaatctgacaaacatccaagtcacgaatcttttcttcaatgagttctctggaaccatttccacggatattgaaaacttgacctcaccagaaatctttgatgtcaacacaaataacttgtatggggagttgccagagaccattcttcaactaaatgccttaagaaatttttctgtgttcaccaataatttcactggcagcattcccagagaatttggaaagagtaatccttctttgactcatgtctacctttcaaacagcttctctggagaactgcatcctgacttgtgcagtgatggtaagctagttattttggcagtcaataacaacagcttttcagggccattgccaaagtccttgagaaattgttcatcactatttagagtctggcttgatgataatcagttaactggaaacatcgcagatgcatttggagtactcccagctgcagaaataagttggttggtgagccctcctgggagtggggtgaatgtgtga

SEQ ID NO: 107799 - DNA, 141 bp, Glycine max
  Peptide Sequence Number=SeqID_224577
atggagacttcaatccattctcctttaacgtttaggaaccttaatagagcaaccggaggaagagctctagagagcattagaaatgccacaattgataacagagaacgctttagtgactacatcgagttgatgtcccaatga

SEQ ID NO: 107800 - DNA, 2316 bp, Glycine max
  Peptide Sequence Number=SeqID_224578
atggccaagataaatgagcaacaactaatgatgagcctatacttctaccagttatcaaacaagtgttgttgcggaggcggcatcatggggagtagggctaagcaggggaggagattgcagaagatgatgaagtgcatgtgcctgagggagccgttgaagaaaggaggagaagatgaaacggttccttcctcggattctcttgcaatcacggagttttattcttcaacggcgagtgggcgttctggcctcgacggagaaattgagaagatggggtcgggttctgggaacatggatgaagctgaattgtccttgcgtgagagtggcatcatggatatcatggacaatgaggaagctagagctttgttaggaaaagatgaatatcaggaagggaatatagaagcagctttacgtatttatgagaggataaatataagtgctgtgacttccaagatgaaaatttcccttgccaaaagcagagaacatcataagaaacattcccattattatgctacgcctccgatgtccatatacacggttggattactgttggaagcaattttcctaaaagcaaaatgtttgcaggttctggggaggtttaaagaatctgcccaaacttgtaaagttattctggacatagttgagtcttctttacctgaaggcttgcctcaaaactttggtcacgagggtaaattgcaggagactttgggtaaggtagttgagctacttccagaattgtggaaacttgctgattctccccgtgatgttattttgtcttaccgtcgtgcactccttcaccaatggaatcttgatgcaaaaaccatagcaaagattcagaaagaatttgttgtttttcttctatatagtggaggggaagcaatcccttcaaatcttcgttcccatatggacagctcgtttgtacccagaaacaacttagaagaggctatacttcttttaatgattttgctgagaaaaatatctttaaataaaattgaatgggatccgtcaattttggatcacctttcgtttgctctatctgtttcaggggatttgacaactttagcccatcaatgggaagaattactccctgggactatcaatcgaagagaaagataccatgccttatctctttgttattatggcgcaggtaatgacttggtagcactgaatcttcttaggaaattgttgagtagtagagaggacccaaaacatgttccttctttgttaatggcttctaagatttgtagtgagaaccctgatcttgcaaaagatggggcaagcttagctcgcaaagtgcttgagaacttggatggaagatgtgatcggttggaaagtctttccagttgcttacttggtgtttcactttcagcacactcaaaaattgatatttctaattctgagagggttgagaaacaatctgaggcacttcattctctggaaactgcaagcaaagtgaccaaaatgagtaacccccttgtaatatactacttgagcttagaatgtgcagagcaaaggaagttggatgctgcacttcattatgcaaaatgctttctaaacttagaagttgggtctaatattaaaggatggttattgttagcccggatattatcagctcaaaaacagtttttggacgctgaatctattgtcaatgaagctttgaatcagactggaatatgggatcaaggagagttactgcgaacaaaagctaaactacaaatagcacagggccagttgaagagtgccattgaaacatatactcagcttcttgctattctcctagttcagagaaaaacttttggttcaaagaagaagctgtataaggactacatagatcatgctaggagcatggaagttgaaatatggcatgatcttgcttttgtgtacataagtctgtcacggtggcatgatgcagagagcaagctatgtaacaagttagatgctgtgaggtgtcaagagatcacagagcttgggtgtgaagcaaagcatgccttattaaacaaatgcgtaggtacaatgcacgaagcaaagggcctttacaaagaggctttaaaagcttttcgtgatgctttgaacattgatcctggacatgtccctagcttgatctctgctgcggttgttcttagatggtgcagtaatcgatcaaatcctgctatcagaagctttctgatggatgcactacggcatgacagatttaatgcttctgcttggtataatcttggtatttttcacaaggatgagggtacaattctagaagctgcagaatgttttgagacagcaaactctcttgaagaatccgctccggttgaacccttcagatga

SEQ ID NO: 107801 - DNA, 426 bp, Glycine max
  Peptide Sequence Number=SeqID_224579
atggttggttactactatgctcctagcggcaagccttaccctgataattggatcattacagatgtcgtttatgagtttgaaggatctctaatctcaaggtcagggaatcaggttgaagggaaccctggagcaataagtggcgatgagacggtgccatatctctccctttcctggtgcaaaaactggcttggaccaaaagtgaacataacaaaagctccacagtcagagcatgatggttcagatgtacagattaaattgaatgtgaaacatccccatgaagaagatattgttccaaacatgacaagatcaccaagggtgaagtacataacctattatgaagattctgaaagtcttcctggaaagaggacagcagtttgggagcttgataaaggtgcatggcttgtcctgggagttgtcatggactaa

SEQ ID NO: 107802 - DNA, 360 bp, Glycine max
  Peptide Sequence Number=SeqID_224580
atgcctttttccaagtactgtagaacagataataaatattggaagcatttttctgggggaagtcacgtgggtccacaaacatatcactgtgatgagcaggagtttaagacaaacttatctgggtggccaacaaaaataatcaacattgaaattccctcaactcgtgcatttgatgcatatccttcattctcagaaatacccgaggccaacttgtccagcatggagtgtggactacctactcaattatctttctcagctcgggaaatatcagatggcacctttttcaaagcaattgaagattatgacccagacagcaagaggctcttgtacctgttagagaagttagtgttatctcattaa

SEQ ID NO: 107803 - DNA, 2128 bp, Glycine max
  Peptide Sequence Number=SeqID_224581
atgccgaggataagaaatgaaagagttgaacagggaagagacattgcgatacctgagaaacaaggttttgccccggcggtgaagagaagaaggaaagaagagcagaaaaatgagcaaaaagcagagggtggtgaaattggacgaggagcaaattgcagaatagcgggaaatctttcgctcattcgatcgaaacaaggacgggagcctgacgctgttggagctgagtttgcttctgcgatcgctgggtctgaagccgagtcaggatcagtcaaagggtggataccaacaataatcggttggtggccggagttcgtcacattggtggcgccggagcttctgccggcgaagtcgccttacacagaggagcagcttaggcacttgttccgaatgttcgaccgcgacgggagcggcctcgtcactgcggctgacactaacggcgatgacatgatcaactttaaggagttcgctcaaactattacttctgctgcttttcataactcctggccctatctctctctttctagggaagtccaagaccgacgcctcagcatcatcgacgtttcctccgccgacgattcgcttctcgatggaaaccctctcagccaccaacattcagagaatcaagagcactcagatatgttgtgcactccgaactcgaagaagttcgaagacgccgccaccaaactccaacagtgggagcacgatcctcactccaatgattcatccggaaacggaaaacctaagaaaaacagcaaatgcaatctgcgcaagagtttagcctgggacagtgcctttttcaccagcgccggggttttggatccggaggagttgacttgtataattgaaggtgttgagaaggatgaaaagcacgaattaccggctattcaagaggatgtgtacaagtcgtgtgagtctatatctacgttagcgagtgatagcttgacctttgaaagtgtggacatggagggtgatttgtttgaggatgtaagagcttcaattcagaaatctagcaaaaagtcctgccctgcagcttcaaacaccaaagtgccatcttcccccgcggttccattgttccaaactcatgactcttcgaaaaaggttggcatggtttctcgcaagaaggaaatttgctatgagaaatggagatgtgcatttcctatgagaaatggggaggatttctactgcagcacggtggtcccacctgcttctaagaatccaattgctggcatgcaagggtttgggaaaatgacaaagaagaataatcctattttcccacaaattccacagcctgtggctacaaggagagagtcatctattttaaagcaatcaaaggcaccagttaggtctagtttaagttccactcttccatccaagagagattcacttggcaatctacatgtcaaaagtgaaagggacaaggcaaaacaaacagttggtgatagagtcagttcagtggcaaaagcatctgttcttggaggttctcgaggttctgtgcctaagccaacactaccatccaaatcacctgttggtccaacagtatcaaccaggactagatcagtgacttccacatcttccggtaacaatttatctgacaatattggtaaatcttcttttagttacttaaaaagaagttataagccaacctcgtgttgctcggttgtcaaaacaccttcaagaattgcttcaagaaataaagctgaacctgagatttctagtctttcaagcttgatgtctgccacaaagctttcttctagtatttcacctgctagctctatcagtgactggtcttcatcagagtcatcctcaacaacttctatggctaaacgtgtgtgtaatagttcaaggtccagcattgatagtgggtcaagcagaaaggttttattgaacactgatacagatcaaggtacacatcctcagactcctctgagtgattcaagcttattagaaaggcaagaggcttggcatagtgggattattagtcagaaggaaaggacagcacctggagcagcagttcttcctccagcttccaagaaagcttcaggccttcgactgccttcaccaaagattggtttttttgatggggtgagttttgctttgtttatatttgatgtagctagtaaccgtgtgg

SEQ ID NO: 107804 - DNA, 129 bp, Glycine max
  Peptide Sequence Number=SeqID_224582
atgattccagagtacttcaggaaatccagttcttacatcagtcacaatttaaggatcagaaggtggggagcaaagcttgagctattcaagccagaaatttcagcaatcaagcttaagaataaatcttaa

SEQ ID NO: 107805 - DNA, 1356 bp, Glycine max
  Peptide Sequence Number=SeqID_224583
atgggggaaagatactctgagttcaatgggaatcaggtgaatcttcaatggtggtcttttgtgttctctgcatcggagggaatgtatgaagcttttctcggtgtgtgcttcgctgttctattgaaggcaggtcatgaagccggtgaagttttcgccggtggagggacggtgtggctgcggcggttggggggtggtgggtatagctcagaaggttggtcctatgttttggcccttcatggccacagaaaaatgcaatcttttaggttggcaattgagcaccatggtgatcttgaatctcttgagttttgggagggtttgccacatgatatgaagaacttggcaagtgagttgtatcaaaatcaatgtagaatgaatgagacaattgtgatttgccacagtgaacctggtgcttggtaccctccactgtttgaaacctttccatgccctccatcttcttaccatgatttcaagtctgtgattggcaggactatgtttgagaccgatagggtgaacgatgaacacgtggagcgctgtaatagaatggactatgtttgggttcctacagagtttcacaagtctacatttgtgcaaagtggggttcatccttccaaggtggtgaagattgttcaacctgttgatgtggagttctttgatcctgtgaggtacaagccattggatcttgcttctagagcaaaacttgtcttaggttctggtgtgaggaagagttttgtgtttctaagtgtcttcaagtgggagtatagaaaagggtgggatgtgttgttgaaatcatacttgaaggaattctcacaggatgatagggttgctttgtacttgttaacaaatccttatcataccgacagggatttcgggaacaagatattggattttgtggagagttctgatatggtagaaccagttagtggttgggcttcagtgtatgtgattgatacccacatagcatcgagggagtttccgagagtttacagggcagctgatgcttttgttcttccttccagaggggaaggatgggggagaccactggtggaggccatgtcaatggcattgcccgtgattgcgacaaattggtcaggaccaactgagtttttgacagaggataatagctatccactgcctgtggatagaatgagtgaagtaatagaaggtccattcaagggacacctttgggctgaaccttccgaggataaacttcgggtttttatgagacaggtgatggataatctcactgaggctacagctaaaggcagaaaggcaagggatgacatgataagacggttctcgcctgagattgtggccgacattgttgcagaccacatacaaaacatactagcgcaatga

SEQ ID NO: 107806 - DNA, 1073 bp, Glycine max
  Peptide Sequence Number=SeqID_224584
atgcttgagtacttgaacctttctgtaaacaactttagcggaggaatacctgagagcttcaaaagcttgcaaaatttgaagcatatataccttttatctaatcaccttaatggtgaaattcctgaatccttgtttgaaatttctcacctggaagaagtggatcttagcagaaacagtttaactggttcaatccccttaagtgttgggaatatcactaagcttgtcactctggatctttcttataatcagttgtcagggacaattccaatatccattggaaattgtagtaacttagagaatctgtatttggaaaggaatcaattagagggagttattcctgagagtctaaataatctcaaaaatcttcaagagttatatctcaattataataaccttggaggtactgttcaattgggatctggatattgcaaaaagttgtctattttgagtatttcttacaataactttagtgggggtataccatcaagcttggggaattgtagtggtctaatagagttttatgcttcagggaataacttagttggcactataccatcaaccttcggcctcctgcccaacctttctatgttattcattccggagaacctattgtcagggaaaatacctccacagattggtaattgcaaatcactgaaagagttgagtttgaattccaatcaacttgaaggagaaattccaagcgaattaggaaacttgagtaaattgcgtgatcttagattgtttgaaaaccatttgacaggagaaattccacttggcatatggaaaattcaaagccttgagcagatccatatgtacattaataacctctcgggcgagctaccacttgagatgacagagcttaaacatcttaagaatgtctccttgtttaacaaccagttctccggagtcatacctcaaagcttaggaatcaatagcagtttggtggtgttagattttatgtataataatttcactggtaccctcccaccaaatctttgttttggaaagcacctggtcaggctgaatatgggtggcaatcaatttattggcagcatacctcctgatgtaggaag

SEQ ID NO: 107807 - DNA, 276 bp, Glycine max
  Peptide Sequence Number=SeqID_224585
atgaagagactacaatctataagtataaatcccaatcatgacaggttaactgaagtggtgaaggtgcgcatgcatcctcctagtgctagccgcgtattacttccagatggtagatacatggcttatcctgatcaaggtatacctggagttaaaacatcattgcttgatgagtatggtgtcgcttggtcacatatgatattcctgggtttagggagagtgatcctcatcccaaccggaatttcaactcgtcagcgatggattcttgggcttcactaa

SEQ ID NO: 107808 - DNA, 201 bp, Glycine max
  Peptide Sequence Number=SeqID_224586
atgcagaagcagcatataacaaggaagaaaaacatagaagcagcaagagatacagataccccatatagaaaggagctagaaggagccacaacaagtttgcaagaagagcaaagaaaggtggtgagttgttttgcacatgaaataagagaagaggaggtagaagctgaaaatgaggaatctattttgctcttcttcatataa

SEQ ID NO: 107809 - DNA, 372 bp, Glycine max
  Peptide Sequence Number=SeqID_224587
cgagaaaatgctgttgataacttcagagctggaaaaacatgggttttgattgctactgatgtagttgcccggggcatggatttcaaaggtgtgaactgtgtgatcaattatgatttccctgattctgctgctgcatatgtccacagaattgaaaatgttgatttttcattaggtcgttctggcagagcagggaggactggagaagcgattactttttacacggaagatgacattccattccttcggaatgttgctaatcttatggcagcatcaggctgtgaggttccttcctatctcatgaagttgcgcaaaaagaagtggaagaagcaccgacccaaaagagattcaatctccacaaaaccagacctatag

SEQ ID NO: 107810 - DNA, 2292 bp, Glycine max
  Peptide Sequence Number=SeqID_224588
atgaccattcaaagccaaattcgatgtatatataattgtgtaagacctattttaccaacaagaatcgtctcctgtctcagtagagagttatcaaccaacagttacatcaacttgatgtgcaagcaacggcattacagagaagcgcttgatacattcaatttccatcctaagaattcaagtatccagctagaatcaagcacctatgggaatttaatcttggcctgcaccagcattagatctcttaaatatggcaaaaaaattcatgatcatattttaaagtccaactgtcaaccagaccttgttctccaaaatcatattcttaatatgtatggaaaatgtggttctttgaaagatgctagaaaagcttttgacacaatgcagctgcgaaatgtggtctcttggactataatgatctctggatactcgcagaatggtcaagagaatgatgccatcattatgtacattcaaatgctgcaatcaggttatttcccagatccgttaacctttggaagcataattaaggcttgctgcattgcgggggatatagatttaggtaggcagctgcatggtcatgtcattaaatcagggtatgatcatcacttgattgcacaaaatgctcttatttcaatgtatacaaggtttggacaaattgtacatgcatcagatgtgtttactatgatttctacaaaggatttaatatcctgggcttccatgatcacggggttcacccaacttggttatgagatagaagctttatatcttttcagagatatgttcaggcaaggtttttatcaaccaaatgagtttatatttggcagtgtattcagtgcttgcagaagccttctcgaaccagaatttggaaggcaaatacatggaatgtgtgctaaatttggtttagggaggaatgtttttgctgggtgctccctctgtgacatgtatgcaaaatttggattcttaccttcagcaataagggccttttatcaaattgaaagccctgatttagtgtcatggaatgcaattattgcagcattttctgacagtggtgatgttaatgaagccatatattttttttgtcagatgatgcatacgggattgatgccagatggcattacttttctctccttactttgtgcttgtgggagcccagtgacaatcaaccaaggcacacaaatacattcttatattatcaaaataggtttggataaggaagcagctgtatgtaactctttgctgaccatgtacacaaagtgttcaaacctacatgatgcattcaatgttttcaaagatgtaagtgaaaatgccaatttagtttcttggaatgcaattctatcagcatgcttgcagcacaaacaggcaggagaggttttcagactatttaagctaatgcttttttctgaaaataagcctgacaatatcaccattactaccatattaggaacttgtgcagaattggcatctctagaagttggcaatcaagtccattgctttagtgttaaaagtggactggtagttgatgtttctgtcagcaatagattgatcgacatgtatgcaaagtgtggttcacttaaacatgctcgagatgtttttggttcaacccagaacccagatattgtctcatggagtagtttaattgttggttatgctcagtttggacttgggcatgaagctcttaatctctttagaatgatgaagaatcttggtgtccagcctaatgaggtcacatatctgggggttctcagtgcatgcagtcacattggattggtggaggaaggctggcacttttataacaccatggaaatagaactagggattccaccaacaagagagcatgtttcttgcatggttgatttgcttgctcgtgctggatgcttgtatgaagctgagaattttattaagaagatgggttttaacccagacattactatgtggaaaactctacttgcttcttgtaaaactcatggtaatgttgacattgctgagcgggctgcagagaatatacttaaacttgatccttccaattctgctgctctggtgctactttctaatatacatgcttctgtgggcaattggaaagaagttgcccgattaaggaacttgatgaaacaaatgggtgtacagaaggttcctggtcaaagttggatagcagttaaggatcagatccatgtgttcttctcagaagataattcccatcaacagaggggcgacatttacacaatgcttgaagatttgtggttgcagatgctggatgatggttatgatccttgtcagaggttagacattagcatttggtag

SEQ ID NO: 107811 - DNA, 1863 bp, Glycine max
  Peptide Sequence Number=SeqID_224589
atgactcaagtgatgagaggagaggtgattgagaaggcttatgctgggtcttggaaggctcacaagtccccagacaagccttaccttattgaaaagatcaacagaaacgaccctcaagaagttatcttttgttttccaggatcaggtgctgtcagggattggtactctcagaaaaactttggtgaaacaaaaatagatcttggtctgtttccctcactcagaagcattggtatcgatgaacaagctttggtgaatgaggcctttcagaaaaaattccaagaaattttgtctgccaaaccatcacttgcggatgaggtggagaaagcaatgagtaaaaagaagcaaatagtgtttgcaggacactcctctggtggtgcggtggctattctggcaaccctttgggccttggaaaactaccaacctcctaaatcacacggtggcatccctcccctgtgtgtaacctttggttctcccttagttgggaaccacatattttcccatgccacaaggcgtgaaaattggtctcactacttttttcactatgtgatgagatatgacatagtgccacgaatcctccttgctcccctctcttcccttgacccaaaatttgaaccaatttcccagtccttcaaccccaaatccaagtctttcatgagtgactcagtgggaagagccagtgcagaaacaacttcagagttctactttgccataatctcaaatgctgcaactgtcacaagccatgctgcttctaagttaatgggaaccacagataccacattagaaacttggtcaaatttcattaccttaagcccttataggccctttggcacttactatttctgcactggaaatggaaagtcagggaagaaaattgtgataacaaactcaaatgcagttctacaggtcctgtttttctctgctcaattaagcactgaagcagaagctgctcaagttccctataggagcttacgagatcatacaatttatggcaccgaactgcaacaaatggggcctcagaatgttgtgcacttggatcaacatcagctccagaatcttcctttgtctgaagatggtgctggtggctcaaatgcaaccattaacacggccttaaatgaccttggcctgattccaagagcaagactgtgcctccgggcagcagcagagtgggaggcaagaagaactgacaacgagaataagatcaaagagaagaaagattttgttgcgaaaaaattggacgttcttcgggaatacagaaaaatgtataaggataaaagggtgggtttttacgatggcttcagggagcataagcaaggtgaggatgacttcaaagcaaacgtgacgaggctagagctggcaggtgtgtgggacgagatgatggaaaaggtaagaagttatgaactcccagatgaatttgaaggcaacaaagattacattgaccttggaactgagcttcggaaacttatggaacctctggatattgccaattattaccgacatgggaggaattatgaggacagttcttcttcttacatgattaagggaagaccaaaacgatatagatatcctcaaagatggttggaacatgctgagagaaagtcacatgaatctctctcagcatcttgcttctgggccgaggtggaagaacttcactacaagacaagtaggagtagtaacattgtctcattggatcaacaatttaaggaaaggattgagaaattagagattcaaataaaagcatggagtgacagaaaggaactagatgaggatgtcttcttggagggttctaccttggtgaagtggtggaaagcacttcctcaacaacacaagcaacattcatgcattaaaactcttattagagagtga

SEQ ID NO: 107812 - DNA, 2139 bp, Glycine max
  Peptide Sequence Number=SeqID_224590
atgtcagcacctagtcatgcaattgtaaaggctgtggctgccacagctggggctatgttacttattgctgcgatatttgtttactttttttacaaatttgttcttgctagataccaccagagacacaaagttggtgcaagtttgcttcgagaatcaggagtgaaccttgagtatattaacaaagttggtggcaatgtgaagggactaattgttgaagaaaatggggtggatgttctttatgtgatggacacagaaagaagaccattgattactggttttccaaatagtatattcaatccaagttacgaacttgatgaggaagaaaagagaatagatataatggtccaaaggtccaaagtatccaagcctgaaattccagaggcatgtgaatctcctagtgttgttggtcatgagaatcaagttaagccagtgtcacaagcatcatcaatttcaacatcactaacaccaagacaaaacttgccacaatcacctcaaccactaccacaatcttcaccaatgattgatgagaacaagaaaactcaaccatcaccaccaccaccaccacctcctcctcctcctcctcctcctccaactcgtcctccaccaccaccacctggtccacctccacttcctaaggccagtggcttcatttcatcactgaaacccccacctgctcccaaagggaaaacaaacataagaagcactaaagagggtatggtaggggagagttcaagagagaagggtgttggtcaaacaaggctgaagcctctacattgggataaggttgcagcaaatgttgatcattcaactgtgtgggatcagatcaatgatggctctttcaggtttgatgatgaactaatggaatcactctttggatattcaagcagctataaaacccaagaaagaaacagaactctttccactttggccaagtccaattccaatgcaccagctcaaatattcattcttgagccaagaaaatctcagaacactgcaattgtgctaagatcacttgctatttctcgcaagggaatcttggatgcagttcttgatggtcagggactaagtgttgagacactagaaagactaactaaaatagctcccacacaagaagaggaagccaaaatcatccaattcagtggcaacccggatcagcttgctgatgctgaatctttcctatacttcattcttaaagcagttccaacagcattcaaccgtttgaaagcaatgcttttccggtcgagttacaattgcgaagttcttcagctcaaggaacagctacaagcacttgaaatgggttgcaaggaactgagaactagtggcctgtttttgaaactccttgaggccattctcaaagctgggaaccggatgaatgccggaacatcaagaggcaatgcacaaggtttcaacttgagttctcttagaaaactttctgatgtgaaaagcacagatgggaagactagtttgcttcacttcatagtggaacaagtggttcaatcagaaggaaaaagacaagctatctatcaaaagcacaaacttcacataagcaatggtgaaacaagcaatgtgaataatagaccttattcatatagcctcatacaacaagaggcagataaagaacatgtattgcttggtttgcaagtattaggtgggctaagtgaagagttatctgaagcaaagaaagcagctagtcttgagtatcataatttcatcactatgtgttcaactctcaatgctcatgttagtgaaatcagacagattataacatgctgtggcaatattaggagtggtggatttatcaatgaaatgaaagggttcctagaggaatgtgagggagaacttgacgtggtgaaagaggagcagacaaggatcatggagcttgtgaagaaaacaaacgagtactatctagcaggagcatctaaagacaacatgagttttgttgacatggtagataaggcttgcatagaactaaaaaagaaggtagaaaagaagaatattgtgggaggagaggctgtgtcaacaacaccacctttgtcaccatcaaagaggacgccgctcagattccctaactttgatttgtattttctatcgaatgtgtcagaaactacatcttctagccaatcagaagatgatttctga

SEQ ID NO: 107813 - DNA, 259 bp, Glycine max
  Peptide Sequence Number=SeqID_224591
atgccaatgtaccaacaacaagaacaacctcctccaatgatcagtgtgacacaacaatcatcacatgagtccattggtcccttgattggagttctggtcgttgtaattgttttgggcgtaattgctgttatgattggaaggctttgttcaggaagaagaatcatggggcatggccaatacgatgttgaaagctgggcagagagaaagtgttcatcttgcattgatggcagaattaacctctcacttcccacaagagtca

SEQ ID NO: 107814 - DNA, 687 bp, Glycine max
  Peptide Sequence Number=SeqID_224592
atggaatcaatcagaaattctgctgattgtatgctgttaagtgctccagactcattggtagtgtcgataaccaaaaatcatgttgacagtgatgaggaagctagcacagctggtgttgttttgagtacgcctcctcaaagtcatgtcaatagctttggaattaatggccttgatatgctcaaattcacgtatagggttccttggcctcttgaactcattgcaaatactgaggcaattaagaagtacaaccaggtgatgcggttcttgttgaaggtcaagcgtgcaaaatttgtattagataaagtgcggagatggaagtggaagggtaagggatctgctacaaacaacagaaagcatcattgggaacctgagcatttttatctgttactacaatttctatggcgggaactatgcgaaggtatgactgcagcaaaatctctggatgaagtcattgaagtccatgaggcttacatcttatcaattcagcggcaatgctttgtggttcctgataagctgggggctcttattgccagccgcatcaacagcatccttggcatagctttagatttttataacatacaacagacattaggtagcggtggagctgtttctgcaatcaaagcaaggtgtgagatggaagtggaccggatagacaacagtttgatgattgcattgctttcttactaa

SEQ ID NO: 107815 - DNA, 246 bp, Glycine max
  Peptide Sequence Number=SeqID_224593
atggcacttggcaaaaactcaaccatgcaaggtgagccaaacccaaccatgatattcaatacaaaaagatgcaaagaagacagagtcacgaaaaataaggttgcagaaaaatacctaggtacagtggcgaggtgtcacggtggcgataaggttgtagagagaggtagagtcgcgaagaagaagcttagatggagaagaagagaaagcaagaaaaataggactcgcgttaacatcggctttcaataa

SEQ ID NO: 107816 - DNA, 153 bp, Glycine max
  Peptide Sequence Number=SeqID_224594
atgttgctagatataactaggctctgtaataggataagatttcctcgtgaaggaggtatggcaccatcaaggttacttcctccaggtttgaatagaagtccacctaatcatcactcgacttttattggattgaaccagtcagaaagtatatga

SEQ ID NO: 107817 - DNA, 219 bp, Glycine max
  Peptide Sequence Number=SeqID_224595
atgtcgagcgacgacaacaactacaaccacaaacaaggtcagggccaattgcagattaccctatttagaggaggagcagtcagagatgaagcttgtttgtcatggtggccaagagctactactccttactcatccacaagtgaaggaggcttacatggagtgatcagggttattagaccttgttacagtgcaatatcttgccaaaaacaagggctttaa

SEQ ID NO: 107818 - DNA, 363 bp, Glycine max
  Peptide Sequence Number=SeqID_224596
atggagtcaacaacggtatcatcatcggagttggagacgatgcttcctcttcctctggcgtcggagtcgcagcaaccctgcgtctccgaacttctctccttcacgctcgattgccttcacaaggaacccgaactcctttgcgtcgacgccgactgcattcaccaccaaatgcaagaggtcgcagtcggcaactaccgatctttcattgccgccgccgacgccttaatcgccattcaccaggaagtttcttccattgacaaccaccttgaatctctggttcttttggtagctgaacaaaggataagaaccaacaagtggtgcctaccgtggggcatagatcaagatcaagaaagattggaataa

SEQ ID NO: 107819 - DNA, 852 bp, Glycine max
  Peptide Sequence Number=SeqID_224597
atggctccgatttcgacagaagagctttatcaatttcacaaaactcaccgtgaggtcttctgttttctggtcttcaaactacatcgcgacctagcaaagtcccttctagtcatggccttatggatttggctagaatacaatggatacccccaaatcacccatgaagtgatggacgtgccttacacttttgtcaatggtcttgttgatgaagctgtctcttgtctggaatgcttagaagaagaaaattttgtcgtcccaaataatggtggattacccttaacaacaaggctaacaaaaagtggcatatctatgaaaatctttaagcagaaaaggtacaccataatagccggtatcaaaagtgttttgaaaaatatttgtactcgaattttttctgatcttgtgcagatagctctaagaatcaatatcaacagagctggtacatcacaaggtaacatatcacatataactatccctagttttccacaccctttgtttggtacctttgatatgacaccaatggatactgtgagcctagacttgtttgatgagcgaatatggacaaaggggccctgtgatgatgttactcctgatgataaatccatgtttgtaacattttctagaggttttccagtgtcaagagacgaggtgataaaattgtttacatatgcatatgggaattgtttggaggacttatctatgggaaaccctgatgaaaataagcagtctttgtttgcaatggtggttttgaaaaccgtggaaacagtcgatcaaattttgaatgggaaacgcgttgcaaagcttcggataaatggaaaacacatttgggttcgcaagtatgagcgtcgtgactga

SEQ ID NO: 107820 - DNA, 207 bp, Glycine max
  Peptide Sequence Number=SeqID_224598
atgttgtttcctagtgtatttgcactaagtgagggaactactctaaatgcgccctacggtgccttaagtgtggaaatggctaaagaacaagtcccaaatcattgcatatccatactatgcacatacaatgggttgaacaagtatctaggaggacatgagatgcccatggagatacttatgttatatcttcttaggctaactttttga

SEQ ID NO: 107821 - DNA, 576 bp, Glycine max
  Peptide Sequence Number=SeqID_224599
atgtcaacaagagaaggtatgggttacattggttttagaggatcaataaataatgaatctaatccgctagttattctcaatatctactcatcgtgcactttggaggtgtttggtgatgtgaaaaataaacaaggttgtgttgttaaggagattagagacttggattctaaagatgagaaaaaggaaccagtgagagttaaggaggaagtgaagatgttctttgaagcaaaattcaaagagcaagagggtagtgctatttcacttgatggtgtcccctttgcttctattgatcacaacaataactatttgttggtggctaaatttttggaagaggaaatgagacaatcaatatgggaatgtgatggtgataaatttcctggtcttgatgactacaactttcacttcatccgatcttgctgggaattactcaaggaggacattctaaaggtgatgaaggagtttcatagaaaggaaatattgcctagaggctccaatgcaactattttggcacatattcctaagattgagagtcctattggtttgaatgattatagacctatatccctagcttgttag

SEQ ID NO: 107822 - DNA, 501 bp, Glycine max
  Peptide Sequence Number=SeqID_224600
atgtttggctttctaagatttaaaggtgtggaaaatgctttgaaattggaaaggcaactggaacaaactgttattcgtaatgttaagatgcatgtgaatctccaagagtacaaaaggaggaaatatgatgatttgggattctatatgaaggggaagcagtacggaggtgcatatgaaggaccacaacaaagaagtgatgaacaaggagaacaaaaagaagtagatgatggtatgagggaaaagattaataaaggcaaaattcatggaatttggtctttgtttctatcattggaaaaaaggaatcccaccatagttccagggaatagaatggcatggatcatatgcatgggtatcccattaatgaatttaaaagaagaaaatttcaagtgctttgaaggaaaattgatgcaaaaatttgaagaaaaagtcttcaagaaaaagttgaagattgggacaactcgcttagcacacaagacaggcccagcgcagctcctcgcttag

SEQ ID NO: 107823 - DNA, 750 bp, Glycine max
  Peptide Sequence Number=SeqID_224601
atgggcattgtgtacactgataacagtgtgaacatatcagctggggtggtgaatgccacactcacagatattgtgtacactgataagacacttgccatatatcatgtggagcaacctctcattcctttagacttctctaagcctaagcctatagcttcagcaccagctatggccaaggctcctaaagctgataaggagaactcttcagcagaagatgaggatcaggctcaggcagccaaggacaactcagatacaacacgttttgttggcattcatggaacaatgttggtgtccattggagtagctctgcttacagtaacaactacaatgtcatttggaattgatgttcagccatatttgacttcttactacttcaatattttgcttgatactacagtgttgtgtacaaaaggaggaattatgttgtgtgttctggactgcgtcgtctgcttcccattcaagactggaagtgacatactccttgtatttggtgactatctttcgagtttgctcaatctaatgctctatctctgtgggggaaatatttttgtccatgtgtcagctatgcaaatgggagacgacaaacaacattggaaatcgattcctgttgtacctgttacagatggctatgttattgggagtagcatcaaatcgattcctattgttggaaaggatattactctttttgttcaacagcttatgcgggggttcgagggttctgtcataacatggaaaagaaagatcccttag

SEQ ID NO: 107824 - DNA, 1521 bp, Glycine max
  Peptide Sequence Number=SeqID_224602
atggctaggttgaaggtgttgtctgccctagacacagcaaggacacaatactaccacttcaaagccatcatcattgcagggatggggctcttcaccgatgcctacgacctcttctcaatcactctcatcatcaagataattggaagggtatattacggccaccgcgaaggtgaaaaccggtacgaaaccccaccggaggtcgtgtccgccttggtcgccgtcgccctgctgggcaccgccgtcggccagctggtatttggccggcttggcgacctcaaggggcgacggcgagtgtacggattcgctcttttgttgatggtcttcagctccttagcttctggcttctccatttgcataagaaaaacctgcgttctcctcactcttggcttcttcaggtttttcttggggctgggtattggaggagactaccctctgtcttctaccataatgtcggagtttgcgaacaagaagacaagagggtcgttcatagcggcggtgttttcgatgcaaggcttcggcatattggccagctccaccgtgaccatggcagtgtgctccatattcggcgcagcgtccaagaattccgaggctgacgtggcatggagactcatactcatgctcggttctgtccccgcagccatgacttactactggcgcatgatgatgcccgaaaccgccaggtacacagcattagtggagcaaaatgtgatgcaagcagcaaaggacatggagaaagtccttgatgtaacactgagccagattgctgaagaagatcctttgccaccaaccccgcatccttaccctctactttcatgggaattcttgcgtaggcacggtcctgacctatttgcatgttcttccacatggttccttgtggacattgtgttctatagccaagttttgttccaaagtgaaatatacaaacgctacctagacaaaaaggaggacgtggatgtgtatcaagagactttccatgctgcatggatccaagccgttattgctgtttgttccacaattcctggctacttcttctcaatgtatttcattgacaaatggggaagggtcaaaatccaaatgatgggctttttcttcatggcattggcctttttctccattggaattccctattactcttattggaccaccaaggaacatcataagaataaagtgttcatggtgttgtatggacttgcttttttctttgccaattttgggcccaacactactactttcatagtcccggctgagctttttcctgctaggtttaggtcaagttgtcatggcatttctggggcagttggcaaggttggggcaattattgggtctgtggggtttctttgggcttcacatagaaagaaggaggatgggtaccctaagggaattgggatgaaagtgtcccttattatacttggaggggtgtgcttattgggaatggtgatcacctactttttcacgagggaaaccatgggaaggtctttggaagagaatgaggttgagattgaagagcaagataatctttga

SEQ ID NO: 107825 - DNA, 453 bp, Glycine max
  Peptide Sequence Number=SeqID_224603
atgggggcttctgaatcacatgaaaaactgcaatctcaacagcctcagccacagtcacaacatgtacagcaccaacagccacagccacagctacatgaacccaccagaagaagggaatcatcgttgctgcctcctgatcaagggaacacaaaagcttccaaggatagaacaaaggcagtagtagataataatgccactatgatgccagtgaaatctttgaaaggactaccgatcccacacaactatgaacatatactgaaaagtaatgcagattcaccagttgataaatctctgttggataagctatatgctgggaaatattgggtagagaagaagtccaacggcaactgtttcatgctgtacgcaagagcactctcaatcacctgggcagaaaatccaaactattggaaatgggtacagcacaaagaagaaaggttcgatttgattctttaa

SEQ ID NO: 107826 - DNA, 258 bp, Glycine max
  Peptide Sequence Number=SeqID_224604
atggtgctcaactttttcatgtgggacttcacctcacacttatactccaacatgtcaagagtagcaaagtcgggcctcattgcttgcgtagcccttgtgccacgtgcatcaacgaacacatacaaacaaacaagaaatagggacaagactaagcctatgtactattctcagggaactagtcacgaccccttaagtggtaaaaccacttgtcacataaaacaattggacaacataacaactgtaattatagatatctaa

SEQ ID NO: 107827 - DNA, 2244 bp, Glycine max
  Peptide Sequence Number=SeqID_224605
ttttgtcaagaaaaagctcaagctgttaaaatattgcccagtgtgaaaaggattgaacacttaactgtgtgggtgaaagaccaagcttctcaaaagcttaaactgatatctgaagaggctgtggaagtaaagcatgaattgattgagctgcaaaagcatatctcagcacaaggtattcttgttcaggatttaatgactggtgtctgccgtgaattggaagagtggaatcaatcaagcaacgatgttgctgaaattcagcaagaacctgaactacctgaactccttgagcctttaccaaatgagagaaatgaccagaaaatattattcttggaaaccatcgatgtacttttggctgagcataagtttgaagaagcattagaagcattagatgctgaagaaataaattctgcagagttgaagggctcagggaataactcttcagatgatgtttccttgtacaagtcttccttgttggaaaggaaggcaatgcttgaagaccagctggttggaattgctgaacaaccttctgttagtttccctgagctgaaaacagctttaaatggtttaataaaacttggaaaaggtcctctagcacatcaactaatgctgaagttttatcagtctcacctccagaagagaattgaggctttgcttccctcaagttctctctgtcctgaaacatttccttctacattatccaagattgtgttttctgtaatatcactgacaataaaggaatctgctttgatttttggagataatcctgtttataccaacagagttgttcagtgggcagagtgggaaattgaatattttgtacgagtggtgaaagagaatgcacccttatctgagactgtttctgccttacgtgctgctagcatcagcattcaggctagtctgaactactgctcaatcttggaatcacaaggattgaaattgtctaaattactgttggtgcttctgcgcccttctgttgaagaagttttagaatcaaattttagacgtgctagaagagtagtgcttgacatggctgaatgttgcccgttgtcaccacagtttgcatcttcactttctgcaattgctagttcatctagtagcatgcttgttgagagtggaatgcgatttatgcacatagttgaagagatattggaacagctaacgccaacggttagtttgcatttcggaggaaatgtactgaacagaatcttacaactatttgataaatacatggatgctcttaccagagcactaccaggtccttctgatgatgacaatcttccagaactgaaagaggtcgcgcttttcagagctgagactgactcagaacaacttgcaatattgggaatagcatttacgatattggatgaactgttaccaaatgctgtgttatcaaggtggatgctgcaaagtgaaagcaaggccaaggaaccaaatagtggagcaacagagaatgtaaccttcaatacaaatgctagtgtagaattgaaggagtggaggaaacatcttcagcattcttttgacaaacttcgggatcacttctgtctgcaatatattgttactttcatctattcaagagagggaaaaacacggttgaatgcacatatttacttgagtgataacagagaggatctttactgggattctgacccactgccttcgctgccatttcaggcattatttgcaaagctgcaacaattagcaactgtggctggagatgtattacttgggaaagagaaaatacagaaaatgttgctagctaggttaacagagactcttgtcatgtggttgtctgatgagcaagagttctggggtgcattagaggataattcagctcctctaaagccacttggtttgcagcagttaattcttgatatgcactttactgttgaaattgctcgctttgcggggtatccatctcgacacatccatcagatagcatcagctatcactgcgcgtgccatccggaccttctctgctaggggcattgatccacaaagtgcacttcctgaggatgaatggtttgtggaaactgcaaagtcagcaataaacaagctcttgcttggggcatcagggtctgaggcatccgacaccgatgaagatcacatcattgttcatcatgacgaagttgtctcagactctgatactgtttcatccctgtcttctacggaatcaaccgagtcttttgcatctgctagcatggccgaacttgacagcccctctaacttgtctgatccagataattga

SEQ ID NO: 107828 - DNA, 309 bp, Glycine max
  Peptide Sequence Number=SeqID_224606
atgaagaaaaaccagattgcggaattggaatctgaacttaacgtggctcaatctaaactccaagaaaaggaagctgaactccaggcactaaagaactgcatcacactcctttccgaactccctctatccacagtttcgggcaagctatcttcacgagtcgcacaaggaactgaggctgctgaaactgaaatacttttgactttctatgctctcttgttgggagatataaacactgaaatcaccaaattgcatccacattttgtgtggttctgtgaactaaattgcatccacataagaataggattgtaa

SEQ ID NO: 107829 - DNA, 447 bp, Glycine max
  Peptide Sequence Number=SeqID_224607
atggcaaaaaccgttgaggaactaaaatatgagctcatcataagaaaatcatcacttgctcatcaagttttggattatgttggcaatattggtatggagtgttgcaaaatgagtggcagggaagatgaaataatgctcaagcagacgaagagtgaactcagagacaataatgtcaaattttggaatctcccagtaaatgataatggtgaatgtgaaactagtgctcttacagaagactcggatccgctggtactggaaatggatcaactggaagcagaacttgagtttgatcaactccaaaagcttcttgggcatcctgtagacactaatttccatgaagaaataaggcctaaattagacgaggtgaacttcatgagtatcttctcttttgtttatttgtttttgtgcagcagaattgatagcaacactgttatgactgaagtgtag

SEQ ID NO: 107830 - DNA, 1362 bp, Glycine max
  Peptide Sequence Number=SeqID_224608
atgacttctttgtctacccatcacacctatagccgaaagcaaaaatctctcggcctcctctgcaccaattttctgagtttgtacaacaaagaaggtgtgcgcctggtcggtctcgatgacgcagcttcgcggttaggtgtagaaagacgtcggatctacgacatcgttaatgttttagagagtgtcggtgtgctaaccagaaaagctaagaatcagtatacttggaaaggattttgtgcaattcctgctgccttacaagaacttaaggatgaaggtttgaaggagaatcctggatcatttgatgactccaatgacaatgcaaaagtgtctgatgatgaggaggaggaagaagaaacatttcctaatattaacattgggagtcagagtgagaaggaaaatcctgattacactgctactgtcaaatcctccaagaatgggttaaacttccgttcagggccatcccaacccatttccagaatgcatttaaagttcaatggttggattggtttaggtttagatttcatttgtgcattccaagttgacttggctcaaaattcaaatgtcaaagagtcacggaaaaggatgtttggaactgacattggaaacataagttttaaaaggaacaaagttgatttgtccatggatggccagaattctaaaatgcaaaatcaacacgaaaatattagtccacgagctcagttagagaaaatcatcataaaaaaagatgctaagcagacttcagagagctatcagtttggcccttttgctccagcttatgtgcccaaagttggaacctctgaaaataatagtgtgaaaaaggtgcatgactgggacagcctcgcacaggagcatcgtcctcaatatcaaaaccaagtttggattgggaatcgaagagcctatcttggaaacatgagagggagcttggtgagtattagaaaaaggtgtttcgattttgtcaaagggagtgtttgtgaaaatggtgttttcgataagagttggcggaggaggggaaagtgggggtggtcccttgaaacggtggtggagtgtggcatggaagacaagatgaacgtgcgaagaagggggcaaacaaagtttgtatgccactgttcctatgtgatagatagtctggcgcagaagaacccattcgtccacttcaaaggtaatgtcaatgcagtgttggtttacttgatcaatcatgtgttatttagtgagaggcaagcaaggctggtgggggccgatcatagagggactaaaagggctcatgcaaaagttgacataagccttgacatgcttatagaggcctggcctatggttgcatggatgatcgggtggcctgccatcagggtggaatgcagctcttga

SEQ ID NO: 107831 - DNA, 318 bp, Glycine max
  Peptide Sequence Number=SeqID_224609
atggctatggtggactcatttctttccaagtcaaagggttgggagaaatccgtaaggcaaggatcagagctgaagggaggagttgggtttgaggggaatgtggtgatcatgaggccaatgtgggtggagaggccttttggagtggcaaagactgaggagatgaaaggaaacaattgcgtccatgcggtagagatctttgtcaaagacaaggagctttggggtcatgttgacaaaactgattatgcttctgacaaaactatgcacaagaaggcacatgccaaatgggagtacaaggcaaaccttgaggacaagacatga

SEQ ID NO: 107832 - DNA, 759 bp, Glycine max
  Peptide Sequence Number=SeqID_224610
atggcttccgccggcgatcttttcacgcatggtttgccggaagttggtggtgccgggaagttacacgtgcttgctgttgatgacagccacgtggaccgcaaggtgatcgagcggttgctcaaaatctcgtcttgcaaagatatgggttctttggcagtgacggtggtggaaagtggtagcagggctctacagtatctggggttggatggagaaaaaagttccattggttttgatagtgtggatgttaatttgataatgacggattattccatgccggggatgacaggatacgaattgctcaaaaagattaaggagtcatctgtttttagagaggttccagtggtggttatgtcgtctgagaatatcttgaccagaattgatagatcacctagggtttggacaggattagggcacccagatcacatggtgtttagccatgtgaaaaaggaatggagagaggagacaatgatatctgaggaaattattaaaagagtcaagggaatattatgttgcttggaggaaggagcagaggagtttctgttgaaacctgtcaagttgtcagatgtaaaacgcgtaacagatttcatcatgcgaggcgaagggatgaaaggagtaaaaagatctaaaaaaagaagccgatcagatgattgcattccatctctatcaactgcatttgcatcagtttctcatccatgtgatctatcatcacctccatcaccatgtgtatcgcaatcgaagaaatctagattgagcatatag

SEQ ID NO: 107833 - DNA, 465 bp, Glycine max
  Peptide Sequence Number=SeqID_224611
atggaggagaaagattggaatgatgacagtctcaccatgaccaccgtttctcagcactgtttcggcaatgattctgaagcaccaagcttctccatctccaacatcaagcgtagttctcgccgagtatgtttggcagcacaatcatcgatttttaggagccaacgttgtttaggtgttggaacttccttgcctagcttggttgcaacaaaactcggtgcctgtgtcactcttatcgatgacttcaccagattagggggaagtttgccattgataagtgattacattgggcatgtggtgaataagcggaagtttgccaatgcttgtgttgggattgacatggggagtttgagattcattcatattcaatttacaaccaacaattattctaaggctgatttgttgtatgattcaaacgagatagctcttatctcaaaagataatgcccggggtagctcaaaattgtga

SEQ ID NO: 107834 - DNA, 918 bp, Glycine max
  Peptide Sequence Number=SeqID_224612
atgaagctatcagccaaacccatttcgagtccgggtcgcacagacaagttccctcccccactcatgaggtttctcagaagcaatgctgccagcagaagcaccagaaggtccaaatcaagcccaatgttcgtaaggaaaaaaaacaccaccgccatcgaaacccaaacccaggaaccctcttcccccaaggtcacgtgcatgggccaggtccgagtcaaacaagccgccaccacctcacgtgacttagctcccccgcgctgccgctgccgctgctactgctgttggatccgaagccccaacaaccacccctgccgctgcaaacccctctggcccaactggcccagcttcttccgtcgaaagcccaccacgctcaaacatcactccgagcccgagcgcaattttcacgaccaagaatcagaattaccgttccatgagagagtgaatgtcgataaggatagtgattttgcttccaattcaagcacgcccccgagaaacgctttgcttttaactcgctgtagatccgcgccgtacagatcttcctctttggctagtaggttctggagttctcccgttaaggaccaagaaacggagtttccaattccgaacacgacggaacaacaacacacttccgaggaaccccaaacggaacccgaattaggttttctcagagaaaaaattgcttcactcaccgaaccggaaaaggttgaggaagttgaaacagaaacagagtctgcatcatcacgtcctactgtactcactaggtgcaaatcggaaccggcgagaaccggacacagacttcttgaccctctgattatcgttggattctctgaccaactttccaactgggtggaaagtgcaaagtggaaagttaatttggattggaactctgtatctttactatttaggactctgccgtga

SEQ ID NO: 107835 - DNA, 524 bp, Glycine max
  Peptide Sequence Number=SeqID_224613
gtcttcttgggagtgtggctccttgtgtgctgtatggaagcaatgttgagagacttggatctgctcgtgggacatttgccaatcactgcttgccttattctggaatgtatataattggaaattcctgctttggttggaattgccttgcaccctggttttcctatcctagccggacggctattcgtcgcaggttcaatttagaggcgatcacagtcctaattgggcagcatgactgggggggaggtaaggaagtagtgaccaaggagtgcataggagagatgaggggaagttgcgaagcacttaatagatcatgcgggtgctgcggaagcattttggaagatgaggtgcagcgtgaacattgtgagtcagcatgtgacttggcaactcatgtcttctgtcatgtatgtgctctttgtcaagaaggtcgtgagctccgtcgtaggttacctcatcctggctttaatgctcaaccagtactggttatgattcccccaggagagcagaccatgggacgtgaggcttga

SEQ ID NO: 107836 - DNA, 456 bp, Glycine max
  Peptide Sequence Number=SeqID_224614
atgactgcaaagctggggaaggatattgaaagtatttttccaaagggtttgcataaagatattggtcattttaatgtatttgatattgctcagaccattgaaaaggtaaagacaacttctgaaatgccatataacagaagaaaatattataagataagcctgatccggggacgaaatagagcagaatatgcagataaggttattcccataaaagagaatgcgctattatttgcaacgcctaaggttccttatcactgggttcctgaagatcctaatcaatcgggtagcttctgtgtattcaccgaagatttcttcattaaggataaatctcataatacgcttgaagacttgcctatatttcaaccgggagcattccccgtatttgaaattgatgctttgttagcagatgaaattgaggtacttttcaggaaaataaaaactgaaattggagtctga

SEQ ID NO: 107837 - DNA, 423 bp, Glycine max
  Peptide Sequence Number=SeqID_224615
atgggatccaacggaacatcttgggctgaccagtgggataacgggcctgacccagtgactgtctccaatgaatcaaagaaaaagaacaagaaggccttcggcaagaccaaggcagttgcttccaccggcgtgaagaagttgaaggagggcaacaccttagcagagttggctttgggtcctgctttgtgggcagttgttggaggttacatatctggcgtcgaaaaattagtagcagttgaagagaaaaaaccagagaaaaacaaagtggaggataataaagcagaggaagaagaaaagaaagaagaagagaaaaaatcaaaggaatcaaaagatgacaagaaatccaaggaggaatctacaccgtcaaaaatcgtgcaaggcacaaccttcgcaatgcatggacattttaagcacgatttctga

SEQ ID NO: 107838 - DNA, 528 bp, Glycine max
  Peptide Sequence Number=SeqID_224616
atggcaatctccatacccagtagacaacttttcatagatggagagtggaaagtccctcttctcaacaatcggtttccgatcatcaaccccgctactgaagacatcatagggcatattccagccgctactaaggaagatgttgaccttgcggtggatgctgctaaaagagccttttcccataacaaaggcaaagattggtcttcagctcctggctctgttcgtgctcgctatcttcgagccatcgcttcaaagataacagagaaaaaggatgaactaggaaagcttgaagcaattgattgtggaaaaccactagatgaagcactggcagacctggatgatgttattggttgttttaactactatgccgagcttgcagaaggattggacgcaaagcaaaatgctcctgtatcccttcctatggaaaccttcaagagttatgttctcaaggagcccatcggagttgttgcattaattactccatggtatttgctgtttcttcattttaactgcttatgcatttcaatgtaa

SEQ ID NO: 107839 - DNA, 438 bp, Glycine max
  Peptide Sequence Number=SeqID_224617
atggaagaaccagccacatatacaactggagaccatgagattactttaactctcaagtttaacaatttgtatttggttggcttggtgattaggaacaaaggtttaagggttgaagtgaggaggggaggggagagtgatacttttgatgagaacaccccaccagttgatgatccagagtacatttcatcattaggtgcagcaacttttaaaggaatgcagagtggtgatgatgatgctgtttggttgatgcagggatggctattttcatatgatccattctggagacctcctcaaatgaaggcccttttacattctgttcctgttggaaagctggtggtacttgacctatttgctgaagtaaaacccatttgggtaacctcagaacagttttatggagttccctacatctggaaagtcattttccattttatgaaataa

SEQ ID NO: 107840 - DNA, 237 bp, Glycine max
  Peptide Sequence Number=SeqID_224618
atgagataccttggagagtatccggaattcgaagctggaggagtgagatggcagcaggcggagaagaacgccgcgcgcggcggcttcttggaccgaagggggagccctctcgcggtcttggatccgaataaggcggaaaatggtgtcgatgcccgcgccggtggtggaggaagggaggaagaagatgaagatgagaaaaatggcgggaaatggaagcttcatgctgatgggttctga

SEQ ID NO: 107841 - DNA, 159 bp, Glycine max
  Peptide Sequence Number=SeqID_224619
atggggcagtggttgtcgatgatgatgaaagcgcacatgttgggggcagaggttgagagttttgcgaagacaacattgggcagcatattggatggaattggagttgaggatgtggaagatgattttgagggtgtaaagggagtccacatcagaggttga

SEQ ID NO: 107842 - DNA, 134 bp, Glycine max
  Peptide Sequence Number=SeqID_224620
atggcaatcttcctgagtaatggaagtggaggcgaaaacagtaggaggatgatgagaaacagtgagaagccacaaaacatacctaaccagaacacggtgctgaatcgcgggaaagggaagatggaagaagcatt

SEQ ID NO: 107843 - DNA, 543 bp, Glycine max
  Peptide Sequence Number=SeqID_224621
atgttggagcccgacgttaacggcgacggcgggttcatcgttgactcggggtcaacgttaacattcatggagaggccgattttcgatctggtagcggaggagtttgtaaagcaggtgaactacacgcgcgcgagggagcttgaaaaacagtttgggctgagtccgtgttttgttttggcgggtggcgctgaaacggcgtcgtttcccgagatgaggtttgagttcaggggtggcgcgaagatgaggctgccggtggcgaattatttctcgcgggtggggaaaggtgacgtggcgtgcttgacgattgtttctgatgacgtggcgggtcagggtggggcggtggggcccgcagtgatattggggaactatcagcaacagaatttctacgtggagtgtgacttggagaatgaaaggttgcttttcatgaaaatcttactcagcaaagaagcggtattgaagcataagaagattggttgcaatgttcatggttccactatttatcaagatcagaaatcagcttatttaaaatgttggagtacttaa

SEQ ID NO: 107844 - DNA, 852 bp, Glycine max
  Peptide Sequence Number=SeqID_224622
atgaaaacttccatttccgttataaataaacaaccaaaaaccaaaaaaacttcgtcaaaaccatcccatcaccttcacactcgaaggcgtttttgcgttttttctttccctcaaaatgcttcttcctcacattattctctccctcttctctttcctctccatcatattactattcaccaccattacttcatccacccccacccccaacaccatcatcaccctcccttattcacccaccacccctcttcaagtaattcacacccattccacaccctccaactcgccgtctccacatccatcacaagagcccaccacctcaaaaaccacaacaaccctagttcactcaaaaccctagttcaccccgaaacctacggaggctactcaatagacctcaaattcggaaccccaccacaaacgttccccttcgttctcgacactggaagcagcctcgtctggctcccatgctactcccactacctctgctccaaatgcaactctttctcaaacaacaacacaccaaaattcatcccaaaagactcattttcttcaaagtttgttggctgcagaaaccctaaatgcgcttgggtctttggctccgacgttacgtctcattgttgcaagctagccaaagccgcttttagtaataacaataactgttcccaaacatgccctgcatacaccgtccaatacggtctcggctccaccgcgggttttctcttatcagaaaatctcaattttcccgcaaaaaatgtttctgattttctcgtcggctgctccgtcgtctctgtctaccagcctggcggaatcgccgggttcggccggggagaagagtccttacacggcgcaagatga

SEQ ID NO: 107845 - DNA, 515 bp, Glycine max
  Peptide Sequence Number=SeqID_224623
aaagagttgcatttggagcagaggtagtgggagtagcatgggagccagacgaggctgcttccagtgtcgagaacgaaggggaacgtttgtggtggtgggctcttgtgatggatgtggagacggcgagttggagggtgtggaatgggtgtgaattacttgaagaggggtggtgggtgaataagggagggaagaagcattttgagggaaagaaaaaacgcaaaaacgccttcgagtgtgaaggtgatgggatggttttgacgaaggatccttgggcttgcacctctaactatctgtattggttttataaagtttctcacatctatgtcattccttgggaggagagacagtcaccacgtggtcttgtatgtttattgctcaatccacgacagtcacagcctagatcgattccagatggcgtcaagggctatgtaaagcttattggacctcaaagtagtgccaaaggacataggaagaggccaggcaaggatggtggcaagggtggcagaggcaattga

SEQ ID NO: 107846 - DNA, 252 bp, Glycine max
  Peptide Sequence Number=SeqID_224624
atgttggaagaatcatctcaagggtgggaagttccaataaatgttggatttgtccttcctggaggaaagagacaacaacataaagtaaatttaaacgagaagtcaagggagagttggttggagattttagtaggtgagtttgtggcatctaaaaaagatgttggcgagatgaaaatttctttgtatgaatatggtggcatgtggaagactgggcttgtcatccaaggtgtagtcattaaaccaaagaactag

SEQ ID NO: 107847 - DNA, 285 bp, Glycine max
  Peptide Sequence Number=SeqID_224625
ctaattcgccaatggaagtgacgaaatatgaagaacctatcccgccagccctggttgcaaaaccaggctgctctgaacgccctctgcacctagtccgtgcctctaaagaacctatctccccagccctaaccctgtgcacctatgacacgttaaactggactcgtcagtcaaaccagcgagatgagtccacgttgaactcgccaatggaggtgacaataaccactggctatgtcgccaatggtagcagcgagaagtcacgtgctcgtccctcatcatatcgccagc

SEQ ID NO: 107848 - DNA, 296 bp, Glycine max
  Peptide Sequence Number=SeqID_224626
gcggtgttgtccttgctgaggtgttgttggctgattcacgattcactcgaccggatatgggttttcacccaacaaaactcaatttcgtgcctagcgatgcggatgaggcgccacttcgatacccattccatccaggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactcttagttag

SEQ ID NO: 107849 - DNA, 255 bp, Glycine max
  Peptide Sequence Number=SeqID_224627
atgtctgatggagtggatgtggaggttgacatggataatgacgttagaatagacgaagatattcataaagattatggacaagaaattggaaaaattgttgattgtagcaaaacattcataactacaaaggtccaccaccaaacacaacatcttcaggtgcaacatcatcaactgcaacatattcgagagtttcataaatctcttgctcctcatctacaattgcaagtctttaacgtctacgtacatatggagtag

SEQ ID NO: 107850 - DNA, 120 bp, Glycine max
  Peptide Sequence Number=SeqID_224628
atgggtactacacctacaagattctcaatcttgcacttaggtggtaactatgcacatcctcaaggaacacaggtaacaaggatcgtgtctactcaagtatttcctctcgaaacaccttaa

SEQ ID NO: 107851 - DNA, 872 bp, Glycine max
  Peptide Sequence Number=SeqID_224629
atgggggcttcacaatcacaggaagagctacaatcacaacgacagtttcaacaacaccaacacccaaatgaactcaccagaagggaatcattgttgttgtctcctgcagctagtaacaacacaaaacaattcagcaacagcacaaaggtagtagataatgtcacagctgccaacagcaccaacaccaactgtttcatgttgaatgcgagagcactctcaatcacctgggcagaaaatccagactattggacatgggtacaggataaagatgaaagtggcacgatgatagagttacctaatctgaaaatggtttgctggctagaagtgcatgggaaatttgacactagaaaactttcactaggaattctatatcaagtgtcatttattgtaatgttgaaagattcagctcaagggtgggaagttccaataaatgttagacttgtccttcctggaggaaagaaacaacaacacaaggaaaatttaaacgagaaattaagggagtgttggatagagattccagtgggagagtttgtggcatctgaaaaagatgttggcaacatagagatatctatgtatgaatatgaaggtggcaagtggaagacagggcttataatccaaggcattgccatcaaaccaaagaatgagactaatcaatcacaacaccaccaacaaccacatgaactcactagaagggaatcatggttgatgtctcctgcaggtaactcaaaatacttcaagaatagcacaaaggcaatagataatgtcacaagtgccaacaacaccaattctttcatggtgtatgcaagatcactctcaatcacttgggcagaaaatccaaactattggaaatgggtacaacataaagaagcaag

SEQ ID NO: 107852 - DNA, 177 bp, Glycine max
  Peptide Sequence Number=SeqID_224630
atggctgcacttgatttcacttatgaaagcttgtgcattcaatatcttgatgagggtgttccatatgttctcaagattggactaatacatttgctgcccaagtttcatggtcttgcagggagtggcaaaagattggctatactaccttgctcccaggtccattttcagctgggatga

SEQ ID NO: 107853 - DNA, 1128 bp, Glycine max
  Peptide Sequence Number=SeqID_224631
atggtggtgatatctggaattttgttatgttttgcggtggtttttatgattctgcggcgagggaggtgtggcgacgaggggcaatttgggaaagtggagggtggaaatgtggggtgtgtggatgatgtgaaggggaggtttgtggtggtggaggaagagggaggggtgttgggagggatggagttggaggatctgttgaggggttcggcgtacgtggtggggaagagtaggagtgggattgtgtacaaggttgtcggggttgggaaaggtgcggcggcggccagggtggtggcggtgaggaggctcggcgagggcggtgccgcatggcggttgaaggagtttgaggcggaggtggagggtgtggcgagggtgaggcaccccaatgtggtggctctgagagcttattactatgccagggaggagaagctgctcgtcacggatttcgtccgcaacgggaacttgcacaccgcattgcatggtggaccttccaattcattttcaccattaccatgggcagcaaggttaaaaattgctcaaggagcagcaagaggcttaacatacatacacgagttcagtggtagaaaatatgtccatggcaaccttaaatcaacaaaaatccttctggacgaggatcatagtccttacatatccggtttcggacttacccgtcttggcataggtagctcaaactcaaagtctctatcatcagaaccaaaacgttcaaaccactctatagcaacatcagcaattgtttcaattggttcaaatgtttcaacttcctctaacatctacttggcacccgaggcgcgcatagctggtggaaagttcactcagaaatgtgatgtgtattcttttggtatagtgctattagaacttttgacaggtagacttccagatttaggagctgaaaatgatggcatggggctagagagttttgtgagaaaagcattcagggaggaacagcccttgtcggagattatagaccctgcacttctgcctgaggtttatgctaagaagcaagttattgcagtgtttcatgttgcactgaactgcacagaacttgatccagaattgcgaccaagaatgagaaccgtgtcagagaccctagatcgaatcaaattacagtga

SEQ ID NO: 107854 - DNA, 654 bp, Glycine max
  Peptide Sequence Number=SeqID_224632
atggtgaccgggagggacccgagggaggacggaatgttgccggtgaagcggttgtgtgataagttgagcgtgcccgccagggaagggaggttggagagagtgaccggaagtgagggcgttgtgggagagatcgaggacgaggagggtggtggcattgaagagggtggtggggattgcgtgggagaggttactccggcccaggtgcagggggtgagggaggtgtcggtccaggtggctagggctcctgtggggtccactgagattgcggctttgaaggctagcaatgagagcccgtcggagtttagggggagtgtgaggggaagggaaatgaggaagaagaacaaagaaaggtggagaagcggaaataggagaagaagcttagaagaactggagattgcctatgtgaccatgaagatgttggaggagtaccacgttgccaccaaccccatcttgaagaaccatgggggagatgaagacgggttcaccgaggcagtagaaagggttgacacagatgagggcaaggtggttgggaggatcgacggatctacgttggttgtgatgtttaaggtgcagacttgtgatggtgtggtggttatgatgggaagtggtggctccgtgttcgttgtggtgtttgaggcacaggctagtgattga

SEQ ID NO: 107855 - DNA, 471 bp, Glycine max
  Peptide Sequence Number=SeqID_224633
atggagttttattggggattcagagcattcatacctatagatgaactgtgtgatccttccaatgggtttattgtgaatgacacttgcttaattgaagttgagaatttgttcagccagtcagaacatttgaatttgaatctagtggagcaaccagttagcaaaatttatgacaaggctattgaacacactgctgatcctatacccaaggaaatgtgcacaacatcacttgatgagtttgtggatttcagaggcttagggaaaatagagaaatcttttgttccactactagaagatttgaaaaggaagagggaggagaatgtgactgctttagcgatgaaagaagagaggttgaagaaaaagatgaaagaaatagaagcagaacttggaatagcaagaagagacttggtgcaagcaggggaagactttgaagcgtgcaatttggatgctgaagtaggatatggaagaccataa

SEQ ID NO: 107856 - DNA, 498 bp, Glycine max
  Peptide Sequence Number=SeqID_224634
atgaaaattgcttccttgatttctggttgcaatgactacactcacctcctctctattaaggagcatgtgatgagggaagagaagccaattcctactacaaggaagagtgaagtgaagtttctcaagagcttgactcgtcttgtggctgcttttctagtcttatctccaatttgcagcattccagtttcaagtgctcaaaccgtagatattcagagaggaaccacgttgtttcgtcaagcttgtattggatgccatgatgcaggggcaactctatttacaaaggatttacagagaaatgaagttgatacagaagaagcaatctatcgtgtcacatactatggcaaagcacgaatgccaggctttggtaaagagtgcatgccacggggtcagtgcacatttggagctcgtttggaagatgaagatatcaagacattggccgagtttgtcaagttacaggctgatcaagggtggccaagtatagagactaaagaagaatga

SEQ ID NO: 107857 - DNA, 903 bp, Glycine max
  Peptide Sequence Number=SeqID_224635
atggcgatcttgctgggcgaaattcttcaatcgctggagctgtggctgaagctgatcaagaacccgcagcctcagccctacgtgaaccctaatctggaccccgttttgctggtgcccggtgtcggaggctccatgctgcacgccgttgacgaatccgaaggaagccgagaacgcgtctgggttcgcttcctcaacgccgagtacacgctcaagaccaagctttggtcgcgttacgatccttccaccggaaaaaccgagtccatggatccaaattcaagaattatggttcctgaagataggcatggactccatgcaattgatattttggaccctgacttgatgttgggaagtgattctgtgtattatttccatgacatgatcgttgaaatgcgtaagtgggggtttgaagagggaaagacgctttttggttttggatatgattttcgccaaagcaacagtgtatctatcttttggctattggtaggtagtatgatttcccacaatcctaaggataagatttttgagaaatatgttaagaattgggttgcaatttgtgcgccattccagggtgcaccaggaaccatcaattctacctttttaaatggaatgtcatttgtggaaggatgggaacaaaacttttatatttccaaatggagcatgcaccagttgaattatttattgaagcttcttccaatgtcacagctgattgaatgcccatcaatatatgaacttatgggttgtcctaattctcattggaaacatattcctgctctggaattgtggcgtgagagacatgattctgatgggaaatcacatattgttctggagtcatatccaccatgtgatagcatcaaggttttggagcaagctcttgtaaataacatagtgagttaccagtgttaa

SEQ ID NO: 107858 - DNA, 195 bp, Glycine max
  Peptide Sequence Number=SeqID_224636
atggaaatcttccggaagaagcttcctccgggaacattccggatgacgttcttccgaaagttgtctgtgagtacttccggaagacacaaattcttcttccggaagaagctttgtcagaggcaaccaaaaagtgaaaagagacatacaagcgtggtgtccttattttctcgttttctgacacctgaaaaaggttaa

SEQ ID NO: 107859 - DNA, 393 bp, Glycine max
  Peptide Sequence Number=SeqID_224637
atggagagtacatacctcactcaaaaatgcaaaaacagtggtgacctcgttggaaaatgtttgactagcacatctccaccaacattgtgccccactaggaacgatacctccaattgtcatatgcaaatgagatctccaccagcattatgtgttgtcgtcctttatgggctcaccaacatgagtttcaccttccacctgaccttattgaatgatacatctgtgatggagttgtgtgtttgtcctgcacatggcaccgttaagggtgatgtcattacacaactacttgcgatgatgaagagtgacaaggagtgtgatgacaccaccaaggaatttagagtagagaaaagaacgttgcaattggaaccccattgggtttgcagtatatttgattag

SEQ ID NO: 107860 - DNA, 1095 bp, Glycine max
  Peptide Sequence Number=SeqID_224638
atgatgaagcaacaaggaagaaagaagttggtgttcatagacatagttgttacaggctggacggttttaacaaatggatcaagctgtccactgatctgtaaccgtggtggactcgacaagacaacaacaatattcagaacattaacaagaccacaccacaccatgagcgtcatcgacattctcaccagagttgattccatttgcaaaaagtacgacaaatacgacgtccaaagccaaagggactctaatctctcctccgacgatgcattcgccaaactctacgcctccgtcgacgccgacattgaggccttacttcagaaagcagataccgcttccaaggagaaaagtaaggcatccactgtggcgatcaatgccgagattcgtcgaaccaaggctaggttgttggaggaggttcccaagttgcagagattggctatgaaaaaggtaaaggggctttcatcacaagaatttgctgcccgtaatgatttggctcttgcattgccggataggattcaagctatcccagatgggacccctgcagcatccaaacaaagtggaagttgggcagcttcagcctcacgtcctggaattaaatttgattcagatgggaaattcgatgatgaatacttccaacaaactgaagaatcaagtggattcaggaaagagtacgaaatgcgtaaaatgaaacaggcaaaaggattggatactttgaaaaacatggcacatgatatgaatgaggaactggatagacaagttccactgatggacgagattgatactaagcctctttgcatatgcaaggataaggctgcgtacaatatccctctcccataccttcgcatagcgaagagcctttgggcaatggggtacgaagtttttttttttacccttaagccgaaatacctggaaaggaaatcaaagtcttcaaaactggaattagtggacagggcatcttctgaccttaaaaataccaatgttagacttagagatacagtgaaccagattaaaatatatgctagttccttctcttttcttgtgtggatttatatctcagttcatattctaggactgccttgtgtgcctcttcttgaataa

SEQ ID NO: 107861 - DNA, 1545 bp, Glycine max
  Peptide Sequence Number=SeqID_224639
atgcaaatgatacccggagaccccttttcactatccacttccctcccagcagggcttcccaatgaacaaagcacaaacacaaaccctaatcctaatcctccaccacccaacaaaaagaagagaaatctaccaggaacaccagatccagatgccgaggttattgctctttcgccaaagactctcatggccacaaaccgtttcatctgtgaaatatgcaacaaagggtttcagagggaccagaaccttcagcttcatagaagaggtcacaaccttccttggaagctacgacagagatcaaacaaggaagttcggaagaaggtatatatctgtccagagaaaacctgtgtccaccacgacgcggcaagggctctcggtgatctcaccggaataaagaagcattacagcagaaaacacggtgagaagaagtggaagtgtgaaaagtgctccaaaaaatacgcagttcaatctgattggaaggctcacaccaaaacctgtggcaccagagagtataagtgcgactgtggcaacctcttctccaggaaggacagttttattactcacagggccttctgcgatgccttagctgacgagagttcgagactcacctcagttgcttcaacaagcctaaattttaagagcgaagatgcaactatgatcaacacacaagctagtttgtcgacacgtggattaatcactgaccatggaatgcaaaatgtttcacaatttggtccacatgggtttcgtttaatgaacatgggcacagaccagcaaagaccaaacttgtcactatggttgaaccaaggaaatcaccacattaacaatccacttgatgtggcattatcatcaagctcttctggtttgcctgaggttgtgcacatggcacaagctaatattaataataatgccttaattggttcttcttcagtgttctccaattttggaatgcctgcttcttcaaattcatctaatccaaacctaatggggaaaaaaggagatggtggagcttcagatttggcatcaatgtattctgagagtcaaaacaagaattcaaactcaacttctccaatgtcagccactgctcttttgcagaaagcagcacagatgggttccaccagaagcaccaacccttcaattttcagtggcagttttggagtaatgagctcatcttccacacaaagcactagtctcaacagcaatattgcaaaccaaagctgtgaccaacttaaccaagcctttcagaattttaatgcgacaagcagtagtagtgcaactatgctgggaagttctactaactttagctcattgacgcattcatcaaacggttttgaccagtttatgatgcaaaacaatgtggaaccaactcagttgaagctccaccatcctggctcaaactcagtggaacataacttgacaagagattttcttggcgtgagtggaaatggaggtggacaagtacatcatgcatttctaccccaagagctggcaaagtttgcttccttaggctcatcaatggggttgaatcagttcactgtaggccatcaatga

SEQ ID NO: 107862 - DNA, 615 bp, Glycine max
  Peptide Sequence Number=SeqID_224640
atggacaaagatgctaatatagaaatccaactccctcccggatttagattccacccttctgatgaggagctaattgttcactatcttagaaacaaagtcgcatcatcaccccttcctgcttcattcataacagaaatagatctttacaagtataatccatgggagctcccaagcaaagctttgtttggggaggatgagtggtatttctttactcctagggacaggaagtatcccaatggagtgaggcctaatagaccagatgcttctggttattggaaggctactgtgaatgacaaacccattttcacttcctgtgggatgaagagcattgcagtgaagaaggcccttgtgttctacaagggtcgtccgccaaaaggatctaaaacagactggatcatgcatgagtataggttgcatgattctatgatctcgaattcaaggcagagagggtccatgagactggatgagtgggtgttgtgccgagttcgacaaaagactatcagcccaaaaagcattttggaagactcaaatgaacctatttatgaaccaacaagccactttcaacaaatgagtgtgaactcaaatcctgaagcagttaaaaactctgcacagtga

SEQ ID NO: 107863 - DNA, 225 bp, Glycine max
  Peptide Sequence Number=SeqID_224641
atggctagattcacggcgttcatatctatgttgagcattgttcttctaaggaagtgtattcacatgtacaatgaatatgcacctatgttgatggacatggctttcgttttgatgtcgtcggtgagattttccggctcgcggcgtttccggccaaccgaagcagtttccggcaggattcttactcccatgatgacatcaatgatgggtaggcccgatcgcatatag

SEQ ID NO: 107864 - DNA, 780 bp, Glycine max
  Peptide Sequence Number=SeqID_224642
atgacaaagctattcaatttcctccctttcctcttcctcaacatcttcatccaaacaatttcagcccaagtagcaccggcaccagcgggacccaccaacatcacccaagtgcttgagaaagcaggacaattcacaaccttcatcaaactcctcaaagcctcacaaatagctgatagaatcaattcacagctaaacaactcaaaccaaggcctaaccgtgtttgcacccactgataatgcattctcaagcctcaaagcaggaacattaaactccataaactcacaagaccaaatgcagctgatacaattccacattctccccactctctacaccatctcacagttccaaacagcaagtaaccccttgcacacgcaagctggaaacagtgatgacggagagtaccctctaaatgtgaccacctcagggaaccaagtgaatgtaacaactggggtggttgatacaacagtgtccaatactatttacagtgataaccagcttgcagtgtatcaggtagataaggtgcttcttccaatgaagcttttcggcgcgatggcaccagctgcttcaccggcggaggctccggcaccgaccaagccggagaaaaatgtccgggcaggggctgctgattctccttcggggtcggacacgtccgctgatgcttcgagtgcagtgagtttgaaaaggcacatggttgaaggagtagggtggtcatggatgggtcctggttggtccaacgactccaacattccgaactcaagtgaagggagaagctcaaattaa

SEQ ID NO: 107865 - DNA, 582 bp, Glycine max
  Peptide Sequence Number=SeqID_224643
atggagtttaatgttcctgctttgaggcttgagaatgcattatcagtgggtgcaaacacggttaggccttggtttgagttgttcagctgtgaattgattctatcagctatttgtgaagctttgaggagtttaatgaaggttgtgaattgtcctgctttctctagaacttgggtgatgttggtggggcccgctggtgctgctggtgtttgggctgaaattgtttggatgaaaaggaaaaggagaaaatggattagctttgccatttgtgtgagtgaggaagctaagaagactaagatttttgtcacaagtggaagaaggggatgtggtgttgtgtatttatattatatggtgttaaggtttgagggacattacagagaggaaaggggagcaggaattgctttgggaggcagaaacaatagcaggctagagagattgacgtgggattcaaattctagtggccttgcaatggtggttgtggtggtggttggtgtgattgttaatgacagaggattttggcgcatcgaacctatcgatatcggcgtctccctgaatcgcgtttttcagttctacactggaaactga

SEQ ID NO: 107866 - DNA, 252 bp, Glycine max
  Peptide Sequence Number=SeqID_224644
atggcctcacagttacaatacaactggcttcgagtcagcggtctcaatacaaggaatgcgatacttgtgtattctcgcgagtaccacggagacaaaaaagggtgtaatgtgcttaaatgtctctcacattatttccatggtgttgagaatcagtcaaagcttggtgagtggtcgctgatgaatgtgattaatgaggcagtaccacctcttgggaaccaagccatcgtcttctccatttcaaaaactcaataa

SEQ ID NO: 107867 - DNA, 1497 bp, Glycine max
  Peptide Sequence Number=SeqID_224645
atgatgaacacagccaacggcacgatgatctcaccgtcgtcttcgtcgggaacggcggcgcagtcgccgggactgaagacctatttcaaaacccccgagggaagatataagcttcaatacgagaagactcacccttccggtcttcttcattacgcccatggcaaaaccgttactcaggtaaccctggcacatctcaaggacaagcctgcgccttctaccccaaccgcttcgtcatcgtcaagtttcagtgccagcagtggggtacggtcggcggcagctcgattgctgggaggaagcaatggtagccgggcacttagttttgttggaggcaatggtggcagcaagagtaatggaggaaatactaggattagttccattggtgcttcgagtacaagtagtgcaatggcgaatccgaattttgacgggaaaggaacatacttgatattcaatgtcggggatgcaattttcattagtgatttgaattcgcaagacaaggaccccataaagtctattcacttcagtaactcgaatcctgtgtgccacacgtttgatcaggatgctaaggatgggcatgatttgctcattggtttgaactctggcgatgtctactcagtgtcattgagacagcaattacaggatgttggtaaaaagcttgttggggcccagcattataacaaagatggttctaacaaagatggtgctggtgattcttctttcccagttgtaaaggatcaaactcaattttcggttgcccatgcacgttacagtaagagtaatcctatagccagatggcatatatgccagggttcaattaatagtatttctttctcaatggatggggcatacttagcaactgttggacgagatggttacttgcgagtgtttgattactcaaaagagcaacttatatgtggcgggaaaagttattatggtgctttgttatgttgtgcatggagcatggaagatcgcaaggttgtggcatggggcgagggacataactcatgggtcagtggagttgcttttgattcatattggacatcaccaaattcaaatgacaatggagagactgttacatatcgttttggttctgttggtcaggatacacaattgcttctgtgggacctggaaatggacgagattgtagtgcccttgaggcggccacctggtggatccccgacttacagtactggaagccagtcatcgcactgggacaatgttgtcccattgggtaccctgcaacctgctccgagtatgcgggatgttccaaaaatctctccgttggttgctcaccgtgtgcataccgaaccactctctggcttgatatttacccaggaatctgtgctcactgcctgccgggaggggcacattaaaatttggatgaggccaggggttgctgagagccaatcaagcaactctgaaaacttgttagctaccagcctcaaggagaaaccttcactttcaagcaagatcagcagcaattctagctacaagcaatga

SEQ ID NO: 107868 - DNA, 126 bp, Glycine max
  Peptide Sequence Number=SeqID_224646
atggacaaaacaatgccacaaggcaaatgcgtagccaatgaagccaatagccactgccttgcgagttacagtcaaaaccaggaatcaaaatattgttattggagtttaaatttcagaccaaactag

SEQ ID NO: 107869 - DNA, 1554 bp, Glycine max
  Peptide Sequence Number=SeqID_224647
atgggtgtgggtcggttcaaaccgacgctgaagaggaagagggttccgatgagggtctggttaagcttccaaaaatcaatgggtgtcctcgtgggtggaaaccatacttcctccagtgctgcatctctctcactctcttacttaactcgacaacttcagccacattattccatggatgccaaggtattcaaattccagatcctccaaggctccatcgctaagcgcgtggtcattcgctcaatactactcgcgtgcgccgtctcaattgtctccatctaccgcgcgcaatccctcttcgatttcggaaccctcgctcccatcgccacgtacttcgactgcgtttccggcttcgagggcgtcacctttcgccctggttcccacttgctccgaacccgcttctgggcctccgccaattgcgagaaagacgccaacttgaccctctccgtggtcaccgacctaactggtaacaatttactctacaccggagcgaaaagcctctgcgtcggagaaggctcctcaatggccgtcacggcaatgaaacagttaggtttctccagcgtcagcgccgtccaaacgcaccgtttcgtgcagaggaacgtcctgtacgaggataactccttcgatttcgtgttctccagagacctagacaaggtttctgtcccagcattgctggtgctcgaggttgagcgtgtccttaagccacgtggcattggtgcctttcttgtaggcaccactagttctcaccccaatgatttgataagagcagccacacccgtttcctctttgttaaggtcttccaatgttgtgcatgttggttctgtcaacgagcttaaccttgttgttttcaagaaacgagttggaaacgctacttcattttaccaacatggtaatttacccgctgattgtcccagtctcacattcactaaatccctcatagagttgatggagcctctcgtgagtgagaaacaaaaaccaccacctcttgagtttcacaagaggattccctatttgcctaaatttgtggatgtttccactaggaagaggttggtgtatattgacattggggtaggggagcttcttgatgccaatgttagtgattggttcctaccatcgtaccccattgatcagaaggatttcaatatttattttgttcactacaacacttcgattatgttgtcccatgtgaagcaacctggtattacctttgtttaccaccctggcttgtctggtattgataaggtcaatgctaagcttggtagtgatgatgatgatgacatggatcctttacttggggaggaggagaagtttgatttccttgcctggttcaaagaaactgtgcaatatgctgattttgtggtcctcaagatgaatgcaggcagtgttgaactcaagttcctctctgatatatttgagaatggagctatatgctatgttgatgagttgtttctcaagtgtcccgagaggggaggtgatgccagcaagggaagttgcatggatatttacaaggatctccgaagcaatggtgtctatgtgcatcaatggtggggagactga

SEQ ID NO: 107870 - DNA, 846 bp, Glycine max
  Peptide Sequence Number=SeqID_224648
ccacccgccgccgccgccgcccgttacgccgcagcctgagatcgcggcgaatccattcgtgtaccatggtgctgctgcaccgtacccgaaccctcctctgcattaccctcagtaccattaccccggttactaccctccggtgccacccatgccttatcatcctcatcaacatcaacatcatcatcgacacatggacccagcgtggattcaggggcatttccctagtgggcccatgatgcctaaccctgcacctttcgtagagcatcagaaagccgttacaataaagaacgatgtcaacatcaggaaagagacccttaagcttgaacccgacgtagaaaattctggccacttccttgtttcgttttccttcgatgccaccgtttctggcagcatcaccatatatttctttgcaaaagaaggtgaaggctgcatcctcacaccaatgaaggaaaaccaacttgcaccagtgtctgtgcatttcgagcaaggccttggccagaagtttagacaggcagctggaactggtattgatttttcagtgtttgaagagtctgagttattgaaagtgggtgaaaaggatgtctaccctctagcagtaaaggcagacgcatcccctggtaatcatgatgagtcagatagatctccaacatctagtaacacaaactctcagattacgcaaacgatgtttgagaaggagaaaggagagttccgggtgaaagttgtcaagcagatcttgtgggtgaatggaatgagtgtatgtgtagcggatgtgcaaaggattctaggttccagacagatagatgctcaatttgcagacaaccagttgagaggctgttggagatatag

SEQ ID NO: 107871 - DNA, 231 bp, Glycine max
  Peptide Sequence Number=SeqID_224649
atggctcctcgcacgccattcgttaaggccatcactgtcctgatgggctctgcaaatggcatacagggagccaggcacgccaaaattatttatgaggaggtagaagcaattaagcagcataatatatacagcatgaaggaagacaaggccttccatgtccccccaaaagacaaaaacaccactcggctactttggctactgtttttacttgggaaacaaccaagcagctag

SEQ ID NO: 107872 - DNA, 1092 bp, Glycine max
  Peptide Sequence Number=SeqID_224650
atggattgcatctgttattacccaacagaggagccagatgaagataacaatgatggcagcttccgcatattcacttatagagaattgaattctgccacacgaggttttcacccctcggaaaagattggagaaggaggttttggcactgtctacaaggggcagcttcgggatggaacttttgtggccgtgaaagtgctttcgattgagctagattccttgagaggagagagggagtttgtggcagaattgaatacactagcaaatgtcaagcaccaaaatcttgtcattctccgagggtgttgtgtagaaggaggccacagatacatagtctacgactacatggaaaacaatagccttcgccacactttcttaggttcagagcaaaaaaagatgaatttcagctgggaaactcggagggatgtatccataggtgtggcaagtgggcttgcctttctccacgaggaacatcaaccccatattgtgcatagagatatcaaatccagcaatgttcttcttgatcgaaattttacaccaaaagtctccgattttggcttggccaagctactaagagatgaaaagtcccacgtcactacccatgttgctggcacattcggttatcttgcaccagactatgctagttctggacacttgacacgaaaatcagatgtttatagctttggagttctacttttagaaattgtcagtggccaacgcgtggtagattcgtctcaaaacggggagcgtttcatagttgagaaggcttgggcagcatatgaggctaatgatcttctgagaatggtggatcccgtgctgaataagaactatcccgtggaagaagcgaaacggttcctaatggtggggctgcgttgcgtgcaacaaatggcgaggcttaggccacgaatgccagaggttgtggacatgctgaccaacaatgttgagacggtagagtttagtgtttcacaaccaggatttgtcgctgatctcagcagcgccagaataaggaagcaaatgaatccatcagaagaatcaagtgctactgcagcaacctttgcagactcctctggatggtgtacgaccaatcttgtccgttag

SEQ ID NO: 107873 - DNA, 180 bp, Glycine max
  misc_feature (10)..(10): n is a, c, g, or t
  Peptide Sequence Number=SeqID_224651
atgaatccanggctgaagcgaaaagttaagaggcgaaagggtgttatgaagaaaagtgacacaatagaaggtctaaaagatgttgaagaattggagcagtgtgacaacaaccgcttagcgtcgcgaggagccaatttggagggtttacttgttggaaaatgtttgcacttgagaacttga

SEQ ID NO: 107874 - DNA, 123 bp, Glycine max
  Peptide Sequence Number=SeqID_224652
atggcggcaaatcggtgtcaaacgaggatgaaacaacaacatcaagtcacgatatgggatattggatttgattcctacttcctaggagatgttacgttgtacttcgataaacccaatgattga

SEQ ID NO: 107875 - DNA, 861 bp, Glycine max
  Peptide Sequence Number=SeqID_224653
atggcgaaagacatcgaaactgaggtccaaagtgggctgccacacaaggactaccacgacccacccgccgccgcattctacgaccccgccgagctccgcaagtggtccttctaccgcgccctcatcgccgagtttgtcgccactctcctcttcctctacgtcaccatcctcaccgtcatcggctacaatcaccagaccgccaccggcagccccgacctctgcaatggcgtcggcgtcctcggcatcgcttgggccttcggaggcatgatatttgtccttgtctattgcactgctgggatatcagggggacacataaacccggcggtaacgtttgggttgtttctggcgaggaaggtgtcgcttataagagcagttgggtacatggtggctcaggtgttgggggccataagtggtgtggggctagtgaaggctttacagaagagctactacaacaggtacaatggtggcgtgaacatgctcgctgatgggtacagcaaaggaaccggtttgggagctgagattattggcacatttattcttgtctacaccgtcttctctgctaccgatcccaagagagtggcaagagactcccatgttcccgtgttggcaccacttccaattgggtttgcggtgttcatagttcacctggccaccatccctatcaccggcactggcatcaacccagccagaagcctagggcctgctgtcatattcaacaacgagaaggcatgggatgaccagtggatcttctgggttggacccttcatcggtgctgccattgctgcattctaccaccagtccgtgctgagggcccaagcagcaaaggctctcgggtctttcaggagctcctcaaacctgtaa

SEQ ID NO: 107876 - DNA, 240 bp, Glycine max
  Peptide Sequence Number=SeqID_224654
atgttcgtcggaaatctatttgttgaagaagatgaatctttgacttgctccttcaagctaaaggaggtagaaatggaatgtttgagagagatgctaaaagttgcagtacatgcatggtgccctgagattcgatccatgagagttggtgttgctgcaagagttaatgaagaaaatgttgacctattgaacttgccaccagtctggtggtcacagatgtcttatagatcgaaatgcatataa

SEQ ID NO: 107877 - DNA, 1797 bp, Glycine max
  Peptide Sequence Number=SeqID_224655
atgaatcagaatcaattggacttaagagctcatcattctggatcaacacaatcagaggagtcggctctggaccttgaaaggagctactatggtcatcctaacccctccagtccttcacccttgcaaccttttgcaggaggtgctcagcattctgagagcaacgctgcctatttttcttggcctacattgagccgctggaacgatgcagcagaagatagagccaactattttgggaaccttcaaaagggtgtgctccctgaaactttgggtcgattgccaacaggacagcaagctactaccttgcttgaactgatgactattagggcatttcatagcaagatcttacgcagattcagtcttggcactgcaattggatttcgaattagaggaggtgttttgactgatattccagctattcttgtcttcgttgcccgtaaagttcacaggcaatggctcaaccatattcagtgcctacctgctgcccttgaggggccgggaggtgtttggtgtgatgtggatgttgtggagttctcctattatggtgcacctgcacaaactcctaaagaacaattatatacggagcttgctgatggcttaaggggaagtgattcatgtgttggctctggctctcaggttgctagccaagagacatatggaaccttgggtgctattgtcagaagccgatcaggaaatagagaagttggttttctaacaaatcgacatgtagctgttgatttagactatccaaaccagaagatgtttcacccattaccacccagccttggacccggtgtgtaccttggtgcagttgagagagcaacatcatttattactgatgatctttggtatggaatttttgcaggaacaaacccagaaacatttgtgcgagctgatggggcattcatcccatttgcagaagatttcaatatgaacaatgtaatcacaactgtaaaaggtgtaggggagatcggtgatgtaaacatcatagatttgcagtctccaatcaacagtctcattggaagacaagtggttaaagttggaagaagttctggtttgactacagggactataatggcatatgccctagaatacaatgatgagaaggggatttgttttctcactgattttcttgttgttggtgagaaccagcagacatttgaccttgaaggtgacagtggaagtctcattctcttgactggacaaaatggggagaagccatgccctgttggtattatctggggtgggacagctaatcggggtcgtttgaaactaaaagttggtcaacccccagaaaattggacaagtggagttgatcttggccgacttcttgatctccttgaacttgatctcattacaacaaatgaagcactccaagctgcagtgctagagcaaaggaatggttctgctgctggaattgattctaccgttggagaatcctctcctactgtgccaattaaagaaaagcttgaagagagctttgagcctttttgcttgaatatcccacttgctcaagttgaagatgaaccctctcaaagagtcaacccatcaataaggccctgtgagtttcatataaaaagtgagattgaaatagctccaaatgtagaacaccagttcataccaagctatgcgggcaagtctccagcacgtcaaagctacctgaaagaagacatggagctgaaaagtttagctgaacttaggaatggccctgatgaagataattttgtttcgttgcatttaggagagccggaaatgaagagaagaaagctttcaaattcctctttttgcatcaaagaataa

SEQ ID NO: 107878 - DNA, 306 bp, Glycine max
  Peptide Sequence Number=SeqID_224656
atgggcaaacagtgtgtgcaaaaacaaacccatcttagaaaaagaaaaagagagaaaacacagtttctcaactcaggcacaatcagtgtgaaaacaaaaaacgcaacccattcattgaaaagggatgtgaaaaaagaaaaaaatttgcagaaccagtcagagaaaactcaccgatcagcaatgttggagcaatggaaatggccgcctcggaacaaagaagctcgaagagtgtacgaaggagtattgagaagagagagagagagagagagtagtgatgatgatgaaagagcactactagctaaatag

SEQ ID NO: 107879 - DNA, 759 bp, Glycine max
  Peptide Sequence Number=SeqID_224657
ttggatgagatatcagacactggtgcctttgtgagatctgcttcaacattcagaaattggatttcgagggacccgaattcgctgtttccaccggaatcagggaggtgccttgcttacttgaatatcaaaggacttgacaaagccatcagtttctcggctgtcaaacccatctttgagagaactagagaatcagatgaatataagggatggatttttcctgaatcggaaaccgaggtgcctggagctgaacctgataggttcaatggagcaaagactattagggaactttatgaaattgcaagtgaaaactatgccggaaagtacactgttccggttctgtgggataagaaactcaagacaattgttaacaacgagagctcagagataatccgcatgtttaatactgaattcaataatattgcagaaaaccccaccttggacttgtatcccactgatttaaaagcccaaattgatgataccaacgagtggatatacgatagtataaataatggtgtttataaatgtgggtttgcaaagaagcaagaaccatacaatgaggctgcaagacaattgtacggggctttggacaaatgtgaggatatactaagcaagcaacgctatatatgtggcaatacactaactgaagcagacattcgtttgtttgtcactcttattagatttgatgaggtaaaagctgaaacatttcaggaaaaaagaaaatatcttactaattgcaaggcatgtctgacagattcctaa

SEQ ID NO: 107880 - DNA, 440 bp, Glycine max
  Peptide Sequence Number=SeqID_224658
ttgatcacaatgagagtgacaacaacgacaatcatgatggtgattgtgataatagtcatgatgatgacattgacgacgacaaagatcatgataatagagcgatgatgatgatggtagctattgatgatgatgatgaccgtggcgataattatgatgatgactgcaacgatgctcatgacaataacaataacaatcatgacaatgagaagactccagagcctataatagaggcatacctagaggcaaatgatctctgggaagctgtagaggagaactatgatgttcttcctttgccggataatccaacattggctcagattagaaactggaaggaaagaaaagctagaaattcaaaggcaaaagcttctttattttctgctatctcacaagaaaattcactagaaatcagcattgggaatttggcacttcctcaaggatga

SEQ ID NO: 107881 - DNA, 3966 bp, Glycine max
  Peptide Sequence Number=SeqID_224659
atggttacaatttcatcagaggctgcttcttctttctcttttgcatcgcctcttaaaagatacgatgtttttatcagttttagaggcgaggacacgcgcaataacttcacaagccatctttatgctgcctttcagttgaacaaaatccaagccttcatagacaacaggcttcacaagggggatgagatctctccctcgattttcaaagccatcaaacactgcaacctttctgtggttgttctctccaaacactatgcttcctccacgtggtgcttgcgtgaactcgcggaaatacttgatcacaagaaacgtggtggacacattgttatacctgtgttctataagatcgacccttctcatgtaaggaagcagaccggcacttatgggaaagcattcgaaaaatatgaaagagatgttaaacacaacatggccatgctgcagaaatggaaagctgctctcactgaagttgccaatttagttgggtgggaattcaagaatcataggacggaaaatgaactcattgagggaattgtcaaagatgttatggaaaagctgaatcgtatatatcccactgaagtaaaagaaacacttgttggaattgatcaaaatattgctcctatagaatcactattgagaatcgggtcaaaagaagttcgcataattggaatttggggcatgggtggagtaggaaagacaaccattgccaatgctttatttaccaaattatcatctcaatatgaaggtagttgcttcttggcaaatgtaagggaagaatatgaaaatcaaggacttggttatttacgaaataaacttttttctgaggtactggaggatgatgtgaatctccatattagcacccccaaagtaagatccacttttgttatgaggaggcttagacaaaaaaaggttttgatagttcttgacgatgtcgatgattcaaagaaactagaatatcttgctgcacaacatgattgtttgggatctggtagtatagtcattgtcaccaccagagacaagcatgtcattagcaaaggggtggatgaaacatatgaggtcaagggattgtcccttcaccatgctgttaggctttttagtttaaatgccttcgggaaaacctatcctgaaaagggctttgaaatgctatcaaaacaggtggttgatcatgcaaatggcaatccattggctttaaaagttttaggttcacttctccattccagaaatgagcagcaatgggccaatgctttgagaaaactcacgaaggttcctaatgcagagattcagaatgtcttaagatggagttatgatggactggattatgaacaaaaaaatatgttcctggacattgcgtgctttttccgaggagagaatatagaaaatgttataaggctactagaaatttgtggtttctatccatatattggtataaaaatccttcaagaaaaaagtcttgtaactttttctgatgacggtaaagtgtgtatgcatgacttgatacaagaaatgggctgggaaattgttcaccgggaatctatcaaagatcctggaaggcgtagccgattgtgggatccaaaagaagtctatgatgtattgaaaaataacaggggaactgatgcagttgaaggcataatcttagatgtgtctcaaataagtgacttgcccttgagctatgagaccttctcaaggatgatcaatataagatttctcaaattctatatggggaggggtaggacatgcaatttgctccttccttcaggtctcaaatcattgcctaataaattaatgtacctacaatgggatggatacccttccaagtctttgccatctactttttgtactgacaaccttgttgtgctttccatgatggaaagccatgttgaaaaactttgggatggaatcaagagttttgcaagtttgaaagagatcaacctccgtgccagcaaaaagttaactaatctcccagatttatctctggcaccaaatcttgaaactatagatgtttctcattgcacaagtctgcttcatgttcccttatccattcaatatgtcaagaagcttcttctgtttaacttggaatcctgcaagaatcttaagagtcttccaataaacattcacttgtcttctcttgaaatgttcattctcagacgctgttcaagtcttgacgagttttcagtgacttcacagaacatgacaaacctagacttgagagaaacagcaataaaagatttcccagaatatctttgggagcatctgaacaagcttgtttacttgaatctggaatcctgcagcatgctcaagagtcttacaagcaaaattcacttaaaatctcttcaaaaactcagtctgagagattgttcaagtcttgaggagttttctgtgacttcggagaacatgggatgcttgaatttgagagggacatcaataaaagaattgccaacatcactttggcgcaataacaagctttttactttggttcttcattcctgtaaaaaacttgtgaattttcctgacagaccaaaacttgaggatctgcctctcattttcaatggggtatcctcctctgaaagtccaaatacggatgaaccatggactttgtcatccttagcagatttatctctaaaaggaagcagtattgagaatttacctgtaagcatcaaagatcttcctagtcttaaaaagcttaccttgactgagtgcaagaaacttcggtctttaccaagccttcctccatccttggaagacttgtccttagatgaaagtgatattgagtgtttatctttaagtatcaaggatctttctcacttgaaaatacttaccctaaccaactacaagaagcttatgtctccacaagaccttccatcatcttcaaaagcttcattactaaatgaaagtaaagttgattcccatcttgtgagcatgaaaggtctttctcatctacagaagtttcctctggttaagtggaaaaggtttcattctctaccagagcttccaccattcttggaagaattgtcactaagtgaaagcaatattgagtgcatacctaaaagcataaaaaatctttctcatctgagaaaactagccataaaaaagtgcacagggcttcgatatttaccagagcttccaccatatttgaaagatttgtttgtacgtggatgcgatattgaaagcttgccaataagcatcaaagatcttgttcatttgcgaaagatcaccttaattgagtgcaagaagctccaggttctaccagagctcccaccatgcctgcaatcattttgtgcagctgactgcagatcacttgagattgttcgaagttcaaagactgtcttaatagaagatagatatgcatactattacaattgcataagcttggatcaaaattcacgcaacaatatcattgcagatgcaccctttgaggcagcttatacttctttgcaacaaggaacacctcttggtcctctcatttctatttgtttgccgggaactgaaatcccagactggttcagctaccaatcaacaaattcttcactggacatggaaattcctcaacagtggttcaaagattcaaagttcttaggttttgccctgtgccttgtaattggtggcttcctgcaaaacagttatgaagggtatgatccagatgtcaagtgttatcactttgtgaagtctgcctttaactctgaccccagtgttccctttcttggccattgcacaactgtaatgcaggtgccacaaggttttaattcagaccatatgtttatatgctactatcccacttttaatgcctccattctacaagatttcaaggatttaggcatgtactatgatgccaacagcttaaggctccgagtcatctttaaatttaagggtccatatcaacggttggacattgtaaagaagtgcggggtcagacctctgttgattgctaatactgaaaggtttcacatagaaagtgaactacaacctgaatag

SEQ ID NO: 107882 - DNA, 273 bp, Glycine max
  Peptide Sequence Number=SeqID_224660
atgacaaaaaaagcagtgcataccatgaatcccaagtgtagcacgaatgggagaacagaagcagacaagtatcccggccaaattgctgctggctcagattccatgggaacattagcaatgtctcccttgctcacattcttgctcctcctaagattggagtgttctggagcaggagtgagtagtgttatggttgcaatgacaagatataaagctttattgtataatctgaagtcgcatgcttatatgctgtatactataaagaacaatgaatga

SEQ ID NO: 107883 - DNA, 1434 bp, Glycine max
  Peptide Sequence Number=SeqID_224661
atgcttcgttcacggcggcgctccccttacggcgcctacctctgcgccgtgatctccgccgtgctcctcctcttctccgtctccctcctctactcccgcctctcccgctcccacccccactcccaccacctcccccgtccctccctcgtttcccactccacctccgccgacatctccatcgcctcctccgacgaccccatcgacgagctcgacttcatcgacgaaaccctagatcccccctccctccgcctcaaccctcccccctaccacctcttcttcgatcccctctccgcctccctccgccgctccttccaccaccgtcactccgacaacaacaataatttccccttccaatccttctccgataatgatgaccgttccaaaaccgcattcgcctccgacgacgttcccgtggacttcaccgtccgttccatggcggcgcgtgtggccacaatcgacgacgcgctgctgctcaaaacctctcccttaagagaaggatggagcgactggttcgacaagaagagtgtgtttttaagaaaggatagaatgttcagatccaacttcgacgtgcttaaccctctcaacaaccccttgcttcaagatcccgacgccggcgccgccaccaccggactcaccaggggggacagaattgtccagaagtggtggatccatgagttcaagaaagttccattccctggtatcaagaagaaggctcctcttaatgtcaatgtcaacactctcaccaaagttggcatagaacgcagaactttgaatcataaccacaacaacaatgatgatgataataataataatgagattattaaagaagttgtaaattctggtagcaatggtggtgaatcgagcattcagaaagatgttgatgttattggtgctgatagaggtgtgtctgtgaagaatcatgttgtaaattctggtagcaatggtggtgaatcgagcattgagaaagatgttgatgttgttggtgctgctaggggtgtgtctgtgaagaatcatgtgtatgcggatggggatacttggggctactaccctggattgccgcggctgcgattgtcgttcagtgatttcatggatgagtttttcaagctggggaaatgtgttactagagtgtttatggtgtggaattcgccaccttggatgtacactgttcggcatcagcgtggtctcgagagtttgctctttcatcaccccgatgcttgtgttgttgtgttctccgagacggtggaacttgatttcttcaaggacagctttgttaaggatgggtacaaagttgctgttgctatgccaaatcttgatgagcttctgaaggatatgcctgctcacatttttgcttctgtgtggtttgaatggaagaagacaaatttctattctactcattacagtgagcttatccgccttgctgctctgtacaagtaa

SEQ ID NO: 107884 - DNA, 363 bp, Glycine max
  Peptide Sequence Number=SeqID_224662
atggttttctatgcctgggaatttgaagcaactgtgtcaagcacgtgtgaaattatgaatgtagttgttggcattcgatgcctattaggtgtggaagttaggggacacaagagtggtgggggtgcaatattgtttcttgagatattttcagctgaaacagttgctaaactttctacttgcatctccaatactgtctctggcacttcgctcagagttgtccattatgctaagtcaaggcctcagaactttttctctctgggttttttaactcctatggaagaagagagccgtggagttgtgtttttatcagatgaactctcaaggtccaaagaagcgggaagtgtggaaaaatcctctgtttga

SEQ ID NO: 107885 - DNA, 2815 bp, Glycine max
  Peptide Sequence Number=SeqID_224663
atgattttgttcttatttgaatacgagaagagacaactgcatggtgtgttcaaggcatcctgtgatggagctatcaatatagtaccaaatgcgtttgcgaaagtggggaagcaatttcctgctcaggttaagttcgatgcaatttggctctgtaagccactgcctgaaaagttgttccgtgatgcaatcagagaaaattactttacatcaaacaagtttaactttgggctatctgaaaatcaggttcatgaacttctatatttgttcaatgagagaaggctagaaccggaggcttctcctgggagactgttgtccagcaatgaagacttgaaatcagagtggtactctttaggcaaagttggaagatctgttgatcatggaatgtgtattgaaagacttcaaaatgagcaagatgtgggtggtagcatctcagccatcaaaatgcctaatcgccaaggagattctttgctgtacaatggagaatataaatatactggattaaatgcaagtgatgttaagcaaggaaggactgctcagttttcggtggatactactacaagtgagtatgttagtgattatttgggattaaaggatgaaagtaggtttgctgcatatgagaatgaggattatatggatatctgtctcaggccaaacttcataggtggatactccaaaagtccatctgataaaattagaaatcatggtgagggaaggttatcaattagggatgggctcatgagtaaatccctaccagagactgatcagaggattttattttcaaatgatattcctggtttgaataattctgatgtcaatccatctggcttttacagcaagcatattttggagcataatcctcttgttcaaaatcggcttaggccaacttctacaatgattcacccaatccagtcacagatcttaaacaatacaggtgtaacccaaagagatactaattctaacagtaactcccttctgtgtgatccagatgctcctggtttaaattttagccgggtatcatctgctggaattaatgatggttctaagccaataatggaaagcacttctctttcaaacaactatggaaggaaatccttgagcagtcaaccatgtctcattcgtaaagaactgaaagacacgagcaggtggcacactgctgggggtgacttgcaaaattctgttttttatagtagcaacagggattacatgcctctcaacacggttcaaaattctgatcagttggcagcagaatctgttgtttatgaggcttgcgacattccatccttatcaccttctatccctcctccagatattggaaggagtagcagtctacatgatcccttttcttctttgctccatatccaccaatcatggttaggcaacaattttcattccacaactttgcaagaaaacctgagtcatgacataacactaccgaagaactatgacacatatactcctgaaatttcatgggcaaatgagggtcatttcaaagatggtgattcattaatccatgaatatgatattggatgtggttctcaaaataataattctggttatccaaagaaaaagagtagtgttttttctcgattatcttttatgcaggatagcaaacaagaaaatggaaacaatgtgaggaatgagggttatgatttccatacttcagttgatgcagtgatggaaagggttcggctgaatcacaacaagtggatgaagaaaagaaagccaaagcctatgcacaacaaagctgaaagtctgaagtataaaactcaaatcagtagctcgaggaagaaggagggtgattgctttgaaaatgccttgactgatcaaactatggatttgtctactgcaactgaaggcaatgctaaagaaacagctgaagagacatgttttgtggatttcaagcgtcgtagcaaagtgaggaaacttagtgatgaaaatgagatcagaagctccaatgagagtgaaaagaatgagaatttggtgtttgggcaacaaaagaaaagaaagttgatccgcccaaatttcagcaagagtataacttctgatgataagggcattgacctcagtgcttctcaaaacttacaagtaccatcatctcttggaagttatactgttaaggatgttaaggaaagctgctgtgtttttgttcaaactgcggacaacattaaagctgatgctgaagtaagaaatattattagtgaaacacattctgagaagagtagtcatgccaggggatatgcctgcattgaaggaggagaaagagcagctgatagtgctcttgctgcatttaatgttaaatcaaatgctgaagtacaaaacattcatcgaacacattctgaagataagaataatagtagtcgtgccaggggatatggctgtggtgaaggaggagaaaaagcaatcaatggtgctcttactgcattgaatgatggatcaaaatgtcttgacaacataagccagaatgtttttgcttcagcttcttgcaaagacgtgcaaaacggtttatgttcgatggatagtataaaatcagcatctctgaacacaggatcgttgcgttcaattcgtcaatgtcaagagaatcatgcacataagatcatatgtgctggccgaggtattaatactgacaaagaaatgccaaaagattgcagctcctcctttaaagatggatctgaatatttaaagaactctggtaatgaaaaggctccaattgaaacttcgtgtcctatgaaggaaggtttacttgtgatgaatagtataaaatcagcatctgccggtaaaaactcactgcactcaatttgtcaagaacaccttgcag

SEQ ID NO: 107886 - DNA, 972 bp, Glycine max
  Peptide Sequence Number=SeqID_224664
atgttgttcacgcatgcattaccactcctcatctcagctttcgacctcatcaccgcaaccttcatctccgggttaataatcctctcggttttgtccctatgcttcatcttccaccttcgcttcaaatcaaaatccatcacacacttacaaggcttcaactcgctctggaccgtacggttcctcctcgtgttattcgtattcttatggtccatcaccgaacttctccggttacctttttttcgccgaaaatatttgtacccttttacaccctcctttagcatatcccaacaagccgacctctgcaaagtccacatcgtactctccctcggattcttcgaacccgcgttcctcgtaacgctattgtttcttctcaatgcttcgatcaaaacgaagacaccgaaaaataatgacaagtgggccatcacgtccgtgctcctcacgtgcctcccctttgcgacgctccaggcattgctcatattctttgcccctttcgagaaccgagtgccggctgaaacctcggtggttctcaacgacggctacggcttcgagaccgtgctctgcgcgtacccttttctgagtagtgttctttttgctgtgtttggcgttacgtactcgacgtggttcttgttctcgtgttggagggttttgtcgcttgtcatcaacaaaggcttgaggatgaggatttacgtgctggcttggattgtgcttgttgcgattccgctgcagattgtagcgttggggttcagcgttcggtggagcccgcaccaggaggttcacggcgtcgtttcgctcgtggggttcctcgcggtgttttgctgcgccaccaccggggagggcattctcgtcattaagcctatttccgatgcgttggatgctggaggaaattattgcgtgtggaccccgcagacacgggcgtggcaacttgaagaaaccgaaccagctggtgtggttgttcgtttggagggagggtaa

SEQ ID NO: 107887 - DNA, 186 bp, Glycine max
  Peptide Sequence Number=SeqID_224665
atggcttgcagacagttgtgggcttcaagagctgcttcctacctcaggatctccgtgtttcacagaagcttctctaacggttatgttgcaactgatcaaggtttcaaatatcggtcttggtcgcgtaagtcagtagatatcgcagacaaatggcagacaaatgtggccgatgcggaccaattgtga

SEQ ID NO: 107888 - DNA, 327 bp, Glycine max
  Peptide Sequence Number=SeqID_224666
atggcaaaagacaccaaattcttggtaccctatgttgaatttgctcctgcccctgtgattccacacaaaaaggtttcacatcctcctcacttagaaaccattgctgaagaagaggttgaagaagaacacgatgaagaaattttgtcccaactagccatttcttttcaattcttcttgtccagaacaatttcacatcccactgggagtaattgtatgtgcatttgtaatggtcttagtatcaaaagtcgacaactttcacagaggcttttgaatttaaacaaagatgaccaaggattgggctcacgtgcattcggtaaaacaacaaag

SEQ ID NO: 107889 - DNA, 186 bp, Glycine max
  Peptide Sequence Number=SeqID_224667
atggctaagggaatcagaaagctaagttcctggatcgaggttgccccagcacctatcatttacccaaagaaaccttctaacacacccactttggaaacaatcaccgaagaagaagaagctgccgccgagggattcgaaaatggcgatgtcggtggtagccgatgtctagcgtccaacctagcttga

SEQ ID NO: 107890 - DNA, 1566 bp, Glycine max
  Peptide Sequence Number=SeqID_224668
atggggtcctgcttctctgcggaaagcaggagccctccctgcaattcaccaaattcatcatctttcaggaagagaaagagcaactccaagaagaggcttggatcaagagcctcttcatttgagtattggaggaatgagcctcttcataggatccctgggaggatcttcctcaatggctcatcccaagttgcatccttgttcactcaacaagggaagaagggcaccaaccaggatgccatggttgtttgggagaacttttgttctagagaagatactattttctgtggagtttttgatggccatggtccgtatggtcacatggttgcgaaaagagtgagggattctcttcctctaaaactgaatgcccattgggaacaaagtgcatctggtgaagaagtcctcaaggagattagcgttaatactgcaggaagcatgaattcagaagaggctgcatttgcatctgctgatgatgaatccagggtatctgttgatgccgaggaaacagaaaaacacccagaaatctttcagacacttaaagagtcttttttgaaggcattcaaagttatggatagagaactgaagatgcaccaaagtattgattgcttctgtagtgggacgacagcagtaactctggttaagcagggccgtgatcttattattggaaatgttggtgactctagagctgttctgggtacaagagagaaagacaattctcttgttgccatccagttaactgtggatctaaagcccaatcttccagagatgagccataaaagggacatccgtaccggtagagagaggatactaacacttagttggttgggggatggacaaatttttatgtctgttgtgttagctgaagaagagagaattcgcaaatgtaaaggacgtgtttttgctcttcaggatgaacctgaagttgctcgagtctggttgccaaacaatgactcacctggccttgccatggcaagggcatttggagatttttgtcttaaagattttggcctgatatctgttcccgaggtgtcatacagacgagtcaccgagaaggacgaatttgttgtcatggcaacagatgggatttgggatgttctctcaaacaaagaagtggtggacattgtggcagccgcgccaaggcgtgccttggctgcacgagcgctggttgagtcagcggttcgctcatggaggtacaagtatccaacctccaaagtggatgactgtgctgtggtttgcctctttctggactcggactcggactcccacaaagtgtgtagtgcttccaatgtcatcaagtccaaggaacaacctagttcaggtatccaagtccacaacggtgacagtggagatgttcctgcacctactggtctggcaaggtcaggaacttgcagggaaaacaatgaagacaacaacaacaacagcgaggaagagtctaaggaagaggaaatagatactgatgcagaaatagagtggtctgctctcgaaggagtgtcgcgtgtgaacacattactaaacctcccaaggtttgaacctgacaaagaagacaaggggatgagaaaacacaaatga

SEQ ID NO: 107891 - DNA, 501 bp, Glycine max
  Peptide Sequence Number=SeqID_224669
atggcgtctaggaagggcttcctttcgaaagtgagttccatgtttgcatcatcaagcaccgatttggagcccaaatccacagatggtgacttggaattggatgaagctgacgtgttcaactggaacatgtccaatgacaacaacaacaagaacactgtgacagagtcgaagaagaggccacgatctggtaagaagaaaaaggtggagggtggtggtggcaaagtgaaccctgtggcctcgtcctcaatgccagtggctattcctgattggtccaagattctgaaggaggacttcaaggagcacgagaagagagactttgttagtgacgacgacgatgatcatgacgacgatcgtagagaaccagtgcctcctcatgagtatcttgctagaaccagagaagcttctcactcagttcaagaagggaaaggaaggaccctcaagggtagggacttgcgcagtgtcagaaattccatttggaagaaattggggtttgaagattga

SEQ ID NO: 107892 - DNA, 318 bp, Glycine max
  Peptide Sequence Number=SeqID_224670
atgggggtttgggacaagatgattgaagaattgagggagaaaggatatggggaatggaaaggagcgtgtgaaataaaaatcaaatgtttccttggtgtacaacaagagtgtcgagtaagggaaggatgtgaaactaatcaaaggcacaagggttataagattcgtatgtcatttttttcattgtggccttgtaggggtaaagcaaagacaaaagagataagggaaacatggactcgtgtccttggtgaattagacctcagattgccattcccagccccctttagacttggaaccacagaggtatggtcctcctcataa

SEQ ID NO: 107893 - DNA, 1614 bp, Glycine max
  Peptide Sequence Number=SeqID_224671
atgggtgtgaataacattatgattttgggcgatcttagcttgaagtacatttccaattatcttgcaggtggtcaggttgttaccttcagccaagttgttcttgaagttatgaggcatcttgaaggagcttatgcccttattttcaaaagtctacattatcctaatgaattgattgcctgcaagcgtggtagcccactgctgctaggtgttaaagaattgacagaaaataaagaaaatagttcagcatttgaggataacaaattcctatcaaaagatggaaagcctagagaattgtttttgtccagtgatgccaatgctgtggttgagcatacaaagaaagtgctagttattgaggatggtgaagtagttcatctcaaggatggtggggtttctattttgaaatatgagaatgacatgggagaacatggcgcttctctttccagagctttctcagtgcgacgtgcattatctgttctagagatggaggttgagcaaataaataaaggtaattatgagcattatatgcaaaaggaaattcatgagcagccagagtctctaacaaccacaatgagggggaggcttatacatcgaggatctaacaaatccaagtctgttctgttgggtgggctgaaggatcacctcaaaacaattaggcgaagtagaaggatacttttcattggttgtggtacaagttataatgctgctttggcagctagacccatcttggaagaactttctggtgttcctgttactatggaaattgctagtgatctattggatcgggagggaccaatataccgggaggatactgccgtttttgttagtcaatctggtgaaactgcagacactttacttgcactgcaatatgctttagacaatggtgcattgtgtgttgggataacaaacactgttggtagtgcaatagcaaggaatacacattgtggtgttcatataaatgctggtgctgagattggtgtggcaagtaccaaggcatatacaagtcaaatagtagtgatggtcatgttagctcttgcaataggaggcgatacaatttcaaatcaagccagaagagaagctatcatagatggtctttttgacctgccaaataaagtcagagaggtgctgaagcttgatcaggagatgaaggatctagccaagcagttgattgctgagcagtctcttcttgtctttgggagaggatacaactatgcaactgctctcgagggagctttgaaagtaaaggaagtggcactaatgcatagtgaagggatgcttgctggtgaaatgaagcatggtcctttggcattagtggatgaaaatctcccaattgctgttgtagctacccgtgatgcctgcttcagcaaacagcagtctgttattcagcaacttaatgcccgcagaggtcgtctgatagttatgtgttcaaaaggggatgctgcctctgtatgccctaatgaatcttgtagggtaattgaagtcccacaagttgaggactgtcttcaacctgtaattaatgtagttccattacagttattggcatatcatctcactgttctcaggggacataacgtggaccagcctcgtaatcttgccaagagtgtcacaacgcaatag

SEQ ID NO: 107894 - DNA, 585 bp, Glycine max
  Peptide Sequence Number=SeqID_224672
atgtgtggaatatttgcgtatctgaattacgacgtgaacagagacagacgatacatcttgcaggttctcttcaatggcctcagcagattggagtaccgtggatacgattccgcaggcatcgcgatcgacgattccaatttctctccccttgttttccgtcaagaaggaaacattgaatcgctcgtcaaatcggtttatcaagaagtgggagaaactgaactgaacttgggggaatgcttcggcactcacgcgggaatcgcgcacactcgctgggcgactcacggagagcctgcgcctcggaacagtcatcctcagacctctggtcctggtaacgagttcttggttgttcacaatggagtcatcactaattacgaggttttgaaggaaacgctgctccgacatggcttcacctttgaatctgaaactgacactgaggtcattcccaagcttgcaaagtttgtttatgacaaggcgaatgaagcagccgttgcttcacaggcagtagaactcaagtgtgatgctatgttgatgtacattgtgaaatcctgtataagtgggaagagggaggaatgggggtggaggtag

SEQ ID NO: 107895 - DNA, 1404 bp, Glycine max
  Peptide Sequence Number=SeqID_224673
atggctcgcacaaacgacatcgcaaacaagatcgttgtgcgacgattttggtttacgacatccatcagtaacgcaaaaccgccgccttttcgttggaaccaaacggtggcatttggggttcgcaaaacgccacgttttgtggtgtgtgctggccctaagaagatattatttggcaaagagtgcagagaagccttacaagctgggattgataaacttgccgatgctgtttctctcaccgttggacccaaaggacgaaatgttattctttctgaatctggaaaccttaaagtgattaatgatggcgttacaattgctcgatccattgagctttcggatgcaattgagaatgcaggtgccatcctaattcaagaggttgcaagcaaaatgaatgagttggctggtgatggtactagcactgcaattattttggctcgggccatgattaagtctggactactagcagttgcttttggggctaatcctatttctttgaagaaggggatggaaaagactgtaaaggagctggtcaagttcttgaaggagagaagtgttcctgttgaaggaagggagcatattaaagctgtagcctcgatttctgctggaaacgacgagtatgttggtaacttgattgctgaagctatggacaagattggttcagatggggtgatatctattgagtcttcctcatcatctgaaacctctgtgataattgaagaagggatgaagttcaataagggttacatgtctcctcacttcattacaaaccaggagaagtccattgtagagtttgactgggttaaagttttggtaactgatcaaaagatttcaaatgtcaaagaaatagttcctttgctggaaaaggctatgcagttgaatgccccactcttaattattgcagaggatatcacaaagcaagtgttggagaccttagtggtgaacaaaatgcaaggattactaagagttgcagttgtaaaatgtccaggatttggaggtgcaaagaaagctttgttacaagacattgcacttatgactgacttgggtctcacacttgattgtgccacatcagaccagcttggcactgcactgaaagtgagaataacctgtaatgagacaactatcattgctgatcctagtttgaaggctgaaattcaagctagaatttcacagataaagaaggatcttagtgaaacagataatgcaaacctgtcaagaaagctctcagagagaattgcaaaactctctggtggtgtagctgttataaaggtacctaattcagtaaacatgtcaggggctgtctgtattctggtggcctttgttctttactttgctaatgttactttatcatctcttactcttgggttttactggatcatagtgttatttattgcttttaacttgacttga

SEQ ID NO: 107896 - DNA, 429 bp, Glycine max
  Peptide Sequence Number=SeqID_224674
atggcttgcaggcaattgtgggcttcaagagctgcctcttacctgaggatctctgtgtttcacagaggcttttctaatgttattaaagatttcaagtatgttgattctcatgagtgggtgaaagttgatggaaattacgcaaccatcggcataactgatcatgcccaagatcatttgggtgatgttgtatatgttgaattgccagaagtgggagcagctgtgacacaaggaggtagttttggtgcagttgaaagtgtgaaggctactagtgatattaactctcctatttcaggaaaagttgttgaagtcaatgaagcgcttaacagctctcctgctttgaacaatactccaagttctgtgaagaagaagattccaagcactgatggtcttgccaagatctttcagcactctccaatctccatggtgtag

SEQ ID NO: 107897 - DNA, 237 bp, Glycine max
  Peptide Sequence Number=SeqID_224675
atgtgtcgaagtttgttgtcaccaccaccaagctcaagcgggacgatgtcgttatggccaaggtcgacaccaccgtcaaaaatgatttggcaaacaagggtggtgcagcatgatttggtcgtatattcaaactatgatcgggtggggaagcgcaacatgacaattctcggaggagggcaatgctacttggttcatggggttacgggagtgaaaaattgtagtgtagggattttataa

SEQ ID NO: 107898 - DNA, 633 bp, Glycine max
  Peptide Sequence Number=SeqID_224676
atgcagatcaacgcctcaatgatattgttggcagtgcttactatgttgcacctgaagtgctccatagatcttatagtgttgaaggagacttatggagtattgggaccattttgggcacgcacggaatcaggaattttccgatctgtcttaagagcaaatcctaactttgatgattcaccttggccatcaatatcacccgaagctaaagactttgtgaagagacttctgaacaaggaccacaggaaaaggatgactgctgctcaagctttagctcacccatggttgagaaacgaaaaaaatgctattcctttagatattttgatatacaagttagtaaagtcatatgtgcgtgcctcacctttgagacgtgcagcattgaaggtagtcatctgttatgcttccatcagaacaaatgcatattatatcctcccctcctttgctgggggtaggtctctcgcaaaagcattgaatgaagacgagctaatataccttagagcgcagtttaacctcttggagcctaaagatggctgcatctcacttgagaattttagagttgctctcatgaaaaatacaactgatgccatgaaggagtcaagggtccctgaaattttaaatttgctctctccattctaa

SEQ ID NO: 107899 - DNA, 309 bp, Glycine max
  Peptide Sequence Number=SeqID_224677
atggtggtggtgttgaccatggtggagagatttgtccctatcaatcaagccttggacggtgcgaaagtgctccacgtggcaaggaatggttatggggcctttctgatcgaagccatactcctcttcagcttctttgagcaactgcatgaacaatgggtggttcatatcctccttcttctcatgttggtggtggtggtgaaagtgaaggtgaggaatgtgcaaatgaaaactcatgtgatgatgatgctggtggtggcggcggtgatgatgcttctgattatgatgatgatcgctaaggatccccattaa

SEQ ID NO: 107900 - DNA, 2535 bp, Glycine max
  Peptide Sequence Number=SeqID_224678
atggaggccacggccgccgttgccgctgccgccactgccgccgccgtgcgcggcgcctctctccagatgccgcctccgtcccgcaaagagtggcgtgctgtcgctgagcatcatcattctgcgcgaaaccccgacgacgaggagttagacaatgccaaactagggcaatcagacgagagaacaatatatgaggtgcagcaaggaagagagcctcttgatgttgatttttgttcaataacagtggatggagcagtcgacaatgatattttgcagcaacagctacataatgttgtcagacaaagacaagaactactgcaaatggagattgaactaaaggctcaaatgattgctagaactgagataatggaaatgcaaagcacctttgatgctcaactcaaggaccatgttaataatgccagcaagcttcaggagcaactttgtgaaagggagcacacaattcatgagcttgaaaggaaaatggaagagaaagacagagagctgcattctattaaattagacaatgaagcagcatgggctaaacaagaccttctccgtgagcaaaacaaagaacttgcaacattcaggtgtttaggttttggatctggccttctttacatgcttaacaggaatagggttgctcaggagaccattatgtttaaagatgagcagttcagagaggcccaagcatggatagctcgtgttcgtgagatggatgttttccaatcaacaacaaatcaaacactacaagctgaattgcgagagcgcacagagcaatataatcagctctggatgggttttcagagacagtttgcagagatggaaagagttcatttgcatgctattcagcaactacagcttgaactagctgatgcaagagagaggagtggaactttcaatgatgattcaagaatgtcccaaattaattcaaaaaacaatgtgactcagtttggacaggaaaatggaagtcaatttgacttaaatggaagcaatgcttcaggtggaaataatggtctccttccaaatgaaagcactgataatggtccaccatttgcatctacaggcaatgcatcaatccagactgaacatgttgctggtgttcctattgctccatcatctctaattgtcccaccttcatacctcccacatggccaagtaactgcactgcatccatttgttatgcatcaacaaggagttcccaattcagttgcatcacatgttgggcattttcacccagtgcagtcaatgtcacctgtgcaccagtggcaaaaccaacagtctgtgtcagagggttcacaggtacccgtacaggaacatccttcaccatctcaaactgatcaaaatttgatgagatcagatgctaagtttagctatgaaatgtctgttaatggacaaactcttcatagagactatctggatgctcacatccagcaaggcgaggaggcacaaactgtgatttcttcaggaacaagtgaaacacaggtttctcagtcagtcgataagactcaatttgttgcttcccaacaagatcaaagcatgcaacaaatttcttcacagttctctgaggctttacgattgaactcttttgaaccaaatggtgaacataaggagcagaattctgtgccattatctaataatgaaccagatgtccaagttttattggctgagcaagcaacttctgctgtaaatgcatcatctgtcacaagccattcagttaatcataatgaaatgatccagagcaattccactgattctgttttgtctgaagtgttcacctcttctgggtcgacagcttctacaattgccaagacatcagagactgctctccttgatgaaaaatcattattagcttgtattgtacgcactattccagctggtggccgaattcgaattagttcaacgctccctaacaggctgggcaagatgcttgcacctctacattggcatgattacaaaaggaagtatgggaagctggatgactttgtagctagccatcctgaattatttttgattgagggtgactatattcagctccgtgaaggtgcacagaaaatggttgctgcaactgcagctgttgccaaagttgctgcagcagctgctgcatcaactccttattcttcatatatgtccactgtggcagttacaccaatggctcaaactcatcgcatgaaaaaggctccttcaattgattccaaaaatattaaaagtgaatatgcagtcatctcttcaaatccgggggatgatcctttaaaaatgtcagttatgcagcatcaacaaactagtgcatttaatgttgccggaggtctttcaaatgtcaaaattttgagtaaatctaaggatcctcgggaaatggatggccctgaaagtagggttgtgcagtctcctgtacaattacctgttggcaatgggggaagcattgacagatcaagtatgagcagtgcccaaatttcaggctcagcaaatgggaggctagtctcaagctttgcttctaaacagcagaccagggcaactggtgctgtgtacccttctcgaagatag

SEQ ID NO: 107901 - DNA, 522 bp, Glycine max
  Peptide Sequence Number=SeqID_224679
atggaaggcatgtctgtatctggtatggtcatacacaatgggatgacaaagaaaaatataaatgagctcaacaaatgtcaagccaagcttcagcataacttgacttttctggccaaacttgcggatgctgggtctcagacaccaacaccaacaccattgccagcaccgacaccttctcaggtttcccagcaggctattatgcaacaggggcaaggtatgcaacaacctcaagttgcaaatcagccacaaccagatctttctgcattgaacttgcccttggagatgaatgatcagcaacagctgcagcagcatcagcatctggcaatgtcattgcagatgaatgagcaaaactatcagctgccacatttcctctaccaacaacaaattatccctggatcaatgggtggctttcctgttgctaatagtggcttatatcaggcctctcaaaccagactcagtaatctgtcagaaacaccatcaagctaccaaactggctcagattctggtcctggctggtcttag

SEQ ID NO: 107902 - DNA, 549 bp, Glycine max
  Peptide Sequence Number=SeqID_224680
atggcaaagtcaaggcagaagttttcaaaccaggattcttcgttgtcgcctactgctgcaagatcaagggagtgggatggaccatctagatggactgattaccttgggccggaaatggcttctccgttgtcgtctagtagctccaggaatatctatcatgatgggcagtctcagggcacgacgccggcccaatcgcacaagggtatcaacatgcagtgggttgtccaactcactgaggttgccgaaggtcttatggctaagatgtataggttaaaccaacttttggattatccagatcccatcaaccatgtattttcagaagggttttggaaagctggtgtgttccccaaccatcccagaatctgcgtgttgctctctaagaaatttccggaacacttcagcaaattgcaacttgaacgtatagataagattgcttgggattcattgcaagatcatgcagagcttcatttacagagcctggaaccgtgggtgcaggaggaaaggttgaaaatagtgaaagagaaggctgaagcttgttctaaagtctaa

SEQ ID NO: 107903 - DNA, 387 bp, Glycine max
  Peptide Sequence Number=SeqID_224681
atggagtttgatgattccatgatgacttcagcaattgcaatcgaagatgtacggagggaggtcaaaatgttgaaggctttatctggacataagaatttggtcaagttttatgatgcatttgaggatgtcaacaacgtttacattgttatggagttgtgtgagggtggagaattacttgacagaattcttgatagaggtggaagatatccagaggatgatgctaaagctattcttgtacaaattctagatgtagttgcgttttgtcatcttcaaggagtagttcatcgtgatctaaaaccagagaattttctttttgtctctaaagaagaggatgctgtgatgaaagttattgattttgggctatctgattttgttaggccaggataa

SEQ ID NO: 107904 - DNA, 615 bp, Glycine max
  Peptide Sequence Number=SeqID_224682
atggggcattgctgcagcaaaaacatcgccgtcaacaacgagacgctgccctccgatcacgcccccaagccgccgcattacgcggcggcgacggtggcagtggcgtctccgccaccgtcggggagctcgatctccgccgcgactccagggaggaacacgccagcgcaatcgttttcgatgagcccgttcccgagccccctcccggcgggcgtggcgccgtcgccggcgaagacgccggggaggaagttccgatggccgctgccgccgccctcgccggcgaagccgatcatggcggcgctgctgcggcggcaggggaaggcgaagccgaaggaggggcccataccggaggagcaaggggagggtggcggcggcggcgagggtgagaggtcgctcgataagagcttcggttatgggaagaattttggggccaagttcgagttggggaaggaagtgggtcgagggcattttggtcacacgtgttgggccaaggggaagaagggtgacctcaagggacaatctgttgctgttaaaatcatatccaaagctaagctggtgcttgtaccagaaaggaaaatgccatggagacctgttttctggaagaatttatggaattag

SEQ ID NO: 107905 - DNA, 159 bp, Glycine max
  Peptide Sequence Number=SeqID_224683
atggaagagatgaagactgatggaggagacgaggaactggacagcagtccagtgataggtgtttcaggtcagaacatcaacacagatttgttaggtgcagtgacattgctcaatccaaccctcttacacggcgatgtcccaaattgcaattctgattga

SEQ ID NO: 107906 - DNA, 2160 bp, Glycine max
  Peptide Sequence Number=SeqID_224684
atgtttggtccagaagggcgtcctcaacattgttgtgcatggcttgggatcgctagtagttttccagagtgtgcatcttcaattgtcccagaagaggttacaaaaatcggcagggatgctgttctttatgttgaatctctgattgaatctatcatgggaggattggaaggattaataaatatccttgactctgaaggaggatttggtgccctagagaatcagcttcttccagagcaagcagcttcatatctgaatcagacatcaagagtttctattccatcatataaatctccaaaaggaactgccggttttcctttacctggccatgagagctttcctgaaaataatggttctatcaaaatgttagaagctgcaatgcagaggttgaccaatttgtgctcagttttaaatgatatggagcctatatgtgttttaaaccatgtctttgtactgagagagtacatgagagaatgcattcttggcaacttcagaagaagattgcttggtgttctgaaaactgataacgatcttcaacggcctaccgttctagaatcactgattaagagacatattagcatcgtgcatcttgcagagcagcacatcagcatggacattacccagggtattcgggaagttttgctttcagaagccttttcaggaccggtttcttctctgcacttgtttgagaagccaacagatcaacatacaggatcggccactgaatctgtatgcaattggtacattgaaaacataatcaaggatgtttcaggtgctgggattttgtttgttccaattcataaatgcttcaggagtacaaggccagttggtggatattttgcagaatcagtcactgatctcagggaattacaggcttttgtacgtatttttggtggttatggcgtagacaggttagacagaatgctaaaagaacacacggctgctcttttaaattgcattgacacttcactacgctcaaaccgagatgtgctagaagcagttgctaccagtctgcatgctggtgatagaattgaaagagaagcttctgtgaagcaaatagttgatctggaaactgtgattggtttttgtgttcaggctggccttgcactggcttttgatcggctactagctgaggcttctggtgctatacttgaagaaggtgctcccttgatacattcgttgctggatggggtgattaagcatctacctgatggagtaccagaaaaggaagaaatcaggagaatgagaacagtggcaaatactgtaggtgttgttaatgatcatgattcagtttgggtaagatcaattttggaggaggttggtggtgcaagtgatggatcatggggcttgttaccatacttatttgccacattcatgacatctaatatttggtccaccacagcatttaatgttgacacagagggttttagtaacaatatccattgcttggcaaggtgcatttctgcagtgattgccggaagtgagtttgttagattggaacgggaacatcagcatcgacagtctttaacaaatggacatgctagtgagggaatggatcccgaattatcaagtcatatgtcagccgaagctagtatcaagtccacactgcagttatttgtgaaactctctgcagatatcatactggattcttggagcgaaacacacagatctcatctcgtagcacaacttatcttcttagaccaactttgtgagatttcaccgtaccttccaagaagctcgctggaaacccacgttccgtatgccattctccgttcagtatacagccaatactatgcagatactcagtccactccattggcaatactgaacgcatcaccccgtcattcacctgccgtgttactcgcacacgcttctcctgtcttaaggcatcatcgtggtggagactcaccacagtattatgggcacgaatcaggatacttcaaaggatcgtcatcacataaccaggagcacctctatgatgatattggcagcttaaggagcatggacaacaagcaaagaaacgttcgtcgttccgggcctttggattacagtgccagccgtagtagggtaaagtctgttgaaggctcaacttctggaagcactggccccagtccacttcctaggtttgcagtgtctagatctggtccattagcgtacaagtag

SEQ ID NO: 107907 - DNA, 174 bp, Glycine max
  Peptide Sequence Number=SeqID_224685
atggatcaacaaatggaggctaaaatccctgggaggtccttccaaaaaggatcaatgaatctaccaccaaaggggacctatcgcatggaaataatgactacaaaaatgcattgctttaaacatcacaaaagcaaatacatcctagtcattcaaggttgtgatgagatcatgtag

SEQ ID NO: 107908 - DNA, 165 bp, Glycine max
  Peptide Sequence Number=SeqID_224686
atggggtgtgttattggagtgagattggcatcgttcttcaccggtgctgcagcggcgtcgtttctgggcctctacagcctccacaacgattacaagctcgcgcacttatactatattcaacggtgtttttgttcctctaatcatgtcattagcgagagccgttaa

SEQ ID NO: 107909 - DNA, 399 bp, Glycine max
  Peptide Sequence Number=SeqID_224687
atgttgctctttctggtgggagggaaaattcgtgatttactctttcaaattctagaaaatgaaaaggatgtcataataaagcatggagcacaatccagagagagtcggcgggcagcttcacatggaatgcatacatcaaagttctgtttacatccggcaggagatactccatcagcctgccgactgtttgatgctatagttagcttgtgcattccagtgattgtcagtgataatatcgagttgccttttgaagacactatagactacagaaagattgctgtatttgtagaaacttcttcagctataaagccaggacatttgctctcaaaattgagagcagtgaccccagatagagtcttggaatatcagaaaaaactaaaggagccagtagcccaatag

SEQ ID NO: 107910 - DNA, 687 bp, Glycine max
  Peptide Sequence Number=SeqID_224688
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgattcattctatatcagcagggcttgattatccgggtataggcccgctgcatgcacacactatagctacaggaagagctgtaagcatcgcagtgacagatgaggaggctttacaggctgcactggaattatcgcaactggagggtattattcccgctttagagagtgcccatgccctatatgctttaaataaattagaactgaagaaagaagatatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 107911 - DNA, 1283 bp, Glycine max
  Peptide Sequence Number=SeqID_224689
gaaggaattgcaacttgctgtacagcaggcaaaccaataccctaatactgtgcgtggcctggtggtcggcaatgaggtgttgttgcgtggcgagcagtccgagcccaagatgcatgagtacctgcaatgggccaaagccaataccaaagcccccattacatacgcagatgtctgggagttttggctcaagcatccgacattggagcaggatgtcgactttgtgaccgtgcatattctgccttattgggaagacaaaccggttgcgattgagcaggcggttgcgcatacggcttccgtcatggggcatctgggtaccgtgtttaaaaagccaatcctgattggcgaaaccggttggccatcacaagggcgccagcgcttctggtctaaacccagtaccatcaaccaggcgctctatatgcgcggttttttaaatgccgcccagcaaaaccattggcaatacaatgtgattgaagcagttgatcagccatggaagcgcgagctggaaggcacggtaggtggttactggggggtgctggatacagacttgcaacccaaattcagtttgcaaggcagcatggccgaacgttctgatggctttaaaccttatctggttgcactcgtgctggcagtgcttggcgcagcgtggggtcagtacacacaactgtctgcccgctataaagtattacttgccttgactgggctggccgcaggcttgcacgcatacttgcaagtggattatgttcatatggctgcgcgcaatactggcgaatatgtcatgctgggcgggctggtcgtgctaggctgggcgttggcgtggctacagctacggcagtggctgggattaaatgtgtacacctgtattgaacagtccttgttacgattgcttgcgctggcgtttttattgaccagtgcaggcctggcgattaatggccgctatctcgatttcccactgatcctggtttgcctgccattggtgttgatcaccatttcgttgatttcttcgaccaaaattgagcaatctgctgcagccttcaatcaagccggtttttggttgactgcggtcatgtgcgtcatggccgccaatatggcggtggccgtggccatgatggagcctggcaatatcatggcatggtggtggtgtggagcatgtggcttggccctgcttgtgctgcccgtcagaagcctgcaacttggccccttgcattttgggctgtgggcattaaccaatcgtgccttgccgctcatcaatgtcaagcctaccgtgaacgggtttgcgtataccg

SEQ ID NO: 107912 - DNA, 605 bp, Glycine max
  Peptide Sequence Number=SeqID_224690
atgaggttgaagtagatgaaaatactatttcacctaatgaaattgaagaagatgaacttaatgagtgtgaaagggcaaataaaagggctaagaatctttcatttggtgtgtggaattattttgaaaaacctgttaaacatcctgatggaaaattgagggccaagtgtaagtatcttaagagggaccttgtgggcggtgggagtttgagtggaacttcaactttaatttttcatatgaatagatgtcagaaaaagccacattcaattgcagagtctaatgtcgggaaacttgtgcttgatcatactggaagaagtacaataatttatcaaaaggtgttagatgagaagatttctatgatgataattgaccatgatgttgcattctcttttgttgaatataagaggtttagggagttgatattgtatttgtttcctgaagctaagttaccctttaggcgtgttgccactttgaatgtgaacaaattgtacgacaatgataagctaaagttgaaacatatgtgtggacttcttgtacttcagaggattatattgcatcaactacacattatgttgatcaaaattggaagttgcaaaacaaaatactga

SEQ ID NO: 107913 - DNA, 501 bp, Glycine max
  Peptide Sequence Number=SeqID_224691
atgactcccaagtcactagcattttacaaagagaatgctgacaaggatgatgatcggaagacaatcatctacaatctaatgtgcgagaaggcaaaaatatggatcaacattctgagcaaaagtgtgtttcacaaggctagctccaagaatacccactgtgacctccataagttcatgctatttcacttgattgagaacctatcgtttgaccttccacacaccatatatactaacattctgaggaacctcaagggcttaggtgtcctagacaacatctactatgtagccctcatgaacaagcttctatggtttcaaggagtctattttgtgttcaataagatggatgaggattcaaagcacactctaatagttaaggggtcagtgcttgctaaacaacaaaattttagcaagattaacctgaaggttttgaaggtggacttggaacaaagcttaaaggaggctctagaagtggacatagaagccatcaagaagagaaaatag

SEQ ID NO: 107914 - DNA, 1230 bp, Glycine max
  Peptide Sequence Number=SeqID_224692
atggaatcctggttcatcatcctcgtctctctgagtgtctgcgtgttcataagaaccatatttttctctcttcacaacaaaaccatcaccacccctcctggccccacccacatcccaatcatctcaaacatcctatggctccgaaaaaccttaaaactcgaaccgatcctccgaaccctccacgccaaatacggtcccatggtaactctccgcattggatcacgccccgccatatttatcgccgacagaaccctggcccaccaagccctaatccaaaacggttcctttttctccgaccgccccaaaggcctcgccaccggtaaaatcctcaacagcaaccaacacagcatcagctccgcctcctacggccccacgtggcgcgccctccgccgcaatctcgcctctgagatgctccacccctcacgcgccaggtccttctccggaatccgcaagtgggtcctacacaccctcctcacgcgcctcaaatcagattcacaatccaactattcagtaaaagtcgttaaccattttcaatacgccatgttctgcttgctcgtgttcatgtgcttcggtgaaaggcttgacgatgggatagtcagagacatcgagcgcgtgcagcgacaaatgcttctgcggctcagtaggttcaacgtgctgaatttctggccaagggtcacgcgcgttttgtgccgcaaacgttgggaggagttgctgaggtttcgcaaggagcaagaggacgtgttggttccactaataagagccaagaaggaaaagcgagacaaagacaatgaaggttcattaaacgacgacgtagttgtttcctatgttgacactttgttggatttgcaattacctgaagagaaacgcaagctgaatgaaggggaacttgttacgctctgtaacgagtttttgaatgcgggtacagatacaacttccacagcgttgcagtggataatggcgaatttggtgaagtaccctcacgtgcaagaaaaggtggtggatgagattagagaagtagttggtgagagagaagagagggaagtgaaagaagaagacttgcagaaactaccttatctgaaagctgtgattttggaagggttaaggcgacacccaccagggcactttgttttgcctcatgccgtgactgaagacgtgattttgaaggattatttggtgcctaagaatgggacagtgaatttcatggtggcggagatagggttagaccctaag

SEQ ID NO: 107915 - DNA, 216 bp, Glycine max
  Peptide Sequence Number=SeqID_224693
atggtgtcgttggatagtactacctttttctcccaaaaccttggatgttatggttttcttgttgatgaacttagcatgtcgtcagaaggtgctaatcaactcaggagtgttgggctcgttgtcagtatggatgatggtgatttccatggttgggatagcttcactgataggggtgtatgcagaggccatgtaagagggaacaaagccagtgtttga

SEQ ID NO: 107916 - DNA, 354 bp, Glycine max
  Peptide Sequence Number=SeqID_224694
atgcctcagatggactgtgctcataatcatagcgcgtccaggaaggccagagggaaacattgctcatctgttaatagctctcttaaaggttcccttatgaaactatcaaggtgcaatggagagggaggtaaaagcagtttaagagttggtgtagatttgcaaagtggcatgagaggggtgtcatcagtggattcatcttctgatgaggaagaggttggatcttccttgtttttggtgaaggaaatgactcattctttgttcccaatctttggattgtccttggtagtccttgtcttgactccccagggaatggacgaaggaagaacgaatgcacgtggtttagttgtaggttga

SEQ ID NO: 107917 - DNA, 183 bp, Glycine max
  Peptide Sequence Number=SeqID_224695
atgtatccttctaaggagataatcatgttcgagccaagtagaataaatatggaagaagtgcctgaggaatctgatggagaagtgaagtgcacatggaggagaggaatacgcttaattaaaaagagatttaataatgtgcaagatctggtcacattgtctggtggtctttactttaaagaatga

SEQ ID NO: 107918 - DNA, 627 bp, Glycine max
  Peptide Sequence Number=SeqID_224696
atgaacgagattactgatcaaagtcaaagtgcttccctagaaaattggtatctcactcatagtgtgttggttgtcaaagaggttattgatgaagcaaaaagagaaaagaaaaaatgtccattttttaaagtgaattatgaaaagacttatgattccattaattgggatatcttgatttatatgcttcggaggatgggattttgtgaggaatgggtggggtggataaggtgttgcttggagtcaagttctattttggttttggtgaatgagagtcctattggggaatttaaagttcaaagagggttaaggcaagggggtaaatttgttcatttcttctttaatattgaagctgagggactatgtggcatgatgaagcaagtcatagagaaaaaattatatgcatcttatttggcgggaaagttaaaaattgagggaagcatgcttgtgagattagattggtgctttggggagcaattgggtggaacttgtggcgtttctgactcaaaaatttggaaccttatgatgttcctggttttgctcagtggcaaggaattgtggtctgaggtgttcgatgggttttgcacttgtcggcatgcaaggaaaactagccatgttctgatcatttaa

SEQ ID NO: 107919 - DNA, 3846 bp, Glycine max
  Peptide Sequence Number=SeqID_224697
atggaagcagggacattgagtcctaaccaccctccttgctttcttcgtcagtcacttcctgctgttgcacctatgcttctgatttcaacaggatatgttgaccctggaaagtgggtagccactgttgaaggtggtgcacggtttgggtttgatctgatggctgtcatgcttattttcaattttgctgctatcttctgtcagtacatatctgcaaggattggtgcgattactggaaaaagtctagctcagatttgcagtgatgagtatgatacatggacatgcatgctccttggagttcaaacagaactttcagtgataatgctagaccttaacatgatcttgggcatggcacaaggattaaatcttatttttgggtgggacttgttcacttgtgtctttttaactgctactggtgctgtttttcatatacttctctcagttctccttgacattgagaaggcaaaaatcctaggaccgtttgttgctggttttgtattgcttgcttttatacttggactgcttatcaatcaaccggaaattccattttccatgaatggaataccaacaaggttgagtggggagagtgcatttgtgctaatgagtcttctaggagcaaatcttgtacctcacaacttttaccttcattcctctattgtacagtggcatcagggattgacaagcatttctaagaatgctttgtgtcataaccactttttggccatattatgtgtttccagtggtctttatttggtaaataatatgctgatgaccgcctcagcaaatgagttctacagtacagatcctgttctgcttacttttcaggatgcattgtcacccatggaacaggtcttacgtagcccaatagctctgcttgggtttttgctcattttgtttcttgcaaatcaaaccacagcattaacttggagtttaggcggagaagtagtagtgcgtaatttcttaaaattggatattccaggttggcttcattatgctacaattagagtgattgctgttttgcctgccctttattgtgtctggagttcaggagctgaggggatgtatcagctactattatccacacaagttttggtagctctgcaacttccatcttttgtgatccctctttttcgagttgccacatctagatcaataatgggtgtacacaagatatcccagtttctggaacttttggcatcgatcatattcattggtatgcttggcttgaatattgtcttcgtggtagaaatgatattcggcaatagtgactgggcaagtgatttgagatggaatgttgggagtggtgtgtctgtctcatatttagttcttcttaccgctgctattacatcgttatgtttgatgctttggttagccgccacacctttaagatctgccagtgtccaattagatgctcagacatggaactgggatatgccagagactctgccaactcctccagttgttggggaggaattgtatttaactgaaaaaaagtgtcatgaagatgtatctaagcatgtggaggaacacacaccagctgtagcaaaaagcttggactactcagatgtatcacttccaagttttcatcctgatctacctgaatctttaatggaacctgaaccccatgtgaatgctgtaagggataattattctcttatatcgacttccacatcagagttagaggcagtatatgctgtagttaatgagacttctgattcttgtttggaagacaccaaaaccataacaatggaaacaaacgctgaaagggatgacgatgattcatgggaaactgaagaaccttctggagtggtatcagccagtgttccatcttcaacatcagatggccctgcatcattcaggagtcttaatggcaaaagtgatgaaggagggaatagctgtggaagtctttcaagaatagaaggcttagggcgtgcagcaaggcgtcagctagctactgttcttaatgaattctggggacaactatatgatttgcatggacaagtaacccaggaggcaaaggctgggaaaattgaccttttgctgggagtgggtgtagattcaaggcccaccagttccttgcaaaaagtggatgcatgtggaaaggattattctgaatacttagtatctgtcagaggtagagcttctgacgcattaatgaactctgcttcatatgattcttccaagcagcctatgatgcaaagtaattcagagtcttatggccttcaaaggagttcttcctcaatgtgggcaaatcccatccaattattggatgcatatgtacagaactctagccacaatctcctcgattctggtgagaggcgctattcaagtgtgcgtaatctacattcatcagaagcttgggattatcaaccagctaccatacatggttatcagactgcatcctatcttagccggcttggtaaagacagaaattctgctaacttaaattgtcaggtggacttgtcatcactgaaatccccttccatagttaatacaaagtacagggattcacttgcatttgctttggggaaaaggttgcaaagtggctcaggtgtgggccaacccccagggttcccaaatgtagctgtctctagagattcccaattacaatctgagaggttttattatgacttatgctcttctggatctgcagataatacagtcaattcagttaatactaaaaagtaccacagtttgccagacatttcaggatactccatcccccacagggctggttatgtgtctgataaaaatgctccaagggatggttctgttggatatggatcttttgctagtaggacgtgctatgaccaatcattatatttaaattctggatcaagaacaggaggtcatttggccttcaatgaacttcctttgtctgaagtttacaacaaggcactctcttcacagttgagttctggttttgatactggatccctccggtctagattgccttatgagcagtttggggtagctgagaaaattcctaatgttgcaatggaagctgttggaaataggcctaatgcaattgctcaagaaactacttcatttgtggatatagaggggaaacttcttcagtctattagactttgcattgtgaagctcttgaaactggatgggtctgattggttgtttagacagaatggtggagccgatgaggatctgatagattctgttgctgcaagggagaagttgttttatgaaattgaaaccagggagatgaatcaggtcattcatatggatgaagctcattattttccttctgataggaaatttggttcttcaatgaagagtaatggggcatattcttcaggtttttcggtgtcttcggttccaaattgcgggcagggatgtatatggaaaacagatttaataataagctttggagtatggtgtatccacagtattcttaacctctcaattgtagaaagccggccggagctttgggggaaatacacctatgttctcaatcgcctccagggcatcattgatccagctttccttaagcctcggagtcccttggctccatgcttctgccttcaagttcagcaaaagttaagcccccatctttcaaatgggatactacccccaacgactacaaaaccaggccagggcaaatgcacaactgcatcaacgttgcttgaacttatcaaggaagtggagcttgccatctctggcaggaaaggacgtaccggaactgccgcaggcgatgtggctttccctatggggaaggaaaatttggcgtctgttctcaaacggtacaagcggaggctatctaacaagcccgttggcactaatggagggacaggttcacgcaagatccccacattagcaccatacaaccaataa

SEQ ID NO: 107920 - DNA, 3273 bp, Glycine max
  Peptide Sequence Number=SeqID_224698
atgcctggaagcttaaggaatctgtcactttctcccaaaatcttctccttcaccttgcttctctcattaaactcccttctctttttcccatgttgttactcccttgatgagcaaggccaagctcttatagcatggaaaaacagtttaaacatcacttcagatgtgttagcatcatggaacccttcagcctcaagcccatgcaactggtttggggtgtattgcaactcacaaggagaagtgatagagataagcctgaagtcagtgaacttgcaaggctcattgccttcaaattttcaacctctaaggtccttgaagattcttgtcctctcatcaaccaacctcacaggaagtataccaaaagagattggagactatgtagagctcatctttgttgatctcagtggcaattctctctttggtgaaatcccagaagaaatttgcagcctaaggaaactgcagagtttgtctctccatacaaacttcctccaaggcaacattccttccaacattggcaatctaacaagccttgtgaacttgacactctatgacaaccacctcagtggtgaaattccaaagagcattggctccttaagaaagctccaagtcttcagagcaggtggaaacaagaatctcaagggtgagatcccatgggagattggaagctgcaccaacttggtcatgctaggccttgcagaaaccagcatttcaggaagccttccttattcaatcaaaatgctgaaaaatatcaagaccatagccatatacacaactctattgtcaggccccattccagaagaaattggcaattgcagtgagttgcagaacctgtacttgcatcagaactctatctcaggctcaataccaagccaaattggagaactcagcaagcttaagagcctgcttctgtggcaaaacaatatagttggaacaatcccagaagagcttggaagctgcacagagatcaaagtcatagacttatcagaaaaccttctcacaggtagcataccaaggagctttggcaacctttcaaatctccaagagcttcaactaagtgtcaatcagctctcaggtataatccctcctgagatttcaaattgcacttctttgaatcaactggaacttgacaacaatgctctctctggtgagattcctgatcttattggcaacatgaaagacttaactcttttctttgcatggaagaataagttaacaggaaacattccagatagtctttctgagtgccaagaacttgaggcaattgatctctcttacaacaacttgattggtccaatacccaaacaactatttgggttgaggaacctcaccaaactgctgcttctttccaatgatttgtcaggctttataccacctgatataggaaattgcacaagcctctacaggctgaggttgaatcacaatagattagcaggtcacataccaccagagattggcaacttgaagagtttgaactttatggacttaagcagcaatcatctttatggggagattcctccaacactatcaggatgccagaatcttgagtttctagaccttcattccaacagtctcagtggttctgtttcagattctcttcccaaaagccttcagttgattgacttgtcagacaacagactaactggtgcattgagtcacaccattggttcactggttgagttaaccaaactcaaccttggaaacaatcagctgagtggaagaatcccatcagagatcttgtcttgctctaagctacaacttctggacctgggaagtaatagtttcaatggagaaattcccaatgaagttggtctaattccttcactggcaatctctctcaaccttagctgcaaccagttctctggtaaaattcctccccagctctctagtcttaccaaactaggagttcttgatctctcacataacaagctctcagggaatttagatgctctttctgaccttgagaatcttgtttccttaaatgtttccttcaatggcctctctggtgagttgcccaacaccctattttttcacaatcttcctcttagtaatcttgctgaaaatcaaggtctctacattgctggaggtgttgtaactcctggtgacaaaggtcatgctagatcagctatgaagttcattatgtccattctcttaagcaccagtgcagtacttgttcttctcacaatctatgtcttagtcagaactcacatggccagcaaggtgctcatggaaaatgaaacttgggagatgactttgtatcagaagcttgatttctccattgatgacattgttatgaatttgacatcagccaatgtgattggcactggaagctcaggagttgtgtacaaagtcacaattccaaatggtgaaacactggctgttaagaagatgtggtcatcagaagagtctggagcattcaattctgagattcaaacattggggtcaattaggcacaagaacatcatcaggcttcttggatggggatcaaacaagaacctgaagctgctcttttatgactatctccctaatggaagtctgagctcattgctctatggttcaggaaagggaaaagctgaatgggagacaagatatgatgttatattaggtgtggctcatgcactcgcatatttgcaccatgattgtttgcctgctattattcatggagatgtcaaagccatgaatgtgttactaggtcctggatatcaaccttaccttgctgactttggcctggcaagaactgcaactgaaaatggtgacaatactgattccaagccacttcaaagacactaccttgctggttcatatggatacatggctcctgagcatgcatcactgcagcctataactgaaaagagtgatgtgtacagttttggcatggttctacttgaggttctcacaggaaggcacccattagacccaactctaccaaggggtgcacacttggttcagtgggttaggaaccacttgtctagcaaaggagacccttctgacattcttgacacaaagcttagagggagggctgatcccaccatgcatgaaatgctacaaactctagcagtgtcatttctatgtgtaagcaataaagctgatgagaggccaacaatgaaggatgttgttgcaatgctaaaggaaattagaccccttgagacctcaagggcagaccctaatgtattgaagggaggtttaacagcacatagttcaccaccacctcctaagaatgtggtctcacatggatcttctacatgttcctacaatttctcggataactcaatcaattaa

SEQ ID NO: 107921 - DNA, 372 bp, Glycine max
  Peptide Sequence Number=SeqID_224699
atggtggttatgccccaaaagtttgctctttgctttacacttgggtgtggatttattattggatcattctttgctctcaagggtccaaagaatcagcttgctcacatgttgtcaatggagaggctccctttcacattggcttttttaggcagtatgattggtaccatatatgtatcaatggtgcttcacagctacattctctctgtggtattctctgtagtgcaggtaggcacagggtgttgggaaggctaccaaacaagggcagaggctcagcatagtattgttcaccacaatatgggcctgcatgagcaaaaagacttgtgtgagaacgtgtcagtggttcttcaagacgccgtcaatggtgcagtgtag

SEQ ID NO: 107922 - DNA, 270 bp, Glycine max
  Peptide Sequence Number=SeqID_224700
atgcattctaaggagacactagatgtcattgctgtaaagaacctcgacaagcttccaatgactcacaatttgagaatagggggcttagtctcggaatgtctttggaagcagctgatgtcgcagatccagccaagggtcacaatgggtggtggggaagacaatgcaacaaaaaaccaaaaagcacctttcaaaggggcacatccaactgatccaagtagaggtcaaatggaagagaggaccagaggtccaaatagaggtgaatacatgtag

SEQ ID NO: 107923 - DNA, 285 bp, Glycine max
  Peptide Sequence Number=SeqID_224701
atgcagggttggttctcggggcagagcagcgaggaggaggcgaagccggcgtcgtcgttgctcgccgattggaactcctacgcatccgcccaatcctctgaggactcctccgctttccccttcgatatcgaatccgccgttaggtctgccaacgacaccgtttccggcactttcagcgtagaaaatgacataatgttcgtttggttctgtcgagtgaaccccagatccgtgcctgagaagcttcgggtgggaaatattggtcatatattggggctgtttagataa

SEQ ID NO: 107924 - DNA, 465 bp, Glycine max
  Peptide Sequence Number=SeqID_224702
atggcaactggtgactttctacattacaaagtggcatctccatctttcaaatttatgggactcctggttggtattaatcctaggctaagctctcgattggtggaagactggttctcaggatcctcagttgaatacaaaggaactacctttggaatgggatttctgaaagccagaagattaattggctcaattggcacaagaccaggatggtttgaaacctacatccaaaggaagctatttgcttgggaggaggagcaattaaccattctactgactcaactcaatggagtcaatcttgtccatgacagaaacgattgctggatttggaagctggaagtggagaaagcggataaaacttggattggaaagattccaaaacgaaccactacccatacttgtgggagagtgatgctccctctaaggtattggtcttttcatggagattgcttttggacagactcctaa

SEQ ID NO: 107925 - DNA, 528 bp, Glycine max
  Peptide Sequence Number=SeqID_224703
atgacatgttggggcgggcaactgatgcccagccccgaattgtgcatggaggatgcaaatctcaactatgctgagtctaacagagtctccatattaacagtggacaaattttcaagaaggatggttcttcagtttatgggaattaatcacatgttatgttatgcttctcctgctttggctgcaccaattatgccagacatgaaggaacctgaagtcatacggactttgaagctacctagtggagtgagagttcaagaaggggaaggaccagaagcacacgatggagatttggttacattcaattgtgtatgcagacgtgcaaatggatactttgttttcagcacagtggaccaattcaacggagaaagtaatcctgttatacttcctttggatgagaatcagataaagatctttctgagaccttgccatattctttctactttgctcaataacttcaaagttgtaattttaattgttggatttcaaagtatggtgatactggtgaaacaaaagaaaagaaatatgtaa

SEQ ID NO: 107926 - DNA, 267 bp, Glycine max
  Peptide Sequence Number=SeqID_224704
atgtcaatggatgcttgtgaaacaagcatgctgatgctactgatgatagtgggcttaaaggaggtcttgactggcatgaaagttggtggaaagagaagagcactgataccaccttcagtgggatatgtaaatgagaacttgcaaccaatacctgaagagtttggccctcgtcgcagccttttttctcatgcacaagagcctttggttttcgaagttcaactcttgaaaattttgaggcctccaccaccacctgcagcatttaactaa

SEQ ID NO: 107927 - DNA, 843 bp, Glycine max
  Peptide Sequence Number=SeqID_224705
atgttgcggtgcttagagggacttaagcctttatttgcttccatattacgatgttgtgacctggatatatataaccagccaagaggccttgaagatcctgaacttcttgctagagagactgtgttcagtgtaagcgaaatagaagcactttacgagctcttcaaaaagattagcagtgctgtaatcgacgatgggttgattaacaaggaagagtttcagttggcattgttcaagacaaataaaaaagaaagtctgtttgctgatcgggtatttgatttatttgacacaaagcacaatgggatactaggttttgaagagtttgctcgtgctctctccgtttttcatccaaatgcccctattgatgataagatcgaattttcctttcaactatatgatctcaagcagcagggttttattgaaagacaagaggtgaagcaaatggtagttgctactcttgctgaatctggcatgaacctatcagatgacgttatagaaagtataattgacaagaccttcgaggaagcagatacaaagcatgatggcaaaattgacaaggaagagtggagaaaccttgttttgcgccatccgtcacttttgaagaacatgacccttcaatacctcaagattaccctaggttcacccaaaaaagatgcatatatatatgctaaccgagttcagggacatcaccacaacattcccgagctttgtatttcattcacaagtagacgatacttgaagataatttctcccatggcttcttcctttgggctgcatggccacttttgtacaaaaaagggcatggcagacagccttgcttttaccttacatttgttatatctttga

SEQ ID NO: 107928 - DNA, 216 bp, Glycine max
  Peptide Sequence Number=SeqID_224706
atgccgaagagggtagggaggaaaatcaaaccttggaggcagaagatcgggcaacagaagagggaaaagaaggagtgtgaagaagaatttgtggaagtgagatggatgattgcaacgaatgtatctgtgaaggtgacgaaagtgatatggtcgatgacagatagagtacaacccacaagaacctctgacaacatatttttatatcaaatggtataa

SEQ ID NO: 107929 - DNA, 3889 bp, Glycine max
  Peptide Sequence Number=SeqID_224707
ggagtactttgtcacgtatcatggtcttgctcatgctcacaaccgctggattccagaatcaaaattgcttctcgaggctcctaagctcttggccaagtttaagaggaaactgcaggaagtatccatgaaaataatttcttcttttgatgccaaattaccaggttaccaccaggtggaaaagagattggagtataccccaccgggtcttggttatgataatgctacttgggagttagatgatgcttcatttttgacgtcacctgaaggcaggaaagtcatagatgattacgaaagtcgtcgcaagagagcagagagactgtcaaaaaatcattttgaagctaatgaggagagaaaagcttccttttctgaattatcagtgttgccaactggagattcgccaggattttataaccagcatttgacttatgtgaacaagcttcgcatgtgttggcacaaaggtcagagtgctcttattgtagatgatcaaattgaccaggagcgggttatgaaggtgattttgtttatattatctttgaattgtaatgtgaggaggccttttctcatcatctcaacttctgctgccctctctgtatgggaaacagagttcttacgtttggcaccatctgccaatcttgtagtttacaagggagacagagatgcacggagtagcatcagggcattagagttttttaatgaacatggtggaatattatttcaaatactgttatcatcttctcatattattgttaaggacttgcatgaactaagatgcattacatgggaagcaataataattgatgaatgccagcaatccagaatttcaggacacttggacgatatcaagattctaaaagctgaaatgagactccttcttgttagtggacaaatcaaggaagatcaagctgattatatcaaactgctttcattactcaagtccggacagcatggatcaagtattgctcaagtggaaacttatttctctgcttcttctaccatttccaatttgaagagtcaattggaaaaatatgttgtattcaaatgcaaatctggctccactaggtttgtagagtattgggttccagcctgcctttcccatttgcagcttgagcagtattgttcaatgctgctttcaaacttaatgttgttatgctcaggccaaaagtccgactcagttgatgccctccatgaccttattatctcaataaggaaggattcagctagttctctttcacttaaaaaactgcagtcaacttgtggctctggatcaattggagatattttggatgatgttctctgtcagagatttggtaaggattgctatgtacgatatgatagaggttataccccaaaatcaaagcaagctgctttagacacatttaatgatggagaaagtggaaaatttgtcttcttgatggaaaaccgtgcctgtctctctagtgttaagctttcttcagtggacactgttatattgtttgacagtgatttggaaccacaaaatgacctaagaggcttacaaaggatgtctatcagctcacagtttaaacagattactgttttcagattgtactcatttttcactgttgaagaaaaaattttaatgcttgcaaaagagggtatagctcttgacagcaatgtgcgattgcttagccagagtatttgtcccaccctgctaaaatggggtgcctcctatttgttcaataagcttgatgatttgcatgccagtgttgtttctactccagacactgtagatatgtcacttctatgtgatacaacctctgaattatcatcccaattggtttgtggtgctgatgatactgattgtcatggatggtcattcatatcaagaatacagcagaatggaggggaatatgcgagggatgttttattgccaggagaaagaataatgaaatctggcggtgagccatgtggtttttcctggagtgatcttgaaggaaggcatcctaaatggaaatttttgcctgtttcatctcagaggatcaggaacacagtcaaacattttgattacggactaagagaatctgaatgtgaaaaatacacctttatagaaaagaggacagcgtcgaaggataatgttgatcccaagaggagaaaagtgtccaaggataatgctgatcctgagtggagcaaatggaccatgaataaagttgatcccaagaggagaaaggtgtccaatgatgttgttgattctaaaggaagggaagcgtccaggaatattgttgattccaaatattggaaaacaaggttgaagagcaagaagaatacaaggcatcccttgaccaatgaaactacgggaaaaattgcaacgaacatgcaattttcagagaaaaagaacccgcctgacatacgaaatttgccaaagccagatatatcagcttgtttgttggaacatgagattgatatgaaagattcacttgctctagcaaaactgtacttgaacttcgattgcaaggaagaggaagccaccgatgtttactcagaactgtggaagcatgtgaaggatttttctaattgtgtacaaaatggactttgcgtcgagaaatgcaatagaagtggtgcttcagactccaacatgcctgagctgaatgatttggcagaggaggagaagcagaaggattttctgggtacttgtgtttcaaaacttgtgaaatctgtcacaaatgaactcaatcttcaaatgaaatctcccacaacagtggtttcacaagacctgagttgtactcatgaaatttgtttatctccaaatacacctggtagttttcctgtggaaggagatgctatctccatggaatctggctcagaagatgacagagtgaacgctataacattaataactgcagaagattcatccgttgatcacgggagtaatgatgtcaaccctgttactggttctttggaaagacagagccctattagaagtacagatattacacaatctgatggcaatgtttttgaagatcctcaaattttagtgaataaagtggttgctattgacaatggtatgaatatgtctactcattctgcgcagcttgacagtgttgaggcagatgctggaacttctgctagtactgctgttcctgaggtcagacggtggtacagtgtaatgagtcctgtatgtgatgagtcaactgctctgaagtttcctgagactaccttaccatatatgcaaccatcggattcaaatttgtggccattgcctcagatggcaatgtctgctattccatcttttccggagaacaatgcggctagtacagtcatgcctctagatgatatttttcgtcatagtggtgaggatcatcgctatattcatgaggctgaagtaatattggaagcaccaaaggaccttaactcttcctttgtttcacctgtgataccgcaacccttcactagtgtgcccatgaatgaaaatgcgacacatgcacctcacggcattactattcctggatttatgaacagtgattactctgaagctcactctgtgacatctgaagtgtcccaccttgcctacacagacccactactgggtgaaatgtcgataatagaaaacatgaatgaagaagctttcatagatctactaccaatagaaatggagagaattgaaaaggagaaagaagaagccttcaagatacatgagcaaaagatattgcagctccaatctgactatgaaaaggaggttgaaaagttaagtgtaaagtacaagatgttgcttcagaatgttaatactgaagtagctctaaaaagaacggaacttgagacacaatgtgaattagtgttaaggaacaaggtattagctcaagtttggacccataatcttgatagttgtgaaggagatgttgtacagtgctcagaacaaggtacggatcacgagtaa

SEQ ID NO: 107930 - DNA, 306 bp, Glycine max
  Peptide Sequence Number=SeqID_224708
tcaacaacccaagtagatgtaccctctacttgtaccacaaaggatgtaccctccaatgtgttaagacaaagttctcaagcagttaaacctttgaaactttgtgaatggggatacaaaataattctcaggcgggagaagggagacacaagaattcaggcggttagtcctttgttcttttggaaaagggagaagagagacacaaaaagaattcaggcggaagaggaagaagaagttcaaagagactcagaaatcaatgtggaaaagttgcttgtaaaggttgtaagtgttgttcaaatgcaaatcaag

SEQ ID NO: 107931 - DNA, 276 bp, Glycine max
  Peptide Sequence Number=SeqID_224709
atgaccctagatcgtgagtgtagtgttagggaaaaccttttggcagatgagtgtgccactatcgcctaccatgactcggggcgggtcaatagcggtggtgggcagggaaaggaattaggcaacgcgaaaggtggcaggggcaggcattcccgatacacgcgaaaggtggcaggggtaggcattcccgatagcgcattaagactcaactgcgaagtgttcggtagcagaagaagttatacctcgcaatcggggtcttatggtgtgatcgtcgacgag

SEQ ID NO: 107932 - DNA, 192 bp, Glycine max
  Peptide Sequence Number=SeqID_224710
atgtgtggaaagggagcttcatcattaccaaagaagaactcaaaaacatcgacatccttaccttcacgaacactcgcaaggtggcgacaccactcaaaagggcaggactttggctacgtggcagtggtgggaacaacaactagggagtcgacttcggcttccttttgcggaggtcagggaaacacaatgtga

SEQ ID NO: 107933 - DNA, 114 bp, Glycine max
  Peptide Sequence Number=SeqID_224711
atggaggtagatgaattcgtacctagttttctaactccaaggattctacctcttaccgttgtcgccagtatctgctatcaatgtaccaactcttcttcaaagtatcctacataa

SEQ ID NO: 107934 - DNA, 192 bp, Glycine max
  Peptide Sequence Number=SeqID_224712
atgtcttcacgtagacatcctattgccttggcaatagtgtcactagacaacgccaccttcattcccaaaaccttggatgctatagtattcttgttgataaactcaacatgtctcctaaagatggtggtgatttccatgcttgggataatctcaatagcagggctgtttgaagaggccattgcagagagttga

SEQ ID NO: 107935 - DNA, 417 bp, Glycine max
  Peptide Sequence Number=SeqID_224713
atggggtgggaccctaaggtgtgggaggatccaatggcgtttaagccagagagatttatgaacgaagaagggtttgatataactgggagtaaagagattaagatgatgccgtttggtgctgggagaaggatatgccctggatataacttggctttgcttcatttggagtactttgcggctaatttggtttggaattttgagtggaaggttcctgagggagggaatgtggatttgtcggagaaacaagaattcactgttgtgatgaaaaatgcattgctgtgtttatctatgagaggttgggaatggtatataattggaatggatagatacttttttcccgttaatttttacatgaaccatccaagaagattctctcctgccattggcatatcacaacaggggaacattgtggcatag

SEQ ID NO: 107936 - DNA, 336 bp, Glycine max
  Peptide Sequence Number=SeqID_224714
atggcattagaagaactcaaagtaattcagctacagcaaagtaattcagcttatgctcaaccaaactatggctttatttggattttctctaacttctgggagccatacatgttagttatcaattataattcggagcatgaacaacacaattcccttttggagcatcacagtgatccttcttttgatgagcatgctagtggtcatcatcacagtgacattgcttgttcaaaaaggacaaagttgcttgaaaggctaaagagatgggttgatgcaggcagtgaaaaacctagagttaggcattctatttccaaaggggcagaggaacattacacctga

SEQ ID NO: 107937 - DNA, 2244 bp, Glycine max
  Peptide Sequence Number=SeqID_224715
atgtgcagggtgctaatgcttgcattagccctggtagtagtaatagtagctattgcacctcatcaaaccctttctgcaccactaaacagaacactgcctggatgcaaatccacttgtggaaatgtcgaaattccatatccatttggtataggcaactcatctacacccgatcaacgaccctgtttcttgaagcccgtatttaatcttgcttgcaataactccacgttaaaatggggtacggtcacagttttaaacataagcgtcccagctcatcaagtggacgtattgcaattggtttcatggttttgtaatagcgaagattactgggagacttggttgacaactggtatatccagaatttcaaggaaggaaaacaagttcataactgtaggttgcgacagttacggcaatctcaatagcgtttataatgacaaaacatatacaacagggtgcttaacaagatgttatggcaatgctttggtgattgatgatggaacatgctcaggtatagggtgttgccaggttgatattcctcctcgaatgactaatatcactataaaagcatttgccttcacaacctcaaggagaaatatcagcataaataatgcctctgtcatctccaattcaacctgcagttattcctttgttgtcaaaaatggcttttataatttttctaccactcatttaaaaagtttcccaaacaagacgctaccgttggttcttgattggaccgtgggaaacaaaagctgtgacgattccaaaagtagaggcgactacgcgtgcaaggagaatagctattgcgacgacaaggacagtgattatggttaccgatgcatgtgtcgggatggttatgaaggaaatccatatcttggctgcatagacattgacgaatgtaagacaggccatcatacatgcgtaagtgaaaaatattgtctcaacaccaatggatcgcacaaatgtttctgtccaaaggggcaatccggaaatggaacaaaggaagaagggtgccacaaaaaagatgtagttaccaaggttgtcataggagtcgcagcaggaactattattttagttgtggggactaccttactgtacttgatataccagaaaagaagactcaacaaactcagagagaaatactttcagcagaatggtggttccattttgctacagaatctctctacaagagaaaactcctcccaaattcaaattttcacagaagaacaactaaagaaggccaccaacaactttgacgagagcttaatcattggtaaaggaggttttggtacagtttacaaaggtcatctagcagataacagaattgttgctatcaagaagtccaaaatagttgataagagccaaaatgaacaatttgctaacgaggtgattgttctatcccaaatcaatcataggaatgttgtcaagctcttgggatgttgtttagagacagaagttccattactggtttatgaatttgttaatcatggcaccctatttgattttatacacaccgaaagaaacataaatgatgcaacttggaaaacccgtgtaagaatagcagcagaggcagctggagctctatcatatctgcattcagaagcctcaatacccattatccacagagatgtgaagactgctaacatcctcttggataacacttacactgccaaagtgtctgattttggagcttcaagattcgtccctcttgatcaaactgaaatagcaacaatggtgcaaggaacttttggttacctggatccagagtacatgcgtacaagccaactaactgagaaaagtgatgtctatagctttggggtagtgcttgtagagctgctaacagtggagaaaccatattcatttggcaagccagaagagaaaagaagtctcactaaccactttttatcttgcttgaaagagggtcgcctatctgatgttgttcaagttggcattatgaatgaagaaaataaaaaggagatcatggagttttctattcttgctgcaaagtgcttgagactcaatggggaggaacgacctagcatgaaggaagtggcaatggagttggaagggatgcggctaactgagaagcatccttggatcaatacatttcaaaatccagaggaggctcacttgcttcaaaagggatcatctagcgtctgtgaacctggtgatagcagcagccatcaatatactattgggtatgacagcattaatgatcatgtacaaattgcttttgatgatggaagatga

SEQ ID NO: 107938 - DNA, 507 bp, Glycine max
  Peptide Sequence Number=SeqID_224716
atggtttggtacgcaagaattaccagaagtgttagtgagggtttccaaagcttcactaatctgacggtaacagagatcggaacatggaactctctatgcggaaaccggaatatctcacttctcagatcagatctatccgacgtcgttgcagttataatggctccattcagcggcgatgagatgacaccgttttttggcttccttggagccgtagctgccctcgtcttctcctgtaattcaatccctaatttctcaattagatctatcctcggggtctcttcttggggtggtgccgccagcgaaattagcggcataggcgtgccgccactaacagaagcgaaagctgctcctgaacccgtcaacagaaatggcgagatactcctccacgtaggcagcaatgccgctagtggcgagacagatttgctagcaaccctgggggaaaaaataatgtatgaatattggatctttttgagaccaattatagatcccggggaggcaaattcctaa

SEQ ID NO: 107939 - DNA, 657 bp, Glycine max
  Peptide Sequence Number=SeqID_224717
atgtttatgatgaaggtgtgggatgagaatggattggtcatgatgtgctggcccaatcgagttgacatcatgacatgtgaaattggtattactttcattgctccttcgttcgtgatgttgttcgtgatgtttgtgatggtattgtattgcctatgcattgttggtaatctgaggccgttttttgtgaaaaaagtcatacgaattaacaatccgcaacgacaacaagtgtgtgttgttgaggatcctccgacagccacgaaggaattgaacgaagagcaacaacaaccacctgttgaaggtgttactgatattgagggttttccaggcgaaccccatgacacatcagttttgagatattttaaaaatcacattgctttgagagtctggaatggagaggaacgtcctaagctgaagctatcttcccatggaaggaagatgactaagttcgagaggcttgctctagagattgaaggccttgtggctgccagtagactaagtcttttgattgcattgaagcacatgaacacgagtaagcagaacatggcgtattcaaaatttgattttagactcatgagtagggtgttgaggacccacttacgggttcctgagaagaactatacgcaggaggagtggagcatcttagaggcatttgaataa

SEQ ID NO: 107940 - DNA, 183 bp, Glycine max
  Peptide Sequence Number=SeqID_224718
ttatcgtcagaggaagcttctgcgcagattccggcgccgatttcgaccggaactaaagtggcgccttcacctgcgctgaagtatgcggcactcgcgtcgttcagttgggaccaggatagtgacaaagttaagcgccgcaataaggcaatttgtgaaggtaggcctgctatggcagtgccatag

SEQ ID NO: 107941 - DNA, 654 bp, Glycine max
  Peptide Sequence Number=SeqID_224719
atggcgctttcctccgcattccacgaacggctccaccacatggaccgcacgcgaattcaacgtctctctcttctccaggcagagaaagagttgcaagggaacaagtaccgcgttttggcttcaatgctcgcaaacatcagagccacggaacagaggtgctcgtggctcgatcagaaaatcgcgtcgcagcatttcaagcttcttgctctcaagtctcaaatcgagaacctcgaagccaatcacgaatcgctttcactagaactgaggtcgatgcagaacgaggtggaggagcttgaggaattgcgcgtgaaaagagattgcttttacgatgcaaaatggatcgaaatgaaggagttcaaggaaatcgcggataggtttgtggtgaaatgtaaagtggaagttcagagtttgaggaatagagtcaacgagctgaggtcctcttttgtggaacttagaagcagcagtggtgactcttgcaatttggagatagctgctgctgaaatgagaaggttggaactcctggctgaaaaggagagtgtgtgtagaaacattgattataaccaacaagtaaaagcacagttgcaaaagcagcttcggagtattctgattacgcaaacgcaagataagggattggaggtgaagagtaatggctaa

SEQ ID NO: 107942 - DNA, 327 bp, Glycine max
  Peptide Sequence Number=SeqID_224720
atggggaagagaaaagagcgtcgccgcctcgccgctctcggcaacgccggtcgcagagtcaaactcgatcttttcgcggaaccctctggagagttgggtggctccactctacatggtgatgctggaggagatactgattctcaacatcgtgatgggtcacccaattcaccctcttcttcaggtcaacaaccacagaatcccctgctgttacttgggcaatatagtgatgatgaaggggatgccggatcaagcaaagggcttaatgatgcaaatgtgcaaagtcccatgcttaatgaagaggggcttatgatttgcaacaatttatga

SEQ ID NO: 107943 - DNA, 702 bp, Glycine max
  Peptide Sequence Number=SeqID_224721
atgaatcttgttccttttctttcaaataaccgtctaggcatgaaagcaagtggcatttctgcttcccaaccttacttatttctccttggacttttcgaaccaaaaggtttcctcttgaaaaaaggatggcaaaatgatgtcatggggttctgtaagggtttcaccattcctgttggcgaaacaccttatgttgtcattcccataagctatatagcactgtgcatgtcagtcaaaacattcacgtaccatgtgtgttttgccatcaccattggcgaaacacacttcactcatcccgtaccatcatcccgtgacaccatggccatgcatgcacatccagcatgggtttcaccaatggagttcgatttagatgggattgaaacatttcttcaaaatgaatttacatcatcaagggttatacttcaaacactgcaaccactgcttctgaaaaggctacgaaaatgggtggcgtgtgtttcgccaatagtgttggcaaaacacatgtggacagggagcattcgccaatgcatcttgcggaaccaatggtggatggtggatggcaagatgtcaagatgcatgcatgagacatgcatgccacgcatggagtgtgtttcaccagtggtgatggcaaaacacatatggcacaatgattttttttttgttgacatgaatagtgatgggacgctgatgggaatggcggtataa

SEQ ID NO: 107944 - DNA, 771 bp, Glycine max
  Peptide Sequence Number=SeqID_224722
atggtgtccgaaggcattctcctgggcattggtaaccctctcctcgacatctccgccgtcgtcgaccaagacttctttaaaaaatatgatatcacctcaaacaatgcgattcttgcggaggacaagcacacgcctatggcaaagcttggatactgttctataggtgcttttggtacaattctccatttagaatttggagtttcaactcggtttgaagaattggttgagaaatataatgtggagtacattgctggaggtgccactcagaattcaatcaaggttgctcaatggatgctccaagttcctggtgcaacaagttacatgggtggcataggaaaggataagtttggggaagagatgaagaagaactcaaggcttgctggtgtaaatgttcactattatgaagatgaaactacacctactggaacttgtgctgtttgtatagttggtgatgataggtctcttgtggcgaacttagcagctgcaaattgctacaaatctgatcatttgaagagaccagaaaattgggcactagttgaaaaggccaagtatatttatattgctgggtttttcctcactgtatcaccagattccatccagctagttgctgagcatgctgctgcaaataacaagatcttctcaatgaacctttctgccccttttatctgcgagtttttcagggatgtacaggagaaagctctaccgtatacggactttgttttcggatatgagactgaagcaagaacattttctaaagttcatggctgggag

SEQ ID NO: 107945 - DNA, 492 bp, Glycine max
  Peptide Sequence Number=SeqID_224723
atgaggaagcatcacgagccactagagctctttgttgcaagatcgagaggcctcagacttgtaggggcattcttgtcactcaaggaagaaggagagcaccattgttgtagttggaaaggagcaacaagatggccgcattcagatcattgggctttgacctattgttgtcatttggcttggaatttccttttctcttttgtttattgtagctgttgtgttgagtcattggtggtgatcagggatggtgattggggttccgatgttcaaagggtaaaattcgatggtaatcatgtgtttagatgtgcccatgtcacgaggcacactatttacaaaggtggttgttattattgttgcgagaattttgttgttgtaacctttagacatgacgatgaagtaggcatagcagagcttctccgacatgggggtgttagtaaagaaggtgaagagtatttttttctgttaggaagtgtagacatagtgatttatgattga

SEQ ID NO: 107946 - DNA, 132 bp, Glycine max
  Peptide Sequence Number=SeqID_224724
atgattctttcaagaggtgagaggttgaacgaaggtggtgcaaccgaggatggtggtcgctcatggcggattcaaggggtaagaaagaaggtggctggctctatgggagtgggaggttgtttcacgcgctag

SEQ ID NO: 107947 - DNA, 289 bp, Glycine max
  Peptide Sequence Number=SeqID_224725
atgggaagtagagtcatccattgtgctgcctacagttactgctgtgaatgggaacagtggtcatccatgcatgaagatgaaggggactctatccccaatgatgtgccaaagggtcacttggttgtgtatgtgggagagcaccataagagatatgtgatcaagattaccttactcaaccatccactcttcaagactttgctggatcaagctaaggatgagtatgatttcattgcagattcaaagctctatattccttgcactgagcatcttttcctcactgtcctacgcc

SEQ ID NO: 107948 - DNA, 177 bp, Glycine max
  Peptide Sequence Number=SeqID_224726
atgtctattgcgactttcttacgactttcttacttccatccaaatctcactttgaggaaaagactcaacggaagtaagggtagtgtctttctctgtaattctcaaggccggtgcttgatgattgacctttcaaagtttttaaagttcagaccccacaacttggggaggaaaagataa

SEQ ID NO: 107949 - DNA, 474 bp, Glycine max
  Peptide Sequence Number=SeqID_224727
atgaccgaagcgaagatgttaaccacaacttctaaaggatgttcttcctctcgccatgatcaccgccagcgaaatcttctctgtcgagatgtcaaaaaccgaagccctattatttttagatccaggtcacgacccgggttacaagctggatccgaattttcttgcactggaatatgggttttcttgccttgtcaatatggggcccctcctccggattcttgcaagaaaacaggctgtgccacacctgttttggtcccagctaaggttattcatgctctgaacctcaacattgatgaactaaatgtcgttggccaaccatgcttctcaagtttttttggcgtggactatgatgctttgctagcgaggaggaatgctcttctcttgctgcagaagttaagcatgtggcgagaggaggcagaaaactttgaagctcttcgcctgcctcaggaatggacgtacaaactccttcgataa

SEQ ID NO: 107950 - DNA, 240 bp, Glycine max
  Peptide Sequence Number=SeqID_224728
atgacggcgagaaagtggagggaaagcgaaagcggaggaagaagcatggtgtgcgtgggaatggagaatggaagatgccactgttcactgtgtgagtgttgccatggcctttatttagtatctctctttgctgtcaaagaccaagaaggaagaagatggagagaatggaagatgaaaagaacaaaagaggttctagggttcgtgagtgagaatgagagtaagagtgagagtaataagtaa

SEQ ID NO: 107951 - DNA, 259 bp, Glycine max
  Peptide Sequence Number=SeqID_224729
tggtcacgtctctcttgggagaatcgaaggcctcaggaataggtgggatatatggccaacaacagagaaatcgcgttggaaggggaaaagtgatgggaaaaaggccaatatcaataacccaaaaagcagtgttgaaagtgtaaactaccaccattccaagcttaaaggaaactacaacgatgtcgtaggaacttctcaagaagatggtgggaatagaaatttagatggcaagttcaaacatagggtagtccatgcatga

SEQ ID NO: 107952 - DNA, 315 bp, Glycine max
  Peptide Sequence Number=SeqID_224730
catcgtggagtaaagcttggagcagcagtccagcacgacgcgagtagctcaggagaaaatgagggctttcgacgagtgttctacgatggcgtggaccaacagtctaacacgacgcgagtcagacagagtcacgagaaagggctagcgatgatgaagaccaccacgatgccgatgcgactttgcaccagcacaacgccgttttgggttttcgtaaactcgcggactcgaagtagaatcccgagtctacctagactcgcccgagtctgcgctaaatcggacgagtctactccgtttttgattctgcttccgatttaa

SEQ ID NO: 107953 - DNA, 423 bp, Glycine max
  Peptide Sequence Number=SeqID_224731
atgcaatatatgaaaccggcgtttcgaaacgcggctttctactgccacgccttttctcgctccttaaccttaaactctaaccctctccacctcgtctccccatttggaagaccccaaacgtttcgcctcgcaccacccatttcgtgcttctcctccttaatggcgtcttcgctggagaagcaattcgacgactttagggttcagttcgaagaatctggaaccttgcgcgaacgaattcgaagcgtcgtttcggagatcgagtcctccactagactcatctatgtcacccttcttctcgttcaccagtctcgccccactcccgagcttttagagaaggccaagtctcaggttaatgtgttaaagaagcagtataagcaacttgctgaagttgttggaggataccctgggcaatactatagatga

SEQ ID NO: 107954 - DNA, 291 bp, Glycine max
  Peptide Sequence Number=SeqID_224732
atggctgaagtacatggaagagttgctccttctagtggctattcttctcctgatcatcttggaacaatggatactattcccatatcccttgatactagaaatgaaggcttctatggtggtaagtcaaaatatttgcaagaagaacttggcaaaacaatgcatattattccattatcacttggtgctagggatgaaggctattatgtctatggtggcaagtcaaaatatttgcaaaaggaacatagtagaacaatgcatattgttcccttatcacttagtgctaggaactaa

SEQ ID NO: 107955 - DNA, 843 bp, Glycine max
  Peptide Sequence Number=SeqID_224733
atgaagtgttttccattctcgtatggagagaaaaaagatgaaccgaaaggcttgcagttgcagtcaacatcgggtcgatctgacaattccatgtgtgttgaggctgaggttagaagatccggttctgagttaaattctcaggatgtttcggacaatggcagctcagaatcccagaggaggaatgcaattcccagtttgtcccagagacccagcaacctcagagtgtttactgtatctgaactgaaatcagccaccaagaatttcagtcgctctgttatgatcggagagggtgggtttgggtgtgtctacctgggattgataagaagcgcagaggactcctccagaagaattgaagttgcagttaaacaacttagtaaaagaggaatgcagggccatagggaatgggtgacagaagtgaatgttctgggcattgttgagcatcccaatcttgtgaaactagtgggttactgtgctgatgatgatgaaagaggaatccagaggcttctaatttatgaatacatgccaaacagaagtgtggaacaccatttatctcaccgatcagagactcctctcccatggactaggagattaaaaatagctcgagatgcagctcgtgggttaacatacctgcatgaggaaatggatttccagataattttcagagatttcaaatcttcaaatatcctattggatgaacagtggaatgcaaagctatcagactttgggttagcaaggttgggaccatcagatggactgactcatgtctcaacggcggttgtaggaacaatgggatatgccgctcctgaatatgttcaaaccggacgtctaacttcaaagaatgat

SEQ ID NO: 107956 - DNA, 1245 bp, Glycine max
  Peptide Sequence Number=SeqID_224734
atggcaacatttatccgaagaatagcaatcagctatattctcgtgacattgtttttctcttcagatattggattttttggacgtgttgcatcatttggaatcaactatggccaagtagctaacaatttgccccctccagacaaagtccttgaactcttcagcaacttaaaggtcacaaaaacaagaatttatgacaccaaccctcagattttgacagcttttgctaaatcaaacgttgaggtcattgttacggttgaaaacaacatgctaagccagttaaatgatccacaacaagcccttcaatgggtgagtggccatatcaaaccatacctcccagacacaaagatcacaggaattcaagtagggaatgagttatacacaaatggtgacaaaactctaattcagtatcttgttccagcagtggtgaacatccacaatgctctagttcagctaggcctagactccaacatccacgtttcgacgccgagttccttagaagtgcttcaggaatcataccctccttcagctggtagtttcaagagtgagatctcagggatcatgtcccagtttttgaacttcttggccaccactaaggcacccttttggatcaatgcatacccttactttgcatacaaggatgaccctaataggattccattggactatgttttattcaatcctaatgaaggaatggttgacccttacaccaacctacactatgataacatgctctatgctcaggtggatgcagtctcatttgccattgctaaattgggttttagtgggattgaggttagggtatctgagactggttggccatcccaaggagaccctaatgagattggtgcgtcagtgcagaatgctcaaacttataacaggaatttgctgagaaggcaaatggctaatgaagggacaccttttagtcctagaatgaggttggaagcatacatttttgcattgttcaatgaggacatgaagagtggagcaacctcggaaaggaactatggtctctttcaacctgatgaaactatggcttacaatgtagggttggctgcttttgcagactcatccacttcatccacttcaatttctcttacctcctctgccactaaaataaagggaagcttcacagtcctgaaggatggagcgatatgggtattctccctcttgaaggggatattttttgcaggattcaagctagagacctccttgtggagtattcctgtacatattttcaagccttaa

SEQ ID NO: 107957 - DNA, 369 bp, Glycine max
  Peptide Sequence Number=SeqID_224735
atgacagcattttatctacaatttggtggttgtgatgtttataatccaaaggactcaaaggtgattaccttgaatcatcccgtgactgcctccaaaagaggaaaaatagatgttctgaaaagtgctagagaagcagtgcaatttggcctcacaggaagtgctttgggagcattatttactgcaggctatgcctggaaatattcaaagagtttacatggcgctggactgtcatttttagctggaggtatatttgggtggacttttgggcatgaaatcgcaaatcacacacttcaactttacagggtagacacattggctgctgaggccaagtttctggactggtggaataagaagactggagggtattaa

SEQ ID NO: 107958 - DNA, 162 bp, Glycine max
  Peptide Sequence Number=SeqID_224736
atggtggtcctcccattgttgaaggatttgtcaagctttgctcctagtgatgtgaaaacaaacattcggagtcttggtcaaataagagattgtgaagaggatctggtgaatgtttcaaaagaggaagttgaatctttgctattcatgtcccaaccatcttga

SEQ ID NO: 107959 - DNA, 372 bp, Glycine max
  Peptide Sequence Number=SeqID_224737
atgcttcatcagcataatgtctttgctcagtcatttagaatggacaatgagagagacactaatggaaggatatataacttgcccacagtttctaaggttgatgctctaattgttggtgatgaagacatttcattgaatatgggcataatacttgaaacacaaagtgagaatgctgatgattctgaaatgcaatgcaaagatgaagtaaagcaatatttggattgcagatgttggcaagtgaggaaacaagattacactattgggagattgaattgggtacctcccaccattggtggcctcttttatttgaggatgatactctttgttgcaaagggaccatgtagctttaaggatattagaattgtttcttga

SEQ ID NO: 107960 - DNA, 438 bp, Glycine max
  Peptide Sequence Number=SeqID_224738
atgcatactacatgcacaaataataataataatgaaatcatcatttgcctcaacctcgaacaagaaaacaaagagtttgatgtgttcttgaagaatcttgccactcaagattcttcccctcaacctcctaaggttattgctcctacaatggatgaaattcttgtcgttcttgctcctaccgatgaggttcttgttgctcctgcttttgcccctcagagggttcttgatccttttcctgtttctgctcctgcacctaagagggtttatacttatgtcaattttgttcctattccacctacttgcactgctcaagttcctgcccctcagagggttcttgcctctcaggttcctaccaagtcatcggaggagacattcaacaacattgcatttgagcagatctatgtgctgagcagctacccacacaacttgctgccgtag

SEQ ID NO: 107961 - DNA, 471 bp, Glycine max
  Peptide Sequence Number=SeqID_224739
atggcagggaaggggtcctatggggctgtttacaaagcaagggatctgagaacctcggagatggttgccatcaaagtaatatcgttatccgaaggggaggagggttatgaggaaatccgtggtgagattgaaatgttacaacaatgtaatcatccaaatgttgtccgttatcttgcaagctatcagggagaagagtatctttggatagtgatggagtattgcggtggtggtagtgttgctgatttgatgagcgtgactgacgagccacttgatgagggtcaaatagcatatatctgtagagaagcactgaagggtcttgattatttgcactcaatttttaaagtccatagagacattaaaggtgggaatatcttattaactgaacaaggagatgtcaagctaggggatttcggtgttgctgcacagcttacaaggactatgtcaaaacgcaatacggtatttgatgcttaa

SEQ ID NO: 107962 - DNA, 324 bp, Glycine max
  Peptide Sequence Number=SeqID_224740
atggtgggtggaggtcattggaggatggaagaacagatggggagtagtacgaataatgggtgggaatggaagcttacttggaggaggtctctttttgatgctgaagtagaaatggcggataatttcttaggagaaatttcacaacagcaagtggactcaagcagggaagacacctggatttggaaacctgaaacgtgtggttattactcaacaaaaagtgggtataacttgatatggggtgaaacaatgggagcaagtctgaattctgactttcaggatttatggaaactcaaaattccagcaaaggctgcagtgtttgcttga

SEQ ID NO: 107963 - DNA, 582 bp, Glycine max
  Peptide Sequence Number=SeqID_224741
atggctttatatgagcattcagatgtttttcagtggggtctcaatcttcttgacggtgaccctgcttatagtcctggatacaatagcaacataattcaaaaggatgataatgaatgtaacaatgaagagactgatgggatgattacccgtaaacttcaagaagagttttcacagctagagattgccgaatattcaggatatttacagggaggtgaacaacagttccatgttcctgatactcagcctgcatatgattggaatagctcttcaatggtgaactattgttcagaaggttatgattatgcccaagaaggaattggtaatggagaaccctctagttcatgttctcgtccttgtgaaacagaggaatattcgttagagctaactgacaattacccacttgatgatgaagtaggaaggagattgagtcaaatgataccaattcatattttcgtatcttcgacatgcctaactaaactgggcaaaattttaaacagattgcagttatacgacttcgtggagcacaaagtacaaggtgatgggaattgtcaggcaggagggtggctagcacaaggccaataa

SEQ ID NO: 107964 - DNA, 162 bp, Glycine max
  Peptide Sequence Number=SeqID_224742
atgcctgatcttccattccaagttggggatttggctgagtcaagatgctttgaaaaggtggttatcgtggtgcatggtttagatgcaagtgatagcaagaggtatggtggggaaagcaatacttattctttctttttaacacaacagattctgattctttag

SEQ ID NO: 107965 - DNA, 405 bp, Glycine max
  Peptide Sequence Number=SeqID_224743
atgcagctgaaggatgttgtagcaaaactatttgaactttggaatttgatggactcttcaaaagaagagagaaactgttttatgaagattacttctattgttgaaacctcagaatcagaaatcactgaacgaagtgttatttcaacagaaatgatagagaaggcttcagcagaagtggacaggcttgccaaactaaaagcaagcagaatgaaagaacttgtttttaagaaaaggtcagagttagaggaaatatgtagattgactcatattgaaccagatccaagtactgtggccgagaaagctagtgcattaatagattctggtatgttcttgtgcattaatagattattgacctataacctcctcgtagcttatgtttcagaacgactttcttctgctacataa

SEQ ID NO: 107966 - DNA, 321 bp, Glycine max
  Peptide Sequence Number=SeqID_224744
atgaacaaatcatcacaagcagactcttcattaagaaaaagaaacaccccatatcttcattttgcacccaacaaattcctcaaaacccagaattctgaaacaccaaagaaagagaaagacctcaagttctatgagcaaagcagtgcaagtagagcttctgcggatactagtgccatgtcccccaatggccagcattgttaccaaaaatatgagaccctctttcagagagggaaagagaaaagagaaaagcaaagaacaaagaaggaggataatgcttttttagggtatggtggtttgatgctaaaatgcgccaaaatgtag

SEQ ID NO: 107967 - DNA, 264 bp, Glycine max
  Peptide Sequence Number=SeqID_224745
atgttttcttcgtctccaccgtttccttcttcttcttcgccttcagttacgatgcttcatgaacaagctgctcctgcagttgcatcctggtcttctagttctgcagctcagcattttcctacctcagttcttttacaagagcagcgtgatgagtataagcccttactgcacgtgcataataaggaggttcaatttttgtttatatatcagctccttcattgttgggcttgtttaaatgccaataataagggtctatttggataa

SEQ ID NO: 107968 - DNA, 384 bp, Glycine max
  Peptide Sequence Number=SeqID_224746
atgacagatgtcgtaccggatgtcacgacatcacgcttcagaacatgcagattatatttgactccactgtttacaaccttctcacctaaccactacccgtgcaatctctacctaagagccactcttagatatgagaacccctctcactccctctcaaacactctcccgtgtttacaaataaatcaaagacacaccagagattgctctctgaacaaaagagatcaactctacacactagagatcaactctacacactcaggtccaacacttgatgttagagtaacatcaaggtggctcacaaaacactcaagtcccaaaactcacaaaataactcttcaatcccggacttggtacagaactcgtgcagccttcatgtttatatag

SEQ ID NO: 107969 - DNA, 558 bp, Glycine max
  Peptide Sequence Number=SeqID_224747
atgtcagacctaaccctcgcatgcactgacaccccattaaagtgtggtgttgcacactattcactcacatgtacacgttttatttcagcacaactattcgacaatgatgatctcagaggcgcaatggaaacaattgtccagaatccacaattgaattctactgaattctatgttgttactgatcttattcctcaaccacaaccatcatctccacaaccctcatgtccaccattacaactaccacctccacaacagttatcgtacaacaacatagacctcaataatccagtatcttcatacaacaaccttgaatcacaagacccctttgacatgtatacttcatacacacaattattatcagaaaatgattatttttttcatgcccaacaaacctcctttgaccaacaaaaccatctttcatccctctttacgtcaccttcacaactaccacaaacacaaacatcaaaccaagatgaacatcccattgctaacgaagatcccattatacgatttcataatgaaaacatggatgattctagtgaggatgaggatcaatag

SEQ ID NO: 107970 - DNA, 2499 bp, Glycine max
  Peptide Sequence Number=SeqID_224748
atggccagtcaacctgaatcatctgacgcaaagggcacaaaaagggattttagcaccgccatattagagcgtaagaaggctccgaatcggctcgtggttgatgaagctgtcaacgacgacaactctgttgtcgcgcttcatcctgataccatggagaaacttcaactttttcgtggtgacaccatcttgatcaagtgtttgttagctaacatagtgttccctttacttctaaggatgatggttattagggtttgggcacaagagaaagggaaaaaaagaaaggatacaatatgtatcgcacttgctgatgagacatgcgaggaaccaaaaataagaatgaacaaggttgtaagaaacaaccttagggttaggcttggagatgttgtttcagtgcatcagtgtcctgatgtcaaatatggaaagcgagtccacattcttcctgtggatgatactattgaaggagtaacaggaaacctctttgatgcctacttaaaaccttatttcctagaggcatatcgaccagtgaggaagggtgacctcttccttgtgagaggggggatgagaagtgttgaattcaaggttattgaaactgacccttctgagtactgtgttgtcgctccagacacagagatcttctgtgaaggagagcctgttaaaagggaagatgagaatagattagacgaggttggatatgatgatgttggtggtgtaagaaagcaaatggcacagattcgggaattagtggaactgccactgaggcacccacagttattcaagtctattggtgttaagccaccaaaaggaattctgttgtatggacccccagggtctggtaagactttaattgctcgggcagttgcaaatgaaactggtgccttctttttctgcatcaatggacctgagatcatgtcaaagctggctggtgaaagtgaaagcaatctgaggaaggcatttgaggaagcagagaaaaatgcgccatccatcatcttcatcgatgagatagattcgatagctccaaagagggagaagactcatggtgaagtggagcggaggattgtttcccagctcttgaccctcatggatggtcttaaatcacgtgctcatgtaattgttattggagctactaatcgccccaacagcattgaccctgctcttaggaggtttggaagatttgaccgggagatagatattggagttcctgatgaagttgggcgtcttgaggttcttcggattcatacaaagaacatgaaacttgctgaagatgttgatttggaaaaaatagccaaggatactcatggttatgttggtgctgatctagctgctttgtgtactgaagctgcacttcaatgcatcagagagaaaatggatgtgattgacttggaagatgagacaattgatgctgaaatattgaactccatggcagtgacaaatgagcatttccagactgctcttggatcaagcaatccttctgctctacgtgaaacggttgttgaagtgcccaatgtcagctgggaagatattggtggtcttgaaaatgttaagagggaactccaagagactgttcaatatccagtggaacaccctgaaaaatttgagaagtttggaatgtcaccttcgaagggagtcctcttttatggacctcctggttgtggtaaaacgcttttggcaaaagctattgccaatgaatgtcaagcaaacttcattagtgtcaaaggtcctgagctactaacaatgtggtttggagaaagtgaggctaatgtgagggaaatttttgacaaggctcgtggttctgctccatgtgtcctattctttgatgaacttgactctattgcaactcagaggggtagtagtgtcggagatgctggtggtgctgctgacagggttttgaaccaactgcttacagaaatggacggaatgtcggcaaagaaaactgtgttcatcattggggccactaatcgaccagatattattgacccagctcttctgcgtcctggtcgtctcgaccagttgatttatatccccctcccagatgaggattcccgtcatcagatatttaaagcctgcttgaggaaatcccccgtgtcgaaagatgttgatcttagagcacttgcaaagtacactcagggtttcagtggtgctgatatcacggagatttgccagcgtgcgtgcaagtatgccattagagagaacattgagaaggacattgagagagaaaggaggaaaagagataaccctgaagcaatggaagaggatgatgttgaagatgaaatagcagaaatcaaggctgctcattttgaggaatcaatgaaatatgctcgaaggagtgttagcgatgctgacattcgcaagtaccaggcattcgcccaaacattacagcagtctagaggatttggaagtgagttcaggtttgcagattccacctccgccggtggtacagctgctgcatctgacccattttcctctgctggtggagctgacgaggatgatctttacaattag

SEQ ID NO: 107971 - DNA, 1350 bp, Glycine max
  Peptide Sequence Number=SeqID_224749
atgaatagaaggggtaacgaggccattatatgtaacattaacagttcatctgcatcatcgcagagttatcaacttgataacaatatcaaggatctatttctcactttccattgctattgtagacgcaaagagatacaatgccttgatgtcctacttgaagacactgatgttgtgaaagcaataacagagtatgtctcttatgcagctattgagaacttggtggttggtgcaacatcgaggcatgggtttattcgatttaagtcaagtgcatcaagtagcatatcaaagggggcaccggacttttgtaacgtgtctgtcatttcaaagggcaaagtctcttcagttcggaaggctactcgcccaacctcacatacatcaccacttctgagccatatacatgatctaaataaccggggcaaaaatcaacatgagatatcctccagacctatgaatttgggagacaggacatcaatcaaacctcacggctggctggatgaatctattaagtctccatttgtaagaggaagaggcatggatggaatgtcatgcatggacttcccagaatcagatacagacatatcatttgtaagctccgagaggccaagcagtggacgttcatcctccgtttatgactacattgacgtaggccgaacttctcgagtttctaccaattcagatcgtagcttcggatcaacccgattgggggctctcaagttcaacaaccccaattcaccagatacgtcattctcacatgaaagcagtgcaacatcattttcatattcattacagagcgaggatgaagcagcagaagctgatatgaggaggctgaagctccagttaaagcaaacgatcaaaatgtacagtacagcatgcagacaagcacttgcatcacaacagaagttaatggagttgacccacttgagacttgaggaagaaaaaaaaatacaagaggcacgattggctcaggaagctgcaatggcaattgcagagaaagagaaagcaagatgtagagtagccatggaaactgctgaagcatctaagaaaattgcagaggtggaaacacatagaagagcgggtgttgaagttaaagctcttaaagaagtagaagaaaagaggaagctattggacaatctagccctaactgatgtaagatataggagatattgtgtagaggagattgaagcagccacaaactacttttctgagctccagagaattggggaaggaggttatggccctgtttataaatgttatcttgatcacactccagttgctgtcaaggttctacgtccagatgctgctcaagggaagtcacagtttcagcaagaggtgatcaaccagtgggcatga

SEQ ID NO: 107972 - DNA, 405 bp, Glycine max
  Peptide Sequence Number=SeqID_224750
atgggtctagctttaaccgtcggattcctcggccttctcattctatttcacgccgcttattcaactattcagtgtatcctaaaactgattatcaaactagttttgctttttgagtgttggggatcttggatctcaaatttgggtctgatttttgttgcagacaggggcgtgttgaagattactgaagaagagttttcagggcttccattcgaggtggtgattgagctgtttcttggattgctgctctgtttttggactgcgctcactgccccggggaagtttctatccatacaccctcactctgaggagaacagaggtggtgaatggtattctaggggaattaattttggaattatcagttttggaagattgagctttattacgttaggaaatatagctgactaa

SEQ ID NO: 107973 - DNA, 501 bp, Glycine max
  Peptide Sequence Number=SeqID_224751
atgcaacgggcaactgccgctgttgttggggatgctcgtcacgtggatgacgcagctgaagaggtcttccaacatgctaaagaagctggtgttgatgcccaggattttccaggcgggccgcatgacacattagtcatggctgcctatgctgatcatgttgtagtcattgttttgaatggagaggaacgacctgaattgaagctatcctcccatggaaggaaggttcagaaattcgagagtcatttgatcgcatgttcattggacactggcgatcagggacttatatcgacttttgtggaaagatggcataaggaaacgagcaatttccatcttctagtaggagaggtcaccatcaccctcgatgatgtgacctctttgcttcacctgtccatcataagcgcattccacgacttcgacacttttcatgtagacgaagcggtgttgatgttaatggagttacttgaagtcactggagataaagctagagctgagacaatatag

SEQ ID NO: 107974 - DNA, 807 bp, Glycine max
  Peptide Sequence Number=SeqID_224752
atggtgcttcttctaggagcatgtccggagtatggcatattgatttatgaatatatggctaatggaagcttagaagattgtctgtttaaaaaaaagaacaagcgtgttctgtcttggcagttgaggttccgaattgctgcagagatagggacgggcttactattcctgcatcaggccaagcctgaacctttagtgcaccgtgatctgaaaccagggaacattttgctagaccagaattatgtgagtaagataagtgatgttggattggcaaggcttgtcccggctgtagctgaaaatgtaacacaatgctgcatgacatcagcagctggaacattttgttatattgatcccgagtatcagcaaacaggaatgcttggtgtgaagtcggatgtttattctttggggatcatatttctacaattattgacaggaagggctccaattggattggctcaccatgctgaagagtctatagagaaggataccttcgtggaaatgctggacccatctgttactgactggcctcttgaacaagccttgtgccttgcaaaaatagcagtcaagtgtgcggaactcaggcgaaaagataggccagaccttgccaaactagtattgccagagctagataaattgagagactttgctgaacaaaacatgaccatgaccatgcccatcattttaggatgcactgcgccttcacccagccacagtgaagcttccatgcaacaggatgtgatcagtgacctgcagcttgcacattccgaaagctcatcagctccatcaacgcccacagaaggaaaaccttaa

SEQ ID NO: 107975 - DNA, 441 bp, Glycine max
  Peptide Sequence Number=SeqID_224753
atgagagaagaatggtccatagaatacgcttttcaagtaaaggcagaaaactcaagaggaggtaaatataggaacaactacaagaacaaggaggactcctctccagcttgctctcattgcaaaaagacaaatcattctcaacaaaagtgtcggtggaggcctgatgttaagtgtaaaaaatgtggcaaccttcagcacatggagttggtttgcaagtcaccaccaaatgaagtaaaaattgttaccaagcaatatgaggaggaccttttggttatcgcatgtcttacaacaagcaacacctcaactaatttttggttgattgatagtggttgtacgaatcataggatcaatgatcaagagcttttcaaaaaactagatagaacattcatttccaaagtaaaatttggaaatggtgaatttattctggttaatggaaaatga

SEQ ID NO: 107976 - DNA, 324 bp, Glycine max
  Peptide Sequence Number=SeqID_224754
atgcttgggtcttgtgttaagaagttgcaaaagagtgtctcactactctttgttcactccaacgaagatcaactggaagctgcagcaacattggtgccagaagatgttatggagggacattttgctgttcttgccatcaagggtgaagaaacaagaaggtttgttgttaagttggactacttggctgatcctatgttcatggaactactgaaccaggctcgagaggagtatggtttcaagcaaaagggagcacttgcagtcccttgcaggcctcaagaattacaaaacgttcttgatggtccaagagccaaagctgaaaggtaa

SEQ ID NO: 107977 - DNA, 234 bp, Glycine max
  Peptide Sequence Number=SeqID_224755
atggattacgcacatcctaaggggacatccgcggccatacaacaaatcaaggttttcttgacggtgttcgtacatcctgcttatgtcggcgcaaagatttttccaccaaattctcaaattagaggcatgcaaaagtggctcaagctatgtagatgggaggataaccattatgcatttatgaaaggccgaatatatgggcagcaatcaaagttaaaagctactgcgacggggtga

SEQ ID NO: 107978 - DNA, 234 bp, Glycine max
  Peptide Sequence Number=SeqID_224756
atggcagctcgcccaagcgagctaaggcttagtcctaaagtcatcagctcgcccaggcaagctggttccttcaccctgaagtcatttagtggccgcgagccaaaggctagcctgggcaagctagggtccaggaaacttaaagaaaaaacccttttgcccccactttttggtatctttcgcattcttgatcaaaacattgaacgatttttcatcttgtgcggtaactggggttga

SEQ ID NO: 107979 - DNA, 174 bp, Glycine max
  Peptide Sequence Number=SeqID_224757
atggccttggcatcgaccaaaaatagccttgaccattgtcgactgaaaaacatcatcaacaaattggggacaagaagaaatgatgtctccaacttgcctagagacttcaaagtctttcatgagatactaagttcccattctctctctcactctctacacttagcatcagattaa

SEQ ID NO: 107980 - DNA, 1050 bp, Glycine max
  Peptide Sequence Number=SeqID_224758
atggcccgcaccaagaaaactgggcaaatgacgtctaaggcaacaaagaaaattgttgagaagattgattcgttggaggagcaggcctcgcagggttcctttgtcacccatggacgtcaagatgtactaactattgccattgggcgaccagaacaccctggtcgtgtgcgtgctactagagccgatgtcacgatcaagcaatactttggaccagctccaaggacctcccgcacgtcttcctacatggctcccgaagacctggagcagctgacgcaacaaatcagggaccagttggaggagtcgatcatagaaaaaggactcgcactgcctcctgagcctaaggttggtccttcagttgtttgtgtcagcacaaaggagagttgtgttgatcccttagggaacgatccagacacgggtgactcaaacaaatgcgggttgtacgtcgaagaaaatccttcccgcctggttgccctaggaagactttatgagggatccataaccgttcacaacattcctttgctgcatgatcaagtcaaggttagtgtcgaggaggttagagatgcaaatgctcctattcctgtacctactgaagaggttaagttaatgtggcaagcacttaacaccttccttgcttggccgacacatcttgtcaagcgtttatcagaacaggttatgtgggatgctatcgtgtttggggtgtttaatgagaactttcccttgtacataaagcatgaagatctgtctgaaatagcacacggtggtcaatgtctcagcatctctgttatacagttgtggattttgtatatgaccgagacaagtatgcgagcggggaatgtcgatgtgtatggattcaaaaaaaccacagtccatccagaaatttgggcaatcgcattaaaatcaaaaagttacattaagaactggatgcagaattctaaacgggatgtgtacctaggagcctacttgaatggtataataacctatattggtctccaatgcaatgcacattggcaaatggttgtcattttgcctaaggaaaatgttgtcatctga

SEQ ID NO: 107981 - DNA, 216 bp, Glycine max
  Peptide Sequence Number=SeqID_224759
ctggaagaaatcaattcaagaaaccactacaggcaatcatgggaagctggtgatcaaagtatgccatatggtggtggtggtccagagaattctcactctcattctcactctcagggcttcttccaaccattggaatgcaaccctacactacatattgggtacaatgctgtagcttcagatcagataactgccacaactcaacctcaacaaccatag

SEQ ID NO: 107982 - DNA, 240 bp, Glycine max
  Peptide Sequence Number=SeqID_224760
atggggaggggaagagtggagttgaagaggatagagaacaagataaacaggcaagtcacttttgcaaagaggagaaatgggcttctcaagaaagcctatgagctatctgttctctgtgatgctgaggttgccctcatcatcttctccaaccgaggcaagctttatgagttctgtagcagctctagggatggtagatttatcagatctagtaatatggcacatgatctggtgaatatctaa

SEQ ID NO: 107983 - DNA, 840 bp, Glycine max
  Peptide Sequence Number=SeqID_224761
atggtagctatgaagggttcacttgcaacgcagaaagagtggaggaaaggcccttggattggtgaagaggataagttgctatgtgagtatgttagcttgcatggagaaggtaggtggagttcggtggcaaagcttacaggattaaacaggagcggcaaaagctgcaggttaagatgggtaaattatttgagacccggcctcaagaaagctcaattaacacctcgggaagaagagatgattattgaactgcatgcaatcttgggtaacaagtggtctacaatcgcaaagtacttgccaggtagaactgataacgaaattaagaactactggagaacccactctgggaagagggagagatccaaacacaacaagaagctacaaaggccaaaagtgaaaaacgtgcttaaacaattgaaacaaaaacaacaacatgagcaacaacctcaagaatatgatatcaaaagcagcatgtctcatgaagagaccgaaaacgaaacaaaatccttccacacacaaaataataatcagcaagaaatcttagaaatgggcttcatgtatccaacaacaatagagcaccaatataccgttccttccatgcatgacggattctcgtccacgtggcaagacactctagcggatgatggctcatggtttagtttatgggactttgatgaaccacaaggtttttctgattatgttgaccagtttggcaaatgtgccatgccaaatcaaacttcctttggagctggaggggattattccatgcaaaatcatgttaaaacttcttgttttgttgatacatatgatagcctcttctatggaaaagacatgtttgtatga

SEQ ID NO: 107984 - DNA, 777 bp, Glycine max
  Peptide Sequence Number=SeqID_224762
atggaagctatgatgggttccctagcaaccgagaaagagtggaggaaaggcccttggactggtgaagaggacaagttgctaagtgaatatgtttgcttcaatggggagggtagatggagctcggtggcccagtgtacaggattaaaaagaaatggcaaaagctgcaggttaagatgggtaaattatttgaggcccggcctcaagagaggtcaactaacacctatagaagtaggaatcattattgaactacatgcaatttttggtaacaagtggtctacaattgcaaagtacttgccaggaagaactgataacgatattaagaactattggagaactcacttcgagaagagtgggaaatccaaacacaagaagctagaaatgcaaaaggcaaaggtgctaaaacagttgaaacaaaagcaacaacctcaagagtatgatgtcaaaagcatcaagtcccatgaagagacaaaaaatgaaacaaaatcctatgagacagaaaataataagcaaaaagaagtggatttcatgtgtccaacaatggagcaccaatacattgttccatcaatgcatgagggattctcatccacgtggccagacacagtactaggggatgatggctcatggtttagtttatgggactttgatgatgaaccacaatgttctgcagattatgttaaccaatttagcgaaagtgtcgtgccaaatcaagctacctttggagttggagaggattccatgcaaaatcacgataaaatcttttatttcgatgatatataa

SEQ ID NO: 107985 - DNA, 225 bp, Glycine max
  Peptide Sequence Number=SeqID_224763
atgaaatatatgcaatttcagttgagcttagctcatcagtgggctaagcacccatccaccgctaagcgcaacttcagcgtgcttagcgtgacagaaaaatctggtagagcatcaacatcaaggtcgtgcgctaagcacaagatcagtgcgctaagcgcagccgttgtctttagccaggctcaacgcacgactggcgctaagctcaaatccacttactcgttctaa

SEQ ID NO: 107986 - DNA, 240 bp, Glycine max
  Peptide Sequence Number=SeqID_224764
atggagaaggaaatgataacaatgatagtggacacattaccagtgttctactatgagaagatggtgggttacatgccttcatgctttgtaggtttagtgtttgcgggtgacaggatcgaagtaggcctaaaaagtggcaaatttgattacgctgcttcgatgaattctggtgatagaaggcctagggcaaatggagggaataagaaggagggagaaacccatgttctggttgtctattag

SEQ ID NO: 107987 - DNA, 390 bp, Glycine max
  Peptide Sequence Number=SeqID_224765
atggtggaaagggaaaaatttgatcatatagaggaaacgctatgggccattgaaggaggtggaaattatgcctttgctgacatggtggagttgtgcctagtgcccgatgtcattatccctccgaagttcaaggtgccgaatttcaataagtacaaggggactacttgtcccgagaatcacttgaagatgtacaacaagaaaatgggggcatactcaaaaaatgaaaaattgttgatgcatttcttccaagaaagtcttactgtggcagccgtcacctggtatactaatctggaaccttcttgggtccattcctggaaggacctaatggttgcattcattaggcagtatcagtataattttgatatggctctggatagaatgcagctatag

SEQ ID NO: 107988 - DNA, 236 bp, Glycine max
  Peptide Sequence Number=SeqID_224766
atgactggcgagtggattagtcctcacatttggattgtcctcttgaaacgtcagctatcctgcatcaatcaagctctataccttatgcttgacggccacacattgctctataaaattccccggaacaccactctgataggcgcaagttgcattgggattgtaccatcgggggaaaggggattgatagatcttccgggggttcaccataaccatctagttgttgatcaaagatggca

SEQ ID NO: 107989 - DNA, 126 bp, Glycine max
  Peptide Sequence Number=SeqID_224767
atggagctatggaaaaagaaagtgaggtgggtggcgttgcaagcttggcaaatttcgaagggagtttcagccaaggaaaacaaagctataagtgatatcttgttagacatggcacacatgttataa

SEQ ID NO: 107990 - DNA, 333 bp, Glycine max
  Peptide Sequence Number=SeqID_224768
atggaagggagagagagtcgtcacccattgcttagaggaggtaggaaaagagaggagaaaagttacaagcatgtcttatccaccactcagatgcatgtcatggctgccatatgtgatgccctcattccttcactcccactcaacaaggacacctcacaagaccaagctctctctgacttctacaatacctctgcttctcagcaaccttttcctgatgaggctgctagaagtggtgtcgttggtgagttgggttctgtggatgttgtctttcagattggggacgctgttgatctgtggaagactttgcttggactggaagcggcctttcgttga

SEQ ID NO: 107991 - DNA, 513 bp, Glycine max
  Peptide Sequence Number=SeqID_224769
atgaggccccttctgcaaagattagtgaaccctctacagagtagtagttttatacctagaagagggacctctgacaatgctattgttttgaaggaaatcatccatagcatgtccaaatcgaaaaagaagaaaggcgatgttgtgtttaagctggatttagagaaggggtccctgctggaagtcgtggatgagggtctgtgtgggagccgtacgttccatatcaacaacaatggacggtggatatctcatctcttctttgtcgatgacgtgcttctttttgcaaaagctaatccctcccaggttcggttatcgctggtgcaggatgtttgggatgatggtcattgggatattagttctctattcactaatatcccacatgacacagtggagaagctgaatcggttacgtatttggttgcatagtaattcctccgatattattgtgtggaaagggagtatttcagagacaacctgttacggcttcttaaatttagcatcttcaattcaagattga

SEQ ID NO: 107992 - DNA, 1392 bp, Glycine max
  Peptide Sequence Number=SeqID_224770
atggatcatgttattggtgggaagtttaaactgggaaggaaaattgggagtgggtcttttggggagctttatatagctgttaatatacaaaccggagaggaggtggctgtcaagctggaacctgtgaagaccaagcatccccagcttcactatgagtcaaaattgtatatgcttcttcaaggaggaacggggattccccatctcaagtggtttggagtagagggagactacaatgtcatggcaatcgatcttcttggaccaagtctggaagatttgttcaattattgcaaccggaagttaacattgaagacagtgttaatgcttgctgatcaattaattaacagagttgaatatatgcattctagaggtttccttcaccgtgacatcaagccagacaattttttaatgggcctaggacgtaaagcaaaccaggtgtacatcattgactatggccttgcaaaaaaatatagggatcttcagactcataggcacataccatacagggaaaacaagaaccttacaggcacagcccggtatgcaagtgtcaacacccatcttggaattgaacaaagcagaagggatgatctggaatctcttggttatgtgctcatgtacttcttaagaggaagtcttccctggcagggactgaaggctggcaccaaaaaacaaaaatatgataaaatcagtgagaagaaaatgtcaacttcgttagaggggctctgcaagtcatatccctcagagtttgtatcatattttcaatattgccgaacattgcgatttgaagacaagcctgattattcatatttaaagaggctgtttcgagatttatttattagagaaggctatcaatttgactatgtttttgattggactatattgaagtatccgcagattggcggcagcagctctagagggcggcatgaaagtggcaaggcagctatgcatgcaggaccatctgtacaaaagccagaaaaagtatcagttgggaaagagattcgagaaaaattctctggtgctgttgaagctttctcccggaggaacccaacaagtcctagtcctcgtggtgatcactccaaacgtaggagttttgaggaagtagcagtacacaaagatgtgtatcatgatcaagagaagggacgcaattcgtcccgatatggcagcagttcaagaagacccataatctcatcgtcaaccaggccaagttcctctggtgatcatactgacagtcgtactggccggctaacctcaagtggaagccgacaatctgccacacatagaaatattcaacctatgcacgagacaaaacaaccaacttacacacgctctggatccaccagaggcaaccgtgatgatcctctgcggagttttgagctcctctctatcaggaagtaa

SEQ ID NO: 107993 - DNA, 702 bp, Glycine max
  Peptide Sequence Number=SeqID_224771
atgtccaacaacaataaggtgaagggcctccttaaaggcctaagattcatttctcagatattcgataccgatgaaaaagactcagaaattcagattagtaatcccacagatgtaaggcatgtggggcatattggattggatggtcacgatggtccctctgaaaatgatcccagctggatgaacgagtttaaacccgatgattcagtccaaaggacctctcaagattcaaatgagtttcccaaatcatctaagcggcaaacaaaatcaatggggaacataagagagtctcatgcaaaggaaaaatcagacaggaggccaaggccacataaaaagtcatccaaaactaattcagaccaaaatgattcatgcaatggggacacggattcactccaacaacaacaagggaatgattttccacctaaaaagtctcgtcccaagatgtcaaaagatggttccaataatgttggtggtgactcatccaaaaccagatcaaaacctcatcatcatcatcatcatcattctagaaactcatactccaataataatcaagaaggccatgctagacacagttccaagactaggaccacacacgggtcctttgaagaagatgcacattctaggaacaaacacgggtcctttgaagaagaagaacaatttcaaagacgctcttgtgaaaatatactgaaaagttacccaaattag

SEQ ID NO: 107994 - DNA, 273 bp, Glycine max
  Peptide Sequence Number=SeqID_224772
atggctcaatcacttgacaccaggcaccagcactacttctacatcactcaatactttggaggtggctgctgggttggtaataatccaaaacgcttcttcagaagaactctctgtcttgaatatttatcatcgggtgaaaaccgggctgcagttcaggaaaaccaggtactgggttcttttcaatggaagccgcagtatggtggaactggtttgaacgggatcacattggttatggctcaaatagatggtggtgttatgtatgctagaggataa

SEQ ID NO: 107995 - DNA, 258 bp, Glycine max
  Peptide Sequence Number=SeqID_224773
atggttctgatggaaatgagtgcactgcagattcctgggtctgcaaatcaatatgatagtgtgctccatgccttttacaaaattagtaagaatgaaggattgaagggcctggggttgattctgaggttgattatgtacatgtctcaaggatcactgttctttgcttcatatgaatttttcaagaggacattttctctggaagcatcacatcccattgatttatgcattcaggacaatgacgagaatgttgaagagtga

SEQ ID NO: 107996 - DNA, 399 bp, Glycine max
  Peptide Sequence Number=SeqID_224774
atggattctgcgagaagttggttacaaaaatttcaaccacgtgataaattgagggcctctacaaggaacaaagatgatactaatggcacaaatgaaattccaaatgtgcctatggatgatacatctctttccaatgtcacaaaacaaaaggttacggcagccaaacaatacattgagaaccactacaaggaacaaatgaaaagccttcaagagaggaaggagcgtcgaaccatcttggaaaagaagttggctgacgctgatgtctccgaggaagatcaaaataacctacttaaatttttagagaaaaaagaaactgaatatatgcgtcttcaaaggcacaaaatgggtgttgacgattttgagttactaactatgattggaaaaggtgcatttggggag

SEQ ID NO: 107997 - DNA, 219 bp, Glycine max
  Peptide Sequence Number=SeqID_224775
atgtatcttcagttttacataaacgataacggcgacaaagtctacaccactaagaaagagtcgccggtagggctacctacacaatctgctcatccaggaaatgccactgttccaggaatccggctatactactggtactgttccggcaacaaacccaaagcacatgacaatatctatttcccttcccctgcatatagcattcctctgagccctccatga

SEQ ID NO: 107998 - DNA, 114 bp, Glycine max
  Peptide Sequence Number=SeqID_224776
atgagtgaaacagagagagaaaatgttgtgaagtgtgaactgtgccaaaaaggccaaaaagtgaatcccaaaactccaaacggacaaagcgagctgagcacagatcagacatga

SEQ ID NO: 107999 - DNA, 390 bp, Glycine max
  Peptide Sequence Number=SeqID_224777
atggaaacatttggtgcatcgatttcagaggcgagggatgctgcaaccgcaaattctaatggtgaaaatgaaatagagggtttcaagcaacgcgttgatgagataatttcaaaagttgacaaggcaagcttaacaactggcattaggaaagaatggcttgagcagaaagtacatgatatagagaatttttactcgagtatgaataaaaaccaaacaagcacgcccaaaggtaactcagcagcaaaggataaagataaggagaaacatgttccaagtattaagaagcaacagcaggatgcctctcgtagagaagcggctgcttcaaaaagaatgcaagatcttatgcgtcagttcggcacaattctacgccaggcaactatttttcattga

SEQ ID NO: 108000 - DNA, 201 bp, Glycine max
  Peptide Sequence Number=SeqID_224778
atggatgagcgtgtccttctttgctcagcgccactggattgtgtgcttagcgagctcctctcacgtagcgcgtactattccgttttgatcgcgcttagcgagatcctctcacttagcgtgttctgtttttgttttgaccgcttagcgcttgttacgcgcttagcatgggagttgagtctcgcgcttaacgccctcgcttag

SEQ ID NO: 108001 - DNA, 396 bp, Glycine max
  Peptide Sequence Number=SeqID_224779
atggatttcagtactattaagaatcaaatggaggccaaggatggtactggatataagcatgttcgggaaatatgtgctgatgtgaggttggttttcaagaatgctatgaaatataacgacgaaagaagtgatgttcatgtgatggcaaaaactttgttgtcaaagtttgaggagaaatggttgcaacttttacctaaagttactgaagaggaaacaagacgagaagaggaagaagctgaagcacagctagccttgcaagttgctcaagaagcagctcaagccaaaatggctagagatttaagtaatgagctgtatgaagttgatgtgattttagaagaactacgagagatggttgttaaaagattcaggttagctgttgcatcaaatgtttcctga

SEQ ID NO: 108002 - DNA, 318 bp, Glycine max
  Peptide Sequence Number=SeqID_224780
atggcggcactgcatgctactccctctgcattcatgcatgtcatcactaagaagcttagtgaaaaaactatcttctatcgcgtcaacgggttgagcttgttatcaaagtttcataagaaacttatttctaacactgtattgttgaacctcacgaatgctctagtgagctctagcgacacttccaatggtgtgtcgttggcaaacattacacctattgtgaatgttatgtcggaaaatgttgattccaacaacttcagttatgggggtggccgtggtcgtggtggtgatggcgccgatggtggttgtggccaagacatg

SEQ ID NO: 108003 - DNA, 1722 bp, Glycine max
  Peptide Sequence Number=SeqID_224781
gctctgagccaaagtgatggaaggtggcgttatagttctaataatccagagtctagtacctatgctgctggattagcacttgaagcacttgctggagtgatctcattagcatcttctgaaattgatcagtctagggaatcttggcacttctatcgatatcttatatcagttcctttttgtcaggtgaatacagtgaaaaatgatatattgaagcttttcgacagcattgagaaatatgatgatggaacattctattttgatgagaaatttgttggtggacgtgagcatcagggttctctttccacaacttcttctgttgttcgaggggttacagcatttgctgctgtaacttctggaaaaataaatcttccaggggataaaatattgggtttagcaaattttttcctgggaattggaatcccaggagatgccaaggacttcttcaatcaagttgaatcattagctcttctagagaacaacaagcaaggtttcgatcccattggtactgtcacttcctgcaacggtttattcattatccaaaaaagatcagctcaagcacctgtcaaaattcagtgttgttttctggttctcaattacacttgggaaaacatgacaaatttctatttccaaatgaatcaggttagggtgaacactgtacttggttcagctgcaccacctttaacagttaagcttgtgcaagctttccgctctaacgctaaagattcagctattgagagcaaggagctccaatatgatcaaaataatggaattcatttcttggaagctttcccagacaatgtagatgtgggaacttatgtgtttgtttttgagattgcacttcacgattctgctggtgaaaaagtttatgctactggaggccaaattcatgtaccaatatatgtcactggcattattaaagtcagcaatgctgaaattgctgttcttgacagtgatcttggaagtgttgaaacccagaaaacgctagatttggctggaaatgatgatgtttcactctcagctaaccacttgcaaaagttgcgcttttctttccagttgacaacacctcacggtcatgcttttaagcctcatcaggcatttttcaagttgaagcatgagacaaagcatgaacacatctttgtggttggaaatactggcaggaagtttgagattattcttgattttcttggtttggtggagaaattttattacctctctggcagatatgacattgagctgactgttggggatactgtcatggagaactctttcttacggctgcttggtgaagttgatttagatcttcccgaagcacctgagaaggcagcccgtcttcctccactccctgtcgatccttactcaagatatgggcccaaagccgagatagcccacttattcagggctccagaaaagcgaccaccccaggaactctctcttactttcttgggtttgatccttctgccatttattggctttttagttgggctgttacgcctgggagtgaacttgaagaattttccttcttcagctgtacctgctacatatgccttcttattccatcttggcattgctgcagttctattgctttatgtacttttctggttgaagctggacttgttcactacactcaaaactgtaggatttttgggagcttttctgttgtttgtgggacacagaattctttcccatctcgcttcaacatcatctaagttgaagtctgcatga

SEQ ID NO: 108004 - DNA, 459 bp, Glycine max
  Peptide Sequence Number=SeqID_224782
atggctgctatgaatgccatacctggaaatctccctgtgtttgatgggaaaggttacgaagattggtgcgtgaagatggatgctattcttggattccaagaacttgatgagatcgtgagagatgggtttcaagaaccccccaagaatgcttcagcagaatgttggatttcccttgcagtaactttttggtccactttttctttatacaaatatgttcaaagggaatccggtttgccagaaagcgcaccggatcgtcattggatgtaccctctactagaactgatccacaagagatgtatcctgatgcaagctccattggagcttgtaggcctaggatcttcttcatcaatggattcctttgcttcttggaagatgaatggcagcggaatggagaaggaagagggagaggagacgccacttcaaggagaagatgagtctagaagaagctcaccaccatag

SEQ ID NO: 108005 - DNA, 198 bp, Glycine max
  Peptide Sequence Number=SeqID_224783
atgcctacaacagtgctctcaacaacaacaacaacaacaatgttgcttccttttcacaggtccctgtctatgcacaagctctggaaaagaagaaagctccagctaaagcaagggatacgaagagaacaagaagagaccatggagagatggaagagattgtgttcaagctatttgaacggcagccaaattggagtttaa

SEQ ID NO: 108006 - DNA, 351 bp, Glycine max
  Peptide Sequence Number=SeqID_224784
atgaaaaagatgaataacacacttttgttttcagggtttggaaaaccagaaaactttagaaagcattttgcaaaggaagaagaagaagaagaagaagttcaaagagattcaaaggttgtaaaagagtatgtggaaaagttgtttgtaaaggttgtcaaagattgctctgaatccacgacattgcgctcagcgccaccctcgcgcttagcgcgactgaagacaactgttgcgtttagcgcactgatctcgcgcttagcgcacgaccttgatattgatgctctgccagattcttctgtcgtgctaagtgcgttgaagctgtgcttagcggtggatgcacgcttagcccactaa

SEQ ID NO: 108007 - DNA, 687 bp, Glycine max
  Peptide Sequence Number=SeqID_224785
atggataaagcatcgttgatacatgaggtgagaaatcacttgagctgcaataggtatgttgtcgtgtttgatgacgtgtggaatgaaaatttttgggaggaaatgaaatttgctttagttgatgttgaaaatggaagtaggataataatcacaaccaggcaccgtgaggttgcagagtcttgtaggacatcttctcttgttcaagtgcatgagttgcaacctttaactgatgacaaatctttcgaattgttttgtaaaacagcatttagatctgaattagatgggcattgtccacacaatcttaagggcatatcaactgaaattgttaaaaagtgtgaaggtttaccactagctattgtggccactggtggccttttatctcgcaaaagtagagatgcacgcgaatggcaaagatttagtgagaatctaagttcagaattaggaaagcatcccaaattaactcccgtgacaaagattttgggtttaagttattatgatttgccttaccatctcaaaccatgcttcttgtatttcggaatatatccggaagattatgaagttgagtgcgggagattgattctacaatgggtagctgaggggtttgtcaaatctgatgaagcggcacaaactttagaagaagtggcagaaaaatatttgaatgagttgatccaaagcagattggttcaa

SEQ ID NO: 108008 - DNA, 159 bp, Glycine max
  Peptide Sequence Number=SeqID_224786
atgcatgtgcatcgttgttgtcctgtaagtcggaggacaggagaagagttggtcgataccacaccaagtcaaaggccaaaggtacgagcaggtactgggcccgtgatcgataggtcgtcatcctacgtccagctcaagacgttaaagaagcgctactag

SEQ ID NO: 108009 - DNA, 384 bp, Glycine max
  Peptide Sequence Number=SeqID_224787
atgtccaaaacttgtggatttgggatgaccggccctctcgatgagtcgatctcttgctttctcataagggtggacccttgggtacttgtacctatcatctttagaggactacatgtcctcgccatcagaggacttcatgtccttgccatcagagggctgcacgccctcacctccagaggactacctgtcctcgccttgagagggctacacgccctcatcttggttaccctcaccgttgagaggactacacgtcctcgccatcagagggctgcacgccctcaccttcagaggactacacgtcctcgccttgagagggctacacgcccttcaccttgggtactagttaccctcaccgttgagtggactacacgtccctcgccttga

SEQ ID NO: 108010 - DNA, 339 bp, Glycine max
  Peptide Sequence Number=SeqID_224788
atggttggagtaaccaaagactatgccaagttattgaagtatggtgactcgctttaccggtgcaagtgtcttaaggttgctgctcttggcagcatgtgcattgtgatcaagagggttggcgcgagtttggcttatttagaacaggtcagacaacacatggctaggcttccctctattgatccaaatatgactccattggagcttgtaggcctaggatcttcttcatcaatggattcctttgcttcttggaagatgaatggcagtgaaatggagaaggaagagagagaggagacgccacttcaaggagaagatgagtctagaagaagctcaccaccatag

SEQ ID NO: 108011 - DNA, 414 bp, Glycine max
  Peptide Sequence Number=SeqID_224789
atggtccacttaattgttcacctggtcagggaaatcaaatgttgtggtcctgtttatctgcgttggatgtacacggttgagtgctacatgaagatcttaaaagggtataccaagaatctacatcgtccggaagcatctattgttgaaaggtacatcacagaagaagccattgaattttgttcagagtacattgaaaaggctaaacctgttgggcttcctgagtcttgccatgacgacagagtaggcgacctaaagaaactagcttaccagaatgaccctttcatcatggcagaacaagctaagcaagtattttatgtgcaagacccttgtgatgaaaggtggtttgtggttctacacgggaaaacaattggtgttaatgtagaagatgatgattcatacatggacacttattga

SEQ ID NO: 108012 - DNA, 330 bp, Glycine max
  Peptide Sequence Number=SeqID_224790
atgacacatggtcgtgtttcaacatcccagacactaatggatcccttgctaccccctccgagccaaagcatatttgtgatgcaatcctaccccctaagggcattggatagaagactccaagaagattggaccagagatgcaagagaaggccctaggattctcatgagcattatgacctcatttgaggcacaaaatttcgtgctcctctccctctccctcttcctccactcatcttcttctaccttcaagctcttatccatggcttcctatggtggtgagtgttggaacccggcaagtgcactggatcgcgcaagtagtataaaacggtaa

SEQ ID NO: 108013 - DNA, 177 bp, Glycine max
  Peptide Sequence Number=SeqID_224791
atgtaccgatcccatatggttggagcattcttgcaaaacaacgtgaccctgactggtctccctatgattttacctagtaagagtgacccgatttaccaatgtgtgatgattaggtggatggttatagagaatctcatgcttaaggatgttggaacacaatgctctcataggatgtga

SEQ ID NO: 108014 - DNA, 2049 bp, Glycine max
  Peptide Sequence Number=SeqID_224792
atgtcaggtggtggatgcagcagcatagtgtggttcagaagagatctgaggatagaagacaatccagcactgacagcaggagtgagagctggtgctgttgttgcagttttcatatgggcacctgaagaagaaggacaatactaccctggcagggtctctagatggtggctcaagaacagtttggctcaccttgattcctctctcaggaatcttggcactcctctcatcactaagcgatccactgatactctttcttctctatttgaggttgttaagtccactggagccactcaactcttttttaatcatttatatgatcctctgtcacttgtcagggatcaccgagcaaaggaggttctgactgctcagggcataacagtacgttccttcaacgcggacttattatatgaaccatgggatgtgaatgatgcacatggccgaccattcacaacttttgctgctttttgggaaagatgtcttagcatgccttatgaccctgagtcacctcttctcccacctaaaaggataattccaggtgatgcatcgaggtgccctagtgatacattgctgtttgaagatgaattagagaaggcaagcaatgcacttcttgctcgagcgtggtcacccgggtggagcaatgctaacaaggcattgacaacattcataaatggtccactgattgagtactcaaaaaaccgcaggaaagcagacagtgccactacctcacttctctcaccccatttgcactttggtgagttgagtgtcaagaaggtcttccatctagtccgcatcaaacaagttttgtgggccaacgaaggaaacaaagctggtgaagagagcgtgaacttgttcctcaaatctataggtcttagagaatattcaaggtacattagtttcaaccatccctacagtcatgaaaggcctcttctaggccaccttaagttctttccttgggttgtaaatgaaggatattttaaggcatggagacaaggaagaactgggtaccctttggtggatgctgggatgagggagttgtgggccactggttggctgcatgatcgaatacgtgttgtagtttctagtttctttgtgaaggttctgcagcttccttggagatggggaatgaagtatttctgggatacccttttggatgccgatcttgagagtgatgctcttggttggcagtacatatctggtagtctccctgatggtcgtgaaattgaccgaatagataatccacagtttgagggctacaaattcgacccaaatggagaatacgtgcgacgctggcttccagaactttcaagattacccactgagtggatacatcatccttggaatgcaccagagtcagtgctacaagctgctggaattgagctaggatcgaactatcctcttccaattgtgggaatagatgcagcaaaaaacagattactagaagcactatcaaaaatgtggcaacaagaggcagcttcaagagctgcaatggaaaatggaacggaggaaggacttggagactcttctgaatcagttcctgctgcttttcctcaagacacgcgaatggaggaaactcatgaacctgttaggaacaatccccttcccattgctcggcgctaccaagatcagatggttccaagcatcacttcttccttgttgagagtggaagaggaagaaacgtcttctgatcttcgaaactcagcagaagagagcagcagagctgaagtgccagtaactgcaaatgcacaacaaaatgcaggagttgcattgaacgaacggatgttgcagaccactaataggaatacacaaacccaatacaatactacgatggacctgagaaatgtagctgatgattctgcagtagaatcttcaagtggtaccaggagagaaagggatggaggtttagttccagtatggtctccaccagcttccagttactcagaacaatttgtaggagatgaaaatggtataacaagcagttcatcttacttgcaaaggcatcctcaatctcaccaaatgctgaattggaagcagctacctcaaactgggtaa

SEQ ID NO: 108015 - DNA, 366 bp, Glycine max
  Peptide Sequence Number=SeqID_224793
atggtcattccttcgaagttcaaggtgtcagagtttgataagtacatggggactacttgccccaagaatcatctgaaaatgtattgctggaagatgggggcgtacgcaaaagatgaaaaattgctaatgcatttcttccaagaaatgttcgccggtgaaaggatcgaagtgggtctgagaagaggaaaatttgattgtctcactttgacaagtaaaaagcctagggcaaatggacagaatgaggaggagggaggaacccacgttgtgactgtcattcctacatggccaagtttcccaccatctcaacaatgtcattactcagccaatatcatcccttctcattacccaccacccaatcatccataa

SEQ ID NO: 108016 - DNA, 570 bp, Glycine max
  Peptide Sequence Number=SeqID_224794
atgagaagccctctcaaagagtcaatctcatgctttctcataaggggactcaaagtcctcgcctttagagggctcaaagtcctcgccttcagagggctcaacgtcctcgccttcagaggactcaaagtcctcgccttcagagggctcaaggtcctctccttcagagggctcaaggtcctcgccttcagagggctcaaggtcctcgccttcagagggcttaacgtcctcgccttcagagggctcaacgtcctcgccttcagagggctcaacgtcctcgccttcagagggctcaaagtcctcgccttcagagggctcaaagtcctcacctttagagggctcaaagtcctcgccttcagagggctcaaagtcctctccttaaggggactcaacgtcctcgcctttagagggctcaacgtcctcaccttcagagggatcaaggtcctcgccttcagaggactcaaggtcctctccttcagaggactcaaggtcctcaccttcagaagactcaaagtccttgcctttataggactcaaagtcctcgcctttgtagggctcaaagtcctcacttga

SEQ ID NO: 108017 - DNA, 922 bp, Glycine max
  Peptide Sequence Number=SeqID_224795
atggctagtggactggaaactatttgtggacaagcttatggagctcaacaacataaaaaaattggagtgcaaacatacactgctatattcgctctcacattcgtttgtcttcccttcacttttctttggatcaacatggaaaagatactagttttcataggtcaggaccctctaattgcaaaagaagcaggaaaattcataatttggcttattccagcactttttgcatatgcaattctacaaccattagttagatattttcaaatgcaaagtttgcttcttcccatgcttatgacatcttgtgtcactctatgtgtccacatacccctttgttgggttttggtgttcaagactagactgaataatgttggtggagcattagcaatgagtatttcaacatggtcaaatgtgatttttcttggattatacatgagatactctcctagatgtgcaaaaactcgtgcacccatttctatggaattgttccaaggacttcgggagttctttcgctttgctataccttctgcagtgatgatttgccttgaatggtggtcatttgagttgattatcttgttgtctgggctgttactaaatccacaacttgaaacttctgttttatccatttgtcttaacaccacttcaattctctatgcaataccttttggaattggtgctgcagcaagcacaaggatttcaaatgaattaggagcggggaatccacatggtgcctgtgtttctgtgttggctgcaatatcttttgcaatcattgagacaactgtagttagcggaaccctctttgcttgtcgccatgtttttggttatgtttttagcaatgagaaggaagttgtagattatgtcactgtcatggctcctttggtttgcatatcggttatacttgacaacatacaaggtgttctcgcag

SEQ ID NO: 108018 - DNA, 156 bp, Glycine max
  Peptide Sequence Number=SeqID_224796
atgtatgaaaaatcagaggtggtggtccttgcgggggctgagatgggccgtggggcccaggaggagggtgttgctgtggagcttgtggtgttcaaggttgaggttgtgctgctggagaagggtgtggtggccaaaggtgtgctggagatggagtga

SEQ ID NO: 108019 - DNA, 1170 bp, Glycine max
  Peptide Sequence Number=SeqID_224797
atggcaatgcaggcagggttgtttctcgaccccaaaatccccgattccttcgttcgttccatttcgttcaagattcacgccactcccttttccgaatccaatcctcgccgccaacggagaagggttccggcagcgtgctttctatcagttagcttgccgagtgcaaatctcgttaccgaacccaaactgcaaaatggcgaacacgtgtccgaccaggagacaacctcaaacggtgtcgttcagcagagagaggttagggtacgaggaggcaatgccgtcaacaccaccaaacatctctgggctggtgctatagccgctatggtctctagaacttgtgtggctccacttgaaaggcttaagttggagtacatagttcgtggtgagaagaggaacatattcgagcttattagcaaaatagcttcttctcaagggttgagagggttttggaaggggaacctcgtaaatattctgcggacagctccattcaaagcggttaatttttgtgcttacgatacttatagaaagcagctgcttagattctctgggaatgaggaaactaccaattttgagaggtttattgctggtgctgctgctgggattactgctaccattatttgcctcccacttgacactatccggaccaagttggtggcacctggtggagaagctttgggaggtgtaattggtgctttccgatacatgattcaaactgaaggatttttttctctttacaagggtttagtaccatcaattataagtatggcaccttctggggcagttttttatggtgtatatgatatactgaaatcagcttatctgcattcaccggaaggaatgaagagaatccagaatatgcataaacaggatcgggaactgagtgcctttgaccaacttgagttgggaccggtaaggacattgttgaatggggccattgctggtgcatgtgcagaagctgctacatacccatttgaagtggtgagaaggcaacttcaattgcaagtccaggctacaaaattaagttcctttgcaacatttgccaaaatagttgaacagggagggattccagctctctatgcaggacttattcccagcttattacaggtgcttccttcagcttccataagtttctttgtctatgagttcatgaagattgttctgaaagtggagtag

SEQ ID NO: 108020 - DNA, 393 bp, Glycine max
  Peptide Sequence Number=SeqID_224798
atgaagtgcttttactatttcagagacaaatctaggagcagtaagcaaaggtcagcacctgaactgaaagagcaagagaaactcgagttttcagggcctgaaagggtcaccaagtcttcatgctcatctacatctcctcgcggtataccagaactgtatgaggagaagggtcacaatttgagggacttctccttcacagagctcaagcgtgcaacgagtgatttcagcaggcttcttaagataggagaaggtggatttggaagtgtgtttaaaggtacaatcaagcctgctgatgggaatcggaattctgttttagttgccatcaaaaggcttaacaagaatgcattgcagagagcatttagagtcccttggtccccatttccagatgagtaa

SEQ ID NO: 108021 - DNA, 153 bp, Glycine max
  Peptide Sequence Number=SeqID_224799
gtgaaaaagaggctaagtcatgaagtgcaaaaagtgacaattaagcttagctcagcaattgggctaagcatgcatccaccgctaagcgcagcttcagcgcacttagcacaaaggagaatctggcagaacatcagcatcaaggccgcgtgctaa

SEQ ID NO: 108022 - DNA, 879 bp, Glycine max
  Peptide Sequence Number=SeqID_224800
atgtgcccggtgatcggttttggcccgtggctaggtcttggcaagccgttggttgaaattttgccccccggtcaacttcgtggtttttgcccgttgttggcttggctagggtcgacggtgctgggttatggccccgtgctaagtttcggattggttggccccctcctcccccccgtgatcagttttgttgccaggattttgccaactttggcttgcgccccgttggctaagtctgtgcctcggtggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacgggtatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 108023 - DNA, 852 bp, Glycine max
  Peptide Sequence Number=SeqID_224801
atggaacttagtaacaaaaagggctcaccaagggtgaaccttggcatcgtgttgttgcatacatgtaactcgccgtgggtggcacgtactggagacttagtggggggtcatccatttcgattcctcctcttctccggccataacttcctcgacttctatggtgggagtttggagtgtttcttggatgatagtcttgaggtgcccacccttcttggtattggtcggcttagagagcaagtctgctctggtgtttctctccctgggaaagtagtacattttgaagcattcaaaattgtcaataagagtcttcacgatctgatagtacttgagcaacactgtttccttggtctggtatatgttggcaacttatcctttgacaagggtgacattgttagggcattcgaggatgattcttgcctcgcttccctttatgttagatgccccatccatgtagaggttgcaccattctatagaccaggccaccatccttcctacaagtttaggctttcacaaaacttgcttgatggggcgcttctcggtgttatagagtatgcagctagtgaaatagatagggagctagggtacttctggccttggtcgactcaaattggtggtgtcgctatggtcttcttgaaagtcaagaaagaggaacctggacattggtctgattgcccatctctagtaaggcagtgcatttttcaggggtggcttcaattccctgagttccccaaagacttcttccaggtccgccacgtgataggctatgctttgagacttgacgaccatgttgaaaggcataacctagcagaaattgacaactttagtgatgaataccatcttctcctcgtctag

SEQ ID NO: 108024 - DNA, 288 bp, Glycine max
  Peptide Sequence Number=SeqID_224802
atgaaattgagaggaaaaggaggcgtagagtctatcgtcagtctaaaaactgacctaacatgtcgtcatgatgataagtgtggaatctttgacagcaggaagcaagaccttgtggaagtagaggtcttgtcacccatctggtggggcttccttctgctttgtggagcttctcccttgatgcttgtgaggagtatgtttgacttgaccctggttgaaggtcttgccaaccaatccaagggtaggtcgcatgacctgcagagtttctcctttgatagttatgaggagtaa

SEQ ID NO: 108025 - DNA, 1146 bp, Glycine max
  Peptide Sequence Number=SeqID_224803
atggacgagttgcgtgagggctacatccagatagaagaaatgtccagattcaggaacaaagtcagacaagaagctttcaacctagaggtaaccatcaagctacccccgatgaaacctcctaggctggggttagacacgaccaaatactgcaggtatcatcacggtattggtcataacacagaagattattgggctctaaaggacatgatagaagagctcatatgggctaggtacttagcccagtttgtcaaaaggtcagacaaccaccaagcaagagtaagaccaggaggacaccaagaagagcagcataggaaccatgaagcaaacagaagaagagataaagtggaagatcgaggacaattcagccagtcccaaaaacaccatcttcacgccattcaggacatcgacatcaattttgttgatgaaccattacaacgaagtctccctcctatcaccttcacggatagggacttcaagggtgaccctgtggttgtctccaccatcattgaaaatttcatggtgtccaaggtctcccctgacattatccacccttacgtcggtccactccttggctttgtaggcgagagagttgagaccaaaggctacatggacttaatgatcaccttcggtcaaggccagaagacacttaacgagcttggagccatagtttccatgtcgcatttgaaaataaaattccctaccttgaccagggagattgtaaccgtggagcccaccaagcctcaccctacagtggctaaaggtactcaagtcatgagcatagacgaagggtctccaataaaagccttgaccgtctaccaagcaagcctggacgatgaattcaatatagatccaagtgatgaaacctctgatagagacccatcaaagagttcctcaagctgtagctcgaacctatactcgggcagtaatgacgcaaagctgccaaagaagaagtggacaaactcctcaacgctaacttcgtcagaagtcaggtattccacttggcttgccaacgtcgtcatggtgaaaaaggccaatgacaaatggagaatgtgcattgactatgacgatttgaatagggcttgccccaaatatgcatatcctctgcctagcatcgacaggctaatcaatggagcattcaggttctag

SEQ ID NO: 108026 - DNA, 676 bp, Glycine max
  Peptide Sequence Number=SeqID_224804
atgggggtggagagaccattggttcatgttcctgatgctcaaaaggatttgatttgggaggacattcaggctgaatttgatattctggaagcgtctagtaaaaggacgaagaagaaaatcctccagacggtaggagagcgatggaggaaatttaagttagatttgacctccaaacgggcactagcacaaggcaaggaggacgatgatgacaaagtttgtaagaagtacgatattagcaaagagaagtggaaccaattttgtcaaagctgtagagatccttcatgggagtcgatcactaaaaaagtgacgagactactaatgttgtcctttagccaaatacagtctcagggaatcatacctcctattgagcctaaggtagctctttttggtgcccgtgtcaacacaaagggaagttatgttcatccctccgggcaggacccagacacgactgcatcagatatgcatgggttgtatggatcgacaatcgtgcaccatgtccctttgggaaatgatttggtgatggtaggtgttgaggaagttcgagatgctgatgctcatatccctataccaactgaagagcttatgcaagtagcgtgggatgcaactatgtttggggtgtacaatgataatgtccccttgtacttaaagcatgaagatcttggggaaatagcacatg

SEQ ID NO: 108027 - DNA, 186 bp, Glycine max
  Peptide Sequence Number=SeqID_224805
atggctgggacgccacagttaacttcagcgttgaagcttgatgtcagcaacaaccaccttgaagggaatcttctaaatgaatttgctaatcttaacaatctgaccgttatggaccttaggaataataggttcactggagggttgacccttatgccaccactacacaagactttgctctctggttga

SEQ ID NO: 108028 - DNA, 915 bp, Glycine max
  Peptide Sequence Number=SeqID_224806
atggaagagtcaccggaaaggtggcttcgttttttggaaatggatgagtgcaatttatttggtcacatgcactctcttgtggaagtgttcaagggggagaatctagtgcaacaagaaaaatcttgcaaaagtcacccttgtgattcaaatatcactaaagaaagcaccaccatccttcttaggaaccctataaatgattcatcatctttggaaaagaaccctggctttgataaccgtagtagtctcaaacaacatgcatctcaagatgaacctctcttctcatcctcctcaatgccctacactctttcatttgaagattcaacggcagtgccatatgttctcaataaaacatgccaatgttatcatggtgaaaattcaaaggaaacccaagaagaaccaaaaaataatagaaaatctaagaggggtagaagctcttctgagatacaagatcacataatgagtgagagaaagaggagagagaatatcgccaagctgttcatagcactttcagctgttattccggtgttgaaaaagacggataaggcttctgtccttaaaactgctatcgattatgtgaaatatcttcagaagcgtgtaaaggatttagaggaagagagcaaaaagagaaaagtagaatatgcagtatgcttcaaaacgaacaaatacaatattggtactgttgttgatgactcagatatacctatcaatatacgtcccaaaattgaagcaagagtctcaggaaaagatgcgctcatcaaagttatgtgtgagaaacgaaaggacattgttgctaagatcctgggcaagcttgcagctcttaatctctcaatagtttgctgcaatgttttgccgtttgcaaattccgctctgaacattacttgcattgctcagggacagatctatgttcctttttaa

SEQ ID NO: 108029 - DNA, 291 bp, Glycine max
  Peptide Sequence Number=SeqID_224807
atggaggcgtcgcttaaatctgaggtattttgctcatcttttatgcattttttgtcttccttttggtggagctatttgccagggaattctttcctcgcttgcaagttggatattaaatctgaggtattttggtcatcttttatgcatttttttcctgcctttggtagagctatttaccaggttattaatgctgagtgctcgatggtgctttacttgcttcgtttctttgctttgtttttcatacaggttgttcctaaggctatcttttgcccttttgaggttgttgtctaa

SEQ ID NO: 108030 - DNA, 243 bp, Glycine max
  Peptide Sequence Number=SeqID_224808
atgacatggaagttcaaatgcacatttaaggaatttttccaaagaagatttcttgaagaggaggtgtgtatcccaaaatttgatggggttccattcaactccattgatgaagaagacaatgctagtctaatagcttccttttggaagaggaaatcaagaaaacggtgtgggattgtgatggagataaatgtccgggactggatggatacgatttcaacttcaagaaattttggcatgttgtaa

SEQ ID NO: 108031 - DNA, 560 bp, Glycine max
  Peptide Sequence Number=SeqID_224809
ggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtggtgtccggcaagggaagtcggcaaaatggatccgtaacctcgggaaaaggattggctctgagggctgggcacgggggtcccagtcccgaacccgtcggctgtcggtgggaatgctcgagctgcttccgcggcgagagcgggtcgtcgcgtgccggtcgggggacggattgggaacgggcccttcggggcctctttccccgggcgtcgaacagtcaactcagaactgtgctctgaatgtcaaagtgaagaaaattcaaccaagcgcgggtaaacggcgggacgaaaccacagccaagggaacgggcttggcggaatcagcggggaaagaagaccctgttgagcttgactctagtccgactttgtga

SEQ ID NO: 108032 - DNA, 126 bp, Glycine max
  Peptide Sequence Number=SeqID_224810
atggttaacccaaggaccttttttggtttctactgcaaggattggggaacttgtagtgacctgaggtttgttcctataacacatattcaggtatctaatcttggaaaccaaattgagcttccttga

SEQ ID NO: 108033 - DNA, 417 bp, Glycine max
  Peptide Sequence Number=SeqID_224811
atgggtattaaacattttgaagtggtcaagcaaaggtcgcatgccgacaaacaatggtacctggatgaaattagggaagatgtggggttgaatgagggtgaaagggaccttagaatagaagtacaacaaaaagtgtgggaggtggcaacatgcttacatgtgagggaggtgtggggggatgatttgaagaaggttaaggaggaggtatcaattttatttttgaatagattcttagagggtgaggatggaggaactagtcttgatggtgttgattttaatctcatatctcatgaggacaatttattgttatcttcaagatttgaagaattggaggtgaatgaggcaatatgggattgtagggtatccaaaagtctaggatcatatggattcaaattcaacttcatcaagaagttttag

SEQ ID NO: 108034 - DNA, 570 bp, Glycine max
  Peptide Sequence Number=SeqID_224812
atggatgagccatggctgaaatgggtttctattttggacactaatgactatcatttatccactgaatgtgacatgaactctgttgaagaaccattggagggagagaattcagtggatcctggagaactctcatgggaaaatcactcccctaattcatatctcacaaaagaaagaaccacccttttgagcaattcttcatctttggaagagatcaacactagctttgatatgacaagtctcaaacaacatgcttctccacagaaaccaaagtcttgcattctgtcttttgaggattccacttcagtgccaattacttccaagaaaacttgccaattatatcatggtgaacattcaaaggagacacaagaagagctacccaatagaaaacccctcaagagggatacaagctttgatcacataatggctgagagaaaaaggagagagaatatcagcagactgttcatagctctttcagcccttattccgggcttgaaaaagtatccttcgtttaaggtaatattgtttgagacaatgtcggatacaaaatatgagtaccactttactttttaa

SEQ ID NO: 108035 - DNA, 387 bp, Glycine max
  Peptide Sequence Number=SeqID_224813
atggacaaggcttctgttctttacaacgctatagagcatgtgaaatatcttcagcagcgtgtaaaggatttggaaaaagataacaagaagagaaagacagaatccgtaggatgtttcaaaataaataaaaccaatgttgctgacaacgtttgggcatgtgatgataaacctatcaagatatgtcccaaagttgaagcaagagtctcaggaaaagatgttgtcatcagagtaacgtgtgagaagcaaaagaacattttacctaagctactggccaagcttgaagctcataatctctccatagtgtgtagcaatgttttgccatttgggaattccgctctcagcattaccagcattgctaaggaaaaggataacacttctctaaagtaa

SEQ ID NO: 108036 - DNA, 537 bp, Glycine max
  Peptide Sequence Number=SeqID_224814
atgatgtcatgcttgctttggtactccggagaaacaatcttgattgaacctatatttgcccaatggatacaatctgctcatggtaaaacttcctatggatacgatatacttatatcttcaacgaacagtccggcgtacaatgcaggacgaagcatatggttgcctggttggttaaacgctgttaatgagaatagtaattctctattcttaacaatagggcctggagacttcttggttcatcatgctattgctcttggtttacatacaactacattgatcttagtaaagggtgctttggatgcgcgtggttctaatttatcagtctgggcatggatgttcttgtttggacatcttgtttgggctactggatttatgttcttaatttcctggcgcggatattggcaggaattgattgaaactttagcatgggctcatgaacgcacacctttggctaatttgattcgatggagagataaaccagtggctctttcccattgtgcaagcaagattggttggactagccccacttttccgtag

SEQ ID NO: 108037 - DNA, 273 bp, Glycine max
  Peptide Sequence Number=SeqID_224815
atgtggcggaaatcgaaaagaggtgtttttgcgcaatcccaatctggcccacttggaccttccagatccttcctccaaaaggctgttgcttctggaggaagcaaccttgctcgcctgggcaagctgggtggcaagctcctcccctattttgctataaatagggggaggagtgaagaagaaaagggttcagccttcttggcacttctctctctctcgaaattgctgaggaaaattattttcgtgaagaaaatccaagccgaggtgcttccgtaa

SEQ ID NO: 108038 - DNA, 746 bp, Glycine max
  Peptide Sequence Number=SeqID_224816
gattacggatgggaaatattgaaactgtcctttccagcagtattgctgctgtcttttttgcagcttttgtcgttgctggaactatgtggtatggttcagcaacaacccctattgaattattcggtcctactcgttatcaatgggatcagggatactttcagcaagaaatatatcgaagagttggtgctggactagccgaaaatcaaagtttatcagaagcttggtctaaaattcccgaaaaattagctttttatgattatatcggaaataatccagcaaaaggggggttatttagagcaggttcaatggacaatggagatggaatagccgtcggttggttaggacatcctgtctttagagataaagaggggcatgaactttttgtacgtcgtatgcctactttttttgaaacatttccggttgttttggtagatggggatggaattgttagggccgatgttccttttcgaagggcagaatctaaatatagtgtggaacaagtaggtgtaattgttgagttctatggtggcgagcttaatggagtcagttatagcgatcccgctacttccgaggggttggttacttttggacaggcttcttttgctctgctattctttttcgggcacatttggcatggtgctagaactttattcagagatgtttttgctggtatcgacccagatttagacgctcaagtagaatttggagcattccaaaaacttggagatccaactacaaaaaaacag

SEQ ID NO: 108039 - DNA, 268 bp, Glycine max
  Peptide Sequence Number=SeqID_224817
gtataacatagtgaaatcacttgcatctgcacttctctatctgcatgaggaatgggatgaacaagtcattcacaggaacataacctcctcagcagtgactcttgaacctaacatgaccccaagactaggtagttttgctctggctgagtttttgtcaaggaatgagcatggccatcatgtaatcaataatacgagcaacatgaggctgtggattttaattcaggttaggagttgtggatttaaggctgtggcgcccaaaactaggtag

SEQ ID NO: 108040 - DNA, 855 bp, Glycine max
  Peptide Sequence Number=SeqID_224818
aggcaaatgggcctcgttcatagacactctcgcactgttgatcttcggaggaatcctctttccaaatgtggatgggttggtggatctagcaatgatcgacgcttttctcgcctatcgtgaccacaaggaaagaccggttgtcgctatgctagccgacctatatgacacctttgaccgaagatgtgagaagagcagtatgaggattgtttgttgtaccccggctctttatgtatggttggttttgcacctttttcgccaagagatgaggcatgcttgcccactagaaagccaccgttcatgcacaaagaaaggaggggcaaattgggaccaactcttagcaaacaaagaaggagcatctgtcaactggttccctcgatggaaagaaggaagaattggagttcttatttcgtgcggaggatttccaaatgttcccttaatggggacaaggggttgcattagttacaatcccgttcttgctataaggcaacttggctaccccatgagagggggcacctctagaggaagagctcacgcctgtcatgtcacgaggggcattaacaatgggcctgtcggtggctaccgtaagtggttaaaagcccacatgcaaggtttggattggctcccgagtttgagaatcgctaaaagggaggaagttgaggtaccggaggaagacgaagaggtgcaggcccttagggcagaactcgagcaagcccaaacagtcaaagaaagggctcgcaaggaagagcatggccgtgaaaaatttcgtggagctttgtggggtagcaacagtgagctcaagcttcgaagggaagagagagaccaatcacgagcacatggcatggtcttaaaagagga

SEQ ID NO: 108041 - DNA, 183 bp, Glycine max
  Peptide Sequence Number=SeqID_224819
atggtgtctgaaatgtctaacaaagatggcacgccgcgattgctaagctctgacacggcgagcttgttggaccgggtggaattgggtgtgctcggttccgcgaagattgctacaaccatttatgtgagagacagagagagggagagaggagataagggagagatgagaaggcaagagctttaa

SEQ ID NO: 108042 - DNA, 975 bp, Glycine max
  Peptide Sequence Number=SeqID_224820
agagacgggtatgacgcacttgtcgccatcaagggatcatccgctgtagcccagctcaaggatctggccaatgcgttgagggatgcgcttgatcccggcgccaatcccgtggtgacctatatcagtccgcattcgccgcgggcggccgagtcaatcagtcgccaggggattgccgcgttccagtccccggaaagcgtcagtgcggcacagatggcgatgttgcgggtccacgcgccggctcggccgcccgcggccgactccacggcgccgtcgccggcgccggtgtcgtgccccgagcacggctccctggacgaagcccaggccaaagccctgttcgcgcggtttggcgtgcccggcgtgcgcgagatcgcggtgcgttcaccggccgaggcggtcgaggccgccaggcaattgggaccgcgcgtggttctgaagttgctgtccggcgacattctgcacaagagcgaggtcggcggggtggcggtcaatctgacgcccgacgagatcgggccgcgcctgcggcggatggccgcggacgtgcagcgccacacggggcgggtggccgaggcgttcctggtgcaggagatggtggcgggagcggccgaagtcatcctgggctttcatcgcgatccgcttggcacggcgattctgctgggaatgggcggcgtggtggccgagctgatccgtgacaccacgctgttgctgctgcccgaggatggcgcggccctgacggcatggcaggtcgaggccgccctgcggcggctgaagacctggccgttgctcgatggctaccgggggcgtgaccgcgccgatgtgcccgccctggtcgacgccgtgctcgcgtttgcgcggatggcgcaagccctgggcgagcggctggtcgaggccgagatcaacccgctgttcgtcaggccgctcggtcagggcgtccgcgcggccgacgccattgcgatcatcggcgcggtcgcggcctga

SEQ ID NO: 108043 - DNA, 882 bp, Glycine max
  Peptide Sequence Number=SeqID_224821
atggctcctttcttgaagaattccccttccaggcctacttttttatcaaggatatcactaagtgatatatggagacctgcatcaaggaaatactgcagaaatgatacttggaaaatgttgaaaacttccatttccatacttttctcacagtcagtcctgcaggagccagcatttgaagaattaattctactgtataccaaggaagttgaggaaacaaatgctaaagataaagcagaggttccatcattgcaattaaagatctatgagagaattcctattccagatttaccgctttctatttttatacgtatatttcttcagatgacactcaatttttttcaggtgcgcttggatgttgccacaattttaggacttctggcatacttcataaactacaaatttgagaatgtcttatcttccccatcagcaatattacttgatgtagttgctgtaagtgccctaataatatatgggagtcgtgtggttctaggctacaaacagacatgggataggtatcagttgttagtcaacaagacactttatgaaaaaacattggcaagtggctttggctcagtgcattttcttctagatgcttctgaacagcagcaatacaaggaagctattttggcttatgccatcctgctcaaagcagagaagagtcaggttatttctcggcaaagtgttggagagaagtgtgagagattcatgtatgaagtgtttaaagtaaaggttgaaatgccaattgacaaggcactcaatacattattaaggctgggcttagcaactgaatctagtattgatggaaggcggggattgctggctatgccttgtccgaaggcttatgaggcccttaaagaacgatggaatagtttgctcagttaa

SEQ ID NO: 108044 - DNA, 1683 bp, Glycine max
  Peptide Sequence Number=SeqID_224822
atggaggggggcgagggaggagaggggttgaaccaggcagtgcagcagcagctaaatctgaagcaagtgaagacccgcgctatcagcctcttcaaagccatctctcgtattcttgaagatttcgaggcctacggtcgcaccaactctacccccaaatggcaagacattctgggtcaatattctatggtcaaccttgagcttttcaacatcgtcgatgacatcaagaaggtgtccaaggcctttctggtccatcccaagaatgttaatgccgacaatgctaccatactccctgtcatgctttcctccaaactactccctgaaatggagaccgacgacaccgctaagagagatcaattgcttctggggatgcaaaacctcccaattccaacgcaaattgagaagctcaaggcccgtcttgatctgatttccgcagcctgtgaaggtgctgaaaaagtgttggctgacactcgcaaagcctactgcttcggaactcgtcaaggcccagccgccattgccccggccactctagacaagggtcaggctgccaaaattcaagagcaagaaaatctactccgttctgctgtcaatgccggtgacggattacggataccaggagaccagaggcacatcactcctgcacaacctccattgcatttagcagatgcacttcctgtcgtcattgccaatgaccctactactgcacaaccgcaaccacaactctcagcaaacaccatgggcatgcctgcccagaattccttgttacaggcctcctccgcaaccgtatcacaacttttgggaagatcagcagcatctccttctgctgcaaccaccaccaccacttcttttgacaatataacagcttccccaatcccatatgccaattcacctaggtcttctacaaacatcatgaactctccatcccctcagcaacaacaaacccaacaacagccaccagtgctgcagcagcagcagcaacgacagaaattcatgcaattacctcaacagcagcagcagcaccaaattcttgctcagcagcaacagttcaggcagtctgcaatgcaaggactgggacagttgcacggacaacatcagatgcaattttctcaaccacttgggcaccagcaatttcagggtaggcagctgccttcaggacatgttcagcatggcattggtcaaagccaactcaatcaaggaaaccaaatgactcgattaagccagttttctggtcctgctaacagtgcgctattcagtgctgctcaaacaacacctaatactcaaatgtttgtcctccttgaaagggttgtgatgcagcctgtgtttaacatgggaggtggcaatcctggtggtatgatgcccatacaacagcagcagcagcagcagcagcagcaacaacatggttcacaagcatttggtagcatggcaaatgctcagaatctacaatctggaattaggggaagattgtcatcagatggggaggaaggaacgagcgagaaaggtggggaagtagttgaagatactgagaaggagtatgtccggttgcctggtccaaaactaatgggaaggggagagggaggtgtaggaggtgatgaaatcattcgccgtggtcttaatttccctgcgcgtttttggtattcttcttccgaggcattgccatttgcagtgacgtggagttgcacgcattga

SEQ ID NO: 108045 - DNA, 240 bp, Glycine max
  Peptide Sequence Number=SeqID_224823
atgcggatcaacgagggtgcgcggtgtttggtcgtaggtggtgcgtcttgggtttgcggaaagttaggggtcgcaggttgttcgttggattcgtggctaggagcgacggatttgttggttgataggggcgcggaggtttggtggtccgcgagacaaggaggtatgtggccgctattgtgttttggtcaagaagatgaaggcttacggattgggttaatccgtaagcctcacacggattga

SEQ ID NO: 108046 - DNA, 1377 bp, Glycine max
  Peptide Sequence Number=SeqID_224824
atgtcatattgttggcaaatacacactttggcgagcaaggctcttgttccaattccacagtcacagtcacagtcattgttttttccttattcacattcccatagcagtatctgtgtgggtctgagtcggagggttccttgttcacggcttcaggaaatgtccgtagtagagtcatcctcacaataccagtatcaacaacagcagcaacagagcaccaccaccgactactatcccagtgtcagagatgatgaagaaggtgaaggaatttctaaaatacgagtgcccagacagaaacacatccctgtttccaagtcccaactcctagacgccatcatcctctctatccaagatgatattgatgcccatcactttcgtcttctcacctcatgcttagactctatacttcatgccgagcataaaactatcttagaggagatgcgttccgattatcaacttaccgattcactccaacaacttgtgtccaatcccaatgtcaaggaggaagggaacctctatgactatcagcctgctttggacctcaccgctcttttacgatctctcgacatacctaccaagaaagattatgataccggctccagagttaccattgctacccgtttccaacgtgctttcatgcagcttctttcaaatgcacaatttgaagaactatcagctagggacctgatgttaacgtctgcattgaacacagactatctccttaccttgccaatatatgttgattggaagagagcatatgagtctaatgccataatatttaggcgtggttatgcaactgagaagcagaagggcctattaattgttgaaaaactggattacttacagtctaagtttcttcgaaggaccttctttgctatatcagaaccactaacaaaacttggcacctggataagcgagctttacgaaaatgcctgtcagaaacatgaagtacaaaattggactgaaagattgaggctttggctaaaggaattgtcattatttcagaaatcactactttataatgaccctgcttcagatgagcaaataggtgtggaccaagtaccaaatgcagaacttcctatttggctggctgctcaaagggcagtagctcgatatgaagggattttgtcaccagttggtcctcgtggaaggctcttgaggagattgctttcttggataggacttattccacctatgccagaaacaccttttgaggttcacaatgataataacgctcctgaaccatacctaagtctgttagctcggcttgatgctgctcttattataaaaaggaacaaattgatatggaccccatatatgactgttctaggacccctgaaactcactctcaagtctcaacaagtcttaaatgaacaatga

SEQ ID NO: 108047 - DNA, 204 bp, Glycine max
  Peptide Sequence Number=SeqID_224825
atggagacaagccgcaagtacaacaaattcaatgtgactcagaagaggatgtatcctgcagttagaagaggaataattaaaggcccaacatccttagctctgtcacatggctgggatcaagttcaggcacattctttacatgttctcgatcttctaccacatattcctaaaattgaaaaggtaaagaacaacgtgaagaattga

SEQ ID NO: 108048 - DNA, 384 bp, Glycine max
  Peptide Sequence Number=SeqID_224826
atggttaggattagaggcctaggccgtgccttaggtagggttagtgacagagtacctgtcactgttgcgaacgctgagccagtggtacctgcggttgaggctgacgtagttgcggatgagccgatggctgctatagatgagcatgagggatttctgggtggaccgatcgacccatccgtgctgaccgagtatgttaagcatgttgcagccaacgtatggacgagaaaggctacgacgtttggagggatcaacattatcgtcatcgtggttctcctcttcttcctcgatgcctctccaccggtccaggaagagaaagtcgttgtggttatagtggtgggagagatgaaggaaggaatgcgcgtgaatgaatatggacgtgaatga

SEQ ID NO: 108049 - DNA, 447 bp, Glycine max
  Peptide Sequence Number=SeqID_224827
atggctcacactacttgtgaccccttgaagctaaagcatttgcttcaaaagttcaagttttgtgaggttggtcctatggtatatgctcgagaaaatcaatcacccttgtatctttcttcagagtcaatttttcatgagagaactaagtacatagaagttgattatcgtttcatcaaagaaaagattcccttaggcattatcagaacatctatgaatttgagtgaccaactagcaaacatcttcactaagtcaatttttcatgagagaactaagtatatagaagttgattgtcgtttcatcaaagagaagattcccttaggcatcatcagaacatcttctatgaatttgagagatcaactagcaaacatcttcactaagtctttgccgggtccttggattgcatacatctataacaagctagatgcatatgatctatattgccattga

SEQ ID NO: 108050 - DNA, 1449 bp, Glycine max
  Peptide Sequence Number=SeqID_224828
atgggttcaagattcccatctcatcagctcagcaatggcctgtatgtatcaggtcggcctgaacagccgaaagaaagaactccaacaatgagctcagttgccatgccttacactggtggagacatcaagaaatccggagaattagggaaaatgtttgatatccccatggccatggatgcttctaaatctagaaaatctggtcagctaaataatgccccttcacggactggatcatttgcaggtgctgctgcttcacattctggacctatcttgccaaattccactcctcgttctatttataccacatctggtaacatatcttctggaggcagcatgacgactgcttcagtctcaatgaaaaagaccaactctggtccactgaataaacatggggagcctgtgaagaagtcatctggaccgcaatctggtggagtcacacgccaaaattctggtccgattccacctgttcttcctacaactggtcttattacatctggtcctctaaattcatctggggcaccaaggaaagtatctggtccattagaatttacaggatcaatgaaatcgcctagttctgtaactcacaatccagccatgaccactcttagcctagatgatgaatattccttcaggaggaacttcccaaagccaatactgtggtctgtaattctgattttcattatgggattcattgctggtgcttttattcttggagctgtccacaatgtcattctccttgttgttgtagtagttctttttggtgctgttgcggcattgttcacttggaacagttgttgtgggaggacagccattgttggtttcatttctcgttatcctgatgctgagcttcgaactgccaagaatgggcaatttgtgaaggtttctggggttgttacctgtggtaatgttccattggagtcctcctttcaaaaagttcctagatgtgtatatacttctacaagcttgtttgaatatcgagggtgggattcaaaagccgccaacccgaagcatcgtcgttttacatggggactcagagcagctgagaggcatgtggtggacttctacatttctgatttccaatctggattgagagcattggttaaaacaggctatggtgcaagggtgactccttatgttgatgattctattgtaattgatgttaaccctgacaataaagacatgtctccagagtttcttcgatggttgcgagagagaaatctttcaagtgatgatcgactgatgcgattaaaagaagggtacatcaaagaaggtagcacagtcagtgtaatgggagttgttcaaagaaacgacaatgtacttatgattgtccctcctcctgagcctttgactaccggatgccaatgggctaaatgtatatttccagctagccttgagggtattattttgagatgtgaggatacatcaaagattgatgtcattccagtgtag

SEQ ID NO: 108051 - DNA, 990 bp, Glycine max
  Peptide Sequence Number=SeqID_224829
atgggagagaaaaaagaagcggcgaagaatgagggcgataagaagcctgaatcaggagcaaagcaaaacgacggacgcctacctgtcgttttgaaactcgacatgcattgcgagggatgtgtcaagaagatcaaacgcgccgttcgccatttcgacggtgtggaagacgttaagaccgatctatcaagtaagaaactaacggttattggaaaagtcgaccctgccaaagtgcgagataaactagcggagaaaactaagaagaaggtcgaactcatttctcctcagcctaagaaggattccgccggggataaaccgccggaagagaaaaaatccgaagagaagaaaccggaagataaaaaggcagaagaaaaaactccgaaagagagcacggtggtgttgaagatcagactgcactgtgaaggttgcattcagaagattcgaaagattatcctcaaaaccaaaggagttgagtcggtgaacattgaaggaggaaaggatttggtgagcgtaaaggggacgatggacgtgaaagaaatagtaccgtatttgaacgagaagctgaagcgaaacgttgaagtggtcccacccaaaaaagagggtggtgataagaaagagaacaacaagaaggaaggtggtggtggtggtggtgctgaaggtgcagcgaaggtggaggtgaacaaaatggagcactacgggtacgcgtacccagctccccatatgtactggcacggtcacggtggatacgcacctggtgaaagtagtagtagtagcagcagcagcaacaacagctatgaggtagaggttcaatcagggtattcgtattcgaatcaaggttatgatggtaattacgtgaattacccttaccagcatgggtataatgataattacatggcaatggcacaaccaccacccccgttctacttgaaccctcaccatcctcctccacagatgttcagcgatgagaatccgaatgcgtgttccgtgatgtga

SEQ ID NO: 108052 - DNA, 1476 bp, Glycine max
  Peptide Sequence Number=SeqID_224830
atggaagttatgactaggactagtggtgtagatggtggagaggcggaggtttcagggtctcctacagagaaggcaattctttcttgggcagtgaagttggggatgaattttgatcttattagatcaaattcaacaattctccacgtcttccccttcaattctgagaaaaagcgaggtggtcttgctctgaaactgccggactctgcagtacatatacattggaaaggagctgcagagatagttctaggaaaatgtactcaatatcttgattcagatggtcacttgaaatctattgaagaagagaaggtattcttcaagaacgctatcgaagacatggctgctcagagcttgcgttgtgttgccattgcatacagatcgtatgatttagacaaaattccatctaatgaggaggaattagaccagtggtgcttacctgaacacgagcttgtcttgcttgctattgttggaataaaggatccttgtcgccctggagtcaaggatgctgtgaaagtatgcactgaagctggtgttaaggtacggatggttacgggtgacaatcttcaaacagcaaaagcaatagctttagagtgtggaatactgatgtcaactgaagatgctgttgagccaaatataattgaaggaaagacatttcgtgaactatctgaaaaagaaagggaacaagttgcgaaaaagataacagttatggggaggtcttctcctactgacaagctgttgatcgtgcaagcactacgtacaggtggtgaagttgttgccgtcacaggagatggcaccaatgatgctcctgcacttcatgaggcagatattggtctttctatgggcatccaaggaacagaagttgcaaaagaaagttcagatattataatcttggatgataactttgcatcagtagtaaaggttcttgctggcctacgacttattagagttgttcgctggggccgttctgtatatgcaaatattcagaaatttattcagttccaactcactgttaatgttgctgctcttgtaataaatgtagtggcagcaatatcttctggtgatgttcctttaaatgctgtacagcttttgtgggtcaaccttatcatggacacacttggggctcttgcactggctacggaaccgccaacagacaaccttatgcacagatcaccagttggccgaagggaaccccttataacaaatgtcatgtggaggaacttgatcgtacaggctctctatcaagtcatcgtccttctcgttcttaacttcggcggtgaaagtattctacgtaataatcaggattctatagcccataccatacaagtgaagaatactttaattttcaatgcattcgtcttttgtcaaatattcaacgagttcaatgctcgaaaaccagaagagatgaatgtcttccggggagtgactaagaaccgtctcttcatgggaattgttggaatgaccttcgtgcttcaggtgtga

SEQ ID NO: 108053 - DNA, 174 bp, Glycine max
  Peptide Sequence Number=SeqID_224831
atggaaggaacgcttataaagagtcaagggagtgagaatgagtcacactcatgtacatgtggtatggaagtgactgatttgcccttggctttgcggtgtaacgggaataaagttagtaaccttttgcggacgcagatcttgagaaaaggagtagctggtgcagtacccaattaa

SEQ ID NO: 108054 - DNA, 1416 bp, Glycine max
  Peptide Sequence Number=SeqID_224832
atggcctccacctcgcgtggttccacctcctcctccaatggccttctcaccgtcaccattgccggcagcagcagcagccactctgacgaccccaccaccaacgacagcgacaacgatgaagacgaattgctcgttgatcctaacgatcctttcgatattacgcataccaaaaatgcaccgcccgagtccctcaagcgttggcgacaagcagctttcgtcctcaatgcgtccaggcgttttagatacactcttgacttgaaaaaggaagaggagaaagagcaaaagaaaagcatgattagatcccacgcacaagtcatcagagcagctttgcttttcagattggctggtgaacgggaactagtgacaagttcagcagcagtggcatccccatctccagttggtgagtatgcagttgggctcgaacaacttgtttcaatgactaagaatcagaatatttctgctttacaacaatatggaggggcaagcttatcaaatttactaaaatcaattccggataaggggattaatggagatgatgctgatctatcaaagaggaaaaatgcatttggaactaatacatatcctcggaaaaaggggagaagtttctggcttattagaatccctgaagacggaggtcaggaagctgtcagtgattatcggcaatctttgcagtttcagaacttaaatgctgagaaacaaaatataaaattggaggtcattagaggtggcagaacaatacaaatatcgatatttgatattgttgttggtgatttagtgccccttaaaataggagatcaggttcctgccgatggagttgtaatcactggtcactctcttgccattgatgaatcgagtatgactggtgaaagcaagattgaccaaaaaacaccttttttgatgtccggttgcaaagtagcagatggaattggtgctatgctggtaactggtgttggtataaatactgagtggggactgctgatggcaagtatctcagaggatactggagaagagactccattacaggttcgtttgaatggagtagcaacttttattggcatagttgggcttactgtagctgtttgtgtccttgcagtcctgttgggaagatacttctctggccattcgaaagatttagatggaaaagtacaatttgttgctggagagactagtattagcaaagcagtagatgggagccttgcaggtaacaattgtggtggttgcagtgcccgaaggtctacctttagcagttaccttaacgtgagaaggctgtccgcatgcgaaactatgggatctgctacaacaatttgcagtgataagacaggaactttgaccttaaatcaggtgggttctgtggccagagggttggatagtccaagaggagctatggccataatttacatttatgcatatgaataa

SEQ ID NO: 108055 - DNA, 1302 bp, Glycine max
  Peptide Sequence Number=SeqID_224833
atgagtggatacccaaaaccggcaactggcggtttagcaacaaacttaaccgtggcaatatcactggctctattgacgctggcggggagtgctatggcgcagaacactgaacatcatcaaacagcattagtcggcacctggaccagtattccggatgcccctgcggtacaaaagccggatcgacccagtgaaggtttgtatcgcatgcaggtcaacagcgacgggacgctcaagccgctggaggtgatcaggatgaaaagcccgtcgtggatcgttaaatcacgcgacgggcggtttgcttataccaccaatgaggaaaatgccggtgccgttaccgcgctggctatcgataaacagggcgcagtgcgggtgctgaatcaggtcgacagccacggcgagcagccaacgcacgccactctcagcccggacggcaaattcctgtttgtcgccaactattcggtggcgaaaggcggagcaggggtaacggtgttcccgattgcgtcggacggcaagctgggcgaacaggtgcagcatttcgcgttcagcgaaggcagcggggtggtaaaagatcggcaggatggcggccatgcgcactccaccacctttacccatgatggccgctatctgtatgcggccgatctcggtgacgataaactgcacgcctatcgctaccacgcggatcggcgagagccgctgcaggcggataccagccgtgatgtgagctttgcgccaggtgcgggtccgcgccacatggtgttctccgccgacggtaaacacgcttatgtgattactgaaatggcgggcgaaatcgtggtgttccgcgtcactgatgaccggctggaacggcaggcacaggtggcgctgaatacgcaaaacagcagcgccgcctgtaaaagcggcggcggcatcattctcagcccgcagggtaaattcctgattgccgctaaccgcggatctgacaatcatctgctggtgtttaagattgccgccgatggcagcctgacagatccacagcgctatgccgccgacggtattgagccgcgcgcgctggcgtttgataacagcggtaaacacctctatgtcaccaacgtgtttaccaataccattacgctgtttgattttgatgcgcacagcggcaagctgagcgcgcgcggtgtggcggcgaagctggcaacgccaaccgacatcaattcttcaactaactgccctttcactcatccggtgcgcgtgacggcgcaccgtcttccgccatggccgacagcgcgctttccagcgaagcctgaaacatctggccgtgactga

SEQ ID NO: 108056 - DNA, 705 bp, Glycine max
  Peptide Sequence Number=SeqID_224834
atgatcgaccagcagattcgcgccagcttcccggacgacggttttcttggcgaggagtacggcctgcaaccgggcacgtcaggctatacctgggtggtcgatccgattgacggcaccagcccgttcctcaacggtatgccaaactggtgtgtttccgttgcggtgctgcatgacggcgtaccggtgattggcgtgatctttgcgccgacctatcaggagtgctacgtcgccgcgctcggccagggcgcaacgctgaatggccgccgtttgcaggtggatccgtcacgtacgctgcaaaatcacgtgaccggctttggcgctaatagctatgtcagcccggaagaggtgggccgcctgctggcgtcactgctggcagcgggtggcaactttatccgtatcggatctggtgcgctgatgctggcatgggtggcagccggacgcgtggtgggctatttcgaaccctatatgcacgcgtgggattgcctggccggttactgtctggtgaaagaggccggcggctggtatcacccgtttaacaccgagggcgatcggctgttaaaaggcgcgcaggtgctggcggtggcgccgggtgcgcaggcagagctgagggcggattgcccggcgtttaagtggtgcatttcacggccgcgcggcgttttccgggtcgccatccatggcgaccttacaacgcttgcgctgtcgtaa

SEQ ID NO: 108057 - DNA, 567 bp, Glycine max
  Peptide Sequence Number=SeqID_224835
atgctgacgctggcgatgcagcgcggttatctgcacggtttctggctgggcatgggcacctgcgtgggcgatttaatttacgccttgctggcgatggctggcatggcggtgatactgcagtttacgccggtgcgctggttgctatggattggcggcggcatcttgctgctgtggtttgccgctaaaatgctttacgccgcgctggccaaaaaaatcgacattcccacggctgaaacccagccttatcgttcactgctgcgcgaatttcggcgcggcattgtgctggcgatgtcgtcaccgacggcgattctgtggttcgccagcgtgggcggcgcgctgatagcccgcatcggccacagcgatgccgctgcaacctcatggtttctcagcggatttttcctcgccggggtggtgtggacctgtgtgatctgcctgatcggcagcatgggcggaaagctgttaggcgagcgcctgctgaagtattcgtatctcgcctcagcgctgattttctgttatttcgcggtgtatgtgatttggtcgggataccgcgagttcgtggcggtttaa

SEQ ID NO: 108058 - DNA, 435 bp, Glycine max
  Peptide Sequence Number=SeqID_224836
atggttagtaccagaggattaggtcgtgacttaagtcacgttactggcagaggtgtgggcagaggagatcgtgatgatttcgatgatgctctgcagcatcgatggcctaccgcatccactcgcaggcaacgagtacctgtcactactgtgcataatgagccagtggtccctgtggcagaggctgacggagcttcgattgaggctaacgtatatgcggatgagccaatggcaggaggtgacgtacaggacactggggcagacatttctgcagacacaggtgcacaagctgctgaggatgagcctaagggattttcgggtggtccgagcgacccatccgtgttgatcgggtatgcggatcacattgcaggcaacatatggatgggagaggagcatcctgagttgaagttatcctctcatggggaggaaggtccatag

SEQ ID NO: 108059 - DNA, 408 bp, Glycine max
  Peptide Sequence Number=SeqID_224837
atgatgtccttaagccagatgcagtcccaatttcaatcgcagatgcaatcacagggactcgcactgcctcctaagctagaggttggtccttctgcttctcatgttagcacaaaggagaattgtgttgatcccttagagaacgacccagacatgggtgactcaaagaaatgcgggttttacatcgaagaaaatcctccccatctggtttccctaggaagactttatgaggggtccacaaccattcacaacatgcctttgcaccatgatcaactcaaggttggtgttgatgaggttaaagatgcaaatgctcccgttcctatacccactgacgaggaagttgtgggaccagcaaaacctgcagataggccggattatgaggtggatgatcccctatatttgatgacatga

SEQ ID NO: 108060 - DNA, 201 bp, Glycine max
  Peptide Sequence Number=SeqID_224838
atgggaggatattcagccgacaaggacagtgtcgatgacactgtatgcaaaaagtacgacattggcaaggagaagtggacccaattttttcagattcgcaaagacccttcgtgggagtatgtgcgaaagaaggcacaggtcattcagaaacaaaacattgcccctcaagtgttgtctcttgggggttatgagtttcgttaa

SEQ ID NO: 108061 - DNA, 594 bp, Glycine max
  Peptide Sequence Number=SeqID_224839
ggtatttccgcccgtcagcgtgactcaaaagtcagtatgacagatcttgtgagcgcggaagatgacgctttttcgtcttacagacagctaaaagtttatacggataaccactcgggtatttccgcccgtcagcgtgactcaaaagtcagtatgacagatcttgtgagcgcggaagatgacgtcgcagaagacgacgttagtctctatgtgctaacaggcttttcgtcttacagacagcaaaaagtttatacggataaccactcgggtatttccgcccgtcagcgtgactcaaaagtcagtatgacacatcttgtgagcgtggaagatgacggcgcagaagacgacattagtctctgcgtgctatcaggcttttcgtcttacagacagcaaaaagtttatacggataaccactcgggtatttccgcccgtcagcgtgactcaaaagtaagagtgacagatcttgtgagcgcggaagatgacggcgcagaagacgacattagtctctgcgtgctatcaggcttttcgtcttacagacagcaaaaagtttatacggataaccactcgggtatttccgcccgtcagcgtgactcaaaa

SEQ ID NO: 108062 - DNA, 648 bp, Glycine max
  Peptide Sequence Number=SeqID_224840
atgttagaagtgctcatagataacaagcttgaaccatacttgctccctgtagtccctgaagagatcaaagtagaagccttcacagtgtatgattactatcacctctatcctaaattcttggatattgttttgccttatattagggaagggaagataacatacgttgaagacatagctaagggtcttaagaacgatccagctacaccagaagcaatgttcaaaggccgtagtgctggcaaacaagaacggtcccagagaactgttgaaagagttcatcttctgaaagtcctagagacacgtaagtcagcattgcagaaaagcaaggcatggcatttgctcgtgctgttactgctgtgttgggttcctcacccatcaacctatggcctggacaatcttgcttatgctattttttgttacatgtcagggatgcacgcacaaaattcaggaatctttggagaagaaaacatgaaactggataatggcttgaaattgaagctgctgaaacggtgtccaatcgctcagacttggagatggaagaaattaatgattctgagcagcttgatcaaattcttgttcatgcctagcaaaagtcacagcctatcctcattgattggttggtacttctctctctctccatcttttgaataa

SEQ ID NO: 108063 - DNA, 351 bp, Glycine max
  Peptide Sequence Number=SeqID_224841
atggtgcttcaggaggcggagtgtgaagttgcgcctctccttaagctagtcctgcatagtgtccatgtggtgcatctagacgatgcggtggccgcggaaggcgtcgtggacggtgtggttcaacccaacgagaaagtagatcttgcagagattcgtatagagaatgagacaatgagagaagctgcaatggaagagcgttatggagaacggttaaagatatggcttgttgctcatatttggaggagaagattggcggcgacattggcgatttttaagaagcgatgtttggcaatccgaagtttgcaacagattctgaaacctcgctctcactggaaactcgccaatttttaa

SEQ ID NO: 108064 - DNA, 645 bp, Glycine max
  Peptide Sequence Number=SeqID_224842
gactacacgtcctcgccattagagggctacacgccctcgcctttgtagggctacacgccctcaccttcagagggttacacaccctcatcttcagaggactatacgtcctccccttgagaggactacacgtcctcgcctttggagggttacacgccctcaccttcagagggctgcacgccctcaccttcagagcactacacgtcctcgccatcagaggactacacgtcctcgccatcagaggactacacgtcctcgccttcagagggctacatgccctcgtcctcagaggactacacgtcctcgccaacagaggactacatgtcctcaccttcagagggccacacgtcctcacttttagaggactagacgtcctcgccgtcgaagggctacacgccctagtcctcagaggactacacgtcctcgccaacagaggactagatgtcctcaccttcagagggccacacgtcctcacctttagaggactagacgtcatcgccttcagaaggctgcacgccctaagcttcagagggctggacaccctcgccacccttggaaacaacaagttgggtggtaaacgcgcagagacagattctgtgccctttatcattcaggagcagcgagtcgagtggaacaacaagttgggtg

SEQ ID NO: 108065 - DNA, 198 bp, Glycine max
  Peptide Sequence Number=SeqID_224843
atggaggtgagaggaggaagggcaagggcaagaagggttccgagtagaaatagagacgttgaagaacaagttccacaaaatcttgaacctaccaagtgtgatggttgggattggtatgagtgggatcatttgccacaccctttggttgggcctcttgagaaaatggtcaaaggagctttcgacccatttccaatttga

SEQ ID NO: 108066 - DNA, 816 bp, Glycine max
  Peptide Sequence Number=SeqID_224844
atggattttgacaaaaccgatgttaaaaactgcactgctgaagctaccgctgtcgttgaagctgcaactaccacaagcgagttcatctctgctgcgattaaaaaacactccacaacagattacagtgtcaatacccttgtagaggcactgatgctctgttttagggctaaagatacaatagaaaacaaagcattggaagagattggaggcacccaattgtttatgcttaatgaagagggcttgagtctattttcaagtagcaggtgggctttatatcagttgccaaaagttgttcgacttaggaataagctttggtggttcttgccttggcaccttaaacatattcctgcagggttgctcattggaatcagccttatcactttgtctttcaaaaacttgtccctcaactttcaattccaccaactcttccttccatcattgtctcctcattctgatcccattctcatctcagcgttaaataatcaaacgaaagtcaccatccattccatcttgaggccaaccaaagcggctatgcatgacatgacagaggaagagttgttgtggagagcttctatggttcctatgattaaggaacttccttacaatcacaccccaaaggttgcattcatgtttttgacaaaagggtttgtccttttggctccactatgggagagattcttcaaaggaaatgaagccttctattccatctatgtccattcacttccttctttcaatgacactgtgtctcaaacttctgtgtttcatggccgtagaatacgcaaggtcactgcatgtgtctttttacttcctaattaa

SEQ ID NO: 108067 - DNA, 144 bp, Glycine max
  Peptide Sequence Number=SeqID_224845
atggatcctcagcctgagctagccagctacatatgtggagattgtggaatggagaatacgctgaagcccagtgacgttatacagtgtcgtgagtgcggttaccgtattctttacaagaagcgcactcgtcgcagtaagctttaa

SEQ ID NO: 108068 - DNA, 291 bp, Glycine max
  Peptide Sequence Number=SeqID_224846
atgtcttggctcttcaaatccaaccaccccgacccaaaatcttctaatctccatgactacaccattatccactcgtcttcgccaccacaagctgtcgccgattgccactgcatcaaggatgacaatgccgaatcaaaggaacccttttcacaaaatgccttgatgatggtgttctacgttgggaggtccctgaaaagctcttggacgatgtcgtatttgtgggagtggaggtatgcggccaagagggcgttaagggagagaacgatgcaaatttgggcccctaaaagctga

SEQ ID NO: 108069 - DNA, 240 bp, Glycine max
  Peptide Sequence Number=SeqID_224847
atgggaataagtgggaaaaagaggaacataggctcaaaggggctatcaaaggaaataattcaaggtaggctcatttggctagaggcttataagaacaaaatgcctaaattatctgccaacatgcatgggaagcaagaagtatcaacaagagtcaagccaaggctattgtgcaagcaatcaatggggcaaaacacaccgaataaaatagatgatgatggctcaaattctcactatgggtaa

SEQ ID NO: 108070 - DNA, 666 bp, Glycine max
  Peptide Sequence Number=SeqID_224848
ttaatgttgaggactacttagattgggaaatgaaggttgagcaattctttgcttgccatcatattagagaagagagaaaagttccattggctacccttagctttcaagggtatgccctctattggtggacttcccttgttagggaacaaaggattcatggggatcctctagtagagtattggaatgatcttaagagtgcccttaggaagaggcacattccctcttactatgaaagggaacttatggacaagctccaaaggcttagacaagggactggacttgtagaaggaagcttcatgatgatgaaccaagaaatttcgatgatgccaaaagtccaagtgattgattcaagacttcaagatcatgatccaagaatccaatccaagattcaagattctagagaagaaatcaagaagcaacaagtcaagacttcatataggataaggtacattctttgtgatacaagtagagggtacatctacttgggttgtaatactgagaacaagagagggtacatctcttgtgcatcagttcaagtggagggtacatccacttggttgttcaaagagaacaagggagggtacatcccttgtggatctttgcttgtaaaggatttcacaagcttattggaaatctcaagaaccggtggttgcttggggactggat

SEQ ID NO: 108071 - DNA, 129 bp, Glycine max
  misc_feature (61)..(61): n is a, c, g, or t
  Peptide Sequence Number=SeqID_224849
atgagtgagataggaagatttggaggtttgggaatggaggaacgtcgcaaggaggaagggnctgcgcagggatttatggaaaatgtgatatttataaagcaggacacgtggccatctgttctattgtaa

SEQ ID NO: 108072 - DNA, 223 bp, Glycine max
  Peptide Sequence Number=SeqID_224850
tagcgcacggatcatctactgtttacccactctttgtgtatggttgtgccatatcctgaattcgtccggggaccattcgttgttgggatgtgaccctcgtttgaccacttcgaggggtcgtgcaaatagcaacaggcccatttgggccttccaggatgctctccagaaggcggtgccttctggaggaagcaccctagctcgcctgggtgagctgggtggcaag

SEQ ID NO: 108073 - DNA, 712 bp, Glycine max
  Peptide Sequence Number=SeqID_224851
atgggtcaacttcaacggcaagccttccgcaaagcctatggtaagatttgggacctagctagggtagaagtctccatggaaccgattgcatccctttcccagtattatgaccggcccctaaggtgcttcacatttgaggacttccagctagtaccgactgtgaaagagtttgaagaaatcctgggatgcccactgggaggaaggaagccatatcttttctctgggttctatccctccatgacaagagttgccaaggtagtgaaaatctcagcacaagagttgaaccaggcgaatgggctttcttttattgacatcttggcacttttgatctttggagttgtcctctttccgaataaggaagggttagtggacctagcagtgattgacgctttcctcgcctttcatcatggcaaggaaagcccagtcgacgccattttggccatgtatgacacattcgaccggggaggtgaaaagagtggcgcaagaattgtttgttgtgcactggctctctatgtatggctggtttcacacctttttctccaagaaggaaggaagaatcgggattctatcttcatacgaaggatgtgcaaaggttcccttgatggaacaaggggttgtattaattataatcccgtcctcgccataagacagcttggctacctcatgagaggagtgccatcagacgaaagcatcacgcctttcatcgcacggg

SEQ ID NO: 108074 - DNA, 159 bp, Glycine max
  Peptide Sequence Number=SeqID_224852
atgcggggtatcacacaagcgggaaaggaatggctagggcttcccaataaggaagggccacaaaataaggcccagtccaatacgcacgctgagcgcgcgttacgcgctaagcccatgatccaacagaagcacgcgctaagcctgcaatacgcgcgctaa

SEQ ID NO: 108075 - DNA, 483 bp, Glycine max
  Peptide Sequence Number=SeqID_224853
atggctttgctgaaggaccatctttgtttaataaaccctaaaattcgcacgatgtgttgctgtcgagacgcttggctacatttgggaaactgcatttggaaaaaaggaggcctaactgcagcaaagaacagtgtcggtcttgcattagacaaggttagcataaaggttatcccttttacaataattgaagttagttacgtgaggtttcaaacaattcagaccactaccttaagattgagaaatggaggtagcctaaatgcggtaaaggttatccctttaattgaagttagatacatgaggtttcaaactcttcagaccactaccttaagattgagaaatggaggtagcctaaatgcggtaaaggttatcccttttagaatacttcaagttagatacatgaggtttcgaactctgcaggccactaccttaagatgtgtatgtttagaggaaatgcttatgggtacaagtcaagtcacactatga

SEQ ID NO: 108076 - DNA, 120 bp, Glycine max
  Peptide Sequence Number=SeqID_224854
atgatgagaactgcttctcagaaatggggctacattcggatcatggctggtacaatctttggaggcatccttggattctatgtcatgcaccgccttgaaactaactacaaggtgtattaa

SEQ ID NO: 108077 - DNA, 282 bp, Glycine max
  Peptide Sequence Number=SeqID_224855
atgagcctttcatcttggcagaacaagctaaataggtgttttatgttgaagattttgttgatgaaaggtggtcagtggttctacaaggaaaaatcattggtctcaatgttgaagatgatgattcaacccttaataattgtcacactattttctctattaacatgcctaaggcacatggctacaccaccaagctcccctcctcctaagtcaacaccttcaccatctacacggaagaggactagaaaagctacacaactcaaatcactatttgttataccatga

SEQ ID NO: 108078 - DNA, 198 bp, Glycine max
  Peptide Sequence Number=SeqID_224856
atggtgaaggagtgggacttccagagctcgaatccatcgaggaggaacatcaagggaattgttgtcttcaatcaacaaactgaagctggagcggtaaaggctattgacgaaggcgcatttgggtgcagcggcggtggagaaggtgccgaaaatcgtggagatggcaaaatgaaaagtcacgagagaatggaagagtga

SEQ ID NO: 108079 - DNA, 219 bp, Glycine max
  Peptide Sequence Number=SeqID_224857
atgaagaaattgatgcagaattcacagagagatgtctacctaggagcttacttgaatagtgctttaaagggattcaaggatattcaaggaagtaaatccaaggcaattgctaaatgtattgcagctaaatgtaataagcaaaaaggaagcactgagtgtggctcctatatgatgcattggatgtcaacgatagtcctaggaggtttcaaggatatttga

SEQ ID NO: 108080 - DNA, 189 bp, Glycine max
  Peptide Sequence Number=SeqID_224858
atgatgatcgagaactttcgttcatgggagcagatgagtagtagtaggtgtcttggagagaagtcttttgttggagccgccaacccaacggtcattgactttgctacatatgacattgaagaaaaagcacaggcgagttatgacatgcttgactttgttaggaaagatgtctcgcgtcgctatggctaa

SEQ ID NO: 108081 - DNA, 189 bp, Glycine max
  Peptide Sequence Number=SeqID_224859
atggcggtcactggtggtcgtgggtggtggaggaggaggtttgtcatgttagactcgctcaggaaaaattttgctcatccgggtgagctggcccaactcagactcacttatgcgagttctgggcgaattcctactccaacatatttcatttcttatgtgaaaatttcaagctccagatgttatttctga

SEQ ID NO: 108082 - DNA, 408 bp, Glycine max
  Peptide Sequence Number=SeqID_224860
atggaaagggggtcccaaactaaattggttgatgtagaaatgggagatcgattagaggatatgattcatgatcttggacaagagccttttcaacaagcacatgcccttatacaacaaggaaatgacatcaatgtttatcttggtcccttgatggaagacttgacaaagttgtgggacgagggggttgaactgcttgatggtgtgatcgacacgcttcttaacattcaaggaaagacaaaggatggtttcaatactcgtcaagatctagctgagatgggcctaggatcttcttcatcaatggattcctttgcttcttggaagatgaatggcagtggaatggagaaggaagagagagaggagacgccacttcaaggagaagatgagtctagaagaagctcaccaccatag

SEQ ID NO: 108083 - DNA, 597 bp, Glycine max
  Peptide Sequence Number=SeqID_224861
atggcaatatatgaactggatcccgatgttgtttgctggggtcttcatctcctagatgattgcacactttcccaccattattcgcctagtattgtaactcaatatgatcctgatttaagtcaagttgaatatgttacagaaggcttttgtcagcatcagtatgtggatagtgacgaggctgttgcacaagcttatcaagaagaattatggcaacttgtttctatggtagcttctgggaatgataactttggtgagtcccataatatgaaagaagtggggaattatggtccaactccaagtgaaagaaaaaatggtgtgcatgaaaataatgtttgtggttcgtcttctggatcagtagaggtacctactacttctactagtgatgacttctgggattcattggaaatatcggatgaatctctagatggtgaagttggcaaaagattaaaccaaatggttcccattcctgctatgcgacttgttgttcattttcccctatggttcctttttctccaattttcaacaaataaattcaagggaaatgaaacaccggaaagcgtatcgggtcgtcaagtatttaaaattaaaacagtgtga

SEQ ID NO: 108084 - DNA, 1275 bp, Glycine max
  Peptide Sequence Number=SeqID_224862
atggcacattctccagacaagataaagaacatcgatggctcaaaagaaactcttaaacttgctgtgaggatcactgatctatggccattatgttgtaactttaacggaatccagggtgatgagatccatgttgtttgtaaacaagaccaactgaagtctaggaagatggacttgaaggaaaattgtacttatgtcatgcataattttaaaatgataaaaaacaacggcagtggatttgcggatgttgtggctggccagtttgaaccaggcctattggttgatgttattggtgttgtggaggaggttgtctttcaccatgtttcaggaaaaggtagaagggtagtctttaaactaaaggacttgagccaacaatttttatcttgcactttgtgggacgattattgcttgcagtttttaaaattcttagatgatcatgaaggtcatggcccaattacagttctattgacccatggtagaataaaggaagctcagggatcttatccgccatcggtcaacaattctttcaaggcttcaaagttagttattaaccaacctgtgatggagattcaagaattcaatgaatggcttgtagagttgggcactcaggcccggtcagtttttaaattccatggtgaaggcagttcacaagtttcaggttctatccaattatcatcaaaggaatcattctttggaaaggttaaggaagttgtttgtgtaactgttggcacaattactaggattgttatggacaatcattcatggtgttatacaacttgcattcagtgccataaaaaaagtgatgcagagatggcgcccttcacatgtgcatgtggcaaatacaataaggaagttgtgcttaggtataggcttgaggtgatgatcaaccacagagatgaaagcacaaaattcctgctttgggactgtgaatgcactgaattaattgttcaatcagctgatgcagttaataggcttaaaattgaagatggtgatgttgatttaaatgcttcacccgaagcacttgataagttgttgggttatgtacttgcttttaagataaaggtgcaacccaagttcaggaattctactgttttgaaatgttcaactgactcaagcttaataaatgctgtgatggatatgctagctgatgctgagcaatccatgtctgtgacagcagaccatgatccactgtttaggctcccattgacacctacaaagcggcaggcatttcaagattgtgatgatgaagcagggagctctcaaatttcacctgcatag

SEQ ID NO: 108085 - DNA, 471 bp, Glycine max
  Peptide Sequence Number=SeqID_224863
atggaaatgccccaaaataacatgcttgtggttgagatgtttgatatgtgggggatagacttcatgggtccattcctcaaatcttttggtaatgaatatatacttgttgtggtggattacatgtctaagagggaaaaagcagtagcactccccattaatgattctctggtggtgactcaaaagcttgcaaccccatatcacccacaaactagtggccaagtagaattgtccaatagcgagttaaaaataattcttgaaaaaacagttagtgcatctaggaaagattgggcaattaaactagatgatgcactttgggcttataggacaacatttaaaactctcattgagctagagcataaagcttgttgggctcttaagtttcttaactttaatcctaagcttgaagcatatgagaatgccaagatctacaaggagaaaacaaagagatggcatgatgctaggataagatag

SEQ ID NO: 108086 - DNA, 189 bp, Glycine max
  Peptide Sequence Number=SeqID_224864
atgccaacgtcatcacgtcagctcggcagctcctcaccaaaatcttactccctgcaccctgctgctgtcattctgctcccacaaacaatgttcgtgatcatcacaggaaatagcctaagcgtgtccacacgaaactctcacttagggaaccatgcagagttcatcgagaccacccggttgtgcatgtaa

SEQ ID NO: 108087 - DNA, 156 bp, Glycine max
  Peptide Sequence Number=SeqID_224865
atgtcgatatcccggatgatagcccaattgacatcaatgaaaatgagttgccaatcaataaaccttaacgatgttcatgatgaaaacggacacctcagactggaggtactaggaattatattggatggttctgctcattctactagtgtcagacag

SEQ ID NO: 108088 - DNA, 387 bp, Glycine max
  Peptide Sequence Number=SeqID_224866
atgggttttcctttgccgagagtcacttatcttgccgaaaatttatctggtcaaggttcaaaaaagtctaaggttgtgtcgcaatggggtcttttatcgcgggagcccgatcttgatatctgggacaaaacaaattcgtgcgtcaaggtgtcggtctcgggccgaacttccatattattccacaaggtacgctcaacaatgatgatttggaaacaacgtgcaaaattagtcatggccacagccaggtgggcactcaagcatcctgttcatggcattgtgatactacggttgggaatttacacaaacagacccaacgaaacaaaaattatgttctttcatcagttcaacgaattcatccattcttatctcggttattcaggaaaataa

SEQ ID NO: 108089 - DNA, 868 bp, Glycine max
  Peptide Sequence Number=SeqID_224867
atgaaggttatgcagaaatcctctttagcgggaagacaatcacaaaatctggagataggggacaacaacaaacactatcgccttaactggaggaacaatgccgacattacctccttttatttcacccatttccccgacgaagctaatgaagagttgctatggaggcacttcaaaaactggggtgacgtacgtgaagtatacatcgctaaaaggctcaacaaggatggcaggagatacgggttcatgcggttcaagggagtctcggatgcaaaaggattggagaaaaagaaccccattaggaggaagtacaccgacgaagcaagtaagccctgcgggataactactggtgctcttcggagatcatatgtggacgtgatgactaagggggggggggggtgcccaggagaccaaagggcagacgaagcacaaacaccaactattctgatcaacccagatgaaggtggggaatattggtgtaacgaaacctgggtgggcatgctaaagaaggtgatggaggtggaaaccttagaggatcgtatcacttgggagttaggatataacgtccgcactaagttcctcggagacgacatggttcttctccctgggatgtccgatgacaaagctcaactcctcattcaatcagagacggaaagcgatgattctctcttttactcactggagaagagggatgttgctgctattggggatgtcctcgagtccgacgatgacaccgaggacccgcgacgattggaccgggctcgagtattggtgcggacaccggttccgccgttgataaggtccgaggtcatcgtccgtgttggggagcttgagtatcgggtatggattgtggaagagaccgggttcgaag

SEQ ID NO: 108090 - DNA, 543 bp, Glycine max
  Peptide Sequence Number=SeqID_224868
atgcttatgtctccaagtgccaggatgcccagctatgggggagctcctggctggggttgttgtacccctatccaagaacaacccactcatgaagtcaattacatgggaaatcaacccgtaaacaattttaatgcaggaggattttctggattccaacatggccaacaatacaatcaacaacagggacaatggaggaaccaccctggaaatcaattcaatagagatcaaggtggaccatccacaaggctacagcaactagggcctagtatctatgatcacacaacaaagctggaagagactctagctcagttcatgcaggtttctatgtctaaccagaagagcatagagtttgccataaagaatctggaggtccaagtgggacagcttgcaaagcaattggcggatagatcatcaagcagttttatagctaatacagagaaaaatcccatggaggagtgtaaagctatgatgactagaagcaaaaaggcaatccatgtggatgaaagtgaagctgagaagaagatggaggaacataaaaaatag

SEQ ID NO: 108091 - DNA, 329 bp, Glycine max
  Peptide Sequence Number=SeqID_224869
aagtactgtacccagagacaggctcagggtgatgctccacaggccacaggcgcgccaccaccgcctcatcaggctggccaggctggggcatttgacatggagcagtatttacggcatttggttcgccagcaggcggccaaccaccgagcacataccagttcagggcagaggttgcatggcccggagattggcccgaggcccaagcgggagaggcgcccccagaagctcctggcgatggagaataggcccacgaggacgaggagatggccgatttgcttgacttcttgggagggagtggagatacgtgactgggagatccccagattcat

SEQ ID NO: 108092 - DNA, 150 bp, Glycine max
  Peptide Sequence Number=SeqID_224870
atgtggaatggaagtatagcacatgtgttaggagaaggtcaagtaaagctagagctatcttcagagaattttcatgttttacatggagtctatcatatttctgatattaggaaaaatttagctacatttgtgatggcttgtttaagttaa

SEQ ID NO: 108093 - DNA, 267 bp, Glycine max
  Peptide Sequence Number=SeqID_224871
atgctccaaccatgtgggatcggcacaggcttaaaggagcactcaaactgggtgacccccaagacctacactctgaagagttcgttagggcctctccctcctgattcagcttacaacacaagtaatgtcacatcaagagttaaccacacagttattcacaagcaaaactcattcacaattccacatctcatagtgtcacaatccaccatcacatgtctacacgtatctcacaaattaacacatgttcaactttgcacttatacttaa

SEQ ID NO: 108094 - DNA, 147 bp, Glycine max
  Peptide Sequence Number=SeqID_224872
atggcaaaagtgcatttaatcgcaatgccttatgcatgcgatatcttacaagatgtgcccagtcaagttgatggccgaaaaatcaaacttccaatcgtcattcagtgtaccttcaaatggtacaccgtcactggacaattgggttaa

SEQ ID NO: 108095 - DNA, 255 bp, Glycine max
  Peptide Sequence Number=SeqID_224873
atgttttgcaagatcaaaagtgggagtctgtaccctggaaaaagttgcaggttggagacattgtcaaggttaagcaggatgcatttcttggctagcactaatgcagatggtgtctgttacattgagattaggacagcattggaaaagacttgggattacgcgactccagagaaggcatctgagtttaaagttactgtaacctttagagtgtgtttggatgaggaaattttgagaatttcaaatttttcaatttaa

SEQ ID NO: 108096 - DNA, 1189 bp, Glycine max
  Peptide Sequence Number=SeqID_224874
gcagttcgccgcgttcctcaacgccgacgccaacgatcgcgctgaactgttggaagagctgaccggcaccgaaatctacgggcggttgtccgaacaggtgttcgaatcgcacaagcaggccaaaaccgacctggatgggttgcaccagcgcgccagcggcatcgagctgctgaacgatgaacagcgccactccttgactgaacagctgacggcgctgagcgcgcaggaaagcgccctcggtaagcaaactcagcaacagcaacaggcgctgagctggctgcagcaatggcaacgcctccagcaacagcaaaacgagggtcaacggcggctggaaaccgcccagcgcgagcagacggaggccgccccgcagctgcagcggctggcgctcagcgaaccggccgagaaattgcggccgctgcgcggtgaacgcgatcgctgccgcgccgagctgcagacgatacaacagcaggcagcccagctgacgcagcaacaggaacagcactcggcgcagctggcgccactgcagcaggcggtggaaaaggcccgtctggcgcagcaagcccatgccgagcatatgcggcagcagcaacagctgatcgatgaccaggtcgccccgctcgaccaccaaatagcccaactgcagtcgacgcaggccgagcggcgacaggccggcgatgccgccgcgcagcagtgtgccaaacagaaaaccacgctggagcagctcaccgccgagcgcagccaactgacggcgcaggccgcacagcatcagcagcggttgaacgcgctgaccgaagcgctggccgttcagcagcaacagcagcaggcgctggcggcgcaaacgccgctggccccgctgcgccagcgcctgagcgccctggcggatctgcgcccgacgcgccagcagttatttacgctcgcctctttatcgcaacaagttgttaaacggctggaacagcagcggcaagagctaaacatcggtcaaaatgaactgacccagttggagccacagttagagctcatccgtcagcaatttaagcagcagaaagcccaccaggccgatgttgaaaaaacctatgcgctggaacaacggatcgtgggtctggaagccgagcgcgcccgtttgcaacccggcgccccctgcccgctgtgcggctcatgcgagcacccggcggtagaacaataccaagag

SEQ ID NO: 108097 - DNA, 162 bp, Glycine max
  Peptide Sequence Number=SeqID_224875
atgatgcaggggagtagtacacatgcagcagaaagcaaaagaatgcttagagatgaaaagatggagaggtttgggtgcaaagtgagtgattcaggcttagcgccactacctgtgctaagcgcacttccaatgattgtaaaacaaaatgatgttggcgcttag

SEQ ID NO: 108098 - DNA, 751 bp, Glycine max
  Peptide Sequence Number=SeqID_224876
atggcatttgaatgccctaatggtgctgaggtttctcaaagtttagcacactttgtggcaaatccaggcataggcatagttgaatctaatctccagctttgtcccaaatccttcactgaaggaatagcaacctcaaaatttgtgcctgataccaaacctgaatctgggaagggtgtgaagttaaagggagcatccaagattaattccaagaaaggcatcaaagcccctgtcagtgctttgaaccagtcctcaatacctggtgatgtggttttcaattgtggtttgtccatcaccgaccttccaccggcattgatatccgagattctcaattgccttgatcccaaggatcttggtgttgtttcgtgtgtctccccgattttacaaagagttgcgtccgagcaccatgcttggaagcaattctattgtgaaaggtggggacttccggcagcttccttggctgtgggttcaggtgttgtggatgatgacaagtcatggagggaacttttcgtggaaagggagtttaggagtaagacttttatgggacaatatagtattgatgtgctgtatggacatactgaagcagttcggactattttcctattggcttctgcgaagctcatatttacctctgggtatgactctgtggtgagaatgtgggacatggagaatgggttgtcaattgcatcatcacgacccctaggctgcaccatccgtgccgttgctgcagacagaaaactattggttgctggtg

SEQ ID NO: 108099 - DNA, 789 bp, Glycine max
  Peptide Sequence Number=SeqID_224877
gagttcgatgagttcaaagtggagttagagaggcgtaatctacacaaacgcctcaccaacctccaagatggaagcatagacgtggttgtggttaaggaattctatgctaatttatacaccacagaggaccaagctccaaagcaagccagagtaagagagcacctgatcaaaatagatgcagacagcctgaatgagtttcttcatattccagtggtattagaggaggaggaatctttacccaccaactctagattttgtaggttgaggtccaatcctcaagagattgaagccaaactctatattccccgcaaggggtttattttgaatgctgagggccaaccatggaaactccttagaaaggatctgactacactggcccagacatggagtgtcttctcttactccaacttagctcccacatcccacacctcagatttgaacatggacaaagccaggttggtttatggcttggtaacccacgtggatatgaacattggcgcactgatctcaagtcaaatctctgctattgctcagagtaactcctctaggctaggatttccagccttgatcattgcactttgtagagctagaggagttacctttggcagtctgacttatgagagcctgagcccaaccattaacttggcctacattaagaaaaactgttggaatatggatgatctgacagttaacttcagaggggcaaggaaggcaagggctcggccagcttatgctccttcttcttctactccaccagctcctccaggcttatctgcccaagacttttag

SEQ ID NO: 108100 - DNA, 759 bp, Glycine max
  Peptide Sequence Number=SeqID_224878
atgaaggtagctctctctgtcaagaacaaaacggcgttcatcgacggcaccctctcgaagcctgaagaaaaagctcctacctatgctgcttggacatgtgcaaacaacattgtcatctcgtggctctacaattcggtatctaaagaaatcatcaccagcatcttgtttgtaaacactacgaaagaaatttgggacgacttgaaaactaggttttcaaggaaaaatggccctagaatcttccaattgaagtgccaattaatgcctttgcaacaaggaactaacgatatcagtatgtattacacaaaacttaagtcaatttgggaagaattggccggttacaaaccaacctttccatgcacttgcggaggtgttcaacaactccaaactcacaatgaatctaaggttactccagcagtattcataggatatcctcatggatataaaggctacaagctgttggatttgaccactctccaaactttcatatcgagggatccacatgccaattctagggttccaaattctcggagcttctgcaccatgtccttcgacagggactccatcgagtacgacatcatcagcgttggtgtcgatcccgccgacttatcgacggcgatacgactcaagcaaatgtgtcgtcaaagaaacactgatttgtctgtctgtgtcctcgagaaaggcatgatctggctaccctctcatgttctagacgaggcatatgactccaagatacatatccaaattcagattctgaagtga

SEQ ID NO: 108101 - DNA, 579 bp, Glycine max
  Peptide Sequence Number=SeqID_224879
atgtcatcaaagccttctaacattgttgtacaaaggaatcatcagaggaaagagaaggacacaatgatgagccttgatcatagtaagctaaaaagagaattgtccaatctctccaatgaagcctaccatgttgaatcttcttcaattccctttgtgtgggaatctcaaccaggaactccaaaggttagattcaaagaaaattctctccctcctctcacaccaccaccatcttatttccaaaatgctaccaaaaaagccactaccaaggccaagaataagaactcacctaaatctagcttcttgcaaactctattccccaaacgtgctactagaaaaggtggtgttcctccacaaactggatctcaaaatatttggtcttattcttctaattctccctcttcttcttcctcttcttcgtcatcatctttgtcattctcttcgccacggcctacgtcgtattcagtgccatcttctccgatgatacactcgcggaagggtgaagaagatgaagatctgtatgaggctcatagctgccttttctctatggttgttgttaataatgtgtggctagttggatag

SEQ ID NO: 108102 - DNA, 300 bp, Glycine max
  Peptide Sequence Number=SeqID_224880
atgtgtcctctcaggtttattctcatattcctgtcggcaacacttgccggcttcttggtccttagaaaccttagatctcaacctcacaccactgatgtcactgagttggaggacgcaaacagtgaaaatgaacacaccaccctaacctcagatgctgcttctccttccttaaaccatgcaaatgcaacttccaaggtttggggtgcattgctatctgggttctggaccttccttgacatggctagcggtcgctatctttggaagcacttggtctcatcctcttcaacgaagcctgaatga

SEQ ID NO: 108103 - DNA, 1359 bp, Glycine max
  Peptide Sequence Number=SeqID_224881
atgcaaaaatatgagttgggaaggttactaggccaaggcacatttgcaaaggtttactatgcacgtagcacaatcactaaccaaagtgtggctgttaaagtgattgacaaggataaggttataaaaaatgggcaagctgatcacattaaacgggaaatatcggttatgagactgattaagcatccaaatgttattgagctttttgaggttatggccaccaagagtaagatttactttgttatggaatatgctaaaggtggagagttgtttaagaaggtggccaaaggaaagctcaaagaagaagttgcacacaagtattttaggcagctagtgagtgcagtggatttttgtcacagtcgaggtgtataccatagagatataaagccagagaacattctgttggatgaaaatgagaatttgaaggtctcggatttcaggttaagtgcgttggccgagtccaaacggcaagatggcttgttgcacacaacttgtggaacaccagcctatgttgctcctgaggtcatcaaaaggaaaggttatgatggtgccaaagctgatatttggtcatgtggggtagttttgtttgtcttactggctggttactttccttttcatgaccctaatatgatggagatgtataggaagataagcaaggcagagtttaaatgtcctagttggttcccgcaaggtgttcagcggctattgcgcaagatgttggatccgaatccggaaactaggatttccatagataaggttaagcaatgttcttggtttaggaaggggccaaatggtagacagaaaacacaagaaggggaaaacctgtgtgtctctccttcagttacaaatcattctgaacaatgtggtgatgaaagtgatgatttagcagcagaagcaagggaagagcaagttgtgccagtaagtataaatgcctttgatataatctccctttcaccaggttttaatctttgtggattctttgaagacagtattcagaaaagggaagcaaggtttacttcaagacaaccggcatcagtcatcatctccaggctggaagaaatcgcaaagcagatgaggatgaaaataaagaaaagggctgcaggtttgttgaaattggagggccttcatgaaggtaggaaggggattttatccattgatacagagatctttgaggttactccacttttgcatttggtggaggtgaagaaatcaaatggagatacattggaatatgagaaaatactgaaggaggacattaggcctgctcttaaagacgttgtttgggtttggcaaggtgaccaacaagagcaatcacaacagttggagcaacagaagcagcaacaacaattaccacagtcataa

SEQ ID NO: 108104 - DNA, 311 bp, Glycine max
  Peptide Sequence Number=SeqID_224882
gcccaagacaaccaagaaatgacattgatgtttatcttagtcccttgattgaagagttgacaaagctatgggacgaaggggttgccgtgtttgacgggtatcgaaatgagacattcaagttgcgtgcaatgttattttgtaccattaatgactttccaacatatgagaatttgagtggatacaatgttaagggccattgtgcatgccctatttgtgaagaagacacaagctatgtacaactgaaacatggaagaaaaatagtgtacacttggcatcgacattttctgaaaccttatcacccttaccgctga

SEQ ID NO: 108105 - DNA, 963 bp, Glycine max
  Peptide Sequence Number=SeqID_224883
atgattgtgtataacctcatgtgcgagcaggccaagattttggccaacattctaaacaagagtgttctccacaaggcaggctcaaaaacaactctgtcagatcttcacaagttttttctttttcacttgatggagaatttgccatttgattttccttacaccatctacatcaacatcttgagaaacttgaaaggcttgggtggtctgaacatcatctattatgcttctctcatcaacatgatgctctgggaacaaagcatgtatcaggtcttcaacaagatggatgatgattctaagcacactctaatagccaagggtttagttgttgctaaaaaactaaaatttagcaaaactaacctaaaagatacaaaggttgctctagaacatagtgaaaaggatgctcctcaagtggacttgattgccataaacaagaggaagcagaaggggctagccaaagctattgctgatgaagatcagggtgtgaacaactttggtatttccaaaaatggacaaaagataatggctgagaaacaaaagaaaaataaaacaaggaagcattcccaaaaagaagaagaagaggaggataagatgaagaagagacatgagcagtccactgcgtccattcctgtgcatctagtagctggaacttcaatcctacaaaggttgaaggacttgagtaagatagatgaaaaagatgaaggatttgtacaagtttatttccataagagaaaaagttgtagccttgctttctcctgcccccataaagagtcacgaaagttcaaccaactccaaaaccaagagaatctgtcatttcgtctgcaataccaaggcatatcaagacaagggctactaaagccaatcctaagattggtgaaaaggagtgggcagtctgcttcacagggaacaaatgttggacaaatggcctcagttatcttaagaaggggtgaattaatttcccactaa

SEQ ID NO: 108106 - DNA, 105 bp, Glycine max
  Peptide Sequence Number=SeqID_224884
atgagctatacaggttcgctaagcgcaccgcttcatctcactaagcgcaccgcttcagttcatccgctaagcgagaaaggcaaggttaagccgaaactcactaat

SEQ ID NO: 108107 - DNA, 243 bp, Glycine max
  Peptide Sequence Number=SeqID_224885
atggcactttcttcttcatcatcttcaacatccatatttgctttagctttgttcactcttttgcttataggaagttcttcagctcaactctctgagaacttctatgatagtaaatgtcccaaggttttctatgccgtaaaatccgttcttcaatctgctttggctaaagaacctcgccagggagcatctatcgttcgcctcttctttcatgactgctttgtcaatgtaaattactactcctaa

SEQ ID NO: 108108 - DNA, 1143 bp, Glycine max
  Peptide Sequence Number=SeqID_224886
gctctgcagctgcacgccgatgccggccatgtagttcttgccgtcgatcgagtactggtcggcgagcgggcccgacgacgcccactcgtactcggagaggtcgacgagctcgggggcgagcttggtcgtcggcgcgatggactgcaccacatcgggtgcgtccccggcggcgagcaggcgggggacggcagcctcgacgccctcggcgcccgggttctggatgacgacgtcgatctcggggttcgcctcctcgaagggggcgacgaggtcgttccagaactcctccgtgaggttcggggtgacgttgacgagcatgcggacggtgacgtcctccgaggagtcaccgccgtctgcgggagtggtcgagcagccggcgagggcgagggcggagaccgccgcgatgccgacaagggggagaactcgggccttgatcatcgcgcggcggcgggcgcggtaggcggccacggcgttgcgattcgcgcaggtggtggagcagtagcgcttcgagcgggcgatcgcctgacaggtgtcgtcggcgcagacggtcagccgcgacccctcgtcgctgcggatcacgtcgatgagcgccatcgcggtctccacgagcacgcgctcggcgagcggtctgtcgtcggacacggcgtgcaggtgccagtcggcaccgtcgtgccgcaccagtcgcggcgccagccgcacctccgcgagggcgtcgttcacgtgtgccgccatctcgtcgcgcggggcgagcagcatcgtccgcaggcgggggcgcagcgtgcgcagttcgtcgagctcgaccgcgtcgtgatcgatccggccggtgtaggggaagacctcgaggaacgtcgtctcgtcggcccccgtgacgagggtgtcggggtcttcggcggagttcgccagccagacggccgcgcggagcgcgtcctcggtgtcatcggtgaagaccatgttgacagcttactccgctcccgcgtagcgtcatctttcatgagcactgtggccaatgacaggcccgtgcgtgcgggcgtcggcctcggactcccgctcgccgtcgccgccgcgttcgccttcgggtcctccggggcctgggcgcgcggcctcatcgacgcggggtggaccccgggggccgccgtcacggtgcgg

SEQ ID NO: 108109 - DNA, 345 bp, Glycine max
  Peptide Sequence Number=SeqID_224887
atggattgcaaaggtttggtggatcaagccttgggtggaaaaagtaacatgacaaagtgtgtgatattttcatctctacttcatcttctttactcttctattgttcatgtttttcaaagtaaagatggagactatcagacatggaaggttgttgaacctgttgatctatatgaagaagggtggaatattcaactcttggcccaatatctgttggaatggatgttggataagattgtcgcttatctagtccccaatcaacagaataggagggacaaacctatttggggacctagcccggatgggtgtttctatgctaaaacaacttatattgttttagcatcctag

SEQ ID NO: 108110 - DNA, 631 bp, Glycine max
  Peptide Sequence Number=SeqID_224888
atggcctctatctctgctccaacaagaacactcctcttcacccattcaaccaaacgcttcttccgtcccttcaaaccttcttcttctcctttccctcttcaatgcaccacaaaaaccacctgcagcaccctccaacaacaacaacaacctcgccgcaacaacaactacaacgtcatcggaatcctcgaagagcgcggtctggttgagtccatcaccagcgacgcgctccgcagcgcgtgcctgacaccggcacccctcaaggtctactgcggcttcgaccccaccgcggagtccctccacctcggcaacctcctcggcctcatcgtcctctcctggttccgctgctgcggccaccgcgctgtcgcgctcatcggcggcgccaccgcgctcgtcggcgacccctccgggaaatccctcgaaagacccgaacttgacgccgaaaccttggagaggaaccaattgggtatctcgaacaccattcatcagattctgggtcgcgctcaagattcaaacttggtcggtcctaattctaattctgattctaattctgattctaattcctctgttgtgattctgaacaactatgattggtggaaggagtttagtttgctggattttttgaaaagggtgg

SEQ ID NO: 108111 - DNA, 2439 bp, Glycine max
  Peptide Sequence Number=SeqID_224889
atgcagaagcatgactcccctgttggctatgtgtcagacctgaaaatcctgtttatagtgaaggtttcttctcttatcagccttgcttatagtaggagttggtcttctgcttcttcaagtggtgttatggagatatctttgttaaaggtgctatctgatgcgatatcctcattttcgcatttatcattttctgaaagaatgaagtcagaacctgtatcaaagtattaccaaaaggcagagaagatgcttaagttgttgaagccgattattgatactactgttttttctgatttagcttctaacaaattgcttagtaagctatttgaggaacttagtctagctgttgatgagttgagggagcttagtctgaactggcatccattatctagcataagaaatgttattcaagttgatcccttaatatcaacaattcaggatttgggactcagcattttacaacagctgaaggcttcacctcaaagtctccttgataatttacgagatgaagcatcatcaaccattaaaaaagctattatggaacaactggaaggtgtagggcccagtacagaggtcctggaaaacatcgccgagaatctgggtctaaggtctaatcaagaggccctgatagaggctgtagcccttgataagttgaaggagaatgctgaacaacttgaaaatgctgtagaagttgaatttattgatcaaatgatctcagttgtaaatcgtatgcatgagcatcttgttatgcttaagcaagctcagagctctatcccggtgttagtacctgctgatttttgctgtcctctctctttagaattgatgatggatccagtcattgtggcatcagggcaaacatatgagcgggctttcatcaagaactggattgatcttggacttactgtttgtcccaagacacgtcagactctggttcacaccaatctaatacctaactacactgtcaaggcactaattgctaactggtgtgaatcaaatgatgtgaagctcgttgatcccatgaagtccaaaagcttaaatcagtcatctccttttcatgggtctatggagtctggtttgatcaaggatttgcctgaaatccaccaagaacgaacatcaacattgcattcctcttcaactccaagtggttccttaaatggcatggttaatgagcagcatgtgaatcttgaaagaatatcatccacaggttcggatgacgagtctgccagctcagatgaagggagtgtggattcagttgaccaatcattaatgtcaccatctacaagggaatcctccaatgccttaagctcagaacaatctcaaactgatgttagaactacttctcataacaatactcctctgctatcaaccagttcagtccacagtcaagatgcttctggagaattgaattcagggccagatgctgttgccatgccaactcgtcatagagaacctgagttttcaccccaattggcggtgccaaggtctcgaagccaaactttatggcaaaggtcatctgagtggcttgttcctagggtagtgtctaatcctatcgaaacaagagctgatctttctgctgctgaaacccaggttcggaaattattggagcagttaaagagcgattctgttgattctaagagagaggcaacagcagaactccgccttcttgctaaggaaaatatggataaccgaattgtgatctcaaattgtggagccattagcttaatagttgatttactgcaatcaaccgatactaggatccaggaaaattctgttacaacactccttaacttatcaatcaatgataacaacaaagctgctattgcaaattctggtgcaattgaacctttgattcatgtccttcagacagggagtccagaagccaaggagaattcagctgccactcttttcagcctatcagttactgaggaaaacaagatcaggataggcaggtctggggcaattcgaccactggtcgatttattagggaacggaacgcctagagggaagaaagatgctgccactgctttgtttaacttgtcattatttcatgaaaacaaggatcgaattgtgcaagccggtgctgtgaaaaaccttgtagagttaatggacccggcagccggaatggttgataaggcagtggctgttctagcaaatcttgctacgataccagaagggaaaacagcaattggtcagcaaggtggcattcctgttttggttgaagttatcgagttgggttctgcgagaggaaaggagaatgcagcagcggctcttctacatctatgctcagacaatcacagatacttaaacatggtgctccaagaaggagctgtaccccctttagtagcattgtcacaatcaggcaccccaagggccaaagaaaaggccttggctctccttaatcaatttagaagccaaagacatgggagcgctgggagagcttga

SEQ ID NO: 108112 - DNA, 393 bp, Glycine max
  Peptide Sequence Number=SeqID_224890
atgacgccaagaggctttacgcaaggtgtcgtccttggagatggaggtggccaaatgaagggatattgctcacgcgctgtaaggtcaaaccaccaactgtcttccaaggttggtagtgtcttagccaagttgtcatgcacaaggttggacgatgatgaactgtccgcacgctacaagggcttccaggaaaagaaaaaagacttgactaacaaagtggaaggcattgcagtggagaggggcaagcttaccaaggttgttgttgatttagaggtttggctaaaggagttggagtccaggttgaaggagtccgagctgcgggcgaccaaggagatggaggccatcaaggagcttgaagaggagttgacaatgtacaagaaagaggttgtggagtag

SEQ ID NO: 108113 - DNA, 552 bp, Glycine max
  Peptide Sequence Number=SeqID_224891
atggaactcactcgaattgagccaaaccttttcactttgagcatactcattaactgtttctgctactttggtcagatggacttggctttttctttacttggcgagattctcaaactgaggttatcacccaactaccataaccttgaatacacttatgaaaatggattatgcaagactaaaagggtgaatgatgccttgaatctctttgaagaaatgcatcctgatacagtgacttatagttctcttattgaaaatcagggagaatctcttatatgctttatgcaaaaatggccatcttacagggcagttgcattgttcaataaaatgaaagaccaggcctgtctaaatgttcggagatatgctgttatgatcaatgaactttgtaaagagggcttgcttgatgaagcattggtcttgcaatcaagaatggaagacaatggtcgcatctctgatgctgtaacttttgaaatagtgatttgtgctttctttgaagaagatgagaatgataaagcagagaagcttcgtaaaatgattgctagaggcctattgtaa

SEQ ID NO: 108114 - DNA, 459 bp, Glycine max
  Peptide Sequence Number=SeqID_224892
atggggaagcctggctatgtgcctaacaccgcccagcggaggcttgccgaggaagttacacggtttgttcatggagaggatggtttggctgaggctcttaaggccactgaggcattgaggccggggtctgagacgaagttggactggaaaactattgaggggattgctgaggatgtgccgtgttgttctctggcttatgatgcggttttgaatctgtcgttggtggatcttttggtctcttctggtttgttcgagagtaaatctgctgcacgtcggttgttgaagcaaggagggctttacttgaataataacagagtggataatgaaggtaagaggattgaggctgcggatatagtggatgggaaagttcttctgttatcagcaggcaaaaagaataaggtgctgattattgaggtgaaatttcaattctgtttggagaatagcaccaaaaataattaa

SEQ ID NO: 108115 - DNA, 717 bp, Glycine max
  Peptide Sequence Number=SeqID_224893
atgtttggacatccagagacagatagattagatgagataattacaaaggtgagagcagagggagaagcatcttgtcaaatgggaaggaagcatttctatggtccaactccagggacaaccttaaacacagtaaccccttgtgcagcatgcaaacttttgagaagaaggtgtgctgaagaatgccctttctctccttatttttcaccacatgagcctcagaagtttgctgcagtccacaaagtgtttggtgcaagcaatgtttccaagatgctaatggaggtaccagaaggccaaagagctgatgcagcaaatagccttgtttatgaagctaacttgaggataagagatccagtgtatggatgcatgggtgcaatatcagctttgcagcaacaagttcaaagattacaagtagaactaaatgcaacaagggcagagatactaaaatacaaatatagagaggctgcatatgcaatatcaatagcagcaattcctgcagactcatcacaaggtctttctcaacctcaaattcaacctcatcctcctcctcctccaccaaaaccattgccttctcctcctccaccaaaaccattaccttctccttctattctcctttcatccttgtcttcatcttcagcttcttctgtgtacactcctcctaaaagcacaatgagccttggatccatttccaccactgaaaatgtcccatactttgtttaa

SEQ ID NO: 108116 - DNA, 1065 bp, Glycine max
  misc_feature (990)..(990): n is a, c, g, or t
  Peptide Sequence Number=SeqID_224894
atgattgtagggtatagtcagagaggctatcctcatttggcactagaattgttcaaagacaagaaatggagcgggattttgcccaattcggttaccgtttcgagtttgttgtcctcgtgtgcacagttaggtaactctgttatggggaagttgcttcatggattggcggttaagtgtggattggatgatcatcctgtgaggaatgctcttgttgatatgtatgcgaaatgcggtgttgtttcggatgctcgttgtgtgtttgaagcaatgcttgagaaggatgttgtgtcttggaactcgattatctctggctttgtgcagagtggcgaggcttatgaggctctgaatcttttcaggagaatgggattggagttgttttcaccggatgctgttactgtggttggcattctctccgcgtgtgcttcacttggcatgcttcaccttggttgttcggttcatggtttggcgttgaaggatggcctggtggtgtccagcatctatgttggcactgctctgctgaacttctacgcgaaatgtggggacgcaagggcagcaaggatggtgttcgattcgatgggggagaagaacgcagtgacttggggcgcaatgattggcggctatgggatgcagggcgatgggaatggatcactcacattgtttagggatatgttggaggagcttgttgaaccgaatgaagtggtgttcacaactatattggcagcttgcagccactcagggatggtcggagagggttcaaggttgtttaatttgatgtgtggggagttgaattttgttccttccatgaagcactatgcatgtatggttgacatgttggcacgtgctgggaaccttgaagaggcgttggattttattgagagaatgcctgttcagcctagtgttagtgtgtttggagcttttctccatgggtgtggacttcattctaggtttgagttgggaggggcggcgattaagaagatgttggagttgcancctgatgaagcttgttactatgtgcttgtgtcgaacttgtatgcttcggatgggagatggggcatggttaagcaa

SEQ ID NO: 108117 - DNA, 305 bp, Glycine max
  Peptide Sequence Number=SeqID_224895
gggcgccatcggaagagggtatcgcgcctttcatcgcacgaggctttagtgacctcaatgcaaaaatgcttcaaagagtccgaaaagcatggaatgcagtgcaaaggaatgataaagagcttagaggaagcaacaacggtgttattggtggatttcaagaaaagttcaaggcgataaccatcagagttaggaaggaatgtcacaagttgagggatggacgagtcgagactggaaagtatgatattagaggacaagttaaaggtttgtcaaaggtcaaagaagagcttgaccaaatagttgagtag

SEQ ID NO: 108118 - DNA, 204 bp, Glycine max
  Peptide Sequence Number=SeqID_224896
atgaatggaaaaagtggagcttggacatcatttgtctgcatgacattcacaccactcacaaaaaattattatattgaacatgagctatggttcaagttgaagccagagatcataacatggctggattttgtgcagtgtccaaaggttcaagatgaaaaaatagaggaccttgacatggacttgatggaatcggctatggtttaa

SEQ ID NO: 108119 - DNA, 378 bp, Glycine max
  Peptide Sequence Number=SeqID_224897
atgttgctaagtagcaatgtcatctatagctgtgtaagagtggtcatgttggtgcgcacgatccgcactcgtctctttacagcggcacgaatgaaatcttgccccggtatgcatagtagctgtgtaatagcctccctctctggttgtgctcgcacagttggccctcctccaatatcagggggtggcccaggaaccgtgtggatatggagcccactgaaagtgaggacgcatagtcctctaaaggcgagggcgtgtagccctctgaagttcaagacgtgtcgcctttcgaaggcgagggagtgtagtcctatgatggcaaggacgtgcaatcctctaaaggtgagggcatgcccccctttgaaaatggggaacatgtag

SEQ ID NO: 108120 - DNA, 813 bp, Glycine max
  Peptide Sequence Number=SeqID_224898
catgcgcggcagatagccgaggcctgccgctatatcgaacgggcggagaaagcgccgtcgctgcagacgctggcgcgtcacgtcgggttgagccaataccatttccaccggctgttcaaagcgatcaccggcctgacgccgaaaggctatgccgacgcgcagcgcagccaacggctgcgcaccggtcttacgcagcaggagacggtgaccgatgctatcttcgacgccggctatggcgccaatggccgcttctatcagcaagccaacgccgcgctaggcatgacgccgaaggcctaccgggcgggcggcaaaggcatgcgcatccatttcgccgtcgggcgctgttcgctgggcgagatcctggcggcgcaaagcgaggtgggcatctgcgccattctgctgggggacgatgcgcagcggttggtgcaggatctgcaggacaaatttcccaatgccgagctgatcggcggcgacgcgcagtatgaagcgctgatggcgcaggtggtggggctgattgaagcgccggagaacgggttggcgctgccacttgatattcgcggcaccgcgtttcaacaacgggtctggcgggcgctgcaggcgataccggtcggcgaaaccgtcagctatgccgatattgcccggcgcatcggcgcgcccaaagcggtgcgcgcggtggctggcgcctgcgccgccaacgtgctggcggtggcgatcccctgtcaccgggtggtgcgcaacgacggcgccttgtccggctatcgctggggcgtcgagcgcaagcaagccttgctggaaaaagaggcgcagcgatga

SEQ ID NO: 108121 - DNA, 150 bp, Glycine max
  Peptide Sequence Number=SeqID_224899
atggagagccaaataaccaagggaaagttcacttacttgatactaggatgccttgcggcggcgttttccgtttgtccagagctggggaagggacgacgatctgtcggtcgtgaccctagcctctacttgcgtccgtccctaagtacctga

SEQ ID NO: 108122 - DNA, 246 bp, Glycine max
  Peptide Sequence Number=SeqID_224900
atggcgacacagtggtggcgctccgccgtcggcctcctccaaatgagattcgtgccagatctggatccatgtgcttcccaatcaagatttatgccaggtctgtatcatgcgcttcatgtcgttgagcttcatcatcaaaataatgtcgcaatggaagaggcaccgcgagttgatcatggtggagcatttgaaggccgtgacagcggccacgacaacgccgtagaaggaccaggccaaaccgcttag

SEQ ID NO: 108123 - DNA, 273 bp, Glycine max
  Peptide Sequence Number=SeqID_224901
atgattcgcataaggggtgccctgcactctaccaatgttgaatacaggttttttcatcctaggttttctcttcatgtatgtaatctgatcttgacacttctatcgtcttcgatagacttccccatcattgtcactagaagctcgcatcccgatgtcccatcgttggtcgccatgcagcctttgttggtgtttgctgtgtgttggcattggtacttggctaccatatggagtgatgggtcggtttggcatttgttgcacctcttagggttttag

SEQ ID NO: 108124 - DNA, 825 bp, Glycine max
  Peptide Sequence Number=SeqID_224902
atggttagaactagaggtcttggtcgcgctttagggtgcgcagtaggaaaagtgatggggaggagaggcgagagtgatgatgatgtcccccagaggcgaaggcctactgcatcagcccgtgatgctgatgttgagggttttccaagcggatcccatgacacatcagttcttagtgattttgaaaatcacattgctttgagcgtgtggaatggagaggaacgtcttgagttgaagctatctttccatggaaggaagatgactaagttcgggaagcctgccgcagagattgaaggccttgtggtggccagtggactgggtcctttgatcgcttgttctctagatacaagcgatcatggactaatgtctgcttttgtggaacattggcataaggaaacaagaagtttccatttgcccgtcggagaggtgactatcaccttggatgacgttgcatctttgttacattttcttgttttaggggcgttccacagctttgagcagcttcatgtcgacgacgctgtcgagatattggtggagttactcgaggtcagtgctgcagatgctagagctgagaccattcagtgtcacgggtcttatgtgcaactatcgtggttgcgcgagttgtatgagctgaagattgaggcattattcttggatgcattgagtaacctgacacagagtgcgggttacgcttggggcgctgctgcacttgtgcacatgtatgataatttaaatgacgtgtcgaagagcacggcgaggcagcttgcaggatatatcactctgttacagtgttggatttatgagcattttccgtccgtcgggaaataa

SEQ ID NO: 108125 - DNA, 6909 bp, Glycine max
  Peptide Sequence Number=SeqID_224903
atggcgtttgagcaaaactccgttccagtggctcgggtggcggaggagcctctcgttttaccggcgactaccgcggcggttgctggcgcggtgccgattttctaccccgcgtctgtggctgatgctggcttggtcggagtggggtatggaaatgtggcttcggttggtggtggtggtggtgctgccacgtggtgtgttcgccctgctgtgcctgttcataatcataatcactctgtgaatcctgctgttgggttctctcatgctcctagttttactaatagggttgctactgctgctggtggtagcaatggtgttgatgtttcgggtagttttgtggctgcttctcatgggtatcctatgaatttgggaagcaattgggttgccacgagtaatggtaatggcttggatagtagtaatagtagtaatagcattagcaatattaatggtaatggtagtggtcttcaggggaatgtcaaagccattagcaatgctagtgatcatgttggtggtgttggggttggttccatttcaaataccccggcaagccagcggactgatctggtgagtgaggagggtggggatgattcggtttcgggacagaaaatgaagttgatgtgtagttatggggggaagattttgccgaggcctagtgatgggatgttgagatatgttggagggcatacgaggatcataagtgttaggagagatgtgagttttaatgatttggtgcagaagatggttggtacatttgggcaagccgtggttatcaaatatcagctccctgatgaggaccttgacgcgttggtatcggtgtcctgccctgatgatctggaaaatatgatggaggagtatgagagattgattgagaggtgtcctgatgggtctcccaaattaagggtctttctcttttgtgcagcagaacttgatccttctggtatggtacagtttgtgaatttagatgatggtgggatgaaatatgttgaagctgtgaatggaattactgatgggattggtggtaaactcacaaggaaagcgagttatacaagtgcagcttctacccagaattctgatttgagtggggtagatgctcttgatagctcaaatgctgctcgaggggatgtcagtggggtacatgtacctttgtctggcacattatcacctgaggggatcgtagttgcttctcgtgatactgctgctgcaaattctgtggtttctgagcctggagtgtcttacacagatgcttctgttgtttcactgggcattcgtgcagttaattctggcccaactcacactccacctgtccagaatgaggtggagtttgaaaagtctgtatctgttaatttttctcatcctcaatttggggtccagcaacttggttcggaaattccaccatctgcacctttgcagacttttgttgatactcaccaggaagttatgaaccatgcagattatgtccagctgcctccccatatgggattcccaaatcctcagcttttaggtaagccttgttccatctactcccaacagtttcatgataatacttctcgttttgggtcccatcatgtaatccctgcagtgcaaatgaccatgactcagcccttttctcatgctggtgtaagaccaagtgttattcaaccacaaacattcatgcaaccacagcagaaccgtttggaccaatataatgatgataatacttcagggttaaggattcaccagcttcctgctgaacaaagttacaatgcatatccggttcaagtcccttttggaggtaactacggctgggttcatgttcctttggcagagcatgtgatttttcctgatgcatttgttcctcaacaaccagtgatgatccctgagaaagtccaaagagtggaggactgttatatgtgtcagaaaaagctgcctcattcacattcagatcctgtggttcaggatcttcgtaatagctgtgctggtacaattcctgattcagtcccaagtttctatagtgtccctatgggggagaactcaagggctcaagcaacaaatatggttttggtgactgcaccaatgaaggaagacaatattgaacaagcagttgagaccaggcccaaggtcattagcaaattggatactccagctggagtaccttctactgacacaactggactttctttggagtctgaaggtgagaaggtttttatacagaagctggattggtctgatcatcccaggaatgctgttgtccaggaagcagttgtaagaacaggtgaaaaacagtcaccaactgatgggctgatgggaacatcaccgctgtcttatcaagatgatgttgcccgccagcatattgtgccagttgaaaactgggctaaagaggatgctcttgtggctaaacctgttaataatgatataccttttgttggcggcacatctgttgaaaattctgactgtatggttcaacaatgtccaacagaatataccaatgaacttgctagcactatttcaaaagcagatgctgtggagaattggatatcacaggaccttctcaaacctattgatggaaggctggacaacccgaagataggcaatcctgaaaattttctaaataatgataaatttgattacagcactcaacatgctgtagagaagaaaggggtggtttcagataacaaccatggcaagtcaaaattgaccactggtgcaaatcaaattaatatgatggatatgcttcctagttctacagtggaatataatgaagttacacaaccccctgtttggggcatacctggatcaaatcctcagtcaaagagtggaaaccttcacaaggatgatgcagttttatcttcagttcccccatctgttaggcttggagatgtgcaggattcttcaaactcactttttagcaatcaagatctctggaatatacacagtacctactttcctccaccaagacctaacaaagttgcattgaagaaagaaacttattctaataaggaccagctctgtgagattccaggcaacagtggggaacaaaatttagaatctcaaatagacaatggcctctaccagacattcaaacagaatttaactttggaagaagctaaatctgccaaggtctcatcagaagaccgacaacttcaagctgttgccgaaggtttagctgcttctgttctgcactcgagcacttcttcaaatcttgatttgcatgccagggatgtgtcccatcatgaagacactggcaatgaagatgttcaaaataatcaaacagatatacagcataatgataaaactcaggaagcaggattcacaggtgggtttgtggaggatctcaaaagcaagcttccagagaaggcaaattttggctttccagtatcagatgttggagctttgcaggttataaaaaattgtgaccttgaagagctgatagagctgggttctgggacctttgggactgtatatcatggaaaatggaggggtactgatgttgcaataaagcggattaatgataggtgttttgctggaaagccttcggagcaagagcgcctggcaatcaagcttgctgacttgcatcatccgaatgtggtagcattctatggtgttgtgcttgatggccccggaggttctgtggcgacagtaacggagtatatggttaatggttctctaagaaatgccttgcagaagaatgggaggaatcttgacaagcgcaagcgtcttttgattgcaatggatgtggcctttggtatggaggataagagtttggacttagaagggaggcccaaggattggagagtgtatgtgaggagaaagggcccgcagttttttaacggggttatcggggacactctagcggaattccggaaatcggtgaaaaaggtggagttgctgatgtttgacagagacaacctttctgggtggattgtatgcgcggaggtatatttccaggtccaggggactcatccaaacgtgaaagtgaatctggctcagttggtgacatttttggagagattgacggtgatccagcaagctggcagtgttgaggaatacattagggaatttgagcgcctcactgctcagcatgcaagtgttgggtcccctgccacgctcgcgcatgatgaattggtgagagtggtggagttggagttgcaagagagacagggaagttgggctgggttttgggcgaccagcagagcatggaggcaatggatcgggcctggaaaaccaggtcgaagatctgggtctgaatatggtaggaccccatccaacaggggtgtgaatgccaaaaatgggtttaaatccgaacccaatgcggatccgcatcgctccaacgcggatctgcatccgcatctttcgtacgtcgaactgaccgaatggaagactaaggggttatgttacaagtgtggaagtcctttccaccctaatcctaatctccaatgtctcgaccgccagttgagggtgatgttggttgaggaaggagaagagaacaaggatgggaacttagtcacggaaactgacgaaaccgatgcggaagaggaagacagcgagtgcaacatgctgtttctggtggtgcaactcaatttcgtttcgcataggttggtcaaagctatgggatggcttgtgaagacaacgaaaacattgaacactaagcttgggtatggatacaaggcgcgagctcagggaatgtgtcatggggtcaaattagggatcggatctttggcttttagggtcgatactgtgttattttatttggagagaattgatttgatattgggaattgcttggttggcaccattggggaagatgatgattgattggggggaattggttatgctgataaaagtagatgataagtgggtcataatacaaggggaagggacacaagtgaccttgcccaatcccaagaaggaagagaagttgtctagttcaatcatggcaacccaggagcaggaattgaaagccctgttaggaagtttcagcaaggtgttcagagaaccccatggattgccaccaaggaggtgtaaggaacatgctatcaatttagttaaagcacaagggctagtaaatgtcagaccatatcggcacccacaccaccataaggatgaaattgagaaacaaatgacacttggaggatctgttgattattgtgctttgaacaaggtgaccattcctgataagtttcccattccggtgtttgaagaattgcttgatgagttgcatggagctcagttctactccaagctcgatctcaagtttgggtatcatcaagtacgagtcaagaaagcgatgtccacaaaacagcattttgcacacatgatggccactacgaatacatggacagtgctggtgttttttgatgatatactcgtgtataacatgagttgggaggatcgtatgacacatctccgggaggtcttgattatattacagcagcaccaactagtggtgaatcagaagaaatgcacgtttgttcagcaagaagtgaagtatttaggacacatcatttcagctcgaggagtagcggtggatcccaataaggtgaaaagtgtgagggaatggcctatgccacaaaatactaaaggagtgagagggttccttgggcagacagggtactataggaagtttattcaggactatggcaaaagggctaaaccattgacggaattgacaaagaaaggaggctttaaatggaactcacaagcaaaaggggccaaagcattggaggaaagaaatttagctaaatctgcttatgaaaaggaattaatggcagtagctttggcaattcaacattggagaccgtacttgctggggagaaagtttgtggtacagacagaacagaaaagtctaaggcagttgcttttgcataggattaccaccatggatcagcagaactgggcagcgacactgttggggatgtatggcgttgctgagttacattctctagttcatcaagcgcagtgggaggatattcaggaagccatgagggaggtacactttgatgagaaggaggttagtgttgtcatctacttcttgcttatatccctaagatgcttaaagagtttccatgagactcctcaaggaggacattctggatattataggacatataggaggttggtggcaaatttgttttggtttggaatgaagcagagtgttcaacaatttgtgatggggtgtgatacttgccaacgacaaaattaccttgctgctgccccaggagggttgctccaaccattaaacattccagagcagatatgggaggagatatcgatggatttcattactggcctccccaagtctaaagggtatgaagcgattttggtagttgtggacaggctgtccaagtacaaccatttcattcccctgaagcatccttattcagcaagggtgttggctgaaattttcgcaaaagaggtggtgcatttacatggtgttccggcttcagtcctcagtgacgaggatccaatttttgtgaggaccactccttttgaggtggtgtatgggaggaagccacctgtgctgaatagatttttgccaggagaagtgagagtggaggctgttcgaagagagctgcaggatagggatgaggcgcttaagcagttaaagtatcagttgcagcgtgctccaaatcgaaagaaggatcaagcagactgtaagaggaaagatagacagtttgcattaggggaatgggtgttccttaagcttaggcctcatggccagttgactgtgggggctcacatcaatcctaaattagctcctcattactatggcccttttaaggtgttggagaaagtcggagcagcggcctacagactttctgaatctgcaaggatacattcggttttccatgtgtcactattgaaaaaagctgtaggtgattacaatgttgaggagacacttcccttcccttggagttggttagtgacaatgcagcaa

SEQ ID NO: 108126 - DNA, 348 bp, Glycine max
  Peptide Sequence Number=SeqID_224904
atggctccgagaaagctttccataaaaagatctaggaaggacgcgcggccgaagggactagtgccgctcccaagttcgatagccatcgtttcaggagcgctgagcacctgcagcgtttcgaagccatcaagggatggtccttccaccgagagagacgcgtccagctcagggacgatgagtacacagtttgatccggatatagttctcgagttttatgccaatgcttggcccacggaggagggcgtgagggacatgcggtcatgggtaaggggccagtggattccttttgatgcagacgccctcagccagttcctgggatacccgctaatgttggaggagggccaatag

SEQ ID NO: 108127 - DNA, 336 bp, Glycine max
  Peptide Sequence Number=SeqID_224905
atgatgaagaggcttgataaactatttatgattttgatcatgtggagctggcattcagattatgatcatgtatgtgatcaaattttcttcggtgatcatattccctcaatgaacaacttagtcactagacttctccatgtttctactttggtgaatggtgaaaatgcagctgctactgttgagatttcagccatggttgcctctcatggttggggtagagggggccattgtaatagaggaggaggacgtggtggtagaggtggtaatgtaccaggggtactgagaatacaaatttttgaagttcagcggacatatggtttcctaatacaaccttga

SEQ ID NO: 108128 - DNA, 222 bp, Glycine max
  Peptide Sequence Number=SeqID_224906
atgcagtctatcaacttcttgctctgccagtatctcctggctaagatgatgagagtgatgagcaaaatgacggcgacagcgacgaagtctatttcattgaagcccttaggaagagacaggaccgtgaggcgccatttggcggaggagattccgattgtggtgcctaggtacgccatcaagcctctagcgacaatggcattggaaagtacagaccaaaggtga

SEQ ID NO: 108129 - DNA, 133 bp, Glycine max
  Peptide Sequence Number=SeqID_224907
gggcagaatcctcttgggccatggtcagaagtcgagacgagttgacggcagaagtcaaccaaggtacttagggatggaggcgaatggaggacagggtcacggccgaccgttgtcccttcccggcgctagataa

SEQ ID NO: 108130 - DNA, 939 bp, Glycine max
  Peptide Sequence Number=SeqID_224908
atgcgtttaatcattgattgcgatcccggcaacggcgttcccggcgccaacgtcgacgacggcctggcgctagccctggcgctggcagccaaaccgcagctgcagctggagttgatcagcatcgtggccggcaacaccccgcgcgaagtgggcttcgccgtcgctaccgacctgctggcgcagagcggctatcaggtgccggtcgccctcggcgcggcgcgcgccctgagcgaaccgccggagccgtggcgcgcacacctggaccgcccgatcgccgatcctaagctggcggcgctgtggcgtgacctgcccgcgccctcgctggccaacgcgcccgcgccggacgccgccatcgccatcggcgaactgatctgccggcatcccggcgagatcacgctggcggcgatcggcccgctgaccaacgttgcgcacgccatgcagctttacccgcagatggcgcaggcggtgaaagagatcgtgatcatgggcggcgtgttcaacgttgagggatatatcaaggacaccaatttcggcctggatccggaagcggcgcggctggtgttgaacagcggcgccgctatcacgctggcgccgctggacgtcaccacccagaccatgctgacccaggcggatctggccgcgttgacccagccggataccccgctgtgccgctatttgcgcgccacgacgcagccgtggatcgactattcgcgccatacgcggcgcctgccgggctgctggatccatgatgcgctggtgatcgcctggctgctggcaccgcagctggtcaccaccgagatctcacgccgctggcggccggacagcctgcgcctgacggtcggcatgccggcgccgcagggcaagccggtgcgcgtcatgcagcaggtggacaacgcccgtctgctggcgttgatcggcgcaacgctggcccgcggatga

SEQ ID NO: 108131 - DNA, 1050 bp, Glycine max
  Peptide Sequence Number=SeqID_224909
atgcagctcggcgggcgcggcgccggcggccagcatggcgatggcccgcttggccatggcgtcgatcggctgctcgaccgcgctgagcggcggcacgctgaattcggattgctgtgtgccgttaaaacagatcagcgccagatcgtccggcgcgcgcagcccatgctccgccagcgccgacaggcagccgagcgcctgctgctcgttggaggtgaaaacggcgcgcgggcgcgggccttgcaccaggcgctgggtggcctggtaaccgccctggcgggtgtaaggcgcttcgaaaatccacgcgtcgcgtggcgcgatgcccgcctccagcagcgcatcgcgccagccgttcaggcgatcctgcgcgttgagcatggtcagcggaccgataaaaatgccgatgtcgcgatagccgtgctgcagcagatggcgggtcgcctggcaagcggcgtcgcgctcgtcgacgcggatggcgcaaacgccggcctggctgtcgatggtgtctatcatcacgcagggagtgccggaagcgcggatcagatcgaaccacgggtggcgatcgacgctggtgtacagcaggccatcgacctggcggcgcagcaggttgttgataagctcatactcgcgctgacgatcgtcgccggcatcgcccagcagcagcacgcggccgcggctgaaggcttcctgctgcagcgcccgcgccagggtggcgaagaacgggttggaaatatccggcaccaccagcccgtaggtttgcgtgctgccggaggccagcgcccgcgcgatgtcgttcggccggtagccggtctgctcgatcgccgccagcacgcgcagccgggtggcttccgccaccgggcgcgggccgttgttgatcacgtagctgaccacggcgacggaggtgcccgctacgcgggccacgtcggcgcgggtaacgcgtcgcgcggagtgattatccaaattgagatcctgttcgccttctcgctacgcggcatcctgcggcagattgagatcgcggccgcgggtttcgggagcaaagaaggtggtgattaa

SEQ ID NO: 108132 - DNA, 171 bp, Glycine max
  Peptide Sequence Number=SeqID_224910
atgatgcgcgcgctttattacgaacgattcggtgagacccccgttgtcgcgtccctgccggatccggaaccgacagatggcggtgtggtcatcgaggtaaaggccaccggcctttgccgaagtgattggcacggttggatgggacatgacccggatattcgcctgccgcat

SEQ ID NO: 108133 - DNA, 240 bp, Glycine max
  Peptide Sequence Number=SeqID_224911
atgttgacatcttcggaaaaggtgcagatgaccacattggtctccgcttgtcaatcagacttggggtctctaaatgatgaggtgcagataaccatatggcgtctccacatgctaccggactcacggcgtgttagtagctcaatagtgaatggcttttttttcttgggagaccccactattccttcttccaaggatagggatggaaactctcatcctgggtcaaggtttatggtggtttga

SEQ ID NO: 108134 - DNA, 390 bp, Glycine max
  Peptide Sequence Number=SeqID_224912
atggctctggtgatggatcccctccttggaaggattgcatcaattggagtattggagagcgaggatcgagctagggtttcggataaatgtgttgttcctgctgagagcaatggcaacggaggcaaaggttgtagaattaagggtttttggcctctgatgttgacggcgccaccgtcgagggatttagggccgaaaggggaaggagagaaggagagctacatggagttcagtgcttctgatgaagattgtggtgatgagcgagaagagagggggccattgttaaagaagcaaagcttcatggtgaatcaaaggttattcaaaggtgttttgatgataacaaaagatgatgacaaaggtgatgacaaaaacctcaaagaacaactcaagtga

SEQ ID NO: 108135 - DNA, 1229 bp, Glycine max
  Peptide Sequence Number=SeqID_224913
aagccggatcaggcccgccgctacctgcagcgcgctcaggaagcactgccggacgatgcgcagatcctgctgaccctggtctcggtggaactgtccgagaaccaaccagcgcccgccacgaagcactggtgcaggcactgaagcatgccgacgcgccgttgccggtggaccgccacgcgatcaactacctgcagttccgcctgcgggaccagccgcagcagcgcatggaactgctgcaggcgctgttcgacaacggctggaagagcggcggcctggaacccaccggactgtggctggcactggccacgctgcaggccgacaacggtcgtggcgacgatattcccgccacgctggcgcgcatcaccggtcccgccgaaatcatccgcctgcgcagtgacaagcggtttgaccgctatgtcgaccgcgccgatgcccgcttcgatccggtgcaggccgcacagaagcacctcgacgaactgcgggtttccggcctgctcgaccgggcgctggatgcacgcatggccgagttcagcagcacgctgctgatgctggaccgcaacgaggaagtgctggcactgaccgatggcatggccagtgcggcggccgagggcgagtcgccctcggcggcggaagccgaatgggtggcgtggctgctcaacagccggcttacggcgctgcgccggctgggccgtaccgatgatgcgctggcggcagccaaactggccgcacgcatcggcgcactgggcccggatggtgccgagcaccagttcaacgtcggcttcgtgttcagttcgctgggccgcatgcaggatgccgccaccgcggtgaatgacatgccgggcctggccggatacggcaaggcggcccaggcactgctgcagttcgttgccgcccgtgaacgtggcgatgccaaggccgaacaggccgcgcgtgcagcgatcctggcccagggcgatgacgcgcgcctgttccagcgcgagatgctgctggacgagggcaatctcgacggcgccgctgccgtgctgatcgaacagctgcgctcacccgtcgagcgcggcgagacactggcctccctgcaggacatgcgcacctatccgtcgctgcccggtgacgtgaagatcgatgcggcctggcgtgcgctgaagcaacgcgccgacgtgcaagccgaggttgcccgcctgggccgcatcgaacgctacgaactggtcagcacctccacctcgcgctga

SEQ ID NO: 108136 - DNA, 152 bp, Glycine max
  Peptide Sequence Number=SeqID_224914
ggtcagagttggttgtcgaggtcttggaaagggttacctacggagggttctgactggtggacgattctaaccaacaaggatgcggaagttggtgggcatgtaagagcccaagcgaatcacactggaatgagagggatccaaagtttgtacag

SEQ ID NO: 108137 - DNA, 339 bp, Glycine max
  Peptide Sequence Number=SeqID_224915
atgacatgcggggttaccttatggttacctgcacctttcgtcaaccgggggaaaaacgagcctgttggcgcgcaaagactaacatcgtctcctgcaccttttttcatcctgacccgtgaagtcagggatagcgagtcaagtggtaggcggagataccttatggtcatccgcgcctttcgtcaaccgaggggaacaaatttgatggtttttactctcatcgtccagaaacattcaagcccaacgacgtgcgagattcttctctgctggccagggacgatcaagtgcaatggcgaagggaagtgtcgtggttgtccaactttttcgttttcaagacactga

SEQ ID NO: 108138 - DNA, 408 bp, Glycine max
  Peptide Sequence Number=SeqID_224916
atgcaacctacacacctcaatggcattaacagctgcccctccatgattggcgagcgggcaatgcactgttcgaccgagtggcctggggttcccccatggtatgcgcaggtcatgctagggttacacgatttcgggaaaggagactgggtgaatttcggagccttccttggtggagggttcctcgtcgtgtcagagcctacgccaaggtgggcattgctggccgggcgaggttgggctggagccaaagcctgtgggggccccctctatgttgacgcaggcgcctttggctgggcgggcgccgagttgggcgactcaggcgttgaagtgacggcatgggcatctccctccttcctctttgccccagctattccagtcctcctacttctggaaccggcgggggagatgtaa

SEQ ID NO: 108139 - DNA, 564 bp, Glycine max
  Peptide Sequence Number=SeqID_224917
atggagacactcgttgttgtggcgcagcataggaaccaatgttacaccaggccgaaaccccaaggtcacgctgagtttggttcctcttcacattcaagagactttagggccataaattgcagaagtttccaaacgggatatggtgttctacctaccccactcaaacgccccaaaacgccgttaactccttcaaaccctaacaaaacccgttgcaaaaccacccccagtagcgccccggttcctatcaaccacaaaaaggagaagaagggtttcaatgttgttcctaatgggggcattttgctctctgaactttgggccgggcccacatactcgagttctccaccgccaagttcgttgcctattccgaaattttcagtgagacctaagaggagtgtgtcacttgatctccctggttcttgccgtgaagttgaaatgccgttacgtgctaactctgcgccgtcctcccctcgcggggagcattctccttgtgctagagatggtctctttgattcggcgacgaacacgctgcgtcgcatccttaatcttaatttggatgatgaatga

SEQ ID NO: 108140 - DNA, 475 bp, Glycine max
  Peptide Sequence Number=SeqID_224918
gttcaaagaacaaggaagcatgcaagtattgttggatgaggtgcaattcaagtccattaatgatgaagacaacaacatgcttactcaaatcttttcgaaggaggagacaaagaatgtgatttgggatttgaatgttataacggccatcagtgagttccatggccatggaagattgccaagaggaaccgatgcttcgtttctcatgcttactctcaagaaggataatccacaagacttaggggaatttagacctattttccttataggttgcttccccatgaaggaattcattgttcaaagaggacttagacaaggcgatatgttggctcctttcctctttttggtggttgtagggggattgagtgggaaaggaaagttgagggtgtctctcttgcaatatgtggaggacgacatgagggatacactcattttgaaagctacacctagatactttgaattagcattcaggcttaag

SEQ ID NO: 108141 - DNA, 1440 bp, Glycine max
  Peptide Sequence Number=SeqID_224919
atggaagaactccaagaaagatttgatggtatgcaaagggaagtcgaagccctccgaggaagagatctgttcgggaaggacgcctgtgaattatgcttggtcccaaatgttactatccctcacaagttcaaggtgccagacttcgagaagtataaaggaaactcttgtccccgcagtcacttggtgatgtacgcgcggaaaatgtccatgtatactgacaatcataagctgcttattcatttctttcaggacagcctgactggggccgctctgaagtggtatatgaatttggacagtgcgagcattcgtacgttcaatgacctgggtgaagcgttcatccgacagtataagtacaatttggacatggccccagatcgtgatcagctccgtgcgatgacacaaaaagagagggaaacgttcaaggagtatgctcagcgttggagggaagtggctgcccagattgtcccgccgttggaagaaagggaaatgactaaaatatttctgaagaccctgagccagttttattacgagaaaatggttgcaagtgcaccaacagacttcaccgaaatggtcaacatgggtgtgcgattagaggaaggtgtccgagagggacgtttgactgcggaaagtacccctgccgcaagtaatgccaagaagtttggaggccactttgcgaagaagaaagatcaagaggtgggaatggtagctcatggtaagcctcagcagaatttcaccccatatcgtcaggttgcgaatgtcgcatccactatcccaaacccatcatatcaccaacaaaggccacattacccctacccgtaccctccacaacaataccctccacaacaataccctccacaacaataccctccacaaccataccctccacaacaataccctccacagcaataccatcagccacaataccctcaaaaacaacaaaatcgcccgcagaccccccaacaaccatatcattcacaaaaccgccagaaaacaacctttgatccaatcccgatgaaatatgctgacttactccccgccctgctcgccaaaaaccttgtccaggtcagaacaccccctcgtacaccagatgttttacctccctggtttcgtcatgatttaacctgcgctttccaccaaggggccccaggtcatgacgttgaaaactgctatgtcctgaagaatgaagtgcaaaaactagtccgggccaacttgctatccttcaaagatcagaatcccaatgttcaggcgaaccctctgccgaaccatgggcctgctgtcaacatgatacaagattgtgatgaagacggtgtcatcctgaacgtccagcacgtccgaactcccctggtcccaatacatatcaagatgtgcgaggcagctctgtttgaccatgatcatgcagcgtgtgaaatatgtcctgtgaatgtaaaaggatgcccgaag

SEQ ID NO: 108142 - DNA, 914 bp, Glycine max
  Peptide Sequence Number=SeqID_224920
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgctcaggtcgttgagggtgtaggtgcggtcgtagttcgaggcggcaccgtcggcgccgccattgttccactgcgccagcgtcggatttttataggtgtcgcgcttgatgttggaatacgtcatggcgaacttggtcttgctgccgccgccccagtatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 108143 - DNA, 222 bp, Glycine max
  Peptide Sequence Number=SeqID_224921
atggaaagaggagccacggaaggtaaaggacgagggtgcatgtatacaatagtggcaaaactcctagtacggagattgaagaatgtgtttcctagattgattgatgagaagcaaagtgccttcttgggagggtggaatattcttcatagtgtcttggtggccaatgaggcggtggaggaagcgaagagaaggaagaagtgtttaatctttgagtgttgttga

SEQ ID NO: 108144 - DNA, 483 bp, Glycine max
  Peptide Sequence Number=SeqID_224922
atgaaattcccagaacctcttggacagatgctcaaagacaaagaagaatatacaaaggtccacagctacagaagtgctaaacaaaaatgggacaaattagctttgacatatgaaggatcaccacaagtaaaatgcaacaagctcaacttgttgacatataagtatgaactcttcactatggaagatggtgaagatatacaagccatatttggacgcttccagactattttaattgaattatgttgtcttaacagaatttttgttaactatgataacattgacaaaattctaagaagtttatccagaaagtggagaccacaagtgatacccttaaaaactatgaagaatctggactccatgtccattgaagaactgattggaaccttaaagattcaggagcaggaacttcaacaagatgaaagattcaaaaagggtaaatccttggctctaacaatacagaaagccaaagcatcttcaatatga

SEQ ID NO: 108145 - DNA, 264 bp, Glycine max
  Peptide Sequence Number=SeqID_224923
atgaatcaaaggctggttggctggaagcagaagcttcttagcagaacaggtcataaaaccttgaggcttcctaaaattcaaggtggtctcgatgttagaagcaggagagagactaatgtggccttattggctaggctcaacgcacctcctcgcttagcaggcaagctcaagcttagcacgaagaaggaccatgaagaaacccaaaagcacgctaagctcgtgaccgcctcgctaagcccagacattgccatgatcagtgcatga

SEQ ID NO: 108146 - DNA, 708 bp, Glycine max
  Peptide Sequence Number=SeqID_224924
atgagaagacaacgtaggagaagatcaccaaaggggaagaaatgtttgtcttttttccattatgtccagaaatggtctccaaccattgtggttggaataaggctcacatgggtgagatgctttggtatccgtttaaacgtctggggtgagaaatgtttctctttggtggctcagatatgtggaaagtatatgaagatcggggtggagacagatagcttacagaggatggagtcaacacaccttctaatccaaacaccattcacaaagcaagtcgatttttgccagagtatcaagatcaatggcaccgtgtaccaaagaaatcaattagatggtgaagagtctacacttgggaataacttgggtatggaaacgcattcatcacagtctgaatactcgttggagagccatggccagggggtggaaaaggtggaagaaactcatatggtggtttgttgtgctaaactatacactgatggagaagaaagtggtttttgcccactaaacaataaatatgaagacatggcagataatgaaaagatggaagggcagacatgtgtcgagggggagttgggggaaggaaaaggtgaggggcaaatgcatagtgtgggcgttgaaaaggagtttgatggggtagtagtgaggaagcagctttttgaagtcaacactaccctagagaaaggatacccacaacagtcatttgtgagttag

SEQ ID NO: 108147 - DNA, 516 bp, Glycine max
  Peptide Sequence Number=SeqID_224925
atggtagccagtgatcatgacatcctccgtgatcaagcctacacacccacaaagaagagccctcttgagttcacttctcaagatgctatgttagctcaaaacaagctcttggccaagactttagagatcctcataacaactctgagtaatctccctcaacagctgcatgtagtgcatccttctccatctgcagtcatgcacattaggggatgcaacatttttggtggggcttatgagttaggcttatgcatggctcaagacgatgcatccaacgaagttaaatacatggccaatcagaatcgtcaaggattccatcaaggaggaccgccaggatatcatcggggaggaaatttctctcagggccaagctaagcagatggttgaaaggcccactagaacctttgtggccaatactgagaagaatcccaaggaggaatgcaaggaagtcgtcactcgaagccagaagaaggacgatgttgaggaagaaaagagagctaagggagtactggaaaagtag

SEQ ID NO: 108148 - DNA, 423 bp, Glycine max
  Peptide Sequence Number=SeqID_224926
atgtatttatcaagactaattgattactactacacaatccaataccgatctggtaaagccaacagggcgatagatgctttatcccgaatcactaagaactcaccatccacttttctcatgctattaatgactcatttcgcattctcggatcaacttaagagtgaattgtttactcaccctaagctcattgttcttcagcaagatattcaggataatccagctggtcactcagactacacccttagttatggcttgatcctccacaagggtcgcatttggctaccagatggcctcaatttcatccggtctttgctagttgaatttcatacctcccccactggtggtcacatgggcattaagaagaccatggcacgactgggagacaattttatttggccaagcattagagaagatgttcgttga

SEQ ID NO: 108149 - DNA, 330 bp, Glycine max
  Peptide Sequence Number=SeqID_224927
atgcatttaggggctaatgttgagcatgaggccactaaagatggtaaatatgatgattcacatagagaagatgaatcagaaactttatctgatattgatgatgaagaagttgatgatttgtacattcatgatgaggaggggaagcatatcaagaagatgttgtgggaaatagcaaatagggagtatcttgaggagcaggcagccaaggaagcagctgcagcagctaacaagaaagcttttgaggcaaaatttgaaaactgttcggaggatatactagcggcaagagactttgctgcatcttctactgaagccgtggcaaaatccagatag

SEQ ID NO: 108150 - DNA, 456 bp, Glycine max
  Peptide Sequence Number=SeqID_224928
atggcgcaacttgaaaccagtcagcattctccaacctcgtcaaccatgaaacaacacaccgtcatacctttatcgaactcgtgtcacatgaaattagaggttcctcacttagatgggtcgaatccattagggtggatcttcaagatcactcagttttatgagtattatgccacaccagatctggaatgccttatcattgcttcattttatatggagggccctgccttggcgtggtatcaatggatgctgtgtaatggacaaatttcttcatgccctggtcttctgcaggcactagaggctcgttttgctccatcacagtatgaagaccctactagaaccctattcaagctcatccaacacaggatggtcaatgagtatttgtcgaaatttgaaactctagcgaactgtattgttggcctactttctcctttttttgctcagttgttttatttcaag

SEQ ID NO: 108151 - DNA, 3240 bp, Glycine max
  Peptide Sequence Number=SeqID_224929
atggctggaagtctatcaaaaatcattccggatatgtcgaaaatagaacctctagacggctcaaattataagagatggtctaaaaaactgttgattttgtttgaagccttagaggttgattatgtgctatttgaagatcctcccgctgatgtcaacgcttctgaatcatctactcctgaaactcctgccacccctgtcgtcacaccgcttcctgcagaaaccaagaaagctgacgaaaaagcaaagaagaaatatgaaaaggacaacaaaactgctagaggtcatctgctaactcatatggcagataatctgtttgatcttttcattaatcaaaagtctgcgaaaacaatatgggacactctgctgaaacgttacggcgatgacgatgctggaagaaagaaatatgtggtaggaaattggctgcgtttccaaatgatggatgacaaaccaatcatggagcagattcatgagtatgagaatctagttggtgatatactaaatgaaggaatgaagatgtgtgagatattgcaggctaatgtgcttctagaaaaatttccaccttcgtggagtgactaccgcaaccaactgaaacacaagaagagggacttgtcacttcaagaattaataaatcatatgaagacagaggaggccaaccgacttaaagataagcatgttttacattctgtaaattcagttaatgctaatgttgttgagtttgctgatcaacacaggtcaaaaggaaaagaaaaacgatttcagaaaaaaggacaaaagaaaacacacactaatatcaacaaaggtgataacaagattcagaaaagaaagggtgagtgctatgtttgtggcaaaacaggtcataaagcttatgagtgcaaactgaggaagggacaacaatctaacaactcgaaacctgctgcaccacatgctcctcaagcacatctagcagaaaatgaagaagtgatagctgctgtggtagtggaggcaaacatggtcgacaacaaggtggactggattctagataccggtgcttctaaatacttatgcgccaacaaagagctttttcaccagagtgaggatgctgatgacggagaatgtgttttcatgggaaattcagctacagctggagtgcttggtaaaggaaagattctccttaaacttacttcgagaaaaacattatctttgagtgatgttttgtatgttccctctctgcgtaggaacctaatttctggtagttgtctaaatagagctggattaaaattggtttttgaagctgacaaagtagtaataactaaaaatgggaactttgtggggaagggatatttagctgatggtttatttgtattgaacaccattcctaacacatctaatgctatatcatctgttggttctgtttacattgctgagtatgttaatttgtggcatggtagactaggacatgtgaatgtgaattctatcaagaagcttagaaatatgaatctaattaatgtgctagatataaataacttttctaagtgtcctatatgtgaggaagctaagtatgcaaagaagccttttaaacctgtcaaaaatagaactacggaactgcttgaattaattcacacggatttggctgacttcaaaaacacagtaagtagaggaggtaaagcatattttattacttttatagatgatttttctagatatgccaaagtttatcttctaaggacaaaagatgaggctgaagaaatgtttttaaaatataaggcagaagttgaaaaccaattagatcgtaaaattaaaagacttaggtctgataggggtggtgaatatggaactatttttcttaagattttttgtgaaaagaatgggattatccatgaaactagtgccccttatactcctcaacaaaatggcatagcggaaaggaaaaatagaacaattaaagaaatgatgaacgctatgttattaagttctggtatgtctacccaaatgtggggggaagccattttgtcggcctgttatatactaaatagagttccccataaacgactagataaaactccctatgaattatggaaaggatttgcgccaaatttaaattttttaaaagtatggggatgtcttgctaaggtagctctaccagatttcaagaggactaatgtagtgcctttacatttgcgtacttcttcctctgtaacaaatgaacaagttaatgaacctagaagaagtaaaaggaagagaatagaaagtagttttggaccagattttgttactgccttcgtggttgaaaacaatgatgtcgataaaataaatgatgtttttgtatctacttttctcattgaggaagatcctaaaaattataatgaggctgtaacttccattgatgccaacttttggaaagaggcaattaatagtgaattagattctatcatgtctaatcatacttgggatttagttgacttacctaagggaagtaaaccaattagatgcaaatggatttttagaaagaaattaagaactgatggaaccattgataaatttaaggctagattagtagttgttggttacacacaaaagaaagaaattgactattttgatacatattctcctgttactaaaatttccacaattcgttctcttgttgctttagctgctattcatggacttatagtgcatcaaatggatgtaaagacagcttttcttaatggtgacttgagagaggaaatttatgtggaacaacctgagggctatgtgattcaaggtcaagagaacaaagtgtggagtgttatgtttctcatgaattgtactagacctgacatagcatatgctgtgagtagactaagcagatatactcacaatccaggtggaggtgccatatcatggaagtcttccaagcaaacttgtatagcacgttcaactatggaatcagaatttattgctcttgatttagcaggtcaagaagttgaatggttgagaaacttgttggcagatgtgccattgtgggggaaacggtctataccagtttctcttcattgtgactctgaagtagctattggaattgctaagaacaatgtttataatggaaaaaggagacacatatgcattagacacagttcagtcaaagaattgttaaaaaatggtgtgatctcattacagtttgttagatcagagaacaacttggcagatccgttcactaaaggtctaacaaagaaagttgtacttgaatcgtcgagggggatggggcttaagcctttgtgttga

SEQ ID NO: 108152 - DNA, 606 bp, Glycine max
  Peptide Sequence Number=SeqID_224930
atgtgtttgggtggattgattcttcttttgggcctctctctgctgcctcccaaatccatagcctctggcctatcattatccttaatactcgtactgaaggctggtcctggatcgggcatttacctatccctaaaaacatcaaacacttcatatggctttccttccatgggaagctacccacttccttttttagattttctcgtcatgttgcagctcaaagttcatcacaatggtgtggatactgatgcctggttacgtgataatagtcaaagcggacatggaactttatttgcggttaacatttggatgatatcgaggcaacgcaacttggagatcttcaagcagaattcaggtttatactggttacccggttctattgcttttcaccccttgtctacgatcatcaccagcattcgtcagctgcttcgtcggaattgggttgctcctcttcagcatacctatcgtgaaggcaatcaatgtgtggattggttggctaaacgtggatcttcttctgatgtctcttttatgatttgggatgtttgccctagccagtttagcgcttgtctgttagttgactctatatgcatccatactgataggtcttag

SEQ ID NO: 108153 - DNA, 234 bp, Glycine max
  Peptide Sequence Number=SeqID_224931
atgactacaccagatgcgtttatttccaaggtgaacggaagagaagaatctggtaggagcaaaactggagctgagcctcatcaatggtgcaataatggaagcatatctgtgaatgaatcttcgatagaatccgatgaggcccaagaaactgcgcaaggctctcgtggattatggaataggccactgttgaatggcttgaactttatacgcaaaaggttgcaccccctgagatga

SEQ ID NO: 108154 - DNA, 612 bp, Glycine max
  Peptide Sequence Number=SeqID_224932
atgcagaactcaactgtgttcccacttggggaacaacctaggagcagtcccgccacagccacgcctcccataaaacttctgacaaggatggagcagctgaagctgctgagcaaagcagagaaagcagggttgctatctgcagcagagaagtttgggttctccctctcaacaatagagaggcttggactcctctcaaaagcagaagagttgggtgtgctatctgctgccactgatcctggaactccagggacactcttaaccctcagcttagggttgttgatccttggaccgttgtttgtttacttggttcctgaggacaaccttggagaggtggggttgcaggttgtggttgccttggccggtgtaattgggggttctgctggtctcttgggacctgaaagtacttttctttgctatctcaccaaggcattgttgcctctagagtgcttaatcaaggatttttgttacacttatgttgttacaaccaattctgcttatggtttttacaatcgattcctagcccggacaaaggaggaacgttgtgttagaccattggcagctaacataaaactagtccatttcaatatattacacatagatagcccaaattga

SEQ ID NO: 108155 - DNA, 816 bp, Glycine max
  Peptide Sequence Number=SeqID_224933
atggaatatcattccacacccacaggcgatcatataggtgtcgccaagaccctagctcaccttactgagaatttctattggcctagccttagaaaggatgttgaacgctttgttgcttcttttgttgattgccaacatacgaaatatgaaacaaagaaggtggtgggtttattatgtcccttgtcgataccttgtcggccatgggaggacctttcccttgatttcatcaccggtttaccggcatatcatgattataccaccattctcgttgtcgtggatcgtttctccaagggaattcatttagggatgttacccaatcatcatacatctcattctatggtgattttgttcatggatatcgtcataaagcttcatggaatgcctcgcagtctgactgactgtcaaacagaggttttgaaccgcgtcattgaacaataccttcgtgcttttgttcataagaagccatcatcatgggcatctccatatgaaatcacattttgcaaaaagcctttcaactttcctcagtatattgccggaacttctcaggtggatgttgttgatgaattattgaccaatagggaagcgattttcgcgaagttcaagaagaagcttttaaaggctcgggaatggcaaggattgccctcagatgacacctcatgggaggactgggaccaacttcgcgctgtctataaccttgaggaaaatgtgcttttggaaggaaaaatggatgataacaatcaaaaaatacaagcaccatcaggagcagggcctaaaaggaggatcataaccccaacatacctcaaggattttgtttaa

SEQ ID NO: 108156 - DNA, 303 bp, Glycine max
  Peptide Sequence Number=SeqID_224934
atggaggtgctgactgttacccaccatgacattcaaaggaaaagttgtgcgagtggagaggcccaattgttgcaccaatggttcctgcataggtcacgttcccttcgggaaaccaattcctccggggacaaacgcttaagaggaatggagctaggtgactttagaggggtgggcaataacggaatcaaaggtgacgaaggtacaaccaagaggggtgagggtgacggattggggttaatcctaccacacatctttgaagggcttgaacttcacggcggatcttcggagtcaacccagagatga

SEQ ID NO: 108157 - DNA, 315 bp, Glycine max
  Peptide Sequence Number=SeqID_224935
atggcagagtccactcgttcattggtatcgtccgataagcttgaggatgtcattgttaagctcacttcccatcatttatccttgagtgaaacctttcacaacatgacccttaaacttgatgagcttattcacaaattacacaccccaaaatcatccagtccctctccatcttcttctactgctatgccttcccctgcttcttctcccaccccccatcgcatgaaattggatgttcctcaatttgaaggaacagaccctctcggttggatcttcaagatcaaccaattctttgtgtatcatgctactcctgagtag

SEQ ID NO: 108158 - DNA, 213 bp, Glycine max
  Peptide Sequence Number=SeqID_224936
atggataggccaaagcgtttgtctccaagggagataacgagcggagttgccaccaacatttattcgagggtcatgttagaaaaaccaaaaaggatgaaggtattagctaatgtagctccatgtggagtttgtaggccttggatcttcttcatcaatggagtcctttgcttcttgaagtttaatggcagcggaatggacaaggagaagaggtga

SEQ ID NO: 108159 - DNA, 189 bp, Glycine max
  Peptide Sequence Number=SeqID_224937
atgtctagttttgctctggaaattgcttctgggatatcaaagatgtttgctcagaagaaagtcacgctgagcccggtgaggcacaagatagtgatactggatgaagttgataggaacctgattcggttggcaatgccaaagctcatggaagctgatgttcagtttgctgtgtttactggtagggtataa

SEQ ID NO: 108160 - DNA, 573 bp, Glycine max
  Peptide Sequence Number=SeqID_224938
atgggagagttggatcagctagagaaaaggctcagggacattgaaggaggcgaagattatgcctttgctaacctagaagagttgttcctagtacccaatatcatcacccctcccaagttcaaggtgtcggactttgacaagtacaaggggattacttgccccaagaaccatctacagatgtattgttggaaggtgggggcatacgcaaaagatgagaaactgctgatacatttttcccaagaaagtcttacggggacaattgtcacccggcagtgtcagtggatgcaatcctaccctccaagggcattggatagaagactccaagaagattgggccaaagatgcaagagaaggccctagggttctcatgagccttaggactagtgtcgcaacctacccttcggcgggagggcgacgcgtgactcgcgggatgcgtgttccacaaaaggaatacgcgcggagtcgccaccaacgtttatttgaggaaaacgtcggaaaaaccggaaaagacgcgatctacgaacttttaagtgaaaggctcgggagttgtatttacgcacggggaaggtattag

SEQ ID NO: 108161 - DNA, 404 bp, Glycine max
  Peptide Sequence Number=SeqID_224939
ggatcgcacccacaagacacccagtggacctggaaaagtccaacagggccctggggtttccagctctggttacgggcctctatcagtcctatagggtgcccgtacccccccccccccggcaaggtcatgtcatcatagggattgcgcctgcaagacacccagtggacccgaaaaaatccaacagggtcttggagttgtcaagctctaattacgggtctctgcaggcgcagggcgaaacaccacagcagcctggcgatggccggcagcgggcaacagacgcaccgccatcacctctagagttcacctctgctcatccacaaaaaggtttgagtattgcctacaccacatggccgaccaataggcgaccaagtccaaagccaaaggacgcacctagttgctcatga

SEQ ID NO: 108162 - DNA, 420 bp, Glycine max
  Peptide Sequence Number=SeqID_224940
atggccaccgctgaagccttggaacgagaaaccaagaaggcccgaaaggaagaacatgaccaaaacaaagacgagctaaaggcttgtcttaggtcgaaaagaaatttgtcccaacagttaagcgagactaaagggaatatgtgggccatcatcgatgagtgcaaagagaagctaaatctagcagcgactcacgagcaaaggctagaggatgagtacgccaagatatcagcagaaagggaagcaagggaaagggtaattgattcattgcaccaagaggcaacaatgtggatggaccaatttgctcttactttgaacaggagtcaagaacttccccgattgttagccaaggccaaggcaatggcggacacttactccgccccgaagaaattcatgggcttctcggctattgtcagcatatga

SEQ ID NO: 108163 - DNA, 201 bp, Glycine max
  Peptide Sequence Number=SeqID_224941
atggcggtttgtggtggttactggtggctgtgggtgatggagaaaaaagaaggagaagaaatgacgtttttccaaagctacttggactacaaagctcaaaacgcacaagtgactaatgttctcgaaaacggaaacgtggcacacactccagacatcttgtcacagatcccaacggtcagatcgtggacaagtgttctgtga

SEQ ID NO: 108164 - DNA, 393 bp, Glycine max
  Peptide Sequence Number=SeqID_224942
atgaagcggaagcaggcaaggaaggaggcctcggagagggagcggcgggaggaagaagagcgcctgatcgaccccgaggagcagaggcaaatgcagttgctggagcagcaggaggctgagaggatgcagagggacatgatcctcttccaggagagagagaaggagtggatggacacggttattgcccgaaaacaacagcagcagcagcaccaacaacaacgagaagaagaagacgaggacgatgaattcgattgcgtggaggaagaaggccctccagagatcatttggcaaggaaatgagatcatcttcaagaagaaacaactcagagttatcaagcttatcgataccgtcgacctcgagggggggcccggtaccagcttttgttccctttag

SEQ ID NO: 108165 - DNA, 457 bp, Glycine max
  Peptide Sequence Number=SeqID_224943
atggaagaaggtgttcaccaccatgatgagccttggaaaagaagcttggaaggatgcttcaatggagaaaaagaaagagggagagaaagtgagaggggggagcacgaaattgaaggaataaaagagggagagaagtggaactttgaagctcatgagaatcctagggccttcccttggatctctggcccaatctacttggagtctttatccaatgccattggggggccatgcatggcgccaccaccattggtgcttccgcgtaggagctgccacatggcctcggagacgccagtagcagtagcgtgttgcccttctgcttacgtggtgagggaggcgcaaggagcactgacgcgttctgcatgggagagtgaaggagcagctttggcaagcaagagcagtgagggtctggaagcgcaaatggggttggcatttgagggtagaatatggcgcaaatggg

SEQ ID NO: 108166 - DNA, 429 bp, Glycine max
  Peptide Sequence Number=SeqID_224944
atggacagaggcatgacactaactgatgctcctagatctagcatggcattctcaaatttactattcccaataatgcaaggtgggaatggaagagggataagaggttgctactctgaatggaggctcttgtctcttgctgaaattgcatattctggatggtcatttgcctcactaactcttctaaggaaggttgaggaggagcctcagttgcttgttgtctttgttgttgttgttgctgttgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaaggtattag

SEQ ID NO: 108167 - DNA, 264 bp, Glycine max
  Peptide Sequence Number=SeqID_224945
atgcctgcaaataaggcaactgccttaggcagttaccattttactccttttgagcattttctcccattcattgcattcatcctctgcacagtacttcaatctccctgcattgcctgcatttttgctccctctttgcactcatattcaacagcacaagggcctaagtggaggggtgagaagcccctgctttttctggaaatcgcgaatgagcacgctaagcaccatgctgcgctaagcgagtcatcgtttctgttgaacatctag

SEQ ID NO: 108168 - DNA, 650 bp, Glycine max
  Peptide Sequence Number=SeqID_224946
atgggtcaacttcaacgacaagccttccgcaaagcctatggtaagatttgggacctagctagggtagaagtctccatggaaccgattgcatccctttcccagtattatgaccagcccctaaggtgcttcacatttgaggacttccagctagtgccgactgtgaaagagtttgaagaaatcctgggatgcccactgggaggaaggaagccatatcttttctctgggttctatccctccacgacaagagttgccaagtaccaaggaagtgtttggaggaaagggcaaaggccttggaaaatcaaggcgaatgggctttcttttattgacatcttggcacttttgatctttggagttgtcctctttccgaatatggaagggttagtggacctagcagcgattgacgctttcctcgcctttcatcatggcaaggaaagcccggtcgtcgccattttggccatgtatgacacgcccgtctatccgctacaaggtcaccgctcgtgcgtcgaaaaaggaaaggcgaattgggaccaactcttggctagcatggaggggcgtctgttaattggttccctcgctagaaggaaggacagaatcaggattctatcttcatgcgaaggatgtccaaattgttcccttgatgggaacaacgg

SEQ ID NO: 108169 - DNA, 1143 bp, Glycine max
  Peptide Sequence Number=SeqID_224947
atgaaatttagaatctgccctaatcatcataactggaagaacctcttcacgaaagtgcgaaacttgatcagtgttggacgcgcttcctcctcctccgccgccgccgccaacgccatgggtgacgttcagatccacaagaccaaactctgcatcatcggaagcggtccctccgcccacacagccgccgtctacgccgctcgagccgagctgaagccgatcctcttcgagggctggatggccaacgacatcgcccccggcggccagctcaccaccaccaccgacgtcgagaacttccccgggttccccgacggcatcctcggcggcgagctcatggaacgctgccggagccagtcgctccgcttcggcaccgagatccacaccgagaccgtctccaaggtcgatttctcgaaccgtcctttcagggttttcaccgattcccgaaccgtcgaggccgaatccgtcatcgtcgccaccggtgccgtcgccaagcgcctccccttccccggctccggcgacggccccgaaggctactggaaccgtggaatctccgcgtgcgccgtctgcgacggcgccgccccgatcttccggaacaagccgctggcagtgatcggcggcggagactccgccatggaggaagccaccttcctcaccaagtacggttccgaagtttacataattcaccgtagggatacgttcagggcttcgaagattatgcagagcaaggtgatgaataatagtaagattaaggtgatttggaattcggtggtggttgaggcttttgggggcggagataacaagagggtgcttgggggattgaaggtgaagaatgtggtgactcaagaggtgtctgaattgaaggtttctgggttgtttttcgcaattgggcacgagcccgcgaccaagttcttggacgggcagcttgaattggattctgatggatatattgtgacgaagccggggacgacgaagaccagtgtggagggagtgtttgctgctggggatgttcaggacaagaagtataggcaagctattactgctgctggcactgaacgtagtacgggtgtcgtgtcggtgtcggacactaacacagacgcttgtcggacaccgaacacgacaaggggctggggtgtccgtgcttcatag

SEQ ID NO: 108170 - DNA, 363 bp, Glycine max
  Peptide Sequence Number=SeqID_224948
atgtgtcacccaactgcatatgtttgtgtttactacaatatccaaatctgcaacactaatgagggcaccaccttcattagtaacaacacaaaaaacttttatgacgatgctgatgttcgacaaatgctcaacattttttacaacaatccactactaccatttgtggagttatttgccataatttgtgacaataataacctaccaagcaaccaatatgagtcaacctccaatcttgaggacctatcagatgaatacgagagttgttgggtcaaaaaccatggtagtgatactgactcctcttccaggcccgaaggaagtaacatgtcttcatcccatgaaacaatattcaaacgggattggtaa

SEQ ID NO: 108171 - DNA, 441 bp, Glycine max
  Peptide Sequence Number=SeqID_224949
atgggaaatcaacagagacaaggatatactaaaggaggattttcaggcttccagcaggaaaagaatcccaaggaggaatgtaaagctgtgatgacaaggagtaagaggtttgtggaggcggaggttgaggatagtattgtatccaagaagaaagctgctgaaaagaaaggtattgatgaaaagaaagatgatgtgagaagtgaaagcaatcaggaaaaacaaaaacaaataatggtcaagaaaaaagaattaaatgaccaagaaaaagaaaatgaaaatgaaaaaattgaaaaagatgaaaaaaataagaatgaagagaggagtagaagtgaacaagctagagagaagaaaagagaaaaagttgtgaatgaaggtgcggaagtatcatatctgtggtaccctccaagaaggagaaggatcgccatttcacgagatttttag

SEQ ID NO: 108172 - DNA, 180 bp, Glycine max
  Peptide Sequence Number=SeqID_224950
atgggcctctttctcaaccgctttaacgctggaaattcgatatccttggtattcagtaatttctcatctgtaagtagaagtttacactgtgccgatcgtcaattgaaggaacatgaagacggcaacaaaaagctcatgaaaaatacgattgctcacataaactgccgtagattaacatag

SEQ ID NO: 108173 - DNA, 144 bp, Glycine max
  Peptide Sequence Number=SeqID_224951
atgaatggtaacatgagacagccgagtgatgaggttcctccgccgttcacttcaaccgccaagggcagcaattcactcattccggcagctatgggaatcaatgatgatttgcagacgaaggatttggaagaggagagatattaa

SEQ ID NO: 108174 - DNA, 306 bp, Glycine max
  Peptide Sequence Number=SeqID_224952
atgagccaggtgactgttttggtggctggatctgatggtctgattcgaggaggacctgtgtttgttagcacaacgagtaagcatgatacacacaacatggcaagtgaagagtacccgacggaaaatgatgagcaggttccattgttcctattcgaggaccaggctgaacgtatggcagacgtagtggatcagatctataaggctacgttgaaggagctcaataatcaaacaaatatatatatatatatatatatatatatatatgtaacgccttctggtgatcgatgtcaccagatcaagaattga

SEQ ID NO: 108175 - DNA, 189 bp, Glycine max
  Peptide Sequence Number=SeqID_224953
atgattgagagggagaaagagaaaaacgagaatgagaaaagcaaagggattgtggcaagcttgagcttcgtggaggtggcagatcatgagatggagggtggtggtgtggtggaagggaagacaaaggtgttgtactttgtgtcaatttcaaactttaaggcttattgtagcaaatatgtcaaagtttaa

SEQ ID NO: 108176 - DNA, 1704 bp, Glycine max
  Peptide Sequence Number=SeqID_224954
atggagtgtttgaattcggtggaggaggtggtggaggagataatgaggattcacagatcccttccagcccggccagggatagacgaagtcgaagtggctagaggtttgatcgggaatgttgaaaaagaagaccaggcgaggctccaagccatagcgcggcagagcaagggcgttcatgtgccccaagagctcttcatggtgctccaggagatgcagaggaacttcctttatcaccagagcaaggaccagataagagaggccgtcaaactcctcgatctcgataacgtccattccctgttcgatgaattgattcagagagcttccaagtgtgttgcttctccctcttccaaaacaagttactctaacgctaacggctctgcttcctcggtttctaccagcttgtccaagaattcggtttctgtgggcggttttgataagccgccacttgcccctgctgctactacttctagaaagttccacgcagagaaagaacgttctgagttggtcactcgagatgacagttatgtgaagaagtccaagtcctcgttttactctaatggatatggaattgaacccactatcccatcaaaatcaagtattttggattcgtcattaaaacctacaaccactgcaggtcaagatggggataagttgagtttgatcaagcttgctagcttaattgaagtgtctgcgaagaaagggactcgtgatctcaaactgcagaacaagttgatggatcaggttgattggctacctgactcaatagggaagttgtccagcttggtgactctcgatttgtctgagaatcggattgtggccctacctgctaccattggagggctttcgtcgttgaccagattggacttgcattccaatagaatcacggagcttcctgattctgttggaaatctccttagtctggtttatcttgatctgaggggaaatcagttaacactattgcctgcttcttttagcaggttggtgcgtctagaggagcttgatttgagttcaaatcagctttcagcacttcctgatactatagggtcgcttgttaggcttaaaatattgaatgtggaaacaaatgatatagaggaacttccacattctgttggtagttgttcttcccttagggagcttcgcattgactataaccggcttaaggcccttcccgaagctgttggaaagattcagagcctggagattttgtctgtgcggtacaataacatcaaacaactacctacaacaatgtcatccctaacaaacctcaaggaacttaatgtgagtttcaatgagcttgagtcggtgcctgagagcttgtgttttgccacctctcttgtcaagatgaacataggaaacaattttgctgacatgagatccttaccgagatccattgggaaccttgaattgcttgaggaattggatatcagcaataatcagatacgtgtgcttcctgaatcgtttaggatgctcactcaactacgcatcctgcgagcagaagagaatcctcttgaagtcccaccaagagaaatagctgataagggagctcaggctgttgtccagtacatggctgagcttgttgagaagagggaaaagaaggatgttaaagcacagccactaaagcagaaaaagagttgggctcagatctgcttcttttcaaagtctaacaaaagaaagcgtgacggggttgattatgtgaaaacctga

SEQ ID NO: 108177 - DNA, 126 bp, Glycine max
  Peptide Sequence Number=SeqID_224955
atgcgaatgaaacgggggacacgtccaaaggtgtatccagctggcattgtcacaactcaggccaatgtcataacccttttctgcgacggaaacgggtcacgtgctgtggcactagctgtcccctga

SEQ ID NO: 108178 - DNA, 158 bp, Glycine max
  Peptide Sequence Number=SeqID_224956
atggcggatggtggaaggccaaaattccaccatataaacatgccgttgcggcctacaacgctaccatggtgggcctcccttcacaaattgcttatgccaattggcaaaaaatcagccatggcacttccatttaacaacataagtcataaacagatcag

SEQ ID NO: 108179 - DNA, 237 bp, Glycine max
  Peptide Sequence Number=SeqID_224957
atgatcctcatggacgtgacgaccattttgcagataattggaattaatgaagctacagcaagtttgtggaagatttgttgtatggtgggtggtggtttagcaggctcagagcttgaagcacttcccccgcttggaggtggagggtttgtaggacaaagagcattttggattgtaaccttttttgctggttccatggatatatgtgctatacacttacaactagcttatatctgttaa

SEQ ID NO: 108180 - DNA, 243 bp, Glycine max
  Peptide Sequence Number=SeqID_224958
atgataagacgattactgaaaaagagaatccttgagtaccgattgatgcttcataaatggatatacacgagtcatttactcttgaagaatgagctccaagaaaaaggaagaggttcaagaaacttaaatgctaaggttgttgttaagagaaaatctaccataacagaagtagagaatgaaattgaaaagatggttggagaaggtaaagaaagagctaaagctgtgagagcatttgatgtttag

SEQ ID NO: 108181 - DNA, 171 bp, Glycine max
  Peptide Sequence Number=SeqID_224959
atgcatgaaggaatgcatatgacacagatgcaatctaggaatgcggggtcccaaggtattgtccccttcttagatacaacgtctaggggtagcaaagggccccaacaggggatcaagactgaacccgtatgcgatgcatatgcaaaagacgcaatacgggaatgtacatag

SEQ ID NO: 108182 - DNA, 765 bp, Glycine max
  Peptide Sequence Number=SeqID_224960
atggagggaagaatctgcgaggaattaacgcccaggtattatgctctttgtgccattggaggaatgctcagtgctggcaccacccatcttgccatcactccctttgatgtcttgaaagttaacatgcaggtgcacccaattaagtattacagtatttcctcttgctttactaccttactaagggaacaagggccatctgttctttggaaaggttggaccggcaagttctttggctatggtgctcaaggaggatgcagatttggtctctacgatgcgtctgctgaagtgtttgccaatgtagctctatgtccatttgaagctgttaaagtgagggttcaagcacaaacctgttttgctaagggattgtatgatggctttccaaagttatatgcatcagaaggcacacgaggggtagggaagagagagatcatcttgccatctgtgagagaattgaggcctttgggcattgggaggtgcaaaccctcaaagttttgcaagttaggcactgtatcaaggggagaaatcccttatctttctgataagataccagtttccatggttatgttctcaacatttgagcattccgttgattttttgtatcggaatgtggtcaaaagaaaaaaggaggactgttcaataggtcaacaacttggtgtaacatgtttagctggatatgcagctggatctgttggtagcttcatttctaatccggctgacaatattgtatcttctctttataacagaaaggctgatagtcttgcactg

SEQ ID NO: 108183 - DNA, 555 bp, Glycine max
  Peptide Sequence Number=SeqID_224961
atgggttcaaggatgaaaacagcagtatttgaagagcaaacaaacaaggctctgaagaaatggcacatggatgcgaagaagaagaagaagaagcatgtaggaacagtgacactaggaaagtcgagtgcacgaatcatggatggaagccccattggtaattcttcaacagtgcactcctcctctgttcccacactacaccgtttcaaaactaccggccactcaacaacgtacgaggatcaagatcatgatcatgatcatgaatatgaatccgatgatgttgagttgtttcctgtgtcgtcgcaaacaactagcttcattgtaagagtggaccgtggcgaccaacaacaacaagcagaagaagaacatagacaacatagtgagggagaaaccaacagtagcagtgaagtttggaagacagtcttcggtcttggcctcttgttgaatttgtctgctaggatcttagagtccacttcaaaaataacattggagaggtgcgttgagaagataactggacagcttggaagaggccccaagcttcagcaagaacaaatctaa

SEQ ID NO: 108184 - DNA, 2226 bp, Glycine max
  Peptide Sequence Number=SeqID_224962
atgatggaggttgtgattgttgcaattgctgctacacttgggaatcttctgatgggatgggatagttcaactattgcagcgggtatgacctacatcaagaaggaatttgtcttggatgccacacttgaagggctaatcgtgtccatgtcgtttataaccggcaccattgtgacattattctcagggacagtttctgatttggttggaagacgccctatgctgataacatcttctattatgttcttccttagcggtttggtaatgttgtgggcacctaatgttgttattgttctgttagcgaggataattgatggggttgccattgctcttgctgttactcttactcctctctacatatccgaggtagcgccggccgatatcaggggccaattgaacactcttactcagtttgcttgttctggtggaatgttctttgcttacatcctggtgttctcaatgtccttgtcagattcgccaagttggagactcatgcttggggttatttttattcctgccattgcttattttttactggctgtgttttacctgcctgagtctcctaggtggcttgtgagcaaaggccggttacttgaggctgaaatagttctgaaaaggcttcgcggcactgaagatgtttcaggggaattggcgttgctggtggagggtctcagccctgggggtgaagccacttccatagaagagtatgtggttgccccagctagtgagcttcttgttaaccaggaagcagggaaagattatataaagttgtatggtcccaatgatgagggagttacaatggttgctcaaccagtgaatggacagggtagcatgatatcccgtagtatgttgtctcagcaaggaagctttggaactctgactggtggtggtcttaaggatcctattgtcactctctttggaagtttgcatgagaatactctcccggagagtggaggttcacacagtatgctacttcataatgccaacagtatctttagcattggagagacggccagtccctttggtaccaacgacaacctgcacgcgctactaatgccacttcaagggggtgctggggagaaggatagggcttatgggtccaaggacatgttaggtatgaggagcaatagcagcctgagaagtaatagtagtttggttcatgggaatgctgttgacgctcctaaaaataccaacattggtggaggttggcagttggtttataaatcagctgatggtgctggtggtgggaaaagagaaggactccaaagggtttatttgcacgcagaaactgcggcagtgtctcactctcaacatgtttcatttgtttcaacttctggctatgacataccgatagatggtggtgaagcgtatcaagctgctgctcttgtcagccagtcagttctaggtactcatgatatgttgcatctgccagaagttgctgcacaaggaccaaaatggagagctctgctagagccaggagtcaagcgcgcattaattgttggagtaggacttcaaatacttcaacagctgaagctaaggatattcacgatggagacttgcacatacactctcgcttcttcttctgctgctggcataaatgggtttctatactatgctccccagattcttgagcaggcaggagtaggggctcttttatcaaatttgggccttagttcagcatctgcctcttttcttgtaaatatcattacaacattctgtatgcttccttgtatagctctcgcagtaagactcatggatatttctggcaggaggtcaatcatgctgtacactgtacccattttgatagtttgtctcctgatactagtgatcaagcagttctttcaaatcaattctgtcgtcgatgcagcaatcactgctattagtgttgtggtttatgaaagcgtcttctgcatgggcttaggcgttattcccaacatcatatgtgctgaaatcttcccaacaagtgttcgtggaatctgcatttctctgacttctcttacatattggggttgcaccttgattgtcactttgatattcccctacttgctccagcttctcggtctcactggtgtctttggattatttgttgttggctgcatcatttcatggatatttgtctacttgaaagttcctgaaacaaaaggcatgcctttagaagttattattgaattctttgctattggtgcaaagcctggtactgatcctgccgcattgggaatcaaaggttga

SEQ ID NO: 108185 - DNA, 681 bp, Glycine max
  Peptide Sequence Number=SeqID_224963
atgacgcgcgcgttcagaattctaaactccgcggacaacgccaccgcggtagccgcggcggcgcctccgccggaggcggtagcgctggagtccgacttcgtggtgattctcgcggcgctcctctgcgcgctcatctgcgtggtggggctggtggcggtggcgcggtgcgcgtggctccggcgaggctcgggtgccggaaactctcctcggcaagccttggcgaacaagggcctgaagaagaaggtgctgcagtcgcttccgaagttcgcgtacgtggacagcaacccgagcaagtggttagcgacgtcggaatgcgcgatctgcctcgccgagttcgccgccggcgacgagatccgcgtgctgccgcagtgcggccacggcttccacgtgccctgcatcgacacgtggcttgggtcccactcctcttgcccttcttgtcgacaggttttggcggtggccaggtgtcagaagtgtgggcgatttccggccaccggtgccggagcttccagaacgccggcgaccgaacccgaattgaagtccagagaagacaacaatgccgcgagttacagcaataataatattaataacaacagcgacaggggtggcagtaacagtaatagtaattgtaacatggaacatcatcatcacagccaccatgtgaatagtgggttcttgccctga

SEQ ID NO: 108186 - DNA, 270 bp, Glycine max
  Peptide Sequence Number=SeqID_224964
atggcaagggaagacacgtgcgagcctacggagaaagcgcgttgcgggattgccacaatcgcgtttccaccactaggctcaaaaacaggtcagggcccaaaacttcctcaaactaggcccagctttttcagatcaggccaagacttttgtaaaatttatttagttttaaaaggaacaaaagatttcatgagaattatggataaacaaagtgagattgggtgtaggagacgaactgctgcgttcggtgatcacaacccagtgacaatgtga

SEQ ID NO: 108187 - DNA, 1137 bp, Glycine max
  Peptide Sequence Number=SeqID_224965
atggcagctggtgggagtagaagcggttccagagacctcgaccagacaccaacatgggccgttgctgctgtctgcactgttttcatcttgatatccatagcactcgaaaagagcctccacaaagttgggacgtggcttgtacaaaagcacaagacggctttgctcgaagctctggaaaaggtcaaggctgagttgatgattttaggtttcatttcactgcttttaactttcgggcagagttacattgtcagaatatgtattcctgaaaagctcgcagacattatgttaccatgtccgtataaggaagccaaaaaggcatcagatagtgaagaggaacatcgtaggaaacttttgtcctatgagcgtagatatttagctgctgatactgcctcgttcaaatgcagcagggagattagcaaattgaaaacagttgcttatcagggacatgagccacttttatctgtcaatggattgcaccagttacacatcctcatattcttcttagcagtcattcatgtgttttacagtgctatcacaatgatgcttggaagactaaagatacgtggatggaaggcatgggaggcggagacttcaactcataattatgagttcgccaatgctgcttcaagatttaggtttactcacgaaacatcattcgtgagagcccataccagctttttgacaaggattcccatcttcttctacattcgctgcttctttaggcagttttataggtctgtaaataagactgactacttgactttgcgcaatgggtttatcactgtccacctggctcctggaagtaaatataatttccaaaagtttatcaaaagatcattagaagatgacttcaaggtggttgtgggagtcagtcctatcctctgggcatcagttgtagtttaccttctcatcaatattaatggatggcgtaccacaatttgggcagccttaattcctgttgtcttaattttggctgttggaacaaaacttcaagctatattggcaaagatggctcttgaaatcaccgaaagacatgcagttgtccaaggaatgcctcttgtccagggctcagacaaatacttttggtttggtcaaccacagttagttcttcatgttattcattttgctttgttccag

SEQ ID NO: 108188 - DNA, 1317 bp, Glycine max
  Peptide Sequence Number=SeqID_224966
atggcggcggaaccggcgagtgacggcggagccgaggcggagaaattggtcagcaggagagaagaattcgtcgattcgtccaacttgttcagcgcgattctagcaatggcgctgtggctgtattcacttcaacatcgccctggtcctcttcgccgtgtttttccttcctctctccaaatcgatcttggttttcggttttctctttgtctttatggtgcttcctatcaaccaaaaaagttcatatgcaagcacgcctgcaattactttcccatcacacttcacgtagaggatatgaaagcctttgatcctaatcgtgcttatgaatttagcctaataagtcattggaatactgtttacttgtatcttcttggtcgtagctctttcattgtaacaacagtttgcccaacatgcagtttttgggtgttctacacaccgtttttgagacacacatggacatggttgggtcttacaccggcaacaaagaaaatttttatctccctgttagcatctggtcatagttgcattttaatacctggtggagtgcaagaagcatttctcatgcagcgtggcactgagattgctttccttaaggcaagaagaggatttgtccgcataacaatggtgaaaggccgacctttggttccagttttctgctttggccagtttgaagctgttccttcacaccagtattgtagaaatgctgaccaaagtcacatgcaatcaactgctgcatctccacaatcgttccaggccttacttactggcttcgaggctcagacttggactcctgtaaagtgctgctggagggcactatgggacatgatgaactctacaggttcacaaatcttgtcattccaagagatgatcgtgctagtgctagtgtgcatgattcctcaatttaatatcctctacctttttggcagaatactttactgtctgtatctcctatgtttagctcctgtaattcctgctacacatgttaattcacccactgcacttagttcatatgtgaattggcattcaaattttttgcagtcaaatgtctataagtggtggaaaccaggtgggaagttctttctgaaatttgcaagggctatccctggtgcagcggtaaagttgtgccttggtgacctgttggtcatgggatcaaatccggaaacagcctctttgcatatgcaagggtacggctgcgtacaacatccctcccccataccttcgcatagcgaaaagcctctgggcaatgggctttttctcatttcagctgttttcactagcaaagttgctaaggtttcttcaaaaaggaatgagtctaactaa

SEQ ID NO: 108189 - DNA, 2136 bp, Glycine max
  Peptide Sequence Number=SeqID_224967
atggagtttgagcctttgagtctaagcgacgaggttattgaatttgatatgattggtttgggggatgatgctgccattgacacggagcaccctgtcgaggatgatgaggaccttgttaatattgataatagtcctgctactgcttttactgttctagctgctggtttgggacctcacattgctggaggggacactaatcttgaaccttgtcaaggtatggaatttgaatccgaagaggctgcaaaggccttttataactcctatgctcgccgtgttggctttagtacgcgggtgagcatgtcacgacgctccaggcgtgatggttctataattcagaggtcttttgtgtgtgccaaggaaggttttcgtgtggagagggagaagcatttggttgatggcagagtcaagcggcctcgtgctgaaacccgtgttggttgcaaggccatgttggttgtgaaaatccaagattctggtagatgggttgtttcttcttttctcaaggaacataaccatgaattggttccgcctgacaaggtgcattgccttcgttcgcaccgccatgtttcaggtccagctaagtcgttgattgatactttacagggtgccggaataggccctagtggaataatgtctgcactaataaaagaatatggagctattagcaatatcggtttcactgagcgtgactgtaggaattatatgagaagcagtaggcaaaggacccttggaggtgacactcaaatccttttggattacttgaagagcaaacaagcagagaatccttcatttttctatgctgtacaactacaaggtgatgaagatcattgcatgagtaatatcttctgggttgattccaaggccaggactaactacacttactttggtgacactgtcacctttgacacagcatataggtcaaaccgctatagattgcctttcgcacctttcactggtgtaaatcatcatggacagcctgtactatttggttgtgctctcctgataaatgaatctgaggcctcttttgtttggctgttcaaaacctggcttgaagcaatgacaggccaacctccagtttcaattactactgatcatgatagggtgattcgtgcagccatcaacaatgtctttcctggtacccgtcaccgattttgtaagtggcacgtttttaaagagtgccaagagatgttatcacatgtgctttctgaacatcttaattttgaagctgacctccacaaatgtgttaatctgacggagtccattgaggagtttgagtcttgttggtcctccctaattgataggtatgatctcaaagaacacgaatggctaaaagcaatttatggtgataggcggcagtgggtaccagtgtacttgagggacacattttttgctgaaatgtcaataacacagcgaagtgatagcataaactcttatttcgatggatatatcaatgcatcaacaacacttcagctttttgtcaagcagtatgagaaagctctggagagccgttatgaaaaagaagtcaaagctgattatgacacaattaacactactccagttctgaagactccatcacctctagagaaacaggcagctgaagtttacacaagaagattgtttatcaaatttcaagaagagttggttgagacattaacattcttggcaaacaaagtagatgagaaagaaataattactgtgtatagagtagccaaatatggggaaatgcacagggcctactttgtcagatttaactcttttgagatgaaagctacttgtacctgccagatgatagctaaaagtggggccatattggatgaacgtactactaatttgtcaactcgtgcccaagaatccctaactatccgatacaataaccttcgtcacaaggcccttaagtatgctgatgagggaataaactctccaaaagtttatgatgtggcattgagtgcacttctggaagctgcgagtaaagtggcacttgcaacaaaaaatggtggaaggcagactattttaaatggaacatgtgaagaagaccttcatcagagcaatgaagcaactacaagttgcagcgattctcctattggttcacaacaatcttcatacaagttgcaaagatggtttcttaaaggtagttcgtga

SEQ ID NO: 108190 - DNA, 168 bp, Glycine max
  Peptide Sequence Number=SeqID_224968
atggcatatggatttggagactttcattgtcagatgaccacgggacacggggagaaaattaagcaatgggtcaatgaatgggaggcaagttgtgggagaatatcggtggactctttgcacaaaggcttaagtttcactcctatcttttttctttatcttatttgttaa

SEQ ID NO: 108191 - DNA, 336 bp, Glycine max
  Peptide Sequence Number=SeqID_224969
gcagtacgctccattgtcatggttggttgtgaccctaaagggaccttctcagttggggctaagctttcccgctctaggatcttttttggcttcctctcggactcgccatacgaggtgcttgatccctatccttgtcaagaagtcttcgtaagtctgagctttgaattgagtgtcgttgtcggtgacgatagcatatgggaggtcgtacttggagataaggttgttaggagaagtgcatggaacgtctgcaaactcttgacatcttcggcatctcttggtaaagttgagggtgtctatcctaagtgttggctagtagtggccaaggagcgtcctctg

SEQ ID NO: 108192 - DNA, 513 bp, Glycine max
  Peptide Sequence Number=SeqID_224970
atggtgaaaaggtgcacggatgaacataatttttctcagcatgttgtcgggctctccgcctccgcattacaaaaggtgcagaatgtccataatttgtctctgcgtgccaccggactcgatcgtctctggatggcgaaaggtgcgcgaatgaacgtaatttgtctccgcctgtcatcgggctcgccgcctctggatgatgaaaggtgtagaataaccataatttgtctctgcgtgccatcgaactcgatcgtctctgggtggcgaaagaatgaccataatttgtctctgcgtgcctccggactcgatcgtctctggatggtgaaaaggcgtgcggatgactataattttactccgcatgtcatcgggctcgccgcctctgcattacaaaaggtgcagaatgaccataacttgtctttgcgtgccatcggactcgatcgtctatcgatggcgaaaaggtgtgcgaatgaccataatttgtctctgcatgtcaacgggctcgccgcctctggatga

SEQ ID NO: 108193 - DNA, 204 bp, Glycine max
  Peptide Sequence Number=SeqID_224971
atgacgagagaaaagtctatgttccaatgcctgactccatatcatggtggaacaatcactttcagagggaataaaaaaggcagaataatcgacatagtggatatggtgtatccttcaacaaggataagtgtgtcattctatgtgaggatgggtctcccttattctctgctaagagaaaaggcaacctctacaggaaaagactag

SEQ ID NO: 108194 - DNA, 474 bp, Glycine max
  Peptide Sequence Number=SeqID_224972
atgggtagaatgaagtataacaaaatcatgtttaatatgaaaaacaacttaaatggcaaggaacatacctcccaagaaaggaaagatattgagctggtagacgaggaagaagcccagattggtgctgatcgttctagtgcaacctctaataaatctgagatttataacgaggaagcatggaatgcagcacaaaagcataaaccaaagagggtggagagtgtcaatgctgatgcagaagcctttgatgttattccttctggttcgagtaataataaccatgacaattctctccataacacaaagaggggaacgaacaacaatttgaaggttgtacattcaggaactaaagaatgcaaaatagctagtaataagagggatttgtttttgggattttctgagcaccaagagcggctatgcaagaagcttgcacttgaggagggaaggatatatgcagctaatgaacaactttcttaa

SEQ ID NO: 108195 - DNA, 263 bp, Glycine max
  Peptide Sequence Number=SeqID_224973
gttgcacactttatggtggagctcatgggtcaggcttgtgtattcccactaaagaaacgtctcatgaagttaattacatgggaaaccagcctggacaaaattttaatgcagtccagggtgggccacctaacaggccacaacaacaagggcctagcttatctgagagaacaacaaagctggaagaaactcttgctcagtttatgcaggtgtcattgactaatcataagagcacagagtcagccataaaaaatctagaggtctag

SEQ ID NO: 108196 - DNA, 552 bp, Glycine max
  Peptide Sequence Number=SeqID_224974
atgggggcgtatgtgaaggatgagaagctcttgatgcatttttttcaagagagtttgactggggcagcaatcacttggttcactaatttggaatcttcctggattcgttcttggaaagacttaatggttgccttcatcaggaagtatcagtacaactccaacatggctccggatagaatgcaggatttggcggctcaagtagtgcctccaatgatggaaagagaaatgatcacaatgatagtagacactttacttgtgttctactacaagaagatggtggggatcaaggtaggcctaagaagaggcaaattcaattatgctgcttcaacaagtgatgacaataggaagactgaaacaggtggagctaagaaaaaggggggagatgcctatgtcgtaaccacagctcccacatggtcaagtttccaacaaacccctcacaaccccactgttgattttcaccgtctcacaaagacaatcttcgggcttagcgagccatccgctgagcacaacactcctaggctgagcgcgaggaagaatctggaagaaggatga

SEQ ID NO: 108197 - DNA, 1659 bp, Glycine max
  Peptide Sequence Number=SeqID_224975
atgagtgatgcaaaagaaaacgaggaagctggccagggggtgccctcggtcgtggaagaaaaccagcagttggttgatgcagaggttcaagatcaacctgaagctgcctctgctcctgttccagtagaggaaacttcaaatcatgttgaaattgggtcagatcatgttgaaaatacgaaggaagagccacctgctgaggataaaaatgtagaattagaggttgtttcagagggaattccacaagatgttcaaaatactcttctctctgtcccagtagaggctgatgctcaaattttggataggactgagtctgaagaagctgaagcttctggtgcgaaggtggaggctgatgaattaccacagaataataaggaggctgagaataatgatgatattcatcaaaaaagtaatggcgatgttgagatggctgtggaggttaagcctgaagactgtggaatggctgatagtaaagcatgtgataatggtgaccctgtgcttgcaagtcataatgagcctgctacgccacagcctgctcctgcagatacaaacactgaaattatgaatgtattagaagttgagaataaggttgatgaaaagcaagtggctgaacctgcagataacgggaattcaaactcaaagcacatgcttttcttggatgccgaccattcctatgatggtaatgagtcaggaacagaggaagaacagtcagcatttatgaaggagcttgaaaacttctttagggagaggagcatggaattcaaacctcccaaattctacggagaaggactaaattgccttaagctgtggagagctgtaacgagattgggcggctatgacaaggtgacttcatgtaaattatggcggcaagtgggagagtctttcaaacctccgaagacatgcaccactgtctcatggacttttcggggattttatgagaaggcacttcttgattatgaaagacataaaatacaaggtggtgagctgaatgtgcctgttgcttctcatccagagcctataaatattgaaaatcaggcctcagcatcaggtagagcccggagagatgctgcagcacgggctatgcagggttggcactcacaacgtctcctaggcaatggtgaagttagtgaccctattattaaggataggaattctgtgtctgtgcaaaagcgtgaaaagcagcttaaaagcatcaatatacacaaacgaaagaagccatcttcaccttacatggataatgcagtcaaagctgcacgcagtaaaccatctaaaccacaattggacacaactgtgattgatattgggcctcctgctgattgggtaaaagtgaatgtacaaaaaactaaagattgttttgaggtatatgctttagttcctggcctactgcgggaagagcatatcatttttgctatttctctccttcctttgagaggaagttgcaatatgggagaggcaaaagtcatggtagtccgtgtacagtcagaccctgcaggacgcctagtcataagtggggagcctgagcatcccaacaatccttggggtgtgacacctttcaaaaaggttgtcagcttgccctcaagaattgatcctcatcagacgtctgcggtggtgacactgcatgggcagttgtttgttcgtgtcccatttgaacatgcagaatag

SEQ ID NO: 108198 - DNA, 546 bp, Glycine max
  Peptide Sequence Number=SeqID_224976
atgataccaactagacttgttgtaggggcattggaagaaagtggtgatccaaatggtgagaaagcagaaagaggccctggagcaataatgtcatctgggtttggagggcttggattggaaggaatggtgggaatgtctgagccagcagcaggagttggcaaaacaccaccaggagaaggcagcagtggagcaatgtctggggacagctcttggaaaggagatagtgaagagggagatggaggaggatccgttaatgttgctggtgaagatgagagtgtgggaactttgggaataggttcttgtgaatatgatgaaagaagagggagatggagaatgtgggcatttagtggaaaaaaggatgcaaaggctttaaatcgtcggggcctgaagatctgcaggttcccatcatctctctctcacctccaacctaagactaggtggggtcaaatggggcaccacgtggcaagattccattggatgatgataagggaactcagtttttttaccttgaggaagagacaaagattgggaaaggtttccatgtga

SEQ ID NO: 108199 - DNA, 3000 bp, Glycine max
  Peptide Sequence Number=SeqID_224977
atgcatacgcagaccgtttacaagggcaggaagaagaagactattgagtatttcgccatcaaaagcgtcgataaatcgcagaaaactaaggtccttgaagaagtcaggattcttcacacattggatcatgcaaatgtgctgaagttttacgactggtatgaaacttctgctcacctatggttggttttagagtactgtgttggaggggatctgctttccatattacgacaggatagtcaacttcctgaagattcggttcatggttttgcttataatctagtcaaagctttgcagtttttacattcaaatgaaataatatattgtgacctgaaaccttcaaacatcctactagatgaaaacggatgtgcaaagctatgtgattttggattggcgaggaagttgaaagatatatcaaaagctccttcttcctcgttaccgcgagcaaaacgtggaacaccctcttacatggctccggagctttttgaggatggtggagtccattcttatgcttctgatttctgggcactaggctgtgtactatatgaatgctatgctgggaggccaccctttgtgggaagagaattcacccagcttgtaaaatccatcatttcagatccgactccacctctccctggtaatccaagtcggccttttgtcaatttaattaattccctgttggtaaaagatccagctgaaagaatacagtggcctgagctttgtggacatgccttttggagaaccaaatttactctgttgcctctgcctgctcaacctgcctttgatgatatgatagagctacatgctaaaccatgcttatcagaacgtaatggagataaatcttcgcataacaggacccctaccaaatatcgtgaaaaagatgtcaaaggggcgttgagaaaggatgagaactctgttttaggatctagaggcattgagacaccagcaagggcaacaccaattggccacagaactcagacaaagggttctggcagaatacatgaggtaaagcaaaaagataattctaacattagcaagggtgtgaatcttttgagactgtcaagaatagcaaaaacaaatttacagagagaaaatgagaaggaaaactatcgacgccccttgcctaataactctgagaatgattctgaagttaaaattgagaacactgacatggaacttgattttaacgagaatactgaagatgatgcgcatgaagaaactgatggcaccgaacaaacaactcctgtgcctgatgagaaaacagacaatcattttctgaaccagggaaaagcagaggagattgaaaataatacacaccagttggacaccccatctgttgttcaccctccagtctcggatgacccaaggtcatttgatcatgaatcaactcctgaccttcctgacatatctgctatttctcccagtgtgagccctcaggtgaagaagcatagaactaaagaagacgcaggatcaggccttgacttcgattcttcaaggttgtctaacaacctttcccaggttctttggcatccatctgatctctcagtcagacctgtaatgcctagcagaaaaattgataaagcctcagaagtcattccttcactcccttttgaggcattgcaagcatctgattttgtcaagatgcccaaagagaaattggaggcaatccacaaccgaatattatccattttgaatggaaataccagcattggagagaaacagaatgtgattaggtaccttgagatgttgagcagtaatgctgatgcagctaatatcttgaccaatgggccaataatgctcatgcttgtaaaattgcagcgtcaatccaaggcatcagctttgcgtgttcaacttgcttcactgattggtctgttgattaggcactccacctttgttgatgacagtttggctagttctggaattttaggtgcactgactgatggccttagagacaggcaggaaaaagtaaggaggttctccatggctgctttgggtgagttactattttatatatccactcaaaatgcggactgcagggataacaatcaacttgaatctccatcaaaggacaataggactacacatggctggcaggttccaaattcattaatatcacttgtgtcatcaatgttgcggaagggagaggatgatataactcaattgtatgcattgagaacaattgagaatatttgcagtcaaggaggttcctgggtggggcgtttgtccagtcaatatgttattagtaatctctgctatatctatagggcctcagggaaacaagagagtatgaggctcactgcaggatcatgcttggtgcgcttagttcgttttaatcctcctagcattcagttggttattgagaagctctcattcaaggacctagcttctgctcttgtcaagggcagtccacgagagcagcaaatcagcttaaatcttcttaacatggcaatgcttggaagtcacatgttcacaaatattggaagatgccttgtatcacttgctgaggataaaaatctgatcccaagtcttttgggtcttgtcgagcaaggtagtgaagttttaagaggaaaggcactagtccttgtggccctcctctgtaagcatggcaggaggtggcttccacacttcttttgtagccaaaagttactctctgtggtggataggttgggaaaagagaaggatgcttatgtgaggcagtgtttggatgcatttgtgcatattgtggcatccagtattccaggtttattggatataataacaggggatgtccagcaaatgatgggaggaaggcgccaaggacacatctctgcccttaccagcagatctgccccaaaaaccagcattcatttgtttcctgttgtccttcatcttcttggaacttctacttttaagcacaaagtagtcacaccgcaagtcttacggcagttagcgaatttaattaaactcgtggagacaccgtttcaggtatgtgcgactcagccgttgtatcttctttccttttaa

SEQ ID NO: 108200 - DNA, 186 bp, Glycine max
  Peptide Sequence Number=SeqID_224978
atggatttcgaaatctgccctattatgcagaaaaatgttgttgaattgtgcagcagatttttgatgtgtgcagaaaaatgcttgtgcattgctggttatgggaaaggaacctccagtaaaattttcaaggcgatccaacggtcaacgaatcagaacgaagagagtgttactggggtatatgagtaa

SEQ ID NO: 108201 - DNA, 951 bp, Glycine max
  Peptide Sequence Number=SeqID_224979
atgccgacaaaagtagagcttgatgattatttatcgcgggccgatgccgttccgcgcccggatatcgacgcgcggttaaatcatttgcaccgggtgaccagtcggcgccagccgtggccggaactgtgtatcttcgcctttgaccatcgtaaacagctggcggatctggcattagaaaccgggcgcgacccggcctgtattcccgaactcaaactgctactgttggcggccgccgaggcggccggcacagaggccggactggatcggcgcagcggcatcctcgccgatggtacctatggtcaacgttcacttaacgccattaccggtaaaggctggtggatcggtcggccaattgagctccccagctcgcgtccgctacgtcttgaacatggtaatattggctcacagctgatcgactggccgcttgagcacgtcgtcaaatgcctggtcttttaccacccggatgacccggcggcgctgcgcgccgagcaggatgcgctgctgctggaggtctggcatgcctgcaataagtccgggcatgagctgctattggaagtgatcctgccggagaacggaccggacaaagatgaacgccactaccacactatgctggagcacttctatcagttgggcatccagccggactggtggaagctgccgccgctggccagcgcccagtgggagcggatctcagcgcttatcgagcgcgaagatccgtggtgccggggcatcctgctcctcgggctggatgccccatcggatcgattgcgttcaggtttcgccgaagcggccgggcacccgatgatcaagggttttgccgtcggccgaaccatctttggccagccttcgcgccgctggatgcagggcgaactggatgacgcagcgctaatcgatgaagtgaaacgcaactatttacggctcatcggctactggcgcgaagcgcgcggctaa

SEQ ID NO: 108202 - DNA, 621 bp, Glycine max
  Peptide Sequence Number=SeqID_224980
atgatgcaggaaatgtgcgaggattccaaggtccagcatcataactccaccccttatcgaccaaagatgaatggggctgtagaggctgcaaataagaatattaagaagattgtccagaagatgatagtgtcatacaaagattggcatgagatgctgccttttgccctgcacgaatatagaacctcggtacaaacttctactggggtaccaccgtattccttggtttatgggatggaagcggtactcccatttgaggtggaggtcccttcccagaagataatagcggaatcaggcctagaagagttagaatgggctcaagcacgctacgaccaactcaaccttattgaaggtaagcgtttgacggcaatgagccatgggcgcctatatcaacaaaggataaagaacgcgttcgacaagaaggtacgcccgcacaagttcaacgagggggaccttgtgctgaaaaagatatcccacgctgttaaggataatcgaggaaagtgggccccgaattacgaagggcctttcgttgtgaaaagagctttttatgggggtgctctagtactcactaacatggatggagaggaactaccctcgtccgtgaactccgatgtcgttaaatga

SEQ ID NO: 108203 - DNA, 213 bp, Glycine max
  Peptide Sequence Number=SeqID_224981
atgaagaacgatgaagaacgatggaaaaccttcactgatttgctcacggcagcgttacggaacaacctcagcttggattttcttcatggaaacaatttttttcacccaaaacagctgaaatgcatagccaagggggttaggaatatttggaacagcctcccttcgcctatttataggaaaaggggggaggaggttgctgcccagctcgcccag

SEQ ID NO: 108204 - DNA, 324 bp, Glycine max
  Peptide Sequence Number=SeqID_224982
atgcgggggtaccttatggttatccgcaccttttgtcatgcacgggcaagcgagcccgttgacacgcagagactaacgtcgtcatctgcaccttttgttgaccaggggcaagcgagcccgttgacacgcagggacaaacgtcgtcttttgcaccttttgtcttccagagacggcgagtccgatgacatgcgggggtaccttatggttatctgcaccttttgtcaacaacaggcaagcgagcccgttgacacgcagagactaacatcgtcatctgcaccttttgtcaaccagagacaagcgagcccgttgacacacagagactaa

SEQ ID NO: 108205 - DNA, 1249 bp, Glycine max
  Peptide Sequence Number=SeqID_224983
aaaggccgagcagggcactgccgaccggggccagcacggaaactttccttcatcgacgtggcttcgcgggggaagaccagggtcagaacgtgcttctcgcccgacacttcatcttcgcactccacgcgcgaatgcatcatgacgatgccttcgggaatctggtccggtgccagcacggtggcacggttgagttcttcagcaagcgcgagcgcggcaggcgtctggctcagcgcaggggattcgagcatggcgtccaggcggtccatgtcgaaggtggaaacggtgatcgacggcggcaggccgctggcggtactcatggtgaagctccttggttgaaagccatgcaaaaggcggcacctgctggcgccgcctgtctgtattgtggggacaaatgcggccggaatcgactcctgccgattccaggccggtactgcgggggctcagccgttcagcgcggggccgggcagggcggcagtgtcgccggcggcgttgaccgcctccagggtgaacagcgcctgcggcaggcgcttgaactggtcggccagctccataaggaagtcgttcatggccgagctgcggcgccagatcatggcgatgcggcggctgggacggccttcgccggtgaaatcgagcaggcggatgttgttcgagcgcgggaccggcggttgcaccgacaggctcggcagcagagtgatgccgacgtcggcggcaaccatctgccgcagcgtctccaggctggtggcgcggaactcggacttctcgttggcaccgaacaggcggcagacttccagtgcctggtcgcgcaggcaatgcccgtcttccagcagcagcagcttctgcgtggccagttcctgcacgtccaggtgttcgcgacgggccagcgggtggcgcccggaaacagccagcaggaacggctcctcgaacaggaattcggcgtgcagctggtcgtcgatcaccggcagggccagcagcgcagcatcgagtttgccttcgcgcaggcggtcgagcagcacatcgctcttttcctcgaccagcagcagttccagctccgggaagcgatcgcggatgcgcgggatcacatgcggcagcaggtacgggcccagggtcgggaagatccccaggcgcaccgtaccggcttccgggtcgcggctgcgtcgcgccgcttccttcagctgttccacttcggacacgatcacccgcgcccgcgcggcagcctcctggccggccggggtcagcatcaccttgcgcg

SEQ ID NO: 108206 - DNA, 720 bp, Glycine max
  Peptide Sequence Number=SeqID_224984
atgtcagccaccattcctaactgcatctcctatgacccaacctttgcttatgagctggctgtgatcatccaggaaggtatgcgccgcatggtgcagaaccaggaagatgtgtactactacatcaccctgatgaacgaaaactacagccacccggccatgcctgaaggcagtgctgaaggtattctcaaagggatgtatagcttcagcaagtccaaggccaaaggccctaaagtacaactgatgggttcaggcgtgattctgcgtgaagtgattgctgcggctgaattgctggaaaaagactggggcgtgtctgccgacgtatggagcgtgaccagctttaccgagttgcgccgcgacgggattgatgccgagcgtcataacttgctcaatcctgaagccaagccaagactgagctatgttgcgcaagcgctggccaaagcggaaggtccagtgattgcatctactgactatatgcgttcgtttgctgaccagatccacaactatgtgcctaatcgttttgtcgcactgggtactgatggttatggccgttctgactcacgtgaagcactgcgtagcttctttgaagtggaccgctactacgtggtactggccgcactcaaagccttggctgatgacggcaagctaccagcaagcaaagcgaccgaagcgatcaaaaaatacaatatcgacattactcgtgccaacccggccacgatctaa

SEQ ID NO: 108207 - DNA, 474 bp, Glycine max
  Peptide Sequence Number=SeqID_224985
atgacattgctacttagcaacattcttcccagcgaccgcaacgccaatctccccctgcaaaagtatcagttggtctgtgtcgtcccgacatggggatcgcacccacaagagacacccagtggacccggaaaagtccaacagggccctggggtttccagctctggttacgggcctctatcagtcctacagggtgcccgtacccccccggcaaggtcacgtcatcatagggatcgcgactgcaagacacctagtggacccgaagaagtccaacagggtcttggaattgtcaaagctctaattacgggtctctgtcagttctacggagtacctgtcacctccagcaagggcatcaggccccctactaatcgagctttcatcaagaagtactgcgccccagacaggcgcagggcgatacaccacagcagcattgggatggtcggcagcgggaaacagacgcaccgccatcacctctag

SEQ ID NO: 108208 - DNA, 521 bp, Glycine max
  Peptide Sequence Number=SeqID_224986
atgaaaaagaaagcgctggcccaggtgaccgactttgacctcaaactgctgcgcgttttcaaaaccgtcagcgagtgcggcagcttttccgctgccgaaagcctgctcggtattacgcgctcggccatcagcctgcacatgagcgatctggaaaaacggctgggcatgcgcctgtgccagcgcggccgtgccgggtttgcgctcactgaggaagggcgtgaaattttacgacacagcgagaccatgatggcggcggtggaagattttcgccagcaggtgaaccaaatgcatcagcagctgcgcggagagttcaacatcggcatcatcaataatctggtgacgcagccgcgcatgcgtctcacccatgcactggcggcgctgcgggagagcggggcaggtattcgtatcaacatcagtatgttaaccgcggcggatatcgagcgaggtctgctggaaggacgcctgcacgtgggcgcgctgccgatggcggcgccggtctccgggctggcgtacgcacagct

SEQ ID NO: 108209 - DNA, 369 bp, Glycine max
  Peptide Sequence Number=SeqID_224987
atggatttaagtaatgtatttatgagcaacttgcttaaggtagaagcatcaagccctaaatcaaatgctcttgcaaatccactaagtcatacgatcagcttcaagagaccaaattggggaatctgtctaggtttttatcttttggcagaatgtgttaatcacttgacaaaactagagaaaagacgtgtgtccctgtcattaactttagctatcatccagtatgatgctattttgggggcctttttagggaaaacgcccagggagaattataagcaattggacttgaatccggaattgggcttggacttgaagagagcagacaattttattttatcaaatcttatcttatccagattttatttcatctag

SEQ ID NO: 108210 - DNA, 282 bp, Glycine max
  Peptide Sequence Number=SeqID_224988
atggaggagtttgaggctcaggtggactggctaggaggccaaccctcttcctctagagggggtggagcctctgcagcccaagagcctgatactgaggagccaccaacaccaacaccatcaccagcagcagtagaggagaagaccactccagatcagactcctcaaccatctccaacccctacacacatacctgaggatgctgcaccagttgctaagcctgagcagcttatacaggattcatcagtagctccagcattggatcttaatgaagaccagccatag

SEQ ID NO: 108211 - DNA, 231 bp, Glycine max
  Peptide Sequence Number=SeqID_224989
atggagtgcaacatctatggagtaaaaataaaatctgatggacctgtagagagaggagctggaagtggcatctatgtgagtgtaggaggaataaatggagtctgcatgggaggactcaatctctcatgggtcaaggaatcagagtgggctccccgggctttacatagagcagtgattagggcaggaaagccgagcctcgaggagtcatgctgggccatgagtgtaatctaa

SEQ ID NO: 108212 - DNA, 1170 bp, Glycine max
  Peptide Sequence Number=SeqID_224990
atgatcaatacattgctccttgtaatgtgtctagtaactagcggtgctaggcataaagttcatggtactcaaaatgtactacaagaagatttggagttggaaagacaactagagctccttaacaaacctcctatcaagagtattcatacaaatcttgggtacattgttgattgcattgatattaacaagcaaccagcatttgaccatcctttattgaagaaccacaagctccagagaaaacccagctttcaaaaatcaataggaaaaacaagtgtgaagaaatcaccaactaggccattacttgtgcttcagaaggaccagtgtccaacagggactgtacctattcgaagaacaacaaaagatgatctcattcgtgaaaaatcattcttaaattatcacataatgactcaagatattcccggtgttcatattgcagaagtatctctttcatcattatatggtccttattatggagttattggatcaaataatgtgtttaatccaagagttagtaggaaggatcaagttagttcttctcatttatgggttcaaaatggaccagtggaagctgctaacaaaatcgctgcaggatggcatgtggctccacaattatatggtgatgataaaacctatatttactcggcatggacgtcagataatttcgagcggacagggtgctacaatattcgatgttcaggttttgttcagataagcaaagtaaattaccttggtacacatgtgaacaattattctacctacggtggaacgcagcttgaatttatcatttctattactcaggatccagtgaccaaaaactggtggttaaatatggcaaatataaatattggatattttccagcagccttgttctccaacatgacctcagctgatcaagtggggtggggtgggcgaacaagaactcctcctaatactcctagtcccccaatgggatctggacactttcctgatcatacttttcatcatgcgtgttattttacatttgtctcgtttcaaaatgaagcaacaagaaattatggaattggaccacatggagcacaaacattctctgatagatctgattgttttggtgttcgatacttgggatatattgcagaggaggttggatattctctccaatttggaggacccggtggtagttgtggaaattaa

SEQ ID NO: 108213 - DNA, 375 bp, Glycine max
  Peptide Sequence Number=SeqID_224991
atggatgaggaagcttatcttgttatttgtgaaccactgatcatgttatgtgcacacgtagggaaattgctggattcgaggccaacacctccagaatgcaaggaagaagaagagagaaaaaggcacagaaggaaaggaagcttgtattttgttcattcatatccctcaatggtttgctccctttcacgccactattcttcatacgtgcaccactatacccaagtccttgaagtaggcttgttgtttgcaccatattttctgctagttgagcatggaacccgtgtgtttgctacccctgtgcgtccttctacctatcatatcacatcctcaaagaagctaatcaagcaagagttcaatcccttcataggttcttaa

SEQ ID NO: 108214 - DNA, 804 bp, Glycine max
  Peptide Sequence Number=SeqID_224992
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcacgtatccgctgaactcaagaactagccctgtctccttgtatccgagaaagatatcaacacgatcaccacgcttaatgcgcttctctagttctaatctttggttgtatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 108215 - DNA, 540 bp, Glycine max
  Peptide Sequence Number=SeqID_224993
atggcattgaaatttggtccctactcggatagtctgtgcaagaaattgcctacaacattggacatgttgggagcaagggctgttaaattcattcagatggaagagattaccaagtttagaaagaaaatgcgtggaaaatcttcaaggaagccaataggccgagaggtgaagatcaagagtagccatagtctaggaaaatctaaagccaacatgccccctcaatccaaattcagcgactacactttgctgatagagagtcaaggtcgagtattggaggaagcttgtagtaacaagactccgtcacttaacgagttaggggccatcattttgaattcccatttggcgatgaagtttccaagtgaggatggaaaaattatcattgccaaggctaatcagatgaccataagcgaatgttatgctggaagtcttaggattacaaaaagaaagaaggtggcagagtccaaagtacaattggtagtatgcacccctctgaacaacaacgtaggagaagccgaaatcgatccaagagaagcccactaa

SEQ ID NO: 108216 - DNA, 202 bp, Glycine max
  Peptide Sequence Number=SeqID_224994
atacaaagacaaagttaaaggaagtcgagatcctgaaaaggccttaaaaactaagttagcctccgccgagaattctactaaggctctccaagaagaggttgaatgcctcaacaaagagtttactctcttcaaagtggacactgaaaaagctaaggagaaattgaaaagttgtctctgtgagattgggagtccaagatcttaa

SEQ ID NO: 108217 - DNA, 216 bp, Glycine max
  Peptide Sequence Number=SeqID_224995
atgaacaatcaagttgagtacgaagccatactagccggcctgagattagcaaaagaagtaggagccaagtacttcaagtgttggagtgacttcaaacttgtcactggtcaactgaatggagactattggactaaggatcctcaaatgacaagagggaggacacctatacagatgaggcttcataacccctctgttgaagtgctgactcgggattag

SEQ ID NO: 108218 - DNA, 478 bp, Glycine max
  Peptide Sequence Number=SeqID_224996
atggtggtccaaggaaactgtggctgtggttactggtggaaatagaagaattgggtatgagatttgtagacaacttgccactcatggattggctgtcatactgacatcaagagatgttggtgctggtgttgactcaattaaggctttgcaagaaggcggtctcagtgtggtttatcatcaacttgatgtagtggactattcatccatcaaccaatttgttgaatggtcatgggaaaattatggtgatttagatattctggtaaacaacgctggtgttaattttaatcttgggtctgataactcagtcgaaaatgctcgtaaggttattgaaacaaattattatggcaccaagcgtatgactgaagctgttattccattgatgaagccatcccttattggtgctcgtattgtaaatgtaagctcacgtctcggtcgacttaatggaagacgtaatatcttggattctttcccttgttag

SEQ ID NO: 108219 - DNA, 408 bp, Glycine max
  Peptide Sequence Number=SeqID_224997
atgctacaatgcgaagggttttcctctaagctcatatatgattttgaaattcccaacggtgagaattttctgaattgggttgcaaacatgatactcaaatttcacgacgatccaacggtgaacgggttcgagatcgtcgtttttctgagacaggtttggtgggctgcgggaaaaagaaagggttttgagaggagaaggggaaaaacgaaaatgaggccaaaaagaaggcagctgactgaacataactatttatacctaggctttttaaatttatttacgaaaaattgggatgttacatcagtcaaccgagttcaattaatgaatatagttgatcaattcataactgccaataaccaagtaccaaaaaactattcgagcgatgactactcccttcgatctcatctataa

SEQ ID NO: 108220 - DNA, 258 bp, Glycine max
  Peptide Sequence Number=SeqID_224998
atgtgtgctttcagggttttatgtgacgaattctttatcactcctattgctcccaaattcattcatcattataatgtgaaggtaaacaaaaaggggggctatgccatactatgccaaactattttactcgacaagttcgattggcaattcatcaagaaggctcaggccaagaaggttcaatccaacaaggccaaagggcaaacccaggtcctcaagatgaagggccttcaaaaaggccaagagtggagccaatgctaa

SEQ ID NO: 108221 - DNA, 168 bp, Glycine max
  Peptide Sequence Number=SeqID_224999
atggctgcatctccaaccaagaaagctatggatgaagtacctaaccatgattcacaagatggaatgcctgttcctccagccaagcacgctctcaactaccaagaagcgtgggcaggcattcttgacaaagcaagacatggaggcatgcataaacgtggtccaaattaa

SEQ ID NO: 108222 - DNA, 231 bp, Glycine max
  Peptide Sequence Number=SeqID_225000
atggcatcagcaatcacctgggccatgtgtacgttcatccgtgtcagaatggcatacaccaactggcacttaggtagagagaggtcggagttgtggttgctaggcaagacattgctgagcagcagtgtcatccatatttgggtcaaagtagtcatgctggtgcgcatgatccgcacccgcctccctgcagcggtccgggcgaaatcctgccccgatatgcatagcagctag

SEQ ID NO: 108223 - DNA, 156 bp, Glycine max
  Peptide Sequence Number=SeqID_225001
atggatgagaatcaccatggttctctgtttttgaagagcgcaaaggcaaagagagtaagaggactgaatgtccttggcaaagacaaagccggtgagagggaaagcggagagaagaagggtttgcgtctgcaatacgaaattgcatgtccactctga

SEQ ID NO: 108224 - DNA, 243 bp, Glycine max
  Peptide Sequence Number=SeqID_225002
atgtggaagcgtgcaatgaatgaagagatgcaatctatgctaattaatgatgttttggagcttgttgggtttcttgaaaactataaggcaatcggtttatacatacaacaacctgaaggtttccatactggtggtagtgagaatttggtatataaactaaagagatcgattcatggcttgaaacttctcgacagtggtgatagattgagcatggatcaatgtccaaagaatgatatccagtga

SEQ ID NO: 108225 - DNA, 240 bp, Glycine max
  Peptide Sequence Number=SeqID_225003
atggcttttctgatgacctccatgctaaagagaagcaagctcaacttgacttccaaattcctcttaaaggctaaagtgagtgattttatctataattcctcttggaatcttgctgctgtttggaatgtatctttctctaagctgatggaggcgatcaaggccatgcttatccctatagttcctatccatgacaaactgatgtggcttggctctcatgacggaaatctcagtttcaaatag

SEQ ID NO: 108226 - DNA, 231 bp, Glycine max
  Peptide Sequence Number=SeqID_225004
acaggctttgtggttgatttagggatggcctttgtggataactgggcggtgggtaaggaggagacccacatcgatcctttcactggcaaagaccaaatcctcaaagctttgaaggttctccacctttgggcgtattctttgaaagatttgtgcccctttttgcacatgttctgtagttgcatcctatccgaagacattatactgacactgcctaatgaaggcaaccactag

SEQ ID NO: 108227 - DNA, 3603 bp, Glycine max
  Peptide Sequence Number=SeqID_225005
atggagcaagaagagtacacaaaggaggaaatcaattggagctatgtagaatttgtggataatcaggatgttctcgatcttattgagaagaaaccagggggaattattgctcttcttgatgaagcctgcatgttccccaaatcaactcatgagacttttgcacaaaagatgtaccagacatataaaggacacaagcgcttcagcaagccaaaactttcccgaacaaatttcacgattaaccattatgctggagatgttacatatcaagcagattattttcttgataaaaacaaagattatgttgtagcagagcatcaagctcttttatgcgcttccaagtgtccatttgttgctaatatcttccctcctttaccagaggagacatcaaagcaatcaaaattctcttccattggttcacaatttaagcaacaactgcaatctctcatggagacactgaacacaacagaaccccattacataagatgtgtgaaaccaaatacagttctgcagccaggaatctttgagaacttcaatgtcttgaaccaattaagatgtgggggagtacttgaggcaataaggattagttgtgctggatatccaacaaaaaggacatttgaagaatttcttgatcgctttggaatgctagctcctgatgtccttgatggctctgatgagaaaaaggcatctatggccatctgtgataagatgggcttaaaaggctatcaaatggggaaaacaaaggtatttctccgagctggtcagatggctgaattagatgcacgaagagcagaagtcttagctaaagcagctaaactcatacagagacaaatccgaacacatttagccagaaaggagtttatcaccctgagaaagaccacgattcatatccagaagatttggagaggtcacatttcttcaccaaaaagactcacatttttagtcatgtccttctttttctttagtgcatcattgttatggttctgttctggaaaaaacaggagttattattttgctggctttaccttttcagctaaacttgcacgtaaactctatgagcatatgaggagggaagcagcttctatcaggatacagaaacatgtgcgtgcacacagagcaagaataaattatacaacgttacaagcatcagctatagttattcaatcagggttgagagcattagcagcacgaaatgaatataggtacagaagaagaacaaaggcttcaacaaaaattcagacacaatggagaagagcccaagctctttctgattacaaacagcaaaagaaagcaactgttacacttcaatgtctatggagagctaaagtggcaaggaaagagctcagaaagcttcggatggctgcaagggaaactggggcacttaaggaagcaaaggacaagttggagaaacgtgttgaggagcttacatggagaatagatatcgaaaagcacatgaggacggatcttgaagaagctaaagggcaagagattgcaaaattgcaaaatgctttacaagaaatgaaagctcagttagatgaagcccatgctgcaattatacatgaaagagaagcagcaaaaatagcaattgaacaagcaccaccagtaattaaagaggtaccagttgtggacgaaaccaagctagagttactgacaaataaaaatgaggagttggagactgaagtagaagagctgaaaaagaagattaaagagtttgaagaaagttactctgaaattgagaatgagaaccaagcaaggctgaaagaggcagaagaagcacagcttaaagcaacacaacttcaggagactattgaaagattagaattgagtttgtcaaaccttgagtccgagaaccaggttctatgccagaaggctttggaagaaccaaaaaatgaagaactctttgaagagatcaaaatcctcaaggatcagatagcaaatctacaatcagagaatgaatccctacggagtcaggcagcggctgctgctttagagcagaaagttcatccagaaaaaatagaaccagaccaagaagttgctgttgtagagaagatgcaagtgaagccaagagttattgcagataatacgactgcacaaatcaagaatttggataatggaaatccaacagaggaagaatggcatgcaagaaaagaaccaagagcaccaatcttcttgcttactaaacaaagatcactcactgataggcagcaggaaagtcatgacgcactgctcaagtgtctcactgaagataagcgatttgagaaaaacagaccagctgttgcttgtattgtatataaatcacttctgcattggagatcccttgaagcagaaaagactcatatttttgataaaattacacatgctttccgatcatctatagagagtcaagaaggaatccatgatctagcctactggctttcaacaacatcaacacttctgttttatctacaatgcacaatgaaggccagcaatacaactaaggcagtctcacgtaatcgaaactcccccgccactttgtttggaaaaatggcacaaggtttacgttcatcttcactgggcttggggatttcaagtggctatagtggaatggtggacaagacaaatgatcaatctaaagtagaagccaagtacccggctattctatttaagcaacatttaactgcatatgttgagaagatatatggaatgatccgtgatagtttaaagaaagagattagccccttcttaaatttgtgtatacaggcaccaagatccataaggactagatcaataagagggtcatccagaaacatccattcaaatattgttgcaaaacaacagacattgcatatgtactggaaaggcattgtggacaagttagatactgccttgcatatattgtctgataactatgtccctcccatcatagcaaggaagatatttagccaggttttctcattcatgaatgtccagctctttaatagtttgttgcttcgtcgggagtgttgttcctttagcaatggagaatatttgaaggcaggtttacatgagttggaactatggtgtcttaaagcaacagaccagtttgctgggtcatcttgggctgaactcaaacacatacgccaagctgtgggctttctggttttgcatcaaaagactcaaaaatctttggaggagatcacaaatgagctctgcccggtgttaagtattccacaaatatatcgtataggaactatgttctgggatgacaagtacggagcacatggattatctgcagaagtaattagcagaatgagagtgattatgacagaagactcaataaacatacacaacagctcattccttctagaggtggattccagcataccattcttaatggaggagatgttccagtccatgagtgacatccgcctatcagacatggatgtggatccaccaccaatcctcaggcaaagtcattcttttaatggatctgagtatctcgagggataccctgggttcacccaaaagcttatacttggtactacatgtaaaaggaagaaatttgtatggagggattgtcaggagtatctacaaacagtttacatagagaagtatgtatcaccaaggggatctaatgccgccggttga

SEQ ID NO: 108228 - DNA, 165 bp, Glycine max
  Peptide Sequence Number=SeqID_225006
atgaagaggcaaagattaaaggccttgaacgagattggaggaggaatgaagggagatgagggtaaagacagggtggagcaaggtggtcttgtcaaggcgtggttgttgggcaatgacgtagtttttgtatcagatggggtttgtaatgatgtggttgtttggtga

SEQ ID NO: 108229 - DNA, 135 bp, Glycine max
  Peptide Sequence Number=SeqID_225007
atggagcaacgcattgggaagcaaaggagtgcaaaggagaggaccaacattgaggagaagtgctttataaagtgtagatggtttgttacttggagtgacacgatgacgcaacagtacaagtcccacatcgtttga

SEQ ID NO: 108230 - DNA, 1434 bp, Glycine max
  Peptide Sequence Number=SeqID_225008
atgggaacacctgtgaacatcatcgttggatcacaggtttgggttgaggatcctgaggatgcatggattgatggagaggtgacacaaatcaatggcaaaaatgtcaccatcattaccacaaatgggaaaactgtggtggcagaaatttcaagcatataccccaaagatacagaggcaccacctgcaggagttgatgacatgaccaagctagcataccttcatgagccaggagtcctgcataacctcgcaactcgtttttctctcaatgagatatatacatatacagggaatatcttaattgcagtgaatccttttcgaagactgccacacctgtatgacatccatatgatggagcagtacaaaggtgcagcatttggagagcttagtcctcacctttttgctgtagctgacacatgttacagggcaatgataaatgaaaatggaagtcaatccattttggtaagtggagagagtggagctggtaaaaccgagacaacaaaaatgctcatgagatatctagcattcatggggggtagatctgctacagaaggaagaactgtagaacaacaggttttggaggtatatgcagtgatattttcacttctgcagtccaatccagtgttggaagcatttggaaatgccaaaactgtcaaaaacaacaattcaagtcgttttggtaaatttgttgaaattcaatttgacaagaatgggaagatttctggagctgcaatccgtacatatctccttgaaagatcacgagtttgccaggtctctgacccagagagaaactatcattgcttttacatgctttgtgcagcaccaccagaggatgtcaagaagtacaagttaggggatccaaggcaattccactatcttaatcaatcaaactgttatcaagtgtcgaatgtggatgatgcaaaagaatacttggagataaaaaatgcaatggatattgtaggcattagccaagaagagcaggatgcgatcttccgtgtggtagctgcaatcctccatcttggaaacattgactttgtcaaagggaaagaagttgattcttccaaattgaaagatgataaatcactcttccacctccgaacagctgcagagttattcatgtgtgatgcaaaagcactcgaagactcactttgcgagcgtgtcattgtaactcctgatggtaacattaccaaacctctagatccagatgcagctgctttgagccgagatgccttggcaaagactgtctactccaaattgtttgattggcttgtggacaagattaacagttcaattggtcaagattctaatgcagtaagcataataggagtccttgacatttatggatttgaaagcttcaaaatcaacagttttgagcaactatgcatcaacctaacgaatgagaagttgcaacaacattttaatcaggcaaggttataa

SEQ ID NO: 108231 - DNA, 915 bp, Glycine max
  Peptide Sequence Number=SeqID_225009
atggatgggagcatcgatgttgccattgttaaggagttctacactaacctttatgatcttgaggataaatcacctaagcaggtgagggtgagaggccacttaattaagtttgatgaagacaccctaaacacctttctgaggacccccatgatcatagagaagggggagaacctgcctacttactccagattctatcgtttgaggcaagatccacaggaactggcagcccgactatgcatccctgggaagggatttgagcttaatgctgatgggctgccattgaagatcttgcaaaagaatctgaccatgcttgctcaaacatggagcgttttatcattctctaacttggcccctagttctcacacgtctgacatcacactggacaaggccaagttgatctatggcattattcagaagatggatgtgaatctgggctacattatctcaactcagatttctatgatagctcagcatgactcctcgaggatgggtttccttgcccttatcactgctttatgcaaagcccggggagtcacttctgattcattgacttttgagagtctcagtccagccattaatttggcttatggaccccgaaagaccaagcgcaagaggtctgaggctccaccatcttatggtctccctaccccagctccttctacttctactgcagcttcatctactccagcttcatctttaccagctccagcttcagctgctgtagcttcatctttaccagctccagctttagctccttcgacttctacaacagctctttttgccccagcttcatccactcctttgccagttcctgctccagttccttcaggaccttccacagtcagctctgatactttacttgccatgctgcagagccttcataaaggccagatcatcatcatgcagtgcctatag

SEQ ID NO: 108232 - DNA, 963 bp, Glycine max
  Peptide Sequence Number=SeqID_225010
gcgaagtggaccccgttcatagatattctcgcactgttgatctttggaggagtcctctttccgaatgtggatgggttggtggacctagcagcgatcgacgcttttcttgcctatcataaccacaaggaaagctcggttgtcgctatgctagccgacttatatgacaccttcgaccgaagatgtgaaaagagcaatacaaggattgtttgttgtactccagctctttatgtatggttagtttcgcacctttttcgccaagaggtgaggcatgcttgcccactagaaagccaccgttcatgcacagagaaaggaggggcaaattgggaccaactcttagcgagcaaagaaggagcatctgtcaactggttccctcgatggaaggatggaagaaccggagttcttgtttcatgcaaaggatttccaaatgttcccttgatggggacgaggggttgcatcagctacaatcctgttcttgctataagacaacttggctaccctatgagaggggcgccactagaggatgagctcatgcctgtcatttcacaaggtttcaataagaccaatgtggagacacttcagaagtggttaaaagcccacgtgcaaggttttgattggcttccaagtttgagaaccgctaaaagagaggaagttgaggcaccggaggaagacgaagaggagaataccgaactgagagatgtaaatgtggctatcaccaaagccttggaacaagaacccaagagggcttgtagggaagaacacggccggaacaaattccgaggggctctgtggggtagcaacaacgagcttaaactccgaagagaggaaagggaccaatcaagaaccaacatgttagctattatcaccaagtaccaagaagaactaaatctagtcgtggcccacgagcaaaaagtggcagacgagtatgccaagtgtacgcggaaaaggaggctagaggaagggtga

SEQ ID NO: 108233 - DNA, 855 bp, Glycine max
  Peptide Sequence Number=SeqID_225011
atgtggggcatcgatatgattggtagaatcgaaccgaaagcttcaaacgggcatcgtttcattctagtggctattgattacttcaccaagtgggttgaagcagcatcttatgcaaatgtaactaagcaagttgtggtccgctttatcaagaatcagatcatctgccgttatggtgtgcccaacagaatcattacagataatggaacgaacttgaacaacaagatgatgaaagatttgtgtgaagagttcaagattgagcatcacaattcttctccttacagacctcagatgaatggcgcagttgaagctgcaaacaagaatatcaagaagatagtgcagaagatggtggtcacatacaaagactggcatgagatgttaccgtatgctttgcatgggtatcgcacttcagtgcgtacctcaacaggggcaacccccttctctttggtgtatggtatggaagcagtactccctgtggaggttgagattccatcaatgagagttctaatggaggcccagttatcagaagctgaatggtgccaaagcagatatgatcagttgaatctaattgaagaaaaacgcatgaaggccttgtgccacggacaactttatcaacagaggatgaagcaagcttttgacaagaaggttcgtcctcgtgtatttcaagaaggagatcttgtgctcaagaaggttttatctttccaacccgattctaggggcaagtggacgcctaattacgaaggcccatatgtcgtcaagagaaccttctctggtggtgcactgactcttacgactatggatggagatgagctccctcgtcctgtgaatgcggatgcagtcaagaaatactttgtctaa

SEQ ID NO: 108234 - DNA, 306 bp, Glycine max
  Peptide Sequence Number=SeqID_225012
atgccggcgaaggatctaccgcacacgcaattacaatgccggcgacggatctaccgaacacgcaattacaatgccggcgatggcattgcctcaaacctgaagacgtggaaggaattcgaggtggcaaaaagtcaaatgcgaatcggtgaaggatcgagcggttacctgagaattgttggagttattcgtctacggtttcgtgtcggcgaggccgacggagatgaatcggagggaagggcggcgacgatgtttgagagagaaaagcgggtagtgagtgtatgcggagaatggagcaatggagaatga

SEQ ID NO: 108235 - DNA, 189 bp, Glycine max
  Peptide Sequence Number=SeqID_225013
atggcgtcgaggcaaatggaagagattcggaagaaattggctgaccttaattacccgagagcgaatgcccctgcacagtccctcctatttgctggcatggagcgctatgcccttctagagtggctcttctttcgtgacccttcttcatacctttgcaatgtgaggagcctttggcactggggtacatga

SEQ ID NO: 108236 - DNA, 213 bp, Glycine max
  Peptide Sequence Number=SeqID_225014
atggtgttgaagggtacacattatttaccaataatcacgatcgtcaaagaaacatgtaggaaagttgctatatttttcacaaaaaggaggatggaagcacatgcaatgataacatttggccaagaatttggggaacttgtttacaagtgtctcgatgacaccgtggtgaaaatttgccactcatcatgttcaatcctacgatcaccaaaataa

SEQ ID NO: 108237 - DNA, 183 bp, Glycine max
  Peptide Sequence Number=SeqID_225015
atgcaagaagtggctgaatcacaaggagaggaggaggaaaacaaagatgcttcagctgctgccggtctcctcaagaaactaactgttggcgaggataaattggaggacaaagagccgccggaaaaggccacggataccaatgtgaaaggttgctggcatgtttataaaagattggtaacctag

SEQ ID NO: 108238 - DNA, 843 bp, Glycine max
  Peptide Sequence Number=SeqID_225016
aagaaaataccctcacatgctcgaacatctcccgctcctgagacggatgcagtgaatgttgagaaacagggtgaaggtcaaggcattggatccagcagtcctcatggatcgagtcagaaaagttcatccgaagaaaacttttccgatgaagaggccatagaagaggctgaagctggaggttcggacatttacccggcgtcttcgacatctaagctttccgctagcatagggatcgcagaagatacattcattcagatgcaagacgaagaccctgctgcagcccttcgactcctgctgaacacaagtcaagccaacacctcaagtgaaaagattcctggtgcttcgtcctcatctgatgctgaaataaactcttcaatacgccaagattgcctgctcttgaagttatcaatggaatacacacgggaagacgtacttaaatccattgaagagaacccctctgctgcttttgggcacctgaactttttgaagaaattgcacaacccccttacctctgatgagattctaggcaaagttatccaaatcgagtccattatcgatcaatttgcaagtactgtgcagaaaaaacgcgaaaatggcgccagactggatgcccagaaacaggcacatatccttctgctcgagaaagcccgagctgctcaacatgaagtcgaacgtctcaccaaagaggcgaaagaaggatcttctgagatcaaagcctgtgatgataacatctcctcctgggaggcaactattacggatttgctgtctcaggtcgatgatctaaggcaaaaaattgtgacggagcaggcccaaacgcaaggaactccaggagaaggccgctaa

SEQ ID NO: 108239 - DNA, 531 bp, Glycine max
  Peptide Sequence Number=SeqID_225017
atgatccgcaagctttttatggatcaagttggtccgcaagttaattttttagacttacgggtcaagttgatccgtaagtcttttacggatcaacttgatcccaaccagcaatacaacagtgcactctcactcactataagtcatgcactcactgcactcctcgctgcctcattgcgtatcaaccagcagcatcaatggccaccaccgagccaccacaatgacgacgatgaccatgtgccagcggaggacgaggacacgggagcgcaggtcgctccgatcgtgaagctcgaagaggtcgccgtctccactggtgaagaggaagaggatcccatccttgatctgaaagcgaacctgtatcggttcgataacgaagggaatgagtggaaggagcgtggtggtggaaacgttaagctgctgaaacataaggtcagcgggaaggtgaggctcgtcatgcgccaatccaagacgctctcaagatctgcgccaatcatcttggtattatgcattgctttctatcttttcagtttttga

SEQ ID NO: 108240 - DNA, 141 bp, Glycine max
  Peptide Sequence Number=SeqID_225018
atgggtgatcggcatttgagtggctatggtggtcattgggtgtgtgccgacattttggttgatggtggtggtgtctggcttggttgtaatttgagttcttcgttatctttacttcaacaaaatttcttggatttcctctaa

SEQ ID NO: 108241 - DNA, 1011 bp, Glycine max
  Peptide Sequence Number=SeqID_225019
atggcctgccaccgccagcttctgcgcttcgcgcatacaggccagctcgtaatcggttttgatgctgcgatgataatgcaggaagtcgatgacgccctggggattgatcccctcgctgcggatgcccagctgggtggcgcgggacggtaccggcccgatataggccacattgtcgcgctgtgccggcaacagctgagcgatatcgtcagcgtttttcaggccgatgacctcgacatcctgggtccagaagctgtccggcagtggctcgacgttgtgccagtaatcgactggcgagtagaaccacagtttgggtttattcacgccatcgatccacagccagcagttgggcacctgggtcactggcacccaggctttaaactggggattcaccttaaacggatagtcatgatcgtcaagaaatacgcgttgagatatgcgcgtgatacagggttttcagtgaatccatggacttgtctccgatgtcgcgaaagtggcggcagtgtagcacagccgcgcgggggatgccgtgctgcgcgcgctgtgatcgccgagacggacatgctctaccaaggcgataccctttcagtgcactggcttgacgatggcatcgccgagctggtttttgatgcgcccggttcggtgaacaaacttgataccaaaaccgtcgccgccttaggcgaggcgctgagcgtactggagcagcaaagcacgctgcgcggcctgctgctctcttccgccaaaccggcgtttattgtcggggcggatatcacagaattcctgtcactgtttgatgcgcccgctgagcagctcagccagtggctgacatttgccaacagcatctttaatcgtctggaagatttgccggtgccgacgatcgccgccattgacggctacgcactgggcggaggctgcgagtgtgtgctggcgaccgacttccgcgtggccacgcccacagcgcgcattggcctgccggaaaccaaactcggcattatgccgggcttcggcggcagc

SEQ ID NO: 108242 - DNA, 501 bp, Glycine max
  Peptide Sequence Number=SeqID_225020
atggattttacaaagatagtggaaatctcaagtgggttgcttgagtactggaccctatccctcttaagattattgaggccacaaggtccaacagaggcttattctacatcagcagctcctcatctagcttctacatcagcagctcctcctccagctcgtattgtagcagctccttctaccctacctcctgcagattttcaatgtttcgaagccatgattcaaagcatacatcaggggcagattattttgctacaaagtctccagctggtagcacctccaaactccatccctacagtagagcaatttaatgagtgggtagcctggccagggactcagcctctacagctgctcagatgcagcggaagacaaaggagaagaggggagaggaggtgccatcctctagggaataagccatggaagaaggagcttcaccaccaagatgagccttggataagaagcttggaaggatgcttcaatggaggaaaagaaagagggagataa

SEQ ID NO: 108243 - DNA, 697 bp, Glycine max
  Peptide Sequence Number=SeqID_225021
atgcaaatgtgttggagcctaacataccaaaactacttgtattcattagagaattatgagtctcggtatgttttttcctttgtttcctactcccttaaaggtaacataaaattcacacgaccatctgggcttagggagtatgacggtgatcacgcggtattcgcgctaagcgcacttttgggcttcttcgtaggccttcttcatgtgcgtgagtggacagctaagcgagaaaacgtgttgggtgtatcttgtgcgctaagcgagcttagttatcaccaaacaagttatgaacctgtcatcatcatcaatcgtcatgttccgttatatgagaaggcatcctactatgctttagcagaatgttgcattatcaatgcggtgcgggatggcatgaatttggttccttacgagtacattgtctgcaggcaggggagtcttacaatggatgaagctttagacattggttctgaatcacctcttacaaatgcacttgttatttctgagtttatagcttgcttaccttctcttagtggggcaatcagggtaaacccatgggacattaatgctgtagctgatgcactgaatttggccatcacaatgcccagtggagagaaacagttgcggcatgagaagcactatcgatatgttagctctcatgacgtagcttacttgcgccaaacagttttgtgcaagatcttga

SEQ ID NO: 108244 - DNA, 297 bp, Glycine max
  Peptide Sequence Number=SeqID_225022
atgggtccaacccctaaaacaattttttcacacgcagacactgctcatgaattatacaacacccacgacctcacactcatcaaattaatcccaaacaatgtcctgtattgctgttgtagcattctttcaatctcttcttcttctcatacattcaaaggtggagcagttgaagctgcaggtggggagggagcttgcaatagcaatggcaactcgaagactgcagcattcaaaggtggatcagttgaagacgctgttgcagcattctttcagtctcttcttcttctcatccagttttaa

SEQ ID NO: 108245 - DNA, 414 bp, Glycine max
  Peptide Sequence Number=SeqID_225023
atggcttctagcagtgcctctggccttaaggatctcttaagccctcaagcagactcaaactcaatggctatcaccaaaccaataatgaaaccattccaaaagcttgaggagcttgagattataaggatgaactatgagagataccttgagataaaggttgggaagaaggaaatgaaagacaacaagaacaatgaatttactcctggaaaatgttttcctccaccaatttcttgcctcaaaaaggttaaggttggcaagcccttcaagtatctagcatatgataaggaaagtgaaacctatgttgttgaagagataaaaattcccgaagggagtcttttccatgctactagggaggatgagaggttgaagttgtttgccaattttctagacgaggaagagtcacaagagaagtag

SEQ ID NO: 108246 - DNA, 654 bp, Glycine max
  Peptide Sequence Number=SeqID_225024
atggaggtcgaagtcaagatgcgtctcgccaacgccaacgcccaccgctatgtcaccactctactctcgccctttcacgtcatcatccaccaccagcagaacctcttcttcaatggcaccgcctcaaagctttccgtgcgccgcattgtcctctggctccgcttctacggctacgacgagtgctgcgtcacttcactgaaggcgcgagcggtgctagtgaacggtacttcgaaggtcacgatggagcttgtggaagattgcaaaggtcatggcagggtgaagggcaagagtctgattgcagcggaatggagaagaagaagagttgagaggagacgccacttcaaggagaagatgagtctagaagaagctcaccaccataggaaggagaggaagagaagagcacaaaatttagttggagatgatggagagctaattaaggttgacaaagaggcattgcttccaagagaaacctcctcaagcttttggaatggtttcattattggtttggtgatagggattgagtttgagtttgcttgggggcttaagagattcttaaggccgaaggcactgctagaagccattgcaaggagtttcaaggagaaaagttcaactaggagaagtgaggtcataagaaaaataaatttaaaaacatag

SEQ ID NO: 108247 - DNA, 264 bp, Glycine max
  Peptide Sequence Number=SeqID_225025
atgtcacatcttattagagcatgtgtctcaacgtcctctagcacaagcaaattagtcccaaacgacgttgtgtattgctgttgcaacattctttcagtctcttcttcttctcatacattcaaaggtggagtagttgaagctgctggtggggagggagctagctattgcaatggcacctcaaacgctgcagcattcaaaggtggatcagttgaagacactgttgcagcattctttcagtctcttcttcttctcatccagttttaa

SEQ ID NO: 108248 - DNA, 278 bp, Glycine max
  Peptide Sequence Number=SeqID_225026
gaaggctaaaggcagacctcgtcctactaaaggaaagggctctttctattccgagttggcctgcaccggtcctatcctattcgattaggaaactgatgattctagagcaagtgacatccatatcaaatcctccagaagttatgctcaacaggaaagtcattaagaagtgccacagcactattgctattgatcggacattcacaattgcattacctgaatggaatggcagcagtcttcttagtcccaatccctgcgcattcaagaacaagcccatctag

SEQ ID NO: 108249 - DNA, 516 bp, Glycine max
  Peptide Sequence Number=SeqID_225027
atgtctgaactgctgaaaaatgttttgcagctttccccaaaggttgacctttgccatcaggcatatgatgatgatgactatgaaggaagtttttgtgacaaccctttgctggagaacacttcaaatgaatcaaatttagcaagcatagatagccatagaaagtgctttcctttttggtttgctcgtgttggaaatcggcaaaagattgtgattttggttactttgctagttttcatcatcgtggttgcttttgctgtagtaatctggattgggctaggaaagaatcccattgattctgaagtggcagctcagccgagaagttggagcgatgaagtcgaagaggtgaggtcaatgtcaaagaaaggagcttcaatggaagaaggggtagggcttcaatgtcaaagagttgaggtcaatgtcaaagaaaggagcaaggtgaacaaacacgcgagggttcaaacgaaggagcaagcagaaagcgagggttcaaacaaaggagcaagcagaaaggtctag

SEQ ID NO: 108250 - DNA, 398 bp, Glycine max
  Peptide Sequence Number=SeqID_225028
atggctacaccacccaactctcctcctcctcctcctcctagtgcagcatcacagtcgccatctacctcgaagcgcataggaaacaccacaccgctaagatcattggcgactagactagttggggcagagagcccgctagtccatgtcgatcttgcgaccgggaaggctgacggtccccacagtaagaagttaagaacatatttggggatcgtcgctcatgataaggtctatgtcacatacgagaattggaagcaagtctctactgctcataaggatttgatatgggaggatattcaactgacaaggaaagtgtcgacgacactgtatgccaaaagtacgacattagcaaggagaaatgagcctaattttgtcagagccgcagagaacctttgtgggag

SEQ ID NO: 108251 - DNA, 316 bp, Glycine max
  Peptide Sequence Number=SeqID_225029
ggacggagttcttgatcaccgagacggtgccattcgggggacacccgacgtcactgtttccggacttgcagtcgccgaggatgttagtgttcatgaggaaatagtagaaaacgagataacagtgaaaaatgtgaatgagtttgatgatgatgattggaatagtggcacgaacaagctagacaagggggagagaagatggtggatggcattacaaggggcggtttacgggttttgcatgttagagccatttggaatgggcaatggtctcgatcggggatgttgtgttattctcctatgttccctttacagcatgtga

SEQ ID NO: 108252 - DNA, 189 bp, Glycine max
  Peptide Sequence Number=SeqID_225030
atggaagcagagagaattccaagatcacgatttaagactgtcaatgcagattcacattcagagattattcgtgtgacagatgaaggcccgtcggatgtctcagaagaaccgaaggcaagtgctgcatatattagccctatttccttaaaatttaaaggagtgttagcaatacactctctaacaggctaa

SEQ ID NO: 108253 - DNA, 438 bp, Glycine max
  Peptide Sequence Number=SeqID_225031
atggttatgtactggaaactgctatttaataatttgttctctgcaaatattacattgccagatgtttctgagctggagttgaagttttctgaacaatcaaaaatattgttgaatcttcaacaaaaagttgatgacttggcatccaagcatgcttacaatcctgatgaggagtatactgaggtggaatcccaattgcgggcacatttggaatcttttctagaaacagctagaacattcaatttgatttacaccaaggaaattcgtccatggacgcacatgatggaggttccgcaacttcatggatttggaccagctgccaatcgtttattggaggcctataaaatgcttttgaagagatacctattcacaaatatagaactccttttattggttctggctgatcacccttatttcaacatgttagctgttcatgcttga

SEQ ID NO: 108254 - DNA, 184 bp, Glycine max
  Peptide Sequence Number=SeqID_225032
gcttttaggtgataagtcacccttttctcaacaaaacatacaaggggatggccttgatcgtgatgaggagacaggtcgaattcagtatttggctgagattgctaagtttctgggtattacaacaactgtagatacagatgccattcagctatatccttctgtgtcaattgtgcataccttctga

SEQ ID NO: 108255 - DNA, 252 bp, Glycine max
  Peptide Sequence Number=SeqID_225033
aacttgaatgaagcagaattgaagcttagtcttacaagagggatctacggattaagttttggttttaaaaaaagtagaccaaaaagtaactgcaggggaaatccaatagataccctgccatctgcaccagcattggagcaagagcagcctattgttcaggatccaccagctgctccagtgttggatcttaatgagcatgcagaggatcacccacaggaggattggcaggatctttatctttttgcattttga

SEQ ID NO: 108256 - DNA, 584 bp, Glycine max
  Peptide Sequence Number=SeqID_225034
atgaagcccgagacatccttgaaaataaaagaagaggtaaagaaacaatttgacgctggttttttggctgtcactcggtacccagaatgggttgccaatattgtaccagtccctaagaaggacgggaaagtgctcgagttttatgctaatgcttggcccacaaaagagggagtgcgagacatgcggtcatgggagtgcgagttcagtcagaggaggaacaaggccaatgggttcgacgaggaggccattgcccagctgttatgcaccccgggacagtatttcacccggaccgctgcagggagcaatatcttgcctagtgatcataactccaatctccctctaccgaagtgtcagctggtgtatgccatcctgacacggatgagcgtccatgtggctcagttgattgttgatgccatctatttatttgcaggtatgccacccaccaggcaccctctagacctggataagtctaatagggccctggggtttccgacattgatcatggtcctctaccagtcattcggggttctcgtcacctctagtaaggtgatccaaccaccgatcacccgggccttcattgagaa

SEQ ID NO: 108257 - DNA, 462 bp, Glycine max
  Peptide Sequence Number=SeqID_225035
atggccaagtgtgatccaaggcacggcaagtacatggcttgctgcttgatgtaccgtggtgatgttgtccctaaggatgtcaatactgttgttgccaccatcaagactaagaggactgtgactttcaaggacgctgaggctgtcaagaaggcttgtgaggattcaacaactctcactatcaatggccgtcgagcgaattgcaatcttgctttcctaggtgctcatcgcccaaggtcttcttccaatgtttcaccacctccaccgcaaccacaagggagatccaatggtggaatagtgaagaatgttaacaatgcatcaggtccaccaccagccattaatcatgtgcagccatatcattatccagtgaggacaactgctctgccattccataatcacactcttcctttctatgggtatgcgcctacctacattgtgactgacgtaaacttcaattacaatcag

SEQ ID NO: 108258 - DNA, 279 bp, Glycine max
  Peptide Sequence Number=SeqID_225036
atggcgaacattatttctccaacaaaagtgctagtaagaagaccttgtcccaaagaactacaaccaacatcatcaatcaaatcagagaagtatggtaaagattgggaatttcttacaagattctgtgtctccctctctaccaaaacaagctctgaggtgtgtatctttttggtgttggcagcaactagggtggttgcagcatgctcatttatatcagacacggacagtgctgtgttcgtgctcccactctttctaaaggctactacagacaacacttga

SEQ ID NO: 108259 - DNA, 212 bp, Glycine max
  Peptide Sequence Number=SeqID_225037
gggtgatgctaggtgcactggcattattgcttgtgcacccaacaatttttggtaattccataattactcctgtgtcttcttcttcttttattaagttggttttactggtggaggtgaaagtgttaccggtgggtggtggtggttgcagtggttggttcgtcatcggaggtacaccagctacgcgggttggtgttgctggtttccctgagtga

SEQ ID NO: 108260 - DNA, 195 bp, Glycine max
  Peptide Sequence Number=SeqID_225038
atgtcaagcagcaacaagcaaacatgggtatgggcccataaatccaaaggacaagaggaaaagacaagtagaaggcctgcaatccaagagaccaagaataactcccccggtttaaggtgtggtgatcaagaagctcacatgtgcatggtatctaatagactgcacgttacatacaaatgcaacaaggaagcataa

SEQ ID NO: 108261 - DNA, 579 bp, Glycine max
  Peptide Sequence Number=SeqID_225039
atggaataccatacggagtggattaatatctggaaaaacaaatacagtgatgttttagctgggcaatgggttgaaggaatagtgatacatacaccagcgtacatggaatggtataggaaaaacactactttgttcttgtctgttgcacaacaactacatgatccacgcacaacaattacccataatgttgtagggccaggtgttgaacaaatagattttcaaattccacatcctcagtcaatgtattctactccttcacctgttcatcaaacttttggccacactggcgagtcaatcaccgcaaccacccatgaatggttgactgatttatttggcgttgatttcaatacaccaaattcagcagcatcatatttagctactttacaacaattcgatgcaccacattcgtttggagaacaaggtcaaagttcgtcagctgcaacaaccaacattgaaaatactaacatagaacaacaacatcatcatgatgtgggagaaccagtcatactggaaagaagaaattcgcgatgtaatcggcatccaccaccttgtgggactggtcatcgtcttggtcattga

SEQ ID NO: 108262 - DNA, 408 bp, Glycine max
  Peptide Sequence Number=SeqID_225040
atggtggttgtggaggcgatcatggtgttggtgttggtggtggtggctgtaaaggcggcaacaatcatggtgatagcggcggttgccgatcatgatggtgattgcaacaatatccatgataattgtagtggaaatgactatgatagtgatgcacaactcgggaagattcagctacacaagacgagccccaaacttgttcaacaaccaggaaataataatactcgatcaatagttgtttcctattcaagaaataatccttctaataatgtgcctcctcccaatatcactcagccaccaaatgtgccaagaaataatgctcctaatgtgcctcttccaaacactcgatctacaagggttctacgtccaattgaaaacattatgcctccaaatgtgccaaataatttttaa

SEQ ID NO: 108263 - DNA, 342 bp, Glycine max
  Peptide Sequence Number=SeqID_225041
atggaccctggggtacaaatacccacaccatcagagggctacatgcacgccgtcaccttcataggactacacgtcctcaccttcagaggactagacgtcctcacctttagagggctacacgtcctcgccttcagagggctgcacaccctcacctttagtgggttggacgccctcaccttcaaaggggccaactatgcaagtacaattagaggaggaggctatcgtgcagctactgtgcataccgaggcaagatttcacccgtactactgcaaagagacgagtgtggatcatgcacaccaacatggccactcttacacagatatagatgatgttgctacttag

SEQ ID NO: 108264 - DNA, 366 bp, Glycine max
  Peptide Sequence Number=SeqID_225042
atggtggcctctagcggcatagtttctctgctattgcctggaggtagaactgcacattcaaaatttaaaattccagttccagtttttgaagactcaacttgcaatatccatcaaggaactcaattagctgagctattaaatcagacaaatctaatcatttgggatgaagcacccatggctcacaaattctgttttgaggcacttgatcacagtcttagagatatcatcaaacacaactcaaaggacaatacaatctttggaggtaaagtcatggtctttggtggagatttccggaagatcctgccagtcattccaagaggcagccgcaataattccaaattgttatcttacttatatacattctaa

SEQ ID NO: 108265 - DNA, 342 bp, Glycine max
  Peptide Sequence Number=SeqID_225043
atgtccagtgtatgggtaccaacaatcttaccaggtgcagtgcttcaacatgtgttagttgcgtgtttgacagtggtaagtagcgacgttggtggaggagggcactgtcgttgtgcatcagatggacgatcttcatcttccaagccaggctcttgcttcatttttggcacaatatggatgctttttccactgatcactgaagaaggcacaacaaggtttggaaatgcaaagccaattcaagaaaccgtgtttgtggttttaaaaatgaaccacgtttcagcagggccatttttgcttcctgcacccaccaatgtacttgcacacccacaccatttcggataa

SEQ ID NO: 108266 - DNA, 705 bp, Glycine max
  Peptide Sequence Number=SeqID_225044
atggctgaatcatatgagcagagagatatctttaatctaatcatcaataatgtcaatagacaagctggaggaatgtttttcctgtatggatatggaggtactggcaaaacctttatgtggaagacattagcttatgcattatgtttgataggtgatattgttttgacagttgcctcaagtggtatagccttattgttattacccaatggcagaactgcatatttgaaatttgttattcctatgcctacattagagaactccacatgtaatatccaccaaggtacagaacaagctgaactgttaaaggcaaccaagttggttatatgtgatgaggctcctatggctcataatgttccatttggtggaaaagttattgtgcttggaggttatttcaggcaaattcttcccttcatcccaagaggaagtagatctaacatagtgcatgctgctataaatgcttcatatttgtgggattactgcacagttttaaagctaacaaaaaacatgtgtttgcagtccaacctaacaatcacaaatgcacaagaaattaagtggtttttgcagtggctgatagatgttggcgatggaaaactaggcaaaggtgatgatgggctatatgacaaagaaattccatcagaattgttgattacaaactttagtgatcctattgaagcaattgtcagtcatacttatccagacatctaa

SEQ ID NO: 108267 - DNA, 225 bp, Glycine max
  Peptide Sequence Number=SeqID_225045
atgaaaagtgttccagatgttttccaaaaaaatggcaacctgaaactgttgttgaccaagagggttatcctgtttatagaaggcgtaatgacgaataatgatggaactactggacagactgtcgatgagattaagcactatcttgatgtaatatttgaggatgatgatgacattgatgttttgctgtccaagccaactgttaaagagtctatgtttacttcttag

SEQ ID NO: 108268 - DNA, 555 bp, Glycine max
  Peptide Sequence Number=SeqID_225046
atgattgatgaggatggagtatttgaagcaagagatacaccagaggaacttaatcatgttctgggcaaaagattagcattcagatttaaggatttagacatagctaagtggatttcagaaatatcgccagtggaaaattttgtaaaaaatgacaccattattcaaaggatatttgctcatgttactgatggagagaacactattgagtgtgttttctatgatgaatatgtcaaagtaataatagagttagtaagagatagtaatgtttctgctccttttttggcaattcaacatagcagactacatggatgcagtgcattgactcatggtgaaacatatgttgaaactgtggtcaatgtcaacaacatattattggatccaagcttaccaaccatgcctaattctggaataagagtcaagcctgacaaagccaaaattgttggattcatggataataatccttggtgggagttacaaaatagtcaacaattggtcaaatatgatgacaccagacattaccagactggactcggtgttccacttattcccgggtaa

SEQ ID NO: 108269 - DNA, 273 bp, Glycine max
  Peptide Sequence Number=SeqID_225047
atggcaggcagaggtggtgaagtggttcggtggcttcggagagcatccagtggcgagaatcatgccggcggtgaaggccttcgccacaacaaagaggttgtcgtcggtgcagaggaagcgatagtgttttccgacgagtggaaaggcgattctggccatggcagctgttcactcggcacaactccaactctacgccttcataacacgactttaaaaaactcctttcagttgactgaagcaactgatattggtaccgttaacattattctataa

SEQ ID NO: 108270 - DNA, 555 bp, Glycine max
  Peptide Sequence Number=SeqID_225048
atggaaaaagtgagatctaacaaaacaatttctgcaaaatctacatatgaaggctcttcagattacagtactaaaaatgcaggatatgttgatctaggagatccttctaaaacatatgcatattgccaagctgttatgtgcatgggaagggtacaacttccttttctcaagaaccctccaatgcttctgcaacaactattaagtgatcaagaatcacgcaaaagcagaaatttccaacataatatcagggcttataatatgatgtttgcttttagctctcttggagccaagatagatacaagtgtgctcaaaggaaaaggtcaagcaatttataaaactcatggacaatcatgtcatttgattcgaagcccattacgaatgcctgggaaacctccaaaatttgcccaactgtacatatatgatacaaagaatgaaattcaaaacaaaattggtgcattaagttgtgataccgttaaatggatggctatatacatgaaattttttaaacatgtgcaaggaaaaatgtactggattcacatatggtgtccaagttaa

SEQ ID NO: 108271 - DNA, 144 bp, Glycine max
  Peptide Sequence Number=SeqID_225049
atggcatttggtggactagcagctcacccaggcgagctgagacttagccatgaagtaactggctcgtccaggatcctgtttaggttgtcgaacatgcaactggaatcgagaaatgaggttgaaagaaaacaaatgggaagctag

SEQ ID NO: 108272 - DNA, 255 bp, Glycine max
  Peptide Sequence Number=SeqID_225050
atggatgcacctgacctcaactttcagatgcaatgcggtacgtaccgtatccaataccaaggaaatagccctaagcgtgtctacacgacacctcacttaggaaaccatgcagtatttttcgaggccacccagtcatgcaccgtaactcccccaggtgatcaacctatggccacaaggagttccctaccaggtgacacaccccctagtacaaagtacatactgctacagtttatactatttcccgtgtcatatgag

SEQ ID NO: 108273 - DNA, 390 bp, Glycine max
  Peptide Sequence Number=SeqID_225051
atggttaaggctcaacctattgcttccccaatggtttctaaatgcaagtttaataaaacacgagcatatctcttctcagatcctactctttatagaccagtagttagagctcttcaatactccactataaccagacctgaactaagttttgttgtaaacaaagtctgtcagttcatggccaaccctcttgaatctcactggacaaaagggaaaagaattcttaagtatctcaaaggatctttacaccacgacctacttctcaaagctgctactccaagaattcacattcccattaaggccttttgtaatgcagaatgggcttctaaccctgacgattgcagatctacttcaagagatgctatttattttggccttaatcttatatcttga

SEQ ID NO: 108274 - DNA, 546 bp, Glycine max
  Peptide Sequence Number=SeqID_225052
atgaggcatataaagcatgaaggacatgcacaaacccatgggcctgaaatctaccctaaggctcatgaaaatcctagggcattctcttgcatctctggctcaatcttcttggagtcttctatccaatgcccttgcggggtaggattgcatcagaaagggttgaagcaaggagatccattggcaccttttgtttttttttatggtggtggaggggctttgtgggcttgtgaagaaagcagaagaggtgattctattctggttagggacgcttgttgcaagaatttttgggttatcaaaggtattttaaggagttttgagctcgtgttgaagttatttgatatgatttactatgcttcaaatatggtaagattgattccaaccttcgtgttggttcctatggacaaaatgcgtcttattggtggaaggatgttttggatattgatgctaattgtaacacctcgacaaatcacacttgaaagagagaaatccagaggttgtgcaggatgggtgaccttctggaaagttttccagaaagcaagtgagtga

SEQ ID NO: 108275 - DNA, 381 bp, Glycine max
  Peptide Sequence Number=SeqID_225053
atgggggaagacgcattgcaaatttccagtgtcaagtttgatcagggctatcaacctaatccttcactcactctccatgatccttcaaatcaaggaaatattcaaactaacaattttgaagcaaagcttcatggtgaatcaaaggtgattcaaaggtgttttgatgataacaatgatgataaaggtgatgacaaaaagctcaaagatcaatcaaagaacaactcaagtgaatcaacaacaattcaagagttcaagataagaatcaagaagaattcaagaactcaagaagaaagtctagagacaagaatcaagattcaaggttcaagatctcaagaatcaagatcaagattcaagaacaaagagaagactcaatcaagataa

SEQ ID NO: 108276 - DNA, 579 bp, Glycine max
  Peptide Sequence Number=SeqID_225054
atggctaacaataccagtgaattagaacggttacagaatctagtgaaggaattggaggatagggaagtgaaacttgaaggtgaattgcttgagtactatggtttgaaggagcaggaagcagactttgtggagttacaaaggcagttgaaaattaagactgtagaaattgatatgcttaaaatgaccattaattccttgcaggaagagagggagaagcttcaagaagagcttgcacatggagcttcagccaagagagaacttgaggcggccaaaggcaagatcaaggaactgcaaaggcagatacagcttgaggctaaccaggcaaaaacccagttgttgttgctcaaacaaaaagtttctggtctagtgtcgaaagaagaggaggccgccaagaaagatgttgaaattggaaagaaattgaaagctctgaatgacttggaggttgaagttgtggagcttaagagagaaaacaaagaacttcaacacgaaaagcaagaattaacagttaaactcaatgctgctgaatctagaattacagaactctccaatgtgacagaggtcagagtcaccatagagtag

SEQ ID NO: 108277 - DNA, 363 bp, Glycine max
  Peptide Sequence Number=SeqID_225055
atgaggcaggtcgttataggtaccaagaggctctacacaaggtatcatctttggaggtggaggttgccagacggaggactactatttgcacgatcgagatataggagcgccctaagcgtcctggccaggttgttgcgtagaaggttggatggttatgaaatgtctgcacaatgcaagggtttgcaggaagagaaaaagggcttggctggcaaggtggaaggcattgcggtagagagggatgagctttccaaggtgattgcttatttagaggcttggctaaaagcatcgaagtctaagttagaggagtttgagctgcagggaccaaggagagggatgccaacaaggggcttgaagaggagctaa

SEQ ID NO: 108278 - DNA, 400 bp, Glycine max
  Peptide Sequence Number=SeqID_225056
gggaggagcttgccacccagctcgcccaggcgagcaaggttgcttcctccagaagcaacagccttctggaggaaggatctggaaggcccaagacgccaagtatctcaaagcggctaacaaaggtcgcatgtcatcaagtaataatccccggacgaaattagggtatgacagcaatgatcattcgctatggcataaaaggatcgctcacataaatatggaaacattctttgccattagaagagaacttggtcttttagatgctagaggtgcaagagcatatgaaggcagacttggaggcaatgaaaaaccaaatggccaccatgatggaggccatgttgagcatgaagaaataatggaaagcaatgcagctgcagttgctgctaccagcgctgccactgag

SEQ ID NO: 108279 - DNA, 523 bp, Glycine max
  Peptide Sequence Number=SeqID_225057
tgttgcctacaataaggattggaagaggaaattggtgcattgctcgaaggaagattttttagtcttagattgggctgaatctcaacactttgttattgtacatgatgacaattctcgtgtagcttccatgccttactttggagtcattgaagaaatctgggagcttaattatgtaaaattcattgtctatgttttcaagtgtaagtggtttgatagcaatatcggtgtgcgaaccgatgaaacaagtctctgcagctcaaaaggatttgatctaggaggatattcaggggagcggtggaggccgtttaagtcagatttgacctccatgggaggatgtttgaaagaaggcgcaggccattcaaaaacaaaatattgctcctcacgtgttgtctcatacaggagcactgacacaatcgttgatcctccatctcccattaaacgacacatgaagtggaagatggcctgcacaaaaaaatctggtcaaatgatgtctgaggtagcaaaggaaattgccgataggatt

SEQ ID NO: 108280 - DNA, 186 bp, Glycine max
  Peptide Sequence Number=SeqID_225058
atgcattttcctcctttgggaagacgcacccgtgagcctcgcctcactcgcccgccaaagggtaggttgcgacagttggcgactccattggggattgtttttgaaattaatgaaacattggggcttaatccgggattttgggttatggacttgaagagggaaaataaaagcagcgctttacattag

SEQ ID NO: 108281 - DNA, 403 bp, Glycine max
  Peptide Sequence Number=SeqID_225059
aagaaagacacaagaagaagttgaagattgggaactggagtattggcctcacaggataggtttccatgagatcgatgcagcaacaacggggttttctgaagagaatgtggttgttgtaggagggaccaggaagggaatgatgctaacatgggaagagaggattcaagttttgaaaaatgtagccacagggattctatacctgcatgaaggttgggaagttaaggtcttgcatagggacattcaagcaaacaatgttcttcttcataaggacatgaatgcaaggctgggagatttcggattggctcatatgcatgatcatcagggacaagtggtcaacacaacaagagtaatagggacactaggatacattgctcctgaagtgattcaaagaggaacaacgtga

SEQ ID NO: 108282 - DNA, 345 bp, Glycine max
  Peptide Sequence Number=SeqID_225060
atggtgcaaggccaattgcatagtgcagttgatgaaaggttgaaggctaaagggggatacatcatagaggaagaccctagtattagaccaacaatgaggcaggttgtgaaaattttggaggtggaaattgacagcattgagtctgatgaagataacatggaaatgagtttgcttggaaaaataagatcagctactacgtggtctagagctgaatgtgctttaccatacagtggttacccttcttttgatgaagttaagatgttcagttttaattctaggactactagaagtggctcaagtacctttccaggatcagaatcagaaatcaccagtattaatatgtaa

SEQ ID NO: 108283 - DNA, 1152 bp, Glycine max
  Peptide Sequence Number=SeqID_225061
atggcaagttcaagagaaggtcgtcaagcaaagcaagagggtgacaccactaatattgacaagttctcccaggcatcgtccacttcaagacaatggtcagctttcagaaatccaagaattgtgagagtgtcacgttcttttggagggaaagataggcatagcaaggtttgcaccataagagggttgagggacagaaggattaggctctcagttcccacagcaattcagctatatgatcttcaagacaaacttggactaagccaaccaagcaaagtgatagattggttgcttgaagccaccaaatttgacattgacaagctccctccactccaattccctcagggttttggtcaatttcagcatccacaaaccctactccccttccatgattcaagtgctgcctctcatcagctctctctaggacccttctgtgatgctagctccacatttgtgagggatggggggattcaaaacctcatggcaaagtcaaggtattgggagaacatagattcaatgtcaagattaagaggcaataaggaagctgaaaagggcaagtggatcaaaacaagtgagcaagagaatcatgatcaagatggtgttgttggaggttacaacagcttgcaagtttctactcagaggcttttcccaatgcgtagtagtagtactactactactactactcactcccttttacctggtttgtttaacaattccatgccatataactcctacaactctgagccttctagtttgtctttatctcaatttggaagccatggattgttccctactcaacaagtagatcctaatccaagcagcggcaacaatggtgtgcaattccaatcttcttttccattaccatcatctggctctcaattattttttgggtcatcttctgctacaccatcaatgttcaccacctatgctccatttattgcaccctcagtggacactgatccaagacagttcaaccacattcagttcttgaactcaggttctcatatcttgcctcaccctcctctcattccatctcttcatcactcattcaattcacatgtcagacccttcccagaagcaccctttagttcaaagcttttggattcaaacagcagcaaccgtagccaggaaaatcataagggtagcacttcttga

SEQ ID NO: 108284 - DNA, 390 bp, Glycine max
  Peptide Sequence Number=SeqID_225062
atggagaggtgttacaatgagaaagagtacaagtccaacaaaacagaccttactctaaagcttccaccttgtggtgagaatgtagcagaagagagggggttgagaaggtcatcatcatcatcattagtagttggtgttgcaaatgcggcccagtggggtccatctcttggcagatcttgctcactgccaacagagaggcagaggaggagggtggctgcactttcacctcaagtgcttgcttgggtggctgcttcttctgccgtcaatgtcaacaacacaccatcttcacttctcaaaccgaaggcactcccaaattcttctcaggattcaggccttgtgatgaagagtaaggaaagatttatctttgaagcttgtatgactgaaaagtga

SEQ ID NO: 108285 - DNA, 510 bp, Glycine max
  Peptide Sequence Number=SeqID_225063
atggagcagaatattactaaagctgtaagtgttttgtatcacagatttctttgcattgctgtaaatacactcagaggtgtctcatacaacattccatatataggtcccacacattcagccgaaggagttgcttcgaatatccaaacatcaaccaagcaggaaaacgattccatggcttcccaaaaaacaatggccaagggaatttcacctaggcctgctgatactaagccggagaatccggccaaaaagcataaacttgggaactactgcagccttaaaggtgatgtaatggagatcctgaggcggatgccaagtgtgactactactggagatggccccaatgggaagaggatagaagggtttctgtacaagtataggtctggtcaagtgtgtattgtttgtgtctgccatggtaatttcctcactccagctgagtttgtcatgcatgctgggggaaaggaagtagccaatccaatgaagcatatcactgttttatctaactcattttag

SEQ ID NO: 108286 - DNA, 2184 bp, Glycine max
  Peptide Sequence Number=SeqID_225064
atggaatccataagtaacagtggatctagtgttgatatgagaactagtccttctacaaattcaggtgaaggagaacaatttaacaaagaaaagaaacaagtagcctccttttcacccttttcatcagagttgaaatcacaagatcactttgaccttatgccaaatacaacaaccactacaactcatcctagaccttttggtgcaacctctcctacacgtgaccaaacatgctcacagtctgaattgcataacacacatttagtggcagaaaagggtggcggaaggccaattgatagccatgtggaagcacattcttctaacccttttggtgaagctaatccttctccaatggaaaataacacagcccccaccaacactaaacatgttggtgcatctgaatctgaaaaggagcatgaccatactagtgaaagtgcatttcctgctgatggtatgctaggcccccattcatcattggcaccatccacaaatgaatcatcacaagggaatcccttcaaagttcctcccacgagtgaaacgagaaagaacactaatgttggtgaagctgacttggtgaaagttgatgaacaatttgatcatggcagtgaatcacatcatagactaccatcaccggagcaaggtcattggagcgtgcctagtagtgaagcatggacacatcctactaacacacatggtgaaactcatgttccctcttcaagccaacaattagaccccttgttcacattggaatcagcacaaaatcaacaacaagctgatgcaacttctaagaaccatgcaggtgctactactattcccacaagcgttgaaccgcatcataccttttcagttgcaggacaaggacatcaaagcaaggctgatagcaattcagtaacagataacaagtcagactcatcagttttatcattttccccggcttctgaatcttcaactcaagaccacaagcataattctgcaaatgcagccactaacacacacggtgaaactcatgttccctcttcaagccaacaattcgacccctggttcacattggaatcagtacaaaaccaacaagaagctgatgcaacttctaagaaccatggaggtgctactactatcccaacaagtgtcgaactgcatcataccttttcagttacagaacaaggatatcataccaaggctagtagcaattcagtaacagataacaagtcaggctcatcagtttcatcattttccccatcttctgaatcttctactcaagaccacatgcataattctgcaattgcagtcactaaagcacctcaaaaacggggaaaagatgttaagtttgcttcagaattcagtgatgatgatatcccaatcagctcttatccaaaacatggacggcaaggtagtgatggtgcaggacaatactcatcagcaggtgttgctcctggcacaagcaacggctcagaaaagcaaaatccttcactgcaggtgatggagagtccggataatcctacaatttcttcaaactataggtttccatcacatgtgtttgatagacacaaatcaaaatcaaacactcaatggagcactgcctctaatgaatcattgttcagcattcaaatgggaaatacgagtttctcgaatgacatggcttggatgagcaaatctggtgatatggatagacctggtgacatgaactcgtctggcgcatttcctccaagcaatcagcccccattcccacctcaatcccaaccccaacctcaatctcaacctcaacctccagtaacaaaattcaatgatatcagccaatgcactgcaaaacaacatgaagtttcaagagtgactgaacaaaaagctgctgagacaatgagagaggttataatggaaaacagtataaaaagagacagtgtaatcaaaggagatttgatacctgatcgtggggcagcaccttccaataagcgttctacttctaatgctcattctcaccaatcagacgggagcaccaaatcctttgcgtttaatgtattggcagatggagacaaacctctttcaccaaaacatggtgaagagaagagaaagcagcagaaacagccagggcagcttaacattagaccaacaccagatgcagcagctcagaatcccaagtcaaccccaaatgcttctcagaacaaatcatggttttcctgcttctcatgctgttaa

SEQ ID NO: 108287 - DNA, 351 bp, Glycine max
  Peptide Sequence Number=SeqID_225065
atggctagtaaccatttgcttgacgtgaacgatttaaaatcactgtttagcaagaagtttgacacgaaagacttaggtcctactaagaagattcttgggatgaagattcacagggacatgaaatcgagacagttgtggctttcacatcagggctatgttgaaaaggtgttagacagtcagcaaaatgatccttcaattgtgggatatgtggattttgactatgttgatgatttggatgacaaaaggtctacaatagggaagattcaagatgcaactgatatgttaactaaggcaaccacaactgacaagattcaaaattgcttgaacttgttgaatgttgctcaatgctag

SEQ ID NO: 108288 - DNA, 836 bp, Glycine max
  Peptide Sequence Number=SeqID_225066
ggaccaaggagagggatgccaacaaggggcttgaagaggagctaacaatgtacatgaaggaggccatggagcagcttgaaaaaaggtttcaaaaggccgtcaggcaagccaagttcttcaccaaagatcccaacttaggtctttttgatcctttcaaagacgtgaagaacgatgttctacttgatgaaaaagaaattgtcgtgaaggaggaggttgttgttgaggagcagggtgctaaagggaagcaagaccttgtctatgtggaggcaagactttggtggtcttgtgaaatagaaaagtggatgacgcaaagtcatctcaggtttgattccaacctgattaaagttcttgtcacccatgtgatgtctggtgataggtcgtcttggcctatggagctcttctcccttgatggttatgagaagtgtcctagaccttggactagggttattgtagttgctgtgactgagtggaccaaggggggctctccaagggtgaaccttgagtttaacgagctttgggttagggatgtgtttgccctacattttgaaaagcctgtaaagttgcgccgaggcttacctaggacaaaccttgggttttgtgaacctgtgagactcaccaagggtggaccttgggattcactcagggtaaaccttgggttttgtaagccctttggaggatcgaccaaggaattgttcgacctgggttttgggagttgtgctcttgcatacgtgtcacatactagagacggtgatattgttggggcctttgaggatgattcctgccctgcttccctttacattagacgaaccgtcaatgtagaggctctgccaatatga

SEQ ID NO: 108289 - DNA, 282 bp, Glycine max
  Peptide Sequence Number=SeqID_225067
atgaactaccccatcaagcaggttttgcgaaaacctaaactcgcaggaaggatggtggcctgtgcaaaaaggagcagtggcgctaagtgggccctgtgggctcagcacgcatcaaccgctaagcacagcttcagcgcgcttagcgtgacaagggaatctggaagagcacaagaatcaaggttgcgcgctaagtgcaagatcagctcgctaagtgatatgtttgtctcttgccaggctcaacgcacgattggcgccaagcccaaatccacttactcgtgctaa

SEQ ID NO: 108290 - DNA, 630 bp, Glycine max
  Peptide Sequence Number=SeqID_225068
atggacagatttgggcacatcgctgtccagatccaaaatcttaacccagaggtagcattgcattcaatgctcctcaacctacatcccaacaagttcaccgagagtctgtgcaaaaataccctggtagtatggacaagttgcgcaaacgagccaagggatacatctagatggaagaaatgtctagattcaggaactaacgagaaggaagcaccaagaccgactcacataaatcggacaaaaggcttaagccagacaagagccagcctctccccaaatagctcaagtaagagagttacaacctcgacggtcaatcgcactacaatcctggaggaagctttcaatttagaggtatccacaaagctacccccgacaaaacctcctaggctggggttagacgcaaccaaatactacagggacttcaagggtatcaaccccatcaaccaggacgaccacatggttgtctccatcatcattgcaaatttcatggtgtccaaggttctcattgaccagggaagctccaatgatatcctatactggaaaactttccagagactcgaggtctcccctgacactgtccatcctcacgtcggtccactccttggctttgcaggcgaaagagtagagacctga

SEQ ID NO: 108291 - DNA, 1476 bp, Glycine max
  Peptide Sequence Number=SeqID_225069
atggctattttgcaagattgtgttagggcccaggagtttaatgacccatcaaagcagcaacacatcagcctaagattttgcaagtatatattagaatgggtaggaagggaaatgatcaaaattaggaaactgaatgtcactgctgcccggcttccatcctttcatacctgtgttggtgcaaatgaggagaggctaacttcaaaatggtataaagagcatgggattgaattagttcttggaactggagttaaatctgctgatgtaaaacgtaagacactattaacaacaaccggagagaccataagttacaagattcttattgttgctaccggtgctcgggctttgaagctggaagaatttggggtcactggatcagatgcaggaaatgtctgttatttaagagatatagcagatgcaaataggcttgttgatgttatgcaatcttgtcctggaggtaatgctgttgtcattggtggtggatacataggcatggagtgtgcagcgtctttagtgatcaataaaataaatgtaacaatggtctttcctgaggaacattgcatgggtcgattatttacctcaaagatagcaaactactatgaagaatattataaatcaagaggagtaaacttcattaagggaactgtgctgtcatcatttgattttgattccaatgggaagccggagaaaaagactttctataaaggaaaagaaaaatgggaggttgattgtgttaggaacctacttaagcatgttacagctgttaatcttagagatggaagcacactgtctgtggacatggttgtggtaggaattggaatacgtccaaatacagggctgtttgaaggccagcttactttggagaaaggtggaatcaaagtaaatgggatgttgcagtcaagcaacagctcagtctatgccattggagatgttgcagcatttccagtcaaagcagttggggaaacacgaagacttgagcatgttgattcagcacggaaatctgcgagacatgttgtttctgccataatggaaccaaacaaaacgagagaattcgattaccttccttttttctattccagaatcttcacactgtcttggcaattttatggtgataatgttggggaagttgtctattatggagatatgtcaggtagtacatttggagcatactgggtaagcaaggatcaccttgttggggctttccttgaaggcggaactaaagaagagtatgaagccatagccaaggccactaggttaaggccggtaattgaagacttgactgaacttgagagacagggtttgaggtttgctgttacagttagcgagaaaccgatggcctcacccccaattgaggttagggcctcagacctacttttggaaaaaccattatatgcttggcatgctacagctggggttattattgctgcatcaatagctggatttgcatatttttatgggaaaaagcgccacagatggtga

SEQ ID NO: 108292 - DNA, 510 bp, Glycine max
  Peptide Sequence Number=SeqID_225070
atgagggtgtcgaagctgtctatggatcttggtgggagtccaccataccgggtcaatgttgcccctttgaaaggcattgggaagacacgacatagagtcacatcatcattggtgtacaggttgagcggtttccaacctaagggtatgtcaatttccatattatggacgacaaagggatgcccacgagtagtctgccttgctggacggtggatgtgtgagagacttcaatcatctggagtgttgattagtatctgtgtctgtcatggcttctggtggaggattggagcctttgaaaagggtctcagacttcacacgtcggctttgagaattgcctttgttaagaggacaagagggggggacctgcaaaacgatggactccaatgctcaagtaagtatgagttaggagaatgtgcaaaaatatataagatacgcaagcgggtgtacatagtgtgctcaagatgtaactgcataggtgtggttgctttgtattggtgcgtgttgagggtttga

SEQ ID NO: 108293 - DNA, 305 bp, Glycine max
  Peptide Sequence Number=SeqID_225071
atggcagaggtgcattggcccataatgccttatgcatccagtaccgaacaaggtgggcccagtctatctaaagaccagtttgaagagcccataataggattaaatcctcctcataggcttgggcaaggtttcatggcggcggtggcctacaacggtggtggtggaggaggatccctttcgtttcttcaacgattctgccatttgagaaatgaggaagatatgatgattggaagtttgagagagcttgggcgctgtcaagaaagtgagaggaatgagggttatgcgaaaaagagtgagaaaatgag

SEQ ID NO: 108294 - DNA, 300 bp, Glycine max
  Peptide Sequence Number=SeqID_225072
atgaatcctaatgaactattacaggacatgcaaaagagattcacacacatagtaaatcatcttgcatccttaggaaagatatttccaaatgaagatcttattaataaagttttgagatgtttaagcagggaatggcaaccaaaggaacatgaaatggaattaatgagattgaatcaacatgaggagaatgataagaaaaagaaaggaattgctcttaaagcttcatcatcaatccaagaaggaagtgataaagaggattcaaatgaaatagatgatgatctcagtctttttgtaaaatga

SEQ ID NO: 108295 - DNA, 249 bp, Glycine max
  Peptide Sequence Number=SeqID_225073
atgctacaatgcgagggatatttctcttatcttagacatgatatcgaaattcccaatggtgagagtgctcggaaatgggttgcaaacatgctgtttaaatttcacgacgatccaacggtgaatgagtccgagatcgtactttttctaagacaggtttggtggcctgcgaaaaaaaaaagagggttttgggaggagaaggagaaaaacgaaaatgagagaaaaaagaggcaccatcagtgtgaaaactga

SEQ ID NO: 108296 - DNA, 339 bp, Glycine max
  Peptide Sequence Number=SeqID_225074
atggaagtaaccatcttgcaaaaattggggccacagatgaatcgagttacatcactgcttcatctactgccaaacacatttaggactgttgatgtccttgttacttccagtttcaccttgaccaagatgtcatggaccataaaagagcacgctttatgcccttaccgaacctgtgctagagctagagtaatgggtgaagtaaaggaggcgcatgagcagatgaaggccgacatggaggccatgaaagagcaaatagccacaatggtggaggccatgatgagcatgaagagatatggaagccaatacggttgcagttgccgctaccagcgctgttgctaa

SEQ ID NO: 108297 - DNA, 186 bp, Glycine max
  Peptide Sequence Number=SeqID_225075
atggactcttggccaagccacctgtgcaagaaacttctccacactcatagctggctgttggctagagctctgcaatctctgtatgatgatgatctagcctctgtaagatgggagagtcttagatctcttcgccttgcctttccttggccctctctgaatgtcactgttggatcatctagattctaa

SEQ ID NO: 108298 - DNA, 581 bp, Glycine max
  Peptide Sequence Number=SeqID_225076
gtacactttactcctcttcttgttcgagtacagagccgcgacacttctgatccaacggcagttcccggggccaacggcggcatccatagcgaaattcgacgtcgacggcgacgtgatatcccttgacggccacgacatgccgctgcggacggagtcggagaccgacgaccacggccggatccacgtgcggatccgccgctccgtctcgtcggcgccggagacgaactcctccatcggcggcaacaccaccgtcgtgacgccgcggcagtcgaacctctccaacgcggacatattctcgatcaacacgccgctgcacctgcacgaaggcggcggcaacctcgccgccggcgcaagcccccacctctccggctacgcctcctccgacgcgtactcgctgcagccaacgccgagggcctcgaacttcaacgagatggaggccggcacgcccgtgtgggggaggtcaccggtcgccgccgggagagtgtgccggcagtcttcgccggtggcgagagtgttgtgggagtcgccggggaaatgcctgggagataagagacaaggctgcaaggacattaccatgtcag

SEQ ID NO: 108299 - DNA, 435 bp, Glycine max
  Peptide Sequence Number=SeqID_225077
atgataacgggagaggatttgtacaaggtgatgtgcgcgatggtgccgctatacttcgcaatgctggtggcctacggttcagtcaagtggtgcaagatgttcaccccggaccagtgctccggcatcaaccgtttcgtggctgtgtttgctgttccgattctctccttccacttcatctccatgaacaacccctacgagatggacgccaaattcatcgtcgccgacacgctatccaagctcgccgtgcttctatttctctccctctgggccgttttcttcgccggaggctccttggattggctcatcactttcttctccctcgctaccttgcccaacacgcttgttatgggcattccgctgctccaagccatgtacggcgatttcacgcaatcgctcatggtgcaactcgtggttcttcagtgcaccatatggtaa

SEQ ID NO: 108300 - DNA, 1005 bp, Glycine max
  Peptide Sequence Number=SeqID_225078
atgaatcgtcaaggtgactctgatggtcaaactaataccaacaacagatcaaacaacgaaaaccaaacgatgcctctttcaccatttgaaacattggagttgcttcctttatttccgctcacaccagaaaatgcagggcaagtagaagatatgcctggagccgatgatatggctccattgctcggacaagagagtaccatgtttagacaagttggaacctcggttgggactccttcatttaatttgccccagaggctcaatcatttagagccaaggcaattagtatctggatatgaggacgataatggtaatgaagcggttgtgtaccaccttctgaatgaccaagctggcctttcaacgttgagagcttcacagtcacaaagattgaactactctggtggagcaagtagttctagaactcataactatcataatcaagtgcaagtattagaatctggagttccaccttacgtccaacatggaccctcgttgtcaccactaccatcatatccttccgcggaagagagaagaaggctttcatcttacgttcagtctaccctagaagctctacgcagtggtccatccgctgtaatgttcgatatagattttgacacaatggaattcaggagcatcgaccacgcacttgtgtcaccatatgggtttcagaaccccgaagaatttgatgcattgccccagggacttactgtagaaacgatcgtgcagcacctggagagtgaaacttatgtgattgttaataaggatgctccagaagaagataaggaaaaatgccccatttgtctggaagagtttgaagagggaaacttaattgggaagcttcattcttgtatccacaagtatcaccgtcactgcatccgacagtggcttttgtgcaggaacttttgcccagtgtgcaaaagagttgggctggaaaccaacaataatgttaaaagtgaagctacagcagcggaaattaatattaatgaaaatgacaatgacaatgtttag

SEQ ID NO: 108301 - DNA, 276 bp, Glycine max
  Peptide Sequence Number=SeqID_225079
atgttaacacgcgagccctattttgctcgtgctctcttcttcgatctccatctaagctcttcttcttcttctccatctaaggtctcttcttctccgtctaagcttcttcttctccgtcgtgttcgagaccgtgtcaacttgccaccttacgtaggtctgttcggggaactcgtgctcattgcaaggactctgtttgtttttgctgcaaggaccttacctaggtacgtttcggtttgcagtccgtttagggtgctcagtcatgctcacagggtctga

SEQ ID NO: 108302 - DNA, 330 bp, Glycine max
  Peptide Sequence Number=SeqID_225080
atgtcggcgacaccatcgatgaagccacagaaaaggaaggatggtgcgttgaagaagagggagggaggagaaaagtcatcgttgcatgtagtgtcgtcggtgagggagcattgggggaggcactctagaggcagacttggggaaactaaatgcaaaattgcagtatgcactgtattggccactagggttaactctgctcttgaggacttcaaaattgaatatggccctgtatccctacttctgtcagcaacgatggcatcgtcattgctgaaagcaagagctttacatccacgaagggttgagactccaaccgtacatcaccgacattga

SEQ ID NO: 108303 - DNA, 586 bp, Glycine max
  Peptide Sequence Number=SeqID_225081
cgcgaaaacaagcattggcgctaagcaaggaagaggtgtgataaccgcgaatacaggcacctgcgttaagcgagcaaagcatgctaagcgtgagcacgcatgcccaagtccactccagaaatcccttaccactgcggtgttcgttttgacaaccataatctccctgacgtccctatttctcctctacatcaaacactgcaacgtaggaaacattgacgatagtgatgaagtagcattcacgggagcttcaggtctccggagaacactgatgcgggccaagctagaggagcttcagaatgatctaatcaccatcgagaactatgacttcggtgagagtctgtcactgttgcaactgtcaatggcagagtgccacaatttatgtccgcgttgcatggacatgttctacaatgagaagcttctgatgcatagcgatttggacatggcaacctcccagaaatcaaagatcaatgtcggtgatgtacggttggagtctcaacccttcgtggatgtaaagctcttgctttcagcaatgacgatgccatcgttgctgacagaagtagggatacagggccatattcaattttga

SEQ ID NO: 108304 - DNA, 684 bp, Glycine max
  Peptide Sequence Number=SeqID_225082
atgattagacaacatggtcatggtggccttaagcttaatgctaacctttcgaggcacatgagggagatgaaaacagagaaaaggccaataacaaaggtgcggaacagggaggggatgaacaaaagtagagcacgagctgatgatcaggaaattaacagaaacaatgacatacctagcatagaaggaggcagtttggctaaccacagtaaacaacaatggtcaaagctaaggtcgtatgcgaatgtactgacaacaaaaaccaaaagcatggggaagagaggaaatcaaaggcaaaaacaacagacatcaataatatcacactcaacaatgcaactgaacatccctgtggagcagatgaacagattcaataacacatgggttgggaagttacgaaaactggacattttcgacaaattggaagaggagcttatgtgggaagcaggacaggagatcaggcctacatacatgggtgacgacatggttctcctggtgggtctcactgactcacaagtccaacatatgtgtataaatgaagacgaaaatggaatgtcgcttttccattcactagagaaatggaacccagattcctcttgttggactaaactcgaccagaaccgcattaagacaaacatacaacaactagattaccgtaccctgatccctcatgataatatgataaactag

SEQ ID NO: 108305 - DNA, 540 bp, Glycine max
  Peptide Sequence Number=SeqID_225083
atgggtatacgagagcagttgcattcgatatcacaagggagatcagtatgtgtgggcccatttttttacagtggatgtatctggttgaacgaggcaagcattgttgaaaggtatgtcgctgaagaagctattgagttttgttcagagtctatgaaaacaaccaaggctgttggccttcctcaaagtcatcacgactgcagacatagaggtaggggtacacgagaatacaatgttttgacaatgggtcaactggaggtctcacaagcgcatctgtatatattaaataacacagaagagtgggttaacgaaaatattggtgttcgtcaagacgaattgggatttactcttgtagaccttcgtaaggtggattacaaggacaaccctttcatcatggcagaacaagcaagacaagtcttttacatccaagatccttgtgacttaacatgctcagtggttctacaaggaagaactagtggtatcattcaccacaatgatgcttccaaccttgatattggtgatactcatgctttctccccatga

SEQ ID NO: 108306 - DNA, 390 bp, Glycine max
  Peptide Sequence Number=SeqID_225084
atggtttcttctatatatacctttatgtgtgttcttcattccataatagctcttacttgtggagctttgatgatattctactccaaagagatctctgtgcttggccacagatccgagaccgcaagcaagcttcaagggacaacaccctatgatcagcttctgattgacacctctgattccttctctggcttggtgtggatgcttcacatttccattgcagtgtggagattcttctttgagaggaagcttggggatcttgcacatgaatggcctaggcatgctgttggggacatagcattggcaatttcatgggtcttttttcttgtaaacaacatggcccaaattggccttgtgaatgctcagattcttgacataaatggagaaccatga

SEQ ID NO: 108307 - DNA, 728 bp, Glycine max
  Peptide Sequence Number=SeqID_225085
gtttcgcacgcattcaacacgacgccgcgaagctcagaacctcgaaggacctcgaagctgacatcccctgtgccgcatcaacgttgttgcagtactaccgtgctataggctaccccgccgtggttgctagctgtgtcgacgtcaccaccggaaaatctttttacggccctgacgacccctacgccatgttcgtcaacaaagacaccagcaaagccctggcgaagatgagcaagaacgacgatgacatctccccttccctcgacggcctctccgacaaggagattggcgttctcaacgattgggagaacaaattccaagctaagtacattgtcattgctcgtggaatcagttatgctaaccttgcaaatcttcctgcaattctaggactctgtgattcaatggatcttgtagtaggacctgtttctattgcttccctagtgctgggatccatgctcacagaggaagtgtctcccagtgaacaacctgatccttttcttcaattagctttaacttcaacattctttgctgggatccttcaagccgctcttggaattctaaggctaggatttatcattgattttctatcaaaggcaatccttatcgggttcatggctggatcagctataattgtagctttgcaacagctcaagggccttcttggaattaatcaaacatttcaccaaaaagatggccctggttccagttttgagatctgtttttcaaaataa

SEQ ID NO: 108308 - DNA, 495 bp, Glycine max
  Peptide Sequence Number=SeqID_225086
atgcagagcaacattagcttcaaccccaagaatgccattcatgtgcaagatccccaagcttcctctcaaagaagaatctccacactgcaatggaaatgtgaagcatccacacccttaggcaaagaaactctgaaagtctatgtccttaacaaaagcaaccatcaagagaaggaatcctattgtgaacaacaacaagccagagaaggaatcagaggtgtcaatcagaagctgatcatagggtgttgtcccttgaagcttgcttgcggtctcggatctgtggccaagcacagagatctctttggagtagaatatcatcaaagctccacaagtaagagctattatggaatgaagaacacacataaaggtatatatagaagaaaccatttatccgaattcacttcaaaggcctttaattgctttcttacttttaactcaatggagcctctgccctctaaaccaacaatggtagttgaaattccaatcacttctttctag

SEQ ID NO: 108309 - DNA, 258 bp, Glycine max
  Peptide Sequence Number=SeqID_225087
atgactgcgaaaggcattgacaaggatgatggggagggagaggaatgtaggactggaagggcaaggctagctactgaaggcgatgtcggtgagggcgacaaggagaggggtaagggatgggaagacgatgaagatgtcgatgttggcgtggcggaggagattggtgttggtgaagatggtgaggtagaaaacgagtgcggtggggaagaattttttggtagtggggagggtaaagggatctcggtgaagaaatcctaa

SEQ ID NO: 108310 - DNA, 363 bp, Glycine max
  Peptide Sequence Number=SeqID_225088
atgattagtagtggtagtgatagtgctggtggtggttacaacattgttcaccagtcaccacctacaactaattcggttcaacaattagcacagacacaatcacagactaaagaaaaccgaaaagtttctcctaaaaaaaacatactagaagttgtcaccgccacagagagaccaacaacgagagtgagaccgagagcgagagtgagggtgagacctggaatgagagcgagagtgagaccaacagtgatagtgtcgacagtagttcagtgtcgcgagagtgagaaagggttcgtgggagtaaggttgccagaagcgcgagggagacgagttgtgagcgagatgagtgaagtgcaagaaacataa

SEQ ID NO: 108311 - DNA, 747 bp, Glycine max
  Peptide Sequence Number=SeqID_225089
atgaatcctcaaggtgactctgatggtcaaactaatacaaacaacaaaaatgaaatgatgcctcattcactatttgaaacattggagttgcttcctttatttctactcacaccaaaaaatgtagggcaggtagaagatatgcctagagccgatgatatggctccattgctcggacaagagactaccatgtttagacaagttggaactttggttgggactccttcatttaatttgacccagaggcttaatcatttagagctaaggcaattagtatctggatatgtggacgataatgttagagttcgtaatgctcaagcggttgtgtaccaccttctgaatgaccaagctggcccatcaactttgagacctttagagtcacaaagattgaactactctggtggagcaagtagttctagaactcaaaactatcaaaatcaagtgcaagtattaggatctggagttccaccttacgtccgacatggaccctcgttgtcaccactaccatcatatccttctgctgaagagagaataaggctttcatcttatgaaatgtttgaagagggaaaccaaattgggaagcttcattcttgtatcaacaatcatcatcactacatccgacagtggcttttgtacaggaacttttgcctagtgtgcaaaagagttgggctagaaaccaacaataatgttaaaagtgaagctacaacaactgacgttaatattaatgaaaatgacaatgacaatgcttag

SEQ ID NO: 108312 - DNA, 904 bp, Glycine max
  Peptide Sequence Number=SeqID_225090
atgtcttcttccacacaggacgaaatctcctttgtcctgcgtcagtttcttcttcgttcctctgtcacaacccacgagagtaacgacgacgcacgcaattccatgtccaaaactgctctaccagatgggatctcagcctacaagggttcttctgctgccaacgtgtcttctctgtcggtggcagcgagtgagaatgaaactgatgacttcgactgcgagagtgaggaagaagaggttccaactccaccaaagtcgattcgttctaggagttcctccaaaaggaacagagctgcggaagttcataacctctctgaaaagcggaggaggagtaggatcaatgagaaattgaaggctttgcaaaatcttattccaaattctaacaagactgataaggcttcaatgcttgatgaagctattgaatatcttaaacagcttcatctcaaagtacagatgctgtcaatgagaaatgggttgagtttgcatactatgttctttcaagaaggtttgcaacctctgcaattgtctcaggtgccgagaatggattcaggtgaagaaagcagacttatcccttcaaacccaacagcttctctgcctatgcaccaagaaaaccccatgcactatttgtccaatctacctaacaaactcgccatggcagatcagcaatccgtgccaactccatcatatataatcaactcagaaacttctttcaggctggaatctcctattccagaaaatataagatcatttcaactccgaagatttcccgaggaacatattgttatctttgtggtctgtggattgcttggtcgttctgatgaattttacggaaagcttataaccatgggagttgatacaggcaacaaatattggggactcgaacttagggttgaaatccgcaacaacg

SEQ ID NO: 108313 - DNA, 468 bp, Glycine max
  Peptide Sequence Number=SeqID_225091
atggacttctcagagctgattgagagagtcaatggcaaattatcagcttggaatgttcgtttaatcaacaaaccaggttgggtatatcccaagtatatttgtggctttgttgacaaaactattaggtcttttatttggagaggttcgaagggcaaaggactgtataaggctctcaaagtcttaggaaacaattttaaactcaaagttggaaatggagagaaggacttgtgggatgtgtgggaagggaatgggtggaatctggtcaaattgtacactatgcttccctctgatatagctcaagctatcatgagtacacaacaaggaacacatacaaatggtgtcatggttaaacgagggagattggggctacaagctcttggggctggatatgaaaattacattttcatgctaacattcaatttttcatatggcaagtgtttcatcttgctctcccaatcaagggtgtaa

SEQ ID NO: 108314 - DNA, 643 bp, Glycine max
  Peptide Sequence Number=SeqID_225092
atgaactctcttgaagttctttacctctggggcaacgaactacaaggcgagattccatctttctttggtaacatgtgcgcattgcagagtttagacctctcaaataacaagttgaatggggaaatttctagcttcttccaaaattcttcatggtgcaacagatacatatttaaggggttggatttatcttataaccggttgactggcatgttacctaaaagcattggattgctatcagagttggaggatcttaacttggctgggaattctttggagggtgacgtcaatgaatcccatctttctaatttttccaaattacaatccttggacctatcagagaactcgttgtctctgaaattggtcccgagttgggttcctccattccaattaaaatacttgggaatcagatcttccaagttgggccccacctttcctagttggctcaagactcaaagttctttgtacgagcttgatatttctgataacgggattaatgactctgtaccagactggttttggaataacttgcaatatatgagagatttaaatatgtctttcaattacctcattggtgtaattccaaatatttcagtgaagcttcctatgagaccgtctataattctgaattcaaatcagtttgagg

SEQ ID NO: 108315 - DNA, 1242 bp, Glycine max
  Peptide Sequence Number=SeqID_225093
atggctcttcgctcagcgaacatgcacagctcatgcttcttccagattcttcctcgcgctcagccgaggagtgttgcactcagcggatggctcgctaagccgacaggttggcttagcgagagggggactcaaagtcctcgcaattatcttatcaaagattatcaaagtttgttgtcatgcggagacaatcatggtcatccgctttctatgccttccagagacaatcaagtctgttggcacgcggagacaatcatggtcatccgctttctttgccttctagagacagtcaagtctgttggcatatggagacaatcatggtcatccacaccttttgccttccagagacaatcaagtccgttggcatgcggagacaatcatggtcatccgcaccgtttgccttctagagacaatcaagttcgttggcatgcggagacaatcatggtcatccgctttcgttgttttcaagactattacagtcttttttgccttccagagacaatcaagtccgttggcatgcggagacaatcatggtcatccactttcattgttttcaagactattacaatcttctgtgccttccagagaaaatcaagtccgttggcatgcggagacaatcatggtcatccgcttttgttgttttcaagactattaccgtcttctaagccttctagagacaatcgagtccgttggcatctagagacaatcaagtctgttggcatacagagacaatcaagtctgttggcttttcgaagacgacaatgtcttcaaaaggcaacaatgccttcatttacttttcgaagacgacaatgtcttcaaaaggcgacaatgccttcatttacttttcgaagacgacaatgtcttcaaaaggcgacaatgccttcatttacattttcgaagacgacaatgtcttcagccatttatgctttcaaaaggcgacaatgccttcatttacatttcgaacacgacaatgtctacgatcttttcatgctttcaaaaggtgacaatgccttcgtttacgcttttgaagacgacaatgtcttcatttcaaagacttcaatgtcttttgtccttgtgcttcttaggactcaacgttttattgcttggacttccgctagtggccgattggatgcttgcctgggcgagctgagctcgcctgggcaaggtaggttacttcaggaggaagtaggaagctcgccggggcgagctgctatgcaacctccacccctcatttgctataaatga

SEQ ID NO: 108316 - DNA, 378 bp, Glycine max
  Peptide Sequence Number=SeqID_225094
atggagatcatgaaagaccaaatggccaccatgatggaggccatgatgagcatgaagaaaatgatggagggcagcgcagctgcgatcgccactgagggaggtgaagcgttaggaagtacgggcagcccccattttgtgcaagttcagaataagcattccttcccactgtatggcttgcctcccaactatacgccacccaatgttgcacacactcccgaggagaatgtcaacaactcagcacccatgcccattgagggccaacaacctcaatctgatcatgcacatgtctctcaacccatgggggggacacatgaagtgccccaagaccgcactctagctgacttcaagcctcccctcggatgtgccactgagggataa

SEQ ID NO: 108317 - DNA, 501 bp, Glycine max
  Peptide Sequence Number=SeqID_225095
atggggcttcactgttatcaagcgagtcagagacccagcatgaccaccgatcgacctccattcttatggcttcatagacccagcaagtccctagtggagtcgccaactgtcgcaatctacccttcagtgagggtgcgaaaaggccataatagattggccaaagcgtttgtctccaaggaagaaaacaagcggagtcgccaacaacatttatttgaagaaaacggagttgcccctgctcctacgtatcctcagatttattttaattgtgaacaaaagtcatttaaggcgttggacctcgaaacgatgtttcactttttgaaaagtggggagagttatttaaggcgttggaccttgaaacgattgtcgcaacgtgcccttttgcgggcgagcgaaggcgaggctcacgggtgcgctttccaaaggaggaaagatgcgcggagtcgccaccaacgtttatttgtggaaaacgtcggaaaaaccgaaggaaaccggtcaaaatga

SEQ ID NO: 108318 - DNA, 438 bp, Glycine max
  Peptide Sequence Number=SeqID_225096
atggagaaatttgatcacatagaggaaaggctgagggccattgaaggaggcagagattatgcttttgctgatatggaagagttgtgcctagtacccggcatgttcattcctcagaagttcaaggaaagtttggctggggcagcaatcacttggtataccaacctggaatcttcccgggttcgttcttggaagaacctaatggttgccttcattagggatttggcagctcaaatagtgcccccaatgacggagaaggagatgataacaatgatagtagacacattaccagtattctactatgagaagttgatgggttacacaccttcaagctttgccgatttaattttcaccagcgaaaggatcgaagtgggtctgagaagaggcaaatttgattatcctgctttgatgaataggaagcctgggataaaaagagaatga

SEQ ID NO: 108319 - DNA, 204 bp, Glycine max
  Peptide Sequence Number=SeqID_225097
atgagacaggaggctgctactcttgagaagacaccacaggttacagcaaatccaccctcaccagtggtggatctatcttatcctcagcaggcagcagacccttctaccccagtgcttgagatgccagaggaccctgccacaccagtcttgagattgactaccactcctccagtcactcattatgaatgtcctgaagcatactaa

SEQ ID NO: 108320 - DNA, 558 bp, Glycine max
  Peptide Sequence Number=SeqID_225098
gcggagcttgagaaagtccaagcagtcaaggagaagttcaagtcaacagccatcaaagtccgaaaggagtatgatgaactgaagaacatcaacatagccaccgccgaagccttggaacgggaaaccaagagggcccggaaggaagaacacggccgaaacaagttccgaggagctttatggggcaacaatagtgagcttaagcttcgaagagacgagagggatcagtcacgggtcgaaggcatgatcttgaaggacgagttaaaggcttaccttaggtccaaaagaagtttgtcccaacagttaagagagacaaaaggaaatatgttggccatcattgataaatacaaagaagagctaaacctagcagctgctcatgagcaaaggctaggggatgagtacgccaaggtatcaccggaaaaggaagcaagggaaagggtaatcgactcattgcacaaagaggcaatgatgtggatggacagattcgcctttactttgaatggaagtcaagagcttccccaactactagctaaggtcaaagcaatggcggatgtgtactag

SEQ ID NO: 108321 - DNA, 372 bp, Glycine max
  Peptide Sequence Number=SeqID_225099
atggctctatatgaattagcagtttttgatccctctgaccctgttcttgacccaatgtggagacagggtatgttcgttatacctttcatgactcgtttaggaataaccaattcgtggggcggttggaatatcacaggagggactataacgaatccgggtatttggagttacgaaggtgtggccggagcacatattgtgttttcgggcttgtgctttttagcggctatttggcattgggggtggcttgttttgggttttggcgcatttcatgtaacaggattgtatggtcctggaatatgggtgtccgatccttatggactaactggaaggatacaatccgtaaatcccgcgtggggcgtggaaggtttttga

SEQ ID NO: 108322 - DNA, 192 bp, Glycine max
  Peptide Sequence Number=SeqID_225100
atggggttttctgggtctacccaacatagcatcaaggttcacaatgttgagtggtgcatagctaaggaggtggtgaggttgacaacggttacacggtggtctcgtgatttgggcatggctaaagggaggggaaatcaaaagaatgtggtggtgttctggttagggcttgtgagtgtgggcagttgtgattag

SEQ ID NO: 108323 - DNA, 342 bp, Glycine max
  Peptide Sequence Number=SeqID_225101
atggatgttaagaaaggtgggtctttagtacaaatgcaagtgaagttgcagaagcataacgaaaaggagatgggcatgagaaaaggtccatgggcggttggcgaggacaccattctgttcaattacatcgccacacacggtggaggtctaaggaggagtgggaagagttatagattaaggtggctaaactacttgcgccccgacgtgtggcatggaaatgtcacactccaagaacaaatattaattctcgactttcactgtcgcaggggcaacatgtggtcaaacatgtcaacagctgctaggaagaacagacaacaaaataaagaactattggagaattga

SEQ ID NO: 108324 - DNA, 699 bp, Glycine max
  Peptide Sequence Number=SeqID_225102
atggatgttgcgcatttcattttcgggatatttgggaatgcttctggtttgttcctcttcttggccccaatagtgacattctggaggatcgtttcgaacaaatccacagagaagttctcgggggttccttaccctatgacacttctcaattgtctcctttctgcttggtatggtttgccatttgtgtccccaaacaacttacttgtgacaattatcaatggcacaggagcaggaattgaaatcatatacgtctttatattcatctacttcgcaccaaagaaagagaagaccaagattattggccttttctccttcgtgggcaatgcccgaaagctcttctgtggcttcgctgctgccatattttccatcgtcatgtatggttcacccctctcaattatgaggctagtgataaaaaccaagagcgtggagttcatgcccttcttcctctcactctttgtgttcctctgtggcacatcttggttcatctacgggctactaggccgtgacccatttgtggctgtacctaatggcgttggttctgcgttggggacagcacaactaatattgtattttatctaccgtgacaacaaaagtgatccaaagaagattccaagaacagaagaagaagctatggaaatgggcaccgctaataaaaatcccatatccaactcgaatggaatacaagagggacgcgtctag

SEQ ID NO: 108325 - DNA, 582 bp, Glycine max
  Peptide Sequence Number=SeqID_225103
atgacgatgaggaaggaggaggttggcatccatgatagttttctgcattctgtgaaagtccaacaaagccttcttatttttggtcacaggggagagaggaagaaggatatagtgtggaaagttcaagatatcatgtactgtaccaccaccacgtcggattaccaagaaccgcaccacctgagccaaacgcaaaatgacccttaccatcctcaacctcgaccactaccctccaactacctcggcgcacccaaactgccacacttacccgatccaccgcgtgcagtgtgcgtcaccacgacagaccaccatcatcaaccttcgatggatttggaacaaaaacaccacaacctaaatagtcgtctggtcccatcattatcagacttcccttgcgcgatgactgcggagtcgaaatcgcatcgctacagcttcatctgctttgttctctaccgcgactctctcctcttgaatagccctggcgaaagcgagttgcggagtcggaacccaacgaggaagaagaggctaggaagagaggagaagcacatgttggatgaggcaggagagggagtaccaaaccaacgataa

SEQ ID NO: 108326 - DNA, 291 bp, Glycine max
  Peptide Sequence Number=SeqID_225104
atgacattgatgacgctgacgaggttgaccggccccttcctcgatcttgtcaagtgtcatggtggatccatcttgaggttccatttgaagggttttcgttgctgcactaatggttcttttaagggggttttgttcattaacaagttggggcaagctcgacgaagctctccaatctctcaacctctctctcgaactaccctccagataagactgccactctcacgaaactccactcgttcatctccctcacttctcaccacctccaagcctcttccaagtgagaccgggtag

SEQ ID NO: 108327 - DNA, 297 bp, Glycine max
  Peptide Sequence Number=SeqID_225105
atggaaaggaacattaaagtccttttcccgccccctcagccaggaccaagtgagaaaatttctattatccaccaacttagagatgtgaaaaggctgattatgaaagatgatatcattgtggagcttccatattggccttgtagctgttgtccaccatattttccttcttttattggaaaccttcgaggctgctatggaggagtgctggaggaaattatccatgggcctactatgaagaactctgtcctccctaacccagcagttgaattcccaccacagaggcataacttttggtag

SEQ ID NO: 108328 - DNA, 1011 bp, Glycine max
  Peptide Sequence Number=SeqID_225106
atggatagagaacaagaagagatgcagtctctagggttgtttggcttcctttacgaagaagcctccaagatcacactttcatggaggaaaatcctcacccaaatcaccttaaaactaataatccctctctccttcatcttcctcatccacattgaagtctccaaccttttcttcagcaagattcgctcccacactaaagaaatgcatggaacaaaccctaaccctaacctacctcaatatgtgaagctctctgacaagatctcgtctgaattgatcactgtttcaacattccaaatcgcttacttcacttttcttcttatcatctccctcctctccacctcatcagtggcatacaccatcgcttccatctacacccccgaagatgtaacattcaagaaggttatgaatgttgtcccaatggtgtggaagaggttcatgttggcctttttatttgctttagcattttttttcctttacaattttgggagcatgatagttatatgcttatgggcaaatacatttgggataatgagtggtgggggtgcaatttttgatttcataggggttatttacttcatagggcttgctcacttcaccgtggtggtgcaactaacaattatgactgatttgcatgactcttgggaaaccctagccatggagaagaactacaagttgataaaggagaaggtggtttttttaatattcacaattttcgctcaaatggttaatcttgtttcaataatggtttcatcctctgggaagatgccgatattgaaggaaaggcgggcgagttccgtgaacaagacggcgatacttctctctttcttgctcgtgacttgtttgttcctctttggatttttgctgcatgctgtgatctactttgtttgcaagtcctactaccatgagaatgtagacatgccggctttaccagataatcttgaagtgtatggaggagagtatgtgcaattggaggtcaatgatgttcagcaggagcaagattttataatatag

SEQ ID NO: 108329 - DNA, 438 bp, Glycine max
  Peptide Sequence Number=SeqID_225107
atgttgaagcccctggtcacaattattgtattcttgatggttgcctgtgctcaagatatatatagtctgagtgataataccatttttgacgggaagaaaactgtgcgagtctacaatggcatgaatgatggcattcttgtgtatctccattgtcgatccaaggacaatgatcttggccaacatgttcttgcctttgcagagttccaaaaatggtccttcaatgataacctttttggcacgactcttttttggtgcacaatgaatgcaagcaatgtgcatgcgagttttgaagtttatcgtgccaaaactgaggaatataagtgtgatacccaatgcgatagaaatctaaaaaaagatggaggctatttttttaatcagttctatggctactgggagaagagattgtcatggcatattcctaaaacaccatccttttaa

SEQ ID NO: 108330 - DNA, 450 bp, Glycine max
  Peptide Sequence Number=SeqID_225108
atgactactaaagttttgtttgcgattctatacatcatagagtttgtgtacgtcaccgtggtgtggcaaatatcaagtgttgcggctgcgttagaagactatcacggtttcatcactcccgaggtttctctttataagtcacaaaagagcaaggagttgataaaggggaagaagatggttttaatttttgtcaatattcttgcttttcacaccggtggttgctcttgtatcgatattggttttgttccaggagatggtggtgcaaggatggagtgtgagtcctttggaaggagcagcatttggggttctatgcttcttgttattgtcttgttcgttccctttctgtcctatcacaatgagaacattgacaaatcagctttagcagatcgtcttgaagggtatgccaataatggaagtccggatgttcagctgaagcaaaaccaagtttga

SEQ ID NO: 108331 - DNA, 322 bp, Glycine max
  Peptide Sequence Number=SeqID_225109
atggcggaaccatcgaaaaagcggaaaggcacttcgagtcggagtcaacgacattccgaggcacaggaaacctcaatgccttcctccattccctctggatcattgttctcatcagaggaacagcgtatacggtacacaaacctcttttcctctcattccattatagacccaaaattcatagatatggagttcttctcacatgagaattttgaatgctttcaagcatttgaagactccaatcttattccattcatgtctctaaaattacctgtttattctgatttagtcaaagctttttattctaatttagaaatccatgaag

SEQ ID NO: 108332 - DNA, 2425 bp, Glycine max
  Peptide Sequence Number=SeqID_225110
atggtgttcatatttccaacgcttctgtccatgaagctccaaccacttttgctgcttcttgtgatgtacttctgtgcatttgctgcttcttcttctgagattgcttcagaagcaaatgctttgttgaagtggaaatccagccttgacaaccaaagtcatgcttctctctcttcatggagtggcgataatccttgcacttggttcggaattgcatgtgatgagttcaattctgtttccaacataaatcttacaaatgttggattaagaggtacgcttcacagtctcaacttctcattacttccaaacattctcactctaaatatgagtcacaactccttgaatggaactattcctcctcaaattggttccttatccaatctcaacactcttgacttgtccactaataacctctttggtagcattcccaataccattgataatctctccaaactcttgtttcttaatctttctgacaatgatctctctggtactattccttctgaaatagtacacttggttggtcttcatacattgcgcataggtgataataatttcactggatcccttcctcaagaaatgggtagattgatgaatctgagaatacttgatattcctcggtccaatatctcagggactatcccaatctcaatagaaaagttatgcaatttgtctcatctagatgtcgaaagcaacgacctttctggcaacattccactgagaatttggcatatgaacctaaagcatttgtcatttgctggtaataacttcaacggttccatccccaaagaaattgtgaatttgaggagcgtcgagactctctggctttggaaaagtgggctttctggctccattcccaaagaaatttggatgctgaggaatctaacatggcttgacatgagccaatccagtttcagcgggtctattcctcgtgatattgggaagttaaggaacctaaagattcttcgtatgtggaaaagtggcttgtctggctccatgcccgaagaaattgggaagttggttaatctccagattctagatctcggaaataatagtctttatggattcattcctcctgaaattggttttttgaaacaacttggtcaacttgatttgtctgataactttctctctggtgaaatcccctctacaattggaaacttgagcaatttatactatctttacctttataaaaacagtttatatggttctattcctgatggagtgggaaatctccattcactttccactatccaactgtcgggcaacagcctctctggagcaatcccagcttccataggcaatttggtccatttggactccttgttgcttgatggaaatgaactctctgggtccattcctttcaccattggaaatttgtcaaagcttagtgaattatttatacaatctaatgagctcactggaccaatcccagcttccataggctacttggtccatttggactccttgttccttgatagaaatgaactctctgggtccattcctttcatcattggaaatttgtcaaagcttagtgaattatttatatactctaatgaactcactggatcaattccttccactattggaaatttatcaaatggcagggcattactattttttggaaatcaacttggtggcaagattccaatagaaatgaacatgcttactgctctggaaaatttgcagctagctgacaataattttataggccatttacctcaaaacatttgcattggtggaacgttgaaatatttttccgctgaaaataacaacttcataggcccaattccagtgagttggaagaattgctccagccttataagagtcaggcttcagcgaaaccagctaactggggatataacagatgcttttggtgtacttccaaatttggactacctcgaattgagcgacaataacttttatggtcaactttcacctaactgggtaaagtttcgtagcctcacaagcctcatgatctccaacaataatttatcaggtgtgataccaccagagctagctggggcaaccaaattacaacgacttcagctgtcttcaaaccatcttacaggaaacattccacatgatttatgtaacttgcccttgtttgatctctcactcgacaacaataatcttacaggaaatgttcccaaagaaatagcatcaatgcagaaacttcaatttttgaagcttggatcaaataagttgtctggcttaatcccaaaacaactaggaaatttgctcaatttattgaacatgagtctgagccaaaataattttcagggaaatattccttcagagcttggcaaactgaaatttcttacgagtcttgatcttggtggaaattctttgagaggaacaataccttcaatgtttggagaattaaaaggcttagaagcactgaatgtctctcacaataatctttcag

SEQ ID NO: 108333 - DNA, 474 bp, Glycine max
  Peptide Sequence Number=SeqID_225111
atgagagtatcatctcgggcagctcaaggcaaaaatagaaaaactgaggacacaattattggagcctccaaaaagtatcatcttgggcagctcaagacaaaaatagcaaaactaaggacacaattattggagtctccaaaagtaccatgcacagtatcatctcaggcagctcaagacaaaaatagcaaaactaaagacataattattggagcctccaaaaagtatcatctcaggcagctcaagacaaatatagcaaaattgaggacacaattattggaacctccaaaagctctagctgaatgccctttttatgttgtgatgacaggagttgcatgcttctttctgtatcatcttgggcagctcaagacaaaaatagcaaaactaaggacacaattattggagtctccaaaaggatgctatcatggtgatcatgatgaaggtgttaaatttatcaatattgaagaagaagaataa

SEQ ID NO: 108334 - DNA, 484 bp, Glycine max
  Peptide Sequence Number=SeqID_225112
atgccaggttaccatctggtcagttcatgtaatgggttaaactgtggggttagcaaaataccagaaggataccgtgtttgtttctggaacaaggcgacaagggtgatatatagagaatcgccaatgctgtctttttcccagggcatcggtcgtagaacaatgtttgggtttggctatgatccgtcaagtgacaaatacaaggttgtagcaattgcgttgactatgctctcacttgaagtatctgaaaagactgagatgaaagtttatggcgcgggtgacagtagttggagaaaccttggaggttttcctgttctttggacattacctaaagttggtggagtgtatctgagtggaacccttaattgggttgttattatgggaaaagaaaccattcattctgaaatcgtaattatttctgttgacctggagaaggagacttgcagatcactgtttcttcccgatgatttttgcttttttgatacaa

SEQ ID NO: 108335 - DNA, 249 bp, Glycine max
  Peptide Sequence Number=SeqID_225113
atgccaatctccccctacagatgtatcggttgggatcgtgcccacaagacgcctagtgggcccgatgaagtccaacagggccctagggtttccagctctggttacgggcctctgaatggcacccacaaagatacccagtgcacccggagaagtccaacagcgccctggggtttccagctttggttacgggcctctgtcagccctatagggtgctcgttcccccagcgaggtcatgccatcgtgacatag

SEQ ID NO: 108336 - DNA, 579 bp, Glycine max
  Peptide Sequence Number=SeqID_225114
atggagagaagtatgatagatgctgccagtggtggatcccttggagacatgacccctgctgaagccagaaatttaattgagaagatggcttccaactcccaacaatttaatgccagaaatgatgttattgtcattagaggagtgcatgaagtagccacgaattcatcttcatcaggtgagactaagacgcttgaaggtaaactagatgtcttggttaacctggtaacccaactggccatgaataaaaaatctgcacttgtcgccaggctctgtggtttatgctcttctgccgaccaccacacagacctttgcccttttgtgcaacaatctaaagcaattgaacagcctgaagcttatgctgcaaacatctacaacagacctcctcaacctcagcagcaaaatcagccacaacagaacaattatgacctctccaggaataggtacaatcccgggtggaggaatcatcccaaccttagatggttgaatccttcacaacagcagcaacaacaaccttattttcaaaatgttgctggcccaagcagactatacgttcctccaccaatccagcagcaaaaatag

SEQ ID NO: 108337 - DNA, 350 bp, Glycine max
  Peptide Sequence Number=SeqID_225115
atgatgttgctaccaatgatcgtggaactgatagtgcagtctttttacactgtggtgggacaactcggtatcatgtcaatcatgtccatcgttgtggaaatcacttggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 108338 - DNA, 393 bp, Glycine max
  Peptide Sequence Number=SeqID_225116
atggctccaaagaaactctccacgaagaggtatagaagagacgccacaggagaaggatctagtgctgcctcagagtttgatagtcatcgtttccggagtgccgagcaccagcggcgcttcgaggccatcaagggatggtcattccacagggagaggcatgtccagcttagggaggatgagtatatggaattccaagacgagatagctcgcagacgttggacaccgctagtgactcccatggccaagttcgaccctgagatagtcctagaatgccctcaaccagttcctgggcgacccgctaattttggaggaaggccagtagtggaggcgggtgcggatcatgcgcaccagcatgactactttgacccaaacatggatgacactgctgcttag

SEQ ID NO: 108339 - DNA, 483 bp, Glycine max
  Peptide Sequence Number=SeqID_225117
atggcgcctactaggcaccctctggacccagataagtccaatagggccctggggtttccgacgctgatcacaggcctctaccaatcctacggggttcccgtcacccctagtaaggcacagggtgatgcacatcaggccgcaggcgcaccaccaccacctcggcaggccgatccagttgggtcgctgggcgtagagcattatttacagcatttggttcgccagcaggcggccaaccactgtggacaggtgcagatacatgagtgtctctaccagttcagcctcagtcagcaggggcagggttctaccccttttgtatgccctaccccggagcagtttggggctgaggtcgcatggcttggagactggcccgatgcccaggcaggagaggatcctgcagggtcccccagtgaggaggacgaattccatatggataagaatatgactgacctgctcggtttcttgggagggagtggagccacatga

SEQ ID NO: 108340 - DNA, 1035 bp, Glycine max
  Peptide Sequence Number=SeqID_225118
atgggaacgggtgcatcgaaggacgcagatgaagggagcaaggaagagcgtgagaggctcgaccatgcaggtggccaactctacgtgtctctcaagatggagaatcacaagctcacaggggaccttgttcctcacgtttatggctccgttcctctcgtgggttcttgggatccttccaaagctcttttcatggagcgggaatcgggtcaatgtgggaacttagctttgttgtcccacctaatcacggaaagtgtggctcttggaaatggctttgttgccttcaccatgaggagggtgtctggtattgagggtcctagccgcctgcttgtggggggagcattgcaagaggatgcaaggcttgcgttgtttaggcttgatagtggcgaggttcttcagtatcaagtgtttgttaaagcagacagggtttctccctttgaccttgcagctagttggagggcttatcaggataaattccgtccttcatctgtgagatggattccggatgtgagcataaattcagcacctcagaccggtggggagaacagtgttaatctggttctaacacttgagataaatggttgttctgtgggtttggaacttgatcttgagcattatgttgtcccaactcccgcaactgctgcaaattcagctcatgtatatgccgctaacatgacagagaatccaaggtcactaatttgtgggtctggcagcagttcatatcccatcaaggaaatgcaggttattgtgcctgatccatctaagatgtttcaaagttctggaatggttgaatccaagtcagttggaacattttcacctctgcaaaagcaagagagtcagaggggactttttgttgatagaggtgttggatctcctagacttgtaaaatcttctagttcatatattttctctactgatctcaatttggataacgaaaccaagaattcaatgccagctgctgctggagctgtcgctgctgcagctgttgctgatcagatgctgggtcccaaggaagatagacatttggcaattatcctg

SEQ ID NO: 108341 - DNA, 327 bp, Glycine max
  Peptide Sequence Number=SeqID_225119
atgcccttttgcgggcgagcgaggcgaggctcacgggtgcgctttcccaaggaggaaagatgcacggagtcaccaccaacgtttatttgtggaaaacgtcgggaaaaccgaaggaaaccggtcaaaatgaaaattataagttcgggacttgtatttacgtttgaggaaggggaggagcttgccacccagctcgcccaggcgagcaaggttgcttcctccaggcgagcaaggttgccaactttcgaagaagttacgaaaactcacggattgcgaaaaacacctcctttcgatttccgtcacattacagaattttcacggatcgcgtaa

SEQ ID NO: 108342 - DNA, 348 bp, Glycine max
  Peptide Sequence Number=SeqID_225120
atggttgaaaaaaataggcattggcacaaaatagcaagtaagcagtctgctgacttctttcgagctgacaatcctgaaggcgtggaggcacgcaatgagtttaattgtgagtctgtgacaattgaccgagtaaaatctatagcttgcacgctaggccataaggtagcagcactggcatttgaagatatgatctcttggatgcaagaaggtggccaggttgggatatttgatgccacaaacagtagcaaagaacgaagaaacatgctgatgaaattggctgaaggaagatgcaaggtagtcaaagatggcactgaaataaataatcttcctggaaacaatatgcaatga

SEQ ID NO: 108343 - DNA, 642 bp, Glycine max
  Peptide Sequence Number=SeqID_225121
atgtgggaccaagttgaggatgagtaccttgtacacccaaaaaccgacggccagaccgagtgctcctttctttccctcacggaatggtcctacaacattgttgtccacatcaccaccggtgcgtcatcatttcaagccacctatggcaaggcccctacttccatacctcagtatttggagtgttcttcccaggttgaggtcatggacgaattaatgacgacaagagcccaacttcattctgaccttctgtatcatctctctaaggcccaggttgccatgaaatggatcgccgattcacatcgtcatgatgttgtttacaatgttggtgactggttttcatccaaacatgggaccaacccccctgaactgcatcctctaccaccactacattcagagaaccatcatgtggtcgaaccactgtcgatcttggactggaaatgggacaatgacaacactccaccagttcaaaaagtcttggttcagtgggccgacctagcaccaaaagatacctcttgggaggaatggaatactcttcacacctcttacaaacttggggacaaggttgttctgcaacccaacccaggaaggagcaggcccaagagggtgcataaaacaccaacatatctccacaattatgcttga

SEQ ID NO: 108344 - DNA, 1251 bp, Glycine max
  Peptide Sequence Number=SeqID_225122
atggagagggtcatcggagggaagtttaagattggtcggaaaatcggaagcgcatcaaatatcgatacctctgagattgtcgccatcaagatgctgacaagaatagagtacatgcattccaagggatttttgcatagagacatcaaaccagataacttccttatgggtcttgggaggaaatcaaatcaggtttatattattgattttggactagcgaaaagatacagggaccctaacacaaataaacatattccttacagagagaataaaagcttaacaggaactgcacgttatgcaagttgcaacactcacatgggaattgagcaaagttgtcgtgatgatttggagtctcttggctatgttcttatgtactttttaagaggaagccttccttggcagggtttgaaagctgctaccaaaaaggaaaaatatgacaatatttgtgagaagaaattatcaactaccattgagccttacaagtttgagtacaatgaaggaatgctctctatagatcatgttcttatgcctatggtttacattcccttttcaggagtaaatgattcagctcatgttactgtaacaaaaatgttggccaatcttgaacgtccaagtgcacgtgcacgtgtgcagcctaagccatctaatgttcggaatctggatgccaagaatcatactgagaaacatggtgtgaacaatagtccatctacttcctctgccattcccaaatcctctacagaaaatgtctcaaaaccagaaaggcccacaggaacctcaaaccttggtcgtgtatttgggagtaatgctcagttggaaagagggaaagggagtgtgaacgattttgaagatcgagtgagcccgagcgcctctaactctatatgcttagttcatcagttggagaacatagaagagaatgctcctgcagattggcctgcatcatcctgtccccctcctgatactccaactgaatctatggagttccttgctagatcatggagtctttcagccatggaactctccaaagcactgcatagcaccaacaattcgatctccactggtatagagatgccactttcatgcccttcaggccaccaatttgataccaagtgttccaccgcttcaaaagatgtaagaacattggctgtgtttaatttaagagttatttatattaggccattagcacttcttttagctacttttttcttacttggcaatgcaacatgtaaaccgacaatcatgcaaaagctatgttag

SEQ ID NO: 108345 - DNA, 747 bp, Glycine max
  Peptide Sequence Number=SeqID_225123
atggcatcatccttaatgttaccagctgcttcaatgctgagaccatgtaccactttatcatcatcatgtgcttcatcaagaagacttgctctctttcaccttgtctccactggtggcattgctctcccacaagctcagttatttggtgcagaaaaaatagcccaaccagagaagaatttgtttgactgggtcaaaaatgacaacagaaggtttctccatgttgtgtaccgtgttggagacttggagaagactataaagaaaaaggagggaaggttaattacaagggaaccagggcctgttaaagatggcagtgcagtaattgcactcattgaagatcctgatggctataagtttgaacttttggagagaagacctacatctgaacccctatgccaagtgatgcttcgagctgctggaatgaaacttctccgcaagagggacaaccctgagcagaagtacacagtagcttttatgggctatggtcctgaatacatgaatagtgttctagaactgacatataactatggcgtcactaattatgacaaaggaaatggttatgcacagattgccataggcacaaatgatgtctataagactgcagaagcaatcaaattatgtggaaggaagattatccgtgaacctgggcccttgccaggtatcaacaccaagattgtagcttgcctggaccctgatggttggaaattggcatttgttgataatgttgattttctgaaggaattagagtga

SEQ ID NO: 108346 - DNA, 2481 bp, Glycine max
  Peptide Sequence Number=SeqID_225124
atgccagtttgtagacaactggactttgataatggtaatagaggaacaccactgagggtggatgaagacaaaggaatggtgtcggacaccgatcataagtctgatcaagtaatccaaaatccaatacacaggtttacaccattgtcactgtctggaagaaaacaattagttatgaggtctcctgattcatccaggcatgatggaaatataactcaacctttagtgcaatctgggttgtttgttccagaggtccatgttgcacatggtgcaactccatcttctgtacatataagcattttgaagatgaaaactctggaggctactcctgccatttcagttctcaaagaaggaatggacagattgaaagctagattatcaaaattctctcctggattttctctgtcaaataaaaaatattgtgaatacaagcatgatgaaacacgccaaactcctttaggggaaaaactgtttagtttaactccagatagtaacgtgtataaaggcttggttgatggcaatgaacatggaattcagtctaataaaaatatttgcaagtcaagtcaaaatgaagagactctggatgccaaaatagatgaggaaaacttaagtttgatttcagctcatgtttcttacaatgatgaaaatcctaaggttgtggaaatgggagcttctccctcacagatgactcatttaacgaaggtggtagatgtggacctggcagatcgcacagttgagaaagggaaagatgaaattcttgttccaagtcctcctatccaagaggtaacacctcagttgtgttccttgcaagacccacccagtatgcaagacttgtctcccaagggtaacttagatggtcatggtcttgataacagctaccattcagtactccaagtagctcagagccatcttaccaaatcaggtattagtatttcttctgggaagaaactgcaagactcacccaatatgcaaaatttgtctcccaagagtaacttagatggtcatgataacagctaccattcagtactccaagttgctcagagccctcttaccaaatcaggtattagtatttcttctgggaagaaactgcaagactcacccaatatgcaaaacttgtctaccaagagtaacttatatggtcatggtcttgataacagctaccattcagtactccaagtagctcagagccctcttaccaaatcaggtattagtatttcttctgggaagaaactgcaagactcacccaatgtgcaagacttgtctcccaagagtaacttagatggtcatggtcttcataacagctaccattcagcactccaagtagctcagagccctcttaccaaatcaggtattaatatttcttctgggaagaaaagaaaaggtgtcgagatacgaagcaatggagacaatatagataaaattgggaggattggcagaagtccagaggttcataaaagtgggaatggtgacctacagttactttcagagcaaataggttctatgagaagtgaaagagagaagcttggagatcagactttgaatgatggggatcttattcttaaaaaattcttagccagaacaaatcagttgctacctccttcagttgataagctaaatttgagatcgattagcaggttggaagatattttggttcatctgcataaagttaagaagaaagagagtctttgttcagaaattcaatctcagctcaaaataactgatcctctaaacattcttagagacaagagagttgctgaaacaagaacattgctgtatgatatagcatatgagaaggcaaaattacaattattgcatgtgaaacatgacaaattgcagcaatgctcagttggtgacatgaacttcccttgtaaacagaaaaaggtacaacaggtaagctctgggcttcaggagtgtgagacaataaaattaaattccatcccatcttcatctaaaagtggtgcaatggacactcaagctgatgatagtcgttggcagggaaaatgccgggtttcttcccaaaaagtattggaaaagaagcaggagcttgaaattttggaatcaaaagcaaaatcctggagtgaattcttacatagccattgcatgatggaaggatatcaaagctataccaacaccattaaagctgtttctggttatttgcagcagagaaaatcttgcaagtctatacgccagaatttgaagttgtgggaaattgaagattttgagcgcaaggatggttgttacaaagtttgtctcaactattgtggttatctaacccaaaggttcacagtaaatactggtcaatctagtataataatatcaaatagcttgaatgatgtgaatatcgggaagaccttccctaacttggatggcatttctgcatttgtgtttgtcttgcatcctcacaccacaaagaaatgcactggttcaagcattatggccagagaaacacagttcggtgggcttcaactctgtgtctgcaattaa

SEQ ID NO: 108347 - DNA, 2028 bp, Glycine max
  Peptide Sequence Number=SeqID_225125
atggtgcctcctgggccacccacgccgattggtggtgctcagtctgtgccgctgtcgcttttgagatcaaattcgggaatgttggcgggtcaaggggggggagctgtgccttcacaaacctcgttcccttcgctggtgggacagcgaaaccagtttaacaacatgaatatgctagggaacatgtctaatgtgacttccttgctgaatcagtctttcccgaatggaattccaaattcagggcttggtggccctgggagcagccagcgcagtggagggattgatgctggggcagaggcggatccgctatctggtgttggcaatggaatgaattttggcaatcagttgcaatcaaatttgatgaaccctggttcatctggtcaaggtcagggtccacaattttcaaatgcttctggtagccagatgttgcaagatcagcagcattcgcagcaacttcctcagaatttccaacaacatagtcagccgtcaatgcaacagttctctggtcctctgaacgctcaacagcaacagcagcagcagcagcattttcagtccattcgaggtgggatgggtggtgttgggcaggtgaagttggagccacaggtaaacatcgatcagtttgggcagcagcagcagttgccgtcgaggaatcttgctcaggtgaagttggaaccgcagcaacttcaaacattgagaaatatggcaccggtgaaaatggagccccagcataatgatcagcaatttttgcaccagcaacaacaacagcagcagcagcagcaacaacaacaacaacagcaacaactgctccacatgtcaaggcaatcctctcaggctgctgctgctcagatgaatcatcttttgcagcagcagagacttttgcaatatcaacaacatcagcagcagcagcagcaactcttgaaggcaatgcctcaacaacggtcccagctaccacagcagtttcaacagcaaaatatgcctatgaggtctcctgtgaaaccagcatatgaacccgggatgtgtgccaggcggttgacacattacatgtatcagcaacaacatagacctgatgataacaatatcgaattctggaggaaatttgtttctgagtattttgctccaaatgccaaaaagaagtggtgtgtttccatgtatggaaatggcagacaaactactggagttttccctcaggatgtatggcactgtgaaatatgtaatcgcaaacctgggcgtgggtttgaagcaactgctgaggttcttcccaggcttttcaaaataaaatatgaaagtggtactttggaagagctactttatgttgacatgcctcgggaatatcataattcctctggccagattgttctagattatgcaaaagcaatacaagaaagcgtttttgagcaacttcgtgttgttcgtgatggtcaacttcgaatagttttctctccagacctaaagatatgctcttgggaattttgtgctcggcgccatgaagagctcatccccagaagattgttaatacctcaggttagtcaacttggagcagttgctcaaaaataccaggcaataactcaaaatgcaacacccaatttatccgttccagagttacagaataattgcaatatggttgttgcatcagcccgtcagttggcaaaagctttagaagttccattggtcaatgatttaggatatacaaagagatacgtgcggtgccttcagatatcggaagtggtaaatagtatgaaagacttgatagattatagcagagaaacagggactggacccatggatttctataatttccaaacaatgcaaaatgatcctcattgtcagatgtcattatgtccctatgataactatgttgacgtccaaattaaacatgccgagtatcaaatgctgcaaacaagaggtggtggtgaccccagcattgcaggtgtttgcccaagactagtcaaaaaggctagtgcacagccaacctgtttgagcaccagggctgcaaagtgtggtgggtggttaggatccagttgcacagtatga

SEQ ID NO: 108348 - DNA, 131 bp, Glycine max
  Peptide Sequence Number=SeqID_225126
ggggtcattcgagggtaacaaaggatcatcatattctaaacatcatcagcgacaccatgcactcctatattgaagagttactaaaccaatgcagccagaacaaccattatcatcaatttgcagcagcatga

SEQ ID NO: 108349 - DNA, 273 bp, Glycine max
  Peptide Sequence Number=SeqID_225127
atgaaactcaattgggacaacatcattgttgacactatgctgaagaccaagaggattggttccttcaagtgtccttatgcaatgttgatttccaagatacttgactactttggtgtggatacccaagatggggtatttgactttgtggaagttgattttgagatcaagacaaagattgagaaaccaaggaaagatcaagtagaacaactagaagaagctaaagagaagcctatgagtccctttaagacagatgatgtaagcaaagatggatga

SEQ ID NO: 108350 - DNA, 306 bp, Glycine max
  Peptide Sequence Number=SeqID_225128
atgcttacggatcacctgatccataaacaactccaagcttccctacttcgacatcaatggcggaaaatgattgaaatgcttaccttgacggccgacgctgacgatgctcgacggtggacgctggttcgtggttcgtggttcctcttgacggcaacacggcttccttcacggtggttcgtggccgaggaagaagacgaagatggtagcgcgaggaagaagaatggctgcaaggagaatgcgaggaagaagaatggctttgtggggggaaagaagaagaatgcaaggaagcagaggctgcaaggatga

SEQ ID NO: 108351 - DNA, 1098 bp, Glycine max
  Peptide Sequence Number=SeqID_225129
atggcctgggagggattttggcctccttattttttctcccctcctttccattttcctctaaccaaacaccgtaaaaagttggaaagaataaatagcttagctaaattccctcggagaacaagtggttcatctggacttcatagtcagggacaacagtctgaagatcaattacagcagcagtcacagccacaactgccaccccagcatatggtgcctcattcttcaaacggtgatcaaaactctgtgcaaactgctgctatgcaaattgcttctagcaatggtgtgacaagtgtaaataattccgtcaatgcagcatctgcatcaacctccacaagcaccattgttggacttcttcaccagaattccatgaattctagacaaaattccatgaattctagacaaaattccatgaacaatgcaagcagcccttatggaggtagttctgttcaaattgcatccccgggttcctctggtaacatgccacaagcacagccaaatgcatctccttttcaatcaccaacaccatcctcatctaacatcccacaaacatctcaccctgccttaacttcagcaaaccacatgggtacagcaaactcaccagctaatatttccttgcaacaacaacaacaaacatctcttcctgctgaagctgaccctagcgatgcccagagctcggtccagaaaatcattcatgagatgatgatgtcctcccagatgaatggccctggtggaatggctggtgctggttcgcttggaaatgacatgaagaatgtaaacgggattctaccagggagtaacaatacagggctcaacagtggcagtgtcagtggcctggtgggtaatgtggctgtgaacagtaattcaggtgttggggttggtggttatggcacaattggtcttggtccagctggtatgactaatggaatgagacctgtaatgggacataattcaatcatgaatggaaggggaggaatggcatctcttgcgcgtgatcaagttatgaatcatcagcaggatctgtcaagccaactacttagtgggctaggaggagtaaatggcttcagtaatcttcaatttgattggaaaccgtctccatga

SEQ ID NO: 108352 - DNA, 554 bp, Glycine max
  Peptide Sequence Number=SeqID_225130
agattatgatatatccaggatatgttcctgaaccaggcatcaaatatagagttttccactatggattggaattccatgttgggaattggagttttgacaaggcagagtggcgagagatcgacatggtcaacagatgctgggtcaagtttccagaaccaccagactcctcaacacttgatcacaatgacgaggataattttcagcgaaaccttctcagtatagaatgcatgaagacactaaatgaagcattgcatctgcatcatgaaaaaaggaactgccccaaagatggttccgtactcgaatccaaagaggacgcgacagaggaaagcataacttcctggaaaatcagtaatttcagtgaaaattttgactcaaaggtaaatcataagtcagcaaatgattctgaggagatggctagtgttcttaaagatgggacagggatacctagttccttcatggttctatttttatgtgcattttctgtatctggggagggacatgacttcgcaaccgtggctgaaagtgcctctttaaacattcttctcttattctga

SEQ ID NO: 108353 - DNA, 1275 bp, Glycine max
  Peptide Sequence Number=SeqID_225131
atgtatgtagcagagaaattaaacaagggagactcatcagcttgtctcatgcaacaacaaccattctgttatgcctctggctttcccaaagaagccaacaagagcaacccaaataatgcacttggacaatcagtctcatttgggaggttcatgccagagtccctggcatgggagaaatggtctactttctctcacaaccgctatgttgaagaggcagagaggtttacacggcccggttcggttgcacagaagaaagctttctttgaagctcactacaagaaacttgctgctcaaaaggcagctgctttgcttgaacaagcaaacagtgcctcacagacacagcaagaacaagaagaggccatagttgataacacgcataatttgaacatgactagtccaaaatctaagctagttctccttgaagaaaatgcacaggtttttaactctgagccagatgccactacctataattcaaattcaaatacagatgctgctttacctcaaagtgacatgttaggaggagctcaaccactgatagatcaccaagcttttgtggttaagttgcaaaatcagcttggaaaagttgataactacaaggagccaagtgaagagggtacaaactttgatcagaatattttgcaatcaacgggcaagaagaaacaagctgtttcttcattcaagttgttaaaagttattggtacccccaagttcaactctacaccagtgaaatcaaaatctcctagtcattctagtaaagatggtattgctaccccaatgagcaataatcctgcactaacctcttctaaaaaagaaggatcaacttctaagttacctcacatgtcacttaatttcacactagttagagaaatcaataaattgaccgtatcattggtgaggaaatttggaagtactggagttggcgctagttcttccaaggcttcaaaggatagctcgactcttataaagaccacaactaaggcttctaagaatgagtctcaaaagcattcttcattaactccgttaacagaagcgcaaagaagtaaaaggaaaacccccattatatcctccccatttaggttgagcaccgaagaaagagcttcaattagaaagaagaaacttgagaaagtgtgcaatgctagtgaatcacagaaagtgcagccacatacaaaattcaaggagaaagcagacacaaagattagaaaactacgtcagagcatttgtttcatagcagggtcatcacctgatttttaccaggatagagaagcatcaaaaaag

SEQ ID NO: 108354 - DNA, 1245 bp, Glycine max
  Peptide Sequence Number=SeqID_225132
atgcatatagatgacctgcgagccttggcacctatgtggctttcaaaaacagaagaagtacgacaagatagggctcactggggagtgaacataactggtgacatatatgaaaaaggatggattagtgagatgtatggatactcttttggtgcagcagaagttggtctccggcacaagatcaatgataacttgatgatttacccaggttatgctccccgggagggagttgagccaattcttcttcattatgggctgccatttagggtagggaattggtcatttagtaaggctgaccatgatgaggatgccatcgtttataactgtggccagctctttcctcaacctccttatcccagggaggtaatgcagttagaaacagaccccaatctacggcgaggactatttttaagtatagagtgcataaacattttaaatgaagctcttctgttacatcatgtggctaacggctgccctaaaccaccatggtctaaatatgtgaactttttaaaaagcaaagcctttgctgaactaactaaaccaaaattagtaactcctgcttctctagaaatgatggaggatacagtacaagaacatattgatcatgatactaccaggccatatcctaaaatccatactgttttttccactgaatgcaccccatactttgattggcagactgtagggcttatgcatagtttccatttaagtggacagccaggaaatatcactagacttctcagctgttctgatgaggacttaaagctatataaaggccataacttggctcccacccattatgtcccttctatgagtcaacatccattaacaggcgactggtatccagcaattaacaaaccagctgcagtcctccactggctcaatcatgcaaatattgatgctgaattcatagtgattctagatgctgatatgataatgagaggcccaattaccccatgggaatttaaagctgcgcgaggcaaacctgtttcaactccttatgactaccttattggctgtgacaatgagcttgcaaaattgcatattagccatcctgaggcttgcgacaaggttggtggtgtaatcatcatgcatatagatgatttgcggaaatttgctttactctggctgcataaaaccgaggaagttcgggctgatagagctcattatgccagaaatataacaggagatatatatgaatctggttggattagtgagatgtatggttactcatttggcgcagcagag

SEQ ID NO: 108355 - DNA, 831 bp, Glycine max
  Peptide Sequence Number=SeqID_225133
atgggaagacaaccttgttgtgataaggttggtttgaagagaggtccatggactattgaggaggatcacaagctcatgaactttattctcaacaatggtatccattgctggagatcggttcccaaactagcaggtcttctaagatgtggaaagagttgtagacttagatggattaattatctgagaccagaccttaagagaggtggcttcacagaaatggaagaggatcaaattatagaactacattcaggtcttggtaacagatggtctaagattgcttcacatttccctgggagaacagacaatgaaatcaagaaccattggaacacaagaatcaagaaaaggctgaaactccttggtctggaccctgtgacccacaagccaattgagcaaaaggaaaatactgatgagaacacaaataagaccaatccacacccttctatttttggagggtctgaagaaaatgtggagattaaatccttggaaaatggtggcaccaaagaaatggcaaaaacagaagggaaaagagaagaaaacaataaggtgattaattgggatgatacctctgaacttttaaacaattttgaaatgctatgctcaaagttggacttgggatcatggatgatgagtcaagaaaccaatactagtactaattccttatgtagttcttctgtctctatggatgacactagtcacctctctatggacgaatcctcttatcttcaggaaaactccttacagcaatgggttgatagtatggattccattctctcatgggatggcttcaatcctcttgatcaagacattttgttcttggaaaatagggaataa

SEQ ID NO: 108356 - DNA, 467 bp, Glycine max
  Peptide Sequence Number=SeqID_225134
atggagaagttttcgattttgttgctgttggtgatgttggatcagttcattttcactgtggaagcggctcagaaggctccatggaggattcaggtgcttttctctgtggaatgtcagaactactttgactggcaaacggttggactcatgcacagttttagaaaggcaaagcaaccggggcacataacgcgtcttctcagttgcactgaggagcagaagaaaacttacagagggatgcatttggctcccacttttgaggtgccctcaatgagcaaacaccccacaactggtgactggtaccctgcaataaacaaacctgctggggttttacattggctcaaacacagtaaagatgcagaaaatattgactgggttatcatcctggatgcagacatgataatccgtgggcgaattgtaccttggaaacttggtgctgagaaaggaagacctgttgcagcatattatgg

SEQ ID NO: 108357 - DNA, 1473 bp, Glycine max
  Peptide Sequence Number=SeqID_225135
atggtggcccaagcctcttctattgggatgatcaatccttgcatggtagaaactctcaccattcctatttccaaggtggataatcctgggaatttgaaggacttttgtcccataagcctttgtaatgtgttgttgaaggctatctcaaaggttcttgaaagcttcaatccccatagaggtcttcagcaaggtgatatattatctccttatttgtttgtgctttgtatggaaaagctctccattctcattcaacatgttgtggaaaataattcctggaaaccggttaaaattgcaaagaatgggccagggatatcccacctctttttgtcgaagattgccttctctttacataaacaaagagttcccagggttaataactctagcttttccttcctcatggatcgggttaaaggatgtctttctgattggaaggaaagattgcttaatagagttgaacgagtcactctagctaagtctattttaagctccatcctgatttactcaatgcaaaatatgtggctcccacaggggatttgtgatgaacttgataaaattactcgccgcttcatttggggttcctctgatcacaatcattggatgaaatggaaaactttaactcaacggagacacaacagaggtttaggcattcggaccacatgggaggccaacgtagcgatattgggcaaacacatatggactatgttgcatgatcctaatcatggtcctccaaaggcgttatatatctatggtttgatggacgatgtaagtaaccaagattttagcttgtttgtctctgatctttggattctttggattgaaggtgactggtgtttcgattatcttcacactacagtccccttatggcttcaatatgaaattcaaagtgttttcttgaatgatcaggtccctgatatggttgtttggggggattctccaaacagtacttattatgccaaatccgcctatggtcgacacacaaaagctcgcataaccactagttacactatgggaagaggatcttgggtgtgtggtagcggcaaagaatccattctcccttgttttagggactgcctgaaagcaaaaagagtttgggatatgttacgctttgatgcttatcagaacaacacttccaatgttatttcagcctggttgcggcatcacgtacgctacggaaagtcaaggaaaactatttgcggtggcttgttggcggatttggaaattaagctgggaatgaggaaatttttcaagacactgtcataccaaattttggtattgtatctcgcatcaacaacttgcatcacactatcttgcagatctttgattctaaccagaaaatgcctcacgagactcaacttcgttaacatgctccaatggcaactggatagttggttacacgggtattgtggagttactacagtcactaatgcagaacttcaagctatctacaatggtcttagcacttgcgtggcttga

SEQ ID NO: 108358 - DNA, 445 bp, Glycine max
  Peptide Sequence Number=SeqID_225136
atggggagcctacctaagactaacaatgggagcctacctaatttgaccttgaagccacaatcatggacaaaggtaagtagcattatatttggggatctgcctgcgggtactggcttctcttatcccaaaacagaacgtgctgttcagcaaagtagctctaagcttgttcgccatgctcatcaatttattaggaagcattctcctcaatacaaagtcctgatgttgggccgcattttgggaggtattgccacttcacttctgttttcatcatttgaatcatggcttgttgctgagcacttcaaggctatatttcttggaaatggtcttgttgctattttgtctgggctgtttggaaatgtacttgttgatacattggctcttggacttgtggccccctttgatgctgcttcatgttttcttgctattggtgtggccattgctttgg

SEQ ID NO: 108359 - DNA, 675 bp, Glycine max
  Peptide Sequence Number=SeqID_225137
atgcagaggcttccccatcctaagttcaaccctctcaagacccagcctcgaccactgcgacagaatcaacacccccaccgagttaggactcaccctcaacttggacaccaactcaaccaccctccacacgtgcacattgtccaccctctccttcgcacgcttcaccagacccgacccgtacctgacccctctctcccccaactcccacgcgcttgtttgtgcgcattcccacaatacccctctggtagtcctggattcacgcgcttccgcatgttcacgctaaacaaaagcttcagcgtctggtttttaggaagaaaccccatcaccctcgcccaactcctccacatgtgggccaccagaacctcgaacgacgtgtgtgacgacattctgcacacgccctttagagcgttgatccgcctctcgttaaacacaatgcaagttggtctcagcttgctcgtgacacaatgcaagtttcctactagggtttttaacggttccactggaggaaaggagaatgggagcggtggaggaatgtggagatggggtggtggtggcatcggggagaaggtggagagaggaaaaagggaagaggagagaagaagaaagatgagtgaccgagagaagaggaacagacgcgaagcttgtaaaagaggaacggacgcgaggtatatttga

SEQ ID NO: 108360 - DNA, 333 bp, Glycine max
  Peptide Sequence Number=SeqID_225138
atgtctttgggtgcaagaaattcaaggatatttgcccttgaaaaaatcattgctacttcttctacaacattgctgtcaatggcatctcatttaccaaaggcagaagagccggaacgggttttcagtggcaagggacgttggaaccaagtgcattccgttcttgaagccaagaatttgatgaatcatttgttcaatctggcatcttcctccagcaaagggcaaaccaacacaggggaattaggatcagacaaggagcagacaagaaacaaaaggagaacatgcaagccacactacctggaggactacgtgaccagtgccaacaacaaacactga

SEQ ID NO: 108361 - DNA, 216 bp, Glycine max
  Peptide Sequence Number=SeqID_225139
aatggcagtgttgagaagactctgaaggatgatggacaagcaatggcatttgattggtataagagggtgaatgttgttaaagatgtagcaaatgctttgtgctatatgcaccatgaatgctcacctcgaattgttcatcgtgatatatcaagcaagaatgttcttttggattccgaatatgtagctcatgtctcagactttggaccacattcgtag

SEQ ID NO: 108362 - DNA, 258 bp, Glycine max
  Peptide Sequence Number=SeqID_225140
atgttatctgaaattacaggatctggtcccattaggcacatcatcaggcttacttccctcagttatctgaggctgcaaaatgttctatgtactgtagaaactagtgaggaagagaaaggattaattgctgagattgctgacaaaattgaaacttatatcaaagaaaaaggacctcctctagcattgttgtctaaatttagagaaggcagtgctttcttaaaagatgatgcatccgttgatgcattgaatgacctataa

SEQ ID NO: 108363 - DNA, 984 bp, Glycine max
  Peptide Sequence Number=SeqID_225141
atgggttcctcggaagccgaaaacgaggctctccgtggcgccgaagaagaagagggttctacttctaacaagaaatgcggcaagttctacgatgtttatggacccgaaggcaaggcagacattgtttttaactcaccagaagataattcaactctcaatcttagtgatgttcaaggacttgtaacttgggtgctcagtgaaggatttatgccgtcatgggtttttattaagcaaggcaaacagccactggagcgacaaaccgagtctctgatggctggttgttgccaaaatcttgttgatagagagatatgcaactcagatgtgctatcactcactgttcaggtgcacccagacacagtgaattggcgatcaacacctggcagcacctggtcccaccagcagtggcaagcctctggtggttgggcaaataaacctcttattcccaaagtggttatgctctatgtgccaggcctggatgcagctttgttcttgtcacagtctaaaatgcttccaagattaaaaaaattctgtggcaaaccaagggcactcctagctcttagctgtgtgtcagatggtatgcagacgatagatgcactcctaacatgcaagatgaaaaggaaaagggacgagaatagttcaattatggggaaatttgctcggacatctcaacaagtcaaagtacaagagtacaactatggccgcaagcctggaagtcctcatattgttgatatcagtccctacagtctatcatttaaggagcttacaaaagacatacctttccctgttacatactatacactaacagagaaagagttggaagagaatggatattctgttaataagccaggttttctttctactttgcccgctccttcaggatctcctttttatgagatgttggcacttgattgtgagatgtccaaggaagcaagtttctctgtttgtggaaatatgttcatattttgttactccctatacttatag

SEQ ID NO: 108364 - DNA, 180 bp, Glycine max
  Peptide Sequence Number=SeqID_225142
atggggcaaagtgtcaaattctatccttggattgtattagatttagaagccatgcctacaccatcaaagcttcaattggaagcaaatgctatattaaagaatggatggtggaatagatcgcaatcagatacccgcaatatttgtgggatggtgtatcttgcaatgatattggaagcataa

SEQ ID NO: 108365 - DNA, 138 bp, Glycine max
  Peptide Sequence Number=SeqID_225143
atggtgttggtagcaatattcacattgaaggttgaagttaagtgggtagagtacgggaaaagacacaattgcccctacaatgttgctgatatatgtgaaccaaaggtgtacattattcgcagttatcgccgtccataa

SEQ ID NO: 108366 - DNA, 324 bp, Glycine max
  Peptide Sequence Number=SeqID_225144
atggaagaaggattctccaccaacaaaccacctatgtttagaggcgtaaaaggccaatggacaaaggaacaaacacttagatttctgctaaactccaaggctcagaatgtgatgttatgtgctctttcagaagaagaatacaccaaggtaacaacactgagagcattaaagaatcttgactctatgtcccttaacgaacttattggtaccctcaaggttcatgaacaagaacttcagcaagatgaaggacccaaaaaagaaaagtcgctggctctcagagttagaagagcaagaaggcatcatcgtctagagaataagtcttaa

SEQ ID NO: 108367 - DNA, 231 bp, Glycine max
  Peptide Sequence Number=SeqID_225145
atgatgagtatgaagaggatgagggaggatggaggaataagaggtataaggagagaagaaatcatagatgatatggaggtgaaggtcgagcaagtctttgtatgctacaactacaatgaaaggaagaagatcaaattggcctccctggagtttgagagatatgccttagtgttgtggaatcaactgaggagtgatgttgaggggatgaaaaggcctttgattaatacttga

SEQ ID NO: 108368 - DNA, 183 bp, Glycine max
  Peptide Sequence Number=SeqID_225146
atgggtgagtttggggaactcatgctcactacaattatttttcaatatttctgctacaagggtttggtttgggaaactcgtggtcactgcaaggtctgtttggggtgctcactttgcacttcaattagacagctcacatggtctcacggcaaggcagaaacacttggaattatcaagtactga

SEQ ID NO: 108369 - DNA, 156 bp, Glycine max
  Peptide Sequence Number=SeqID_225147
atggggaccattgtgagatggcatggtgggagttactgggttaattatgggaagtgtaaggccccatgcatcaacataaacaagctcaagaagtttggtggtgacaacactggatatagtgaagggcaatttgtgactcttggagctgctacatga

SEQ ID NO: 108370 - DNA, 519 bp, Glycine max
  Peptide Sequence Number=SeqID_225148
atggctttttcaagtcaaaaggaacccagatggttcagtagcccattacaaggcaagcctgatgatcaacatcatccatgcaatagtccttggcaacaactgacgcatcaacttgatgtcaacaatgtgttccgtgaaggatcactcaatgaagaagtatacatggcccaacctcctggcctcaaagactctcaacatccggatcatgtttgcaaatttcataaagcaatctatggtctaagacaagcaccaagagcctggtacaatgctttaaaattgttcatcgtgtcatgtgggttcaccgcgagcaaaagtgacccatctctcttcgtatacaccaacaactatgtgatagcctacttcttggtctatgtggatgatcttctactcacaggggttgaattagttccctctacctctggcattctactctcccaacacaaattcgtaagagacttccttgaacattttgaaatggcaaaatccgaaccatctcccactcccttatttgtaacataa

SEQ ID NO: 108371 - DNA, 2184 bp, Glycine max
  Peptide Sequence Number=SeqID_225149
atgagttacaactccctgtctggaagtattcctcctcaaattgatgccttgtccaatctcaacactcttgatttgtccactaataaactctttggtagcattcccaataccattggtaatttgtccaaactacaatatcttaatcttagtgccaatggtctctctggtcctattcctaatgaagtgggaaatctcaagtcacttctcacattcgatatatttaccaacaacctctctggaccaattccaccttccttgggtaacttaccccatttgcaatccattcacatttttgaaaatcaactctctggatccattccttccactctaggaaatttgtccaagctcactatgttatctttatcatcaaataaactcaccgggaccattcctccctctattgggaatttaacaaatgccaaagtgatatgttttattggaaatgatcttagtggtgagattccaatagaattggagaagcttactggcttggaatgtttgcagctagctgataacaattttataggccaaatacctcagaatgtttgtcttggtggaaacttgaaattcttcactgctggtaataacaatttcactggccaaattccagagagtttgaggaagtgctacagccttaaaagactcaggcttcagcaaaatcttctatctggggatataacagatttttttgatgtacttccaaacttgaactacatcgatttgagtgataatagttttcatggtcaagtttcacctaagtggggaaagttccatagcctcacaagcctcatgatctccaacaataatttgtcaggtgttatcccaccagaactaggtggagcgttcaacttacgcgtacttcacctatcctcaaaccatcttacaggatccattcctcaagaactacgtagcatgaccttcttgtttgatctcttgatcagcaacaatagtctttcaggaaatgttcccatagaaatatcatcattgcaggaacttaagtttttggagattgggtcaaatgatttgactggctcaatcccaggacaacttggagatttgctcaatttattgtccatggatctgagccagaacaaatttgagggaaatattccttcagagattggcagtttgaaatatcttacaagtcttgatctgagtggaaattcgttgagtggaacaataccaccaacgcttggaggaatacaaggcttagaaagattgaatctctcacacaatagtctttcaggtggtctctctagcttggaacgtatgataagtttgacatcttttgatgtatcatacaaccagtttgagggtccacttcctaacattctagccatccaaaatactacaattgatacattgagaaataataaaggcttgtgtggcaatgtcagtggcttgaagccttgcacattattaagtgggaagaaatctcacaatcatatgactaagaaagtcttgatatcagttttaccccttagtttggccattctgatgcttgcattatttgttttcggagtctggtatcatttacgccaaaattcaaagaaaaaacaagaccaggctacagttttacaatctccaagcttattaccaatgtggaattttggtggcaaaatgatgtttgagaatattattgaagccacagaatattttgacgacaaatatctcattggggttggagggcaaggacgtgtttacaaagccttattgcctactggtgaagtcgttgctgtgaagaaactccactcagttccaaatggagaaatgctcaatcagaaagctttcacgagtgagatccaagctttgacagaaatccgacaccgtaacattgtaaagttacatgggttttgttcacattcacaatactcatttttggtgtgtgaattcctggagaagggcgatgtcaagaagattttgaaagatgatgaacaagcaattgcgtttgattggaataaaagggtggatgttgttgaaggtgtagcaaatgctttatgctatatgcaccatgattgctcacctccgatcattcatcgcgatatatcaagcaagaatattcttttggattccgattatgtagctcatgtgtcggactttggaacagctaagtttcttaatccaaattcatccaattggacctcatttgctggaacctttggttacgctgcaccaggtaattag

SEQ ID NO: 108372 - DNA, 407 bp, Glycine max
  Peptide Sequence Number=SeqID_225150
atggaagcaaacgatatatgtgatgtgtatagttttgggatcttggcactggaaatattgtttggagagcaccctggtggtgatgttacatcttcttgtgctgcgacctcaacacttgatcatatggcattgatggataggttggaccaacgtcttcctcatccaacaagccctactgttgttgagctgatatcaattgtgaagatagcagtttcctgtttgaccgaaagtccacgatttcgccctaccatggagcatgttgccaaggagcttgctatgtcgtccaggtctttcgtgattatgctgatactgggggaagcagtagatatagatgctgcacctgacgttattatcactccgcatatgagcggaaaaggtcaaaaacagcggtggcaaattgctctcgg

SEQ ID NO: 108373 - DNA, 144 bp, Glycine max
  Peptide Sequence Number=SeqID_225151
atgtccaatacacgtaatggctgtgtttcagttaacttaaaaatatttttgtgtggtgatgacgatgataatgacattaaccacaatggtggtggtggtggtagtggtactgacagtgatggattcaagatcctaagtcagtga

SEQ ID NO: 108374 - DNA, 2046 bp, Glycine max
  Peptide Sequence Number=SeqID_225152
ctagctgataacaattttataggccaaatacctcagaatgtttgtcttggtggaaacttgaaattcttcactgctggtaataacaatttcactggccaaattccagagagtttgaggaagtgctacagccttaaaagactcaggcttcagcaaaatcttctatctggggatataacagatttttttgatgtacttccaaacttgaactacatcgatttgagtgataatagttttcatggtcaagtttcacctaagtggggaaagttccatagcctcacaagcctcatgatctccaacaataatttgtcaggtgttatcccaccagaactaggtggagcgttcaacttacgcgtacttcacctatcctcaaaccatcttacaggaaccattcctctcgaattatgtaacttgacctacttgtttgatctcttaatcagcaacaacagtctttcaggaaatattcccatcaaaatatcttccctgcaggaacttaaatacttggagcttgggtcgaatgatttcactggcttaatcccaggacaacttggagatttgctcaatttattgtccatggatctgagccagaatagattagagggaaatattcctttagagattggcagtttggattatcttacaagtcttgatctgagtggaaatttgttgagtggaacaataccaccaacgcttggaggaatacaacacttagaaagattgaatctctcacacaatagtctttcaggtggtctctctagcttggaaggtatgataagtttgacatcttttgatgtatcatacaaccagtttgagggtccacttcctaacattctagccttccaaaatactacaattgatacattgagaaataataaaggcttgtgtggcaatgtcagtggcttgacgccttgcacattattaagtgggaagaaatctcacaatcatgtgactaagaaagtcttgatatcagttttaccccttagtttggccattctgatgcttgcattatttgttttcggagtctggtatcatttacgccaaaattcaaagaaaaaacaagaccaggctacagatttactatctcccaggagtccaagcttattgttgccaatgtggagttttggtggtaaaatgatgtttgagaatattattgaagccacagaatattttgacgacaaatatctcattggggttggagggcaaggacgtgtttacaaagccttgttgcctactggtgaactcgttgctgtgaagaaactccactcagttccagatggagaaatgctcaatcagaaagctttcacaagtgagatccaagctttgacagaaatccgacatcgtaacattgtaaagttacatgggttttgttcacattcacaatactcatttttggtgtgtgaattcctggagaagggcgatgtcaagaagattttaaaggatgatgaacaagcaattgcattagattggaataaaagggtggatattgttaaaggtgtagcaaatgctttatgctatatgcaccatgattgctcacctccaatcgttcatcgtgatatttcaagcaagaacgttcttttggattccgatgatgtagctcatgtcgcagacttcggaacagctaagtttcttaatccagattcatccaattggacctcatttgcaggaacctatggatatgctgctcctgaacttgcatacacaatggaagcaaatgagaaatgtgatgtgtatagttttggggtctttgcgttggaaatattgtttggagagcaccctggtgatgttacatcttctctattgctatcatcttcgtccactatgacctcaacacttgatcatatgtcattgatggttaaattggacgaacgtcttccacacccaacaagccctattgataaggaggtgatatcaattgtgaagatagcaattgcttgcttgactgaaagcccacgatctcgccctaccatggaacaggttgccaaggagcttgcaatgtcatcgaggtcatcttcaatgtcaccacagacacacacagagatgaaagactga

SEQ ID NO: 108375 - DNA, 285 bp, Glycine max
  Peptide Sequence Number=SeqID_225153
atgtcgccacacgggggcgacatggatgggggtgaaaaaaggaaagagagggatggggtttctcttgcttttggcatagcgggccccggcgggaggcccgcacgacgggctattagctcagtggtagagcgcgcccctgataattgcgtcgttgtgcctggacttatatggacagttatctctcgagcacagtttaggtttggcatcaatggaaaaaacggagcacctaacaacgtatcttcacagaccaagaactacgagatcgcccctttcattctggggtga

SEQ ID NO: 108376 - DNA, 252 bp, Glycine max
  Peptide Sequence Number=SeqID_225154
atggaccgcacacaagggatccctaggcatggcctatcattccgagtcaagattcttgagattttgtcgcaaaaaattgcaccaaagccaaaggaggatattttgtttgggggtagaagtaggattggggatggggtccccatgcgaatggaaccagacaggatcagagctttttttcttatcactttattttggcataccttgaccaccctacaaccaaagctaaatgccaatagcaacagtaatagataa

SEQ ID NO: 108377 - DNA, 402 bp, Glycine max
  Peptide Sequence Number=SeqID_225155
atgtcggctgaggttgtcaagaattcttgggaaaaaagagcaaaggaatcagtcgtgattagtaaaggggagggctctgattttgtggcaaaagttgtggatttagcagccagagaattaataacaagtgcatcactaggacaaggtttgaccgtgccaaggcttcctgcaatggtagttacacaggtacagcttgaccgtgccaaggatatcagaagagagcttggaatggaaataattgaggaacatacggtgatggaatattctaaggtcagcaagaaatgtgaaaaatgtggccatggggaagctacctattatactagacagatgagatcagcggacaaagggcaaactactttatgcacatgtaccggctatggtcatccgtctcaggagaattag

SEQ ID NO: 108378 - DNA, 279 bp, Glycine max
  Peptide Sequence Number=SeqID_225156
atgagccttttgacacgggagaaagagaaatggaaaaataaaaagaaaactaaaaagacttgggatgaagattggaaaaggagacacctgcaacaatacgtggagcaaccaagggagtggaaaatgaaaaggttagaaaagaggacatatggaacaatacgtggagcaaccaagggagtgagaaatgaaaagcctaaaagaccaaaaaaccaaggaaatggaccaaaaaacacatggcagcaaggtgacagaaaaccaacccaacctagaagggcataa

SEQ ID NO: 108379 - DNA, 354 bp, Glycine max
  Peptide Sequence Number=SeqID_225157
ggcaaggatggacattctcaccctcggtcaaggtttatggtgaattgggattttggctcaaggcttgtagaatggctggacatgatttatgtcaggacgttggtttggccagcggttcaaggatacaggaatgatggtgatttgttgatcacaggcccagtacctgctcgtacctgttccggtggttgggtgcctgctggttggccatgtatcgtaggcaatgctctagcccttgtaaatgagctgaggaggattctggaggtggtggcagtgcgtctatcgccagctactggccgtccccagactgttgtggtgtctcgccctgcgcctgcctgggggtgcagtacttcatga

SEQ ID NO: 108380 - DNA, 498 bp, Glycine max
  Peptide Sequence Number=SeqID_225158
atgagaaatccgaacacaaagggacctcttgaagttgaagaggacatacaattggttgaggatggggttcaaggcataggtagccatattggaatgttgcatatcctacaaatatgcatgtctgagattttggttggagtttgttggatgcgtaggggcacaaccatgggaaacataggaaaccaaaggaatgaagagtctattgatgaggtaagtggtagtgcagaaggcaaaagtctagaattggggagaaaagccatcaaaagacctagtgggagtaagaccccaaacgtcggtgtagataagctcaagaggttgcttgcttttgatagtggatgtagaaaaaggtggttggttgtgataagtgctttgggtttagatgatgggtggggcatgtggtacaagccattgttaagttgtcattttagaagcggaacccttgtcttcagatccttcaccaagaaatggtcagaaaaaattcaatcgagattgggttag

SEQ ID NO: 108381 - DNA, 648 bp, Glycine max
  Peptide Sequence Number=SeqID_225159
atggagagtttagttcaatactctccttgtggggatcaattgatccttcatgccattatctcctcggttgactacattgttatcatcatgctgggaaacgtcaaaacctcgaaggaagcctgggacatcctccacaagatgttctccgacaagacaagagctcaaatcatgcatctatcttgcttcataaagggctccaaacccatttatgaataccttaatggtattaagtcaatatcggatgaacttgttgtcattagttctccgttgaaagatgttgatcttgtcattcacaccttgaatggccttgatgctgagtatagagagccagattccatagccactgctcatgcaacaggaaaggtaaagcataactattataaaaagagcactcagtctaggtacaacccaaactattcatcttccactggtagatccacatctccaaattcaaaaaaggtgatatgccagtactgtgagaaaattgggcacactaccaaggtatgctataagatccatggctatccatacccaccaaaacacaacaatgctctagcaacacatcatgctagagtgctactcccgagtgtgactaattggatcatggactttggggccatacatcacatcacttgtgatcttgattaa

SEQ ID NO: 108382 - DNA, 455 bp, Glycine max
  Peptide Sequence Number=SeqID_225160
atgttaatggtgttgtggaggaggttgtctttcaccatgtttcaggaaaaggtagaagggtagtctttaaaccaaaggacttgagccagcaattgctatcttgcactttgtgggatgattattgcttgcagtttttaaaggatatacccaattataaagttctattgacccatggtagaataaaggaagctcagggatcttatccgccatcggtcagcaattctttcaaggcttcaaagttagttattaaccaaccggtgatggagattcaagaattcattgaaaggcttgcagagttgggcattgaggcccggtcagtttttaaatcccatggtgaaggaagtacacagctttcaggttctatccaattatcatcaaaggaatcattctttggaaaggctgaggcaaagactattgctgagattaacaccatctctgaagtaatcatcttatag

SEQ ID NO: 108383 - DNA, 348 bp, Glycine max
  Peptide Sequence Number=SeqID_225161
gaatcgcacccacaaagacacctagtggacccggagaagtccaacagggccctggggtttccagctctgggatcacgcctgcaagacacccagtggacccgaagaagtccaacagggtcttggagttgtcaagctctagttacgggtctctgtcagttctacggagtgcttgtcacctccggcaagggcatcaagccccctactaatcgagctttcatcaagaagtactgcgtccccaggcaggcgcagggagaaacaccacaacagcctgaggatggtcgacagcgggcaacagacgcaccgccatcacctctagagttcacctcaactcatccacaaaaaggttag

SEQ ID NO: 108384 - DNA, 201 bp, Glycine max
  Peptide Sequence Number=SeqID_225162
atggcctttgtggagacctctgccatggctaggtcccagattttaccgagcccggggatttgtccccttcttagatacaacattctggcaacatggcgcccgacgtatgcatttaagaaggcgacatggaccctccgtcggtttgacaaagtgaggggatcaagacgcaattcgtgcatgatgcagatgcaaaaggcataa

SEQ ID NO: 108385 - DNA, 204 bp, Glycine max
  Peptide Sequence Number=SeqID_225163
atggatgaccttgctaccgaagaactgataggcagcagagatgaaattgaaacgctaaagatgcagaagaagcaatcgaaggtgatggagttggtgaagcaagcctctgcttcccctaacgctaacgcactcacttccatcctcgtccaagccacttctcacccccaacgtcttctctttctcacaatttctcgccctccctaa

SEQ ID NO: 108386 - DNA, 450 bp, Glycine max
  Peptide Sequence Number=SeqID_225164
atgaaggggcaattatctgttacggtagacgcagctgtggaaactgttagtaacaagctcggtggattgagtattggcgaaaacagtgggaaaactgcggcgcaaggttcgactgtgatttggaaacgtaaatcttatggaactgcgagtggaggcaatgttactgaagttgaaaatggagctggagttgatgcaggtgtggcttcaacgcaaaagagcagtggcagtggtttgagtaagatattttgcggtaatttcctgaagaatttcacctactcacgtgcacaagttagagcgactttctatcctaaatttgaaaatgagaaggcagatcaagaggcatattctttctgtcacaaattttccctgtttcgaaatgttcggaccaggatgattgagttggtggcaaaaggtttggctacgataaagataaagaacaaagaggattga

SEQ ID NO: 108387 - DNA, 840 bp, Glycine max
  Peptide Sequence Number=SeqID_225165
atgccacgaaacgttatggattacgcaatcgtcccttctttggcttccgaaatgttacggaactttacggattgcgtgttaacacttctttttaactcccgacatgtcgcgaaacttcacggattgcctaacgatgggtgtcaagagacaagactcaaggaaatttttgatagtattcctaccttggacgagcttcatgctctgggtggagagggtttaaaggctgatatcattcttgaggatttggagaaagataaaaagctatacatgttaaagaaattaattatggcattagttagaggattaaactctaatccagctgccataattaagaagatagttggattagtttctgatttttataagcgtcccaatgtggaaagtccagcaaaagctgcactagatgaaagctctcacatgtttgagaatcgaggagtccaaatgctggggcaaataaagcatggttcttgccgtcctcgagctatcttatttaaagtattagctgatactattggtcttgaaagtaggctcatggtggcacaacggcatatattggctggtcttgcctcagttgttggtgatttaagtgcaccatatgagaaggcttgtcatgtacatgagagccccattgtgaattggctttgggctgttggttgtcattcatttggaccattctctaatacatctcacatcagtcaaatgctcctagatgttgctttgatgaatgctctgtcaatatgccaaaatggtttttatttaccaagaggtatttctcaaatcagcttttttttgtcgacagaggaactcaatatatgcccgtgtggattctgtgcttcataa

SEQ ID NO: 108388 - DNA, 717 bp, Glycine max
  Peptide Sequence Number=SeqID_225166
atggatgacagtcacatgctaacacttgttattcaagaaatgagtaaggagtttccaacttttatggagagtcttgtgcatgaacgagatcagtatgttgaagagttagttcgattaccagataacttccattgttgcactccttcccctaaggctggtcctgtttgtctaactcctgctctttgcaatggctttgttacatttggtagttttaacaatcttgctaaggtagtaatattcttaaatatatcatgtaattatattttgattatcaatagcattgtaaaagttacacccaaggtactacaagtttggccaaagatactatgtgcaattccaaattctcttcttgtgcttaaatgtaaactattttgctatgatagtgtgagacagaggtttctttcaacactagagaagttaggtctggaaccactacgagttgatattctgccacttattcttcttaaccacgatcatatgcaagcttattctctaatggacataagtttggacacattttcatatgctggaacaaccacgacttgtgaatatttatacatgggagttccatgtgttacaatggttggttcacatgcatacaatgttggtgttagtcttcttagcaaagttgtgtgtttgtttaatgcacataaatgttgtccaattatgccacttgaaagaaagcatgtatcactgcccagcacaccatggttttag

SEQ ID NO: 108389 - DNA, 358 bp, Glycine max
  Peptide Sequence Number=SeqID_225167
atggaggggcgtctgttaaatggttccctcgctagaaggaaggaagaatctggattctatcttcatgcgaaggatgacagcgagcttaggggaagcagtaatgggatcatcggcagctatcataagtggctgagagtccgaacacaaggactggattggctcccaaatctaaagactgtgagagacgatgaggttaaagcttcggaagaaagtgatgaggtacaagccctaaaggcagagcttgaaagagcctgggtagtcgaagagaagttcaaggcagcaatagtgagctcaagctccgaagaggtgaaaggaatcatcacgggtcaaaggcatgatcttgaaggacaagctaaag

SEQ ID NO: 108390 - DNA, 354 bp, Glycine max
  Peptide Sequence Number=SeqID_225168
atggtctttaaaatccacgtcttaaccaataaaagcgaaaagcaccatttcaaggcgttggaccttaaagatggttttttaggtgatgacaaaagcctgaaaggttcgatttcgggaacttaccggttgaagactgaagaacgtcgaagaacgatgaagaacggtggaaaaccttcgcaaaatcgcccacggaaacgtctcggaagcgttacggaagcgcctcggctaggattttcttcacggaaacaatttttctcactaattttaacatattcgcggaacttcacggattgcctaacgatgggtgtcaagtacctcgaagtggtcaagggagggtcgcatcccaacaaatag

SEQ ID NO: 108391 - DNA, 321 bp, Glycine max
  Peptide Sequence Number=SeqID_225169
atggctaaaaggggccaaggccccttcgttctgctgagaatcgcgaagaatgcgctaagtgcgcctactgcgcttagcctgttcatcgcatctgagaaaatttcgatttccaaaagaacgcaccaagttgaccatatggcttcaaagaaaagaaaatcatctacttcctcatcttcccaaattagatttgatagatcaagattccattcacaggaagcttgggacagatataatgacattgttgtacctaggaagctgcttccggaaagaaatgtagtagtataccacactgaatttgatgagttcaaggaggaattttag

SEQ ID NO: 108392 - DNA, 234 bp, Glycine max
  Peptide Sequence Number=SeqID_225170
atggcttgtcctcatgcttctggtgttgttgctcttttgaaagctacacaacctcaatcgagtgctgctgctataaggtctgcactagtaaccacggctagtcctcttgataatacacaaaattcaattagggactatggttaccatgctcaatatgcttcccctcttgccattggagctagtcaaatggaccccaacaaagcacttggatccagcaagaaggcagcgagatga

SEQ ID NO: 108393 - DNA, 984 bp, Glycine max
  Peptide Sequence Number=SeqID_225171
atggtttccaagtcatattcagaggggagaatttctctagaagaatatatcacttctttgaagtcaactgtaggacttggtcttcttgcaaaagctataggtattggtaaggggaaggaagaccttactcacccaactgtggaacatgtgaagaaaacccaagcagctgtttggccccatttactggcaagaggttggcactcggagaaactaaagaatcaaggctctctgagctccaaaaattgtgtggcctttcttttccctggtgttaaaaagttttcaagaagaaaacttatgaaaggtgatcattactttgattctgtcagtgatgtcttgagcaaagtgatagctgaaccaaatcttcttaagcttgaagtcgaagatgcagaaataggatccgacaaggatggtcaacctgataacaatcaccaccgttacctcaaacaccaagcttctactaacaatggagaccatatgaagtatgcagttttttatgctggtttggtgcacagagggaagtcatgtaaagttaacgtagatactgatgatataacatataataaagggaacaagcatattagtaaaacaaaacacaagaaagaaactgctaggatatacagcaaaaagaatagtagtaatgctaactaccagaaaggtaaacacaatagagatgctactggccaaaaagaagtgaatgctaaccctaatgatgcaaacaagacgacagaaaaccatgaaaatcaaaagacctatgtgcccaatggcaatcaaccaaagagaatcatagagaatcaatttagtcaaataacaagatcaggtcattcagatgttgcagttcctcccatcaaacggcaaagactcactgcttgggctaaggctgagacaagccacattcttaagaactccttaggaggcttaggatcagaaaaactgggactctcagtcatcttgagttccataaaatgccaacaagaaagccgataa

SEQ ID NO: 108394 - DNA, 465 bp, Glycine max
  Peptide Sequence Number=SeqID_225172
atggcacaaaatagttacacatctatatcatatatccactattccattgcaaatccaaatttgaaacacaaaacatttccaatcattgatcaccatattcaaactttgttagttttggctactcaaaaggcaatcttcaatcacaaggaggttgacgatgtttgttggagaagtgcagagtatgaaagggttgttgttgttggccgtggaggtgcgacacagttggccagttggccagttgaccatggagttacgatgtgtgagagggttgaggtcttgaggagtgaccgagagagaatagagaagtggcagagtggtattggtgtgagacaggaaaacccgaatccaaacccgaccctggttaacttaggttttgcttatcaaaatcggggtagatccgggttgggccccgcaggttcgggtcccattgtcatgcctagctggggaagggggatgaggagttga

SEQ ID NO: 108395 - DNA, 228 bp, Glycine max
  Peptide Sequence Number=SeqID_225173
atggagcttgcagcacacttcggaggtcacggcggagtgaaagaggtgaagacggagcttgcgacaaacttcagaggtcaccagaaaatgcatatatgttcaagagaagtcgtagtagtcagcttacgaccatggacatttcttgacaataactatggtaacaaagtcatttccatgtttgcaattataaaacttctctatgtgttagttggtaatagtttcaaataa

SEQ ID NO: 108396 - DNA, 174 bp, Glycine max
  Peptide Sequence Number=SeqID_225174
atggctaagcacttggatacaatctatgtctcagggtggcagtattcagctacacacaccatgagcaatgagcccagtcctaaccttgctgattacttttatgaaactgtccgaaacaagccgaaggcagctggaaccaatagagggagtgcgccagctgtcgagaccgagtaa

SEQ ID NO: 108397 - DNA, 462 bp, Glycine max
  Peptide Sequence Number=SeqID_225175
atggatattgctaaatatgaaggtcacaatcaaggcaaagaggaccaaccaatgtcaagcatcaaatgcttcaaaaagatgatgatagaagcacactctaaaacaccagtatcagtggatgcatgctataaggattttagagacagaaaggacttggaaaatatggatgacagaaaattttatatacaaaccacaataaccaaagcagatgatctaccaccagaaatctacaactggaagctacaacaacactctggtttgcctcaagctcgtcaacatccaatgcaagaacagttggacaaaagaaacataattaagcttgattctagcttattcaacaagtccatagaagattttaccttatctatctcaaaatacagagataaaactggaaatactctcttaaattgtcatgtagaggatgaattaaacgaggatgcatcacccttctctgttctttaa

SEQ ID NO: 108398 - DNA, 195 bp, Glycine max
  Peptide Sequence Number=SeqID_225176
atggtccatgacatttttgtcaaggtgaaactggaagtaacaaggacatcaacagtcctaaatgtgtttggcagtagacgaagcagtgataggaaaatgcaaggatcacgcatgagcgaacatgaaaacaaaagacaaatgcaggaacgatatgttcattatgatgccacgaagagatgcttatgcgatgcatga

SEQ ID NO: 108399 - DNA, 150 bp, Glycine max
  Peptide Sequence Number=SeqID_225177
atgcgacttgacgtgatggttggggatcatggaactcagctctatggagcatttctaaaggactcaagaattatactccttgatgaagctacaagtgatctcgacgcagaaccaattatagaatggtgcaagagacattttagtccttaa

SEQ ID NO: 108400 - DNA, 294 bp, Glycine max
  Peptide Sequence Number=SeqID_225178
atgtaccctccacttgaactgatccacaagagatgtgccctctcttgttctcagtacaacaacccaagtagttgtaccctctacttgtaccacaaaggatgtaccctccaatgtgttaagacaaaggattctcaggcggttaatcctttgaatctttgggaagggaagaatcaaaagaattctcaggcggttagtcctttgaattctcttggaaagagagaaggaagacacaaaataattcaggcggttagtccttctattcttttggcaaaaggagaagcgaatgaagaataa

SEQ ID NO: 108401 - DNA, 343 bp, Glycine max
  Peptide Sequence Number=SeqID_225179
ccccattgacaatttggccatgcaagggagagtagttagtttgactggcgagttccaagctaggggggaggtttgtagggttgcaggactgcaagtcgttgtgagaaccttaagagttaaatccgaggtagaagagatgggtagaattcttaacaatattgttgcaagtagaaccgtcaaaatgggttccgactcgtgggccagcccggcccattgcggactagagcctaactcacttagcccgtgggttaggtgggctcaacccgtggatgaaattaatggtgatgttgagaaagaagaggaagttgttttggatttcacagtccatgactctaatgtttaa

SEQ ID NO: 108402 - DNA, 177 bp, Glycine max
  Peptide Sequence Number=SeqID_225180
atgatgtttatggatgagtggagttcaagcttgggtcatgcttcggtgtatggattccttgagcctcagtccatacacaatgcaaaggatagacatattgaatgtcaacattacattaaaacatgggtgaaggaatcccaacgagaggtctacctaggagcttacttgaatcaataa

SEQ ID NO: 108403 - DNA, 252 bp, Glycine max
  Peptide Sequence Number=SeqID_225181
atgcatgcagggaagaaggaaaccgccagccccattggcgagtttgggttggcatcgacatgtggcacggagtgcaatggtctcgccactcgtattggcgatttgaccatgcaagggagtaggttcagaggcagctttttcagaccatggggatatagccaatgctactggcgagatgacaaagatatagccagtgctactggcaagatcactgatatagctagtggtgctggcaagatcaatatgctttaa

SEQ ID NO: 108404 - DNA, 297 bp, Glycine max
  Peptide Sequence Number=SeqID_225182
atggaggaagcatgtgaatttcgaagttgggctgaattgattcctgatgcactcggggtaatcttcaccaatctttctcttcaggaaagggtaacagtgatccctagggtgtgcaaatcatgggctaatgtagtaactagaccttactgctggtggtgttacttgtcatcaaagtacttggcctgggactttgtggctggtggcatgggagaatactatgttgatgacagtgatagttacgatggaatgtgggatgatgaagcgaggctagatgagcttcagtttgggttttattaa

SEQ ID NO: 108405 - DNA, 1296 bp, Glycine max
  Peptide Sequence Number=SeqID_225183
atgtcttcaaggcgcgcctgttccacttccccgtcactcaaccctacacacacaaagtgccctttcgaaaccctaaaattcctcctcacactcctagacttcccttccaccaccttcgcatccatccacatctatgatcatgaacctttcagagaacttggcaattcctacctcctcgccggcggcagcgaaggcatcgtcgcttcccaagccaattccatccacgacgatggtcgttcctacatccgattcgagaatataaccttcaggagaaccaaagcttcaactaaggcacgcggttcggtgtcattacacatcataatttttgaggctgttgatcgtaatgatataggtggttctgcttatggtggacaacgggaaatttgttgcagttctgatttagctaagatgagagtttgtaagcaatgggagattattaggagaccttttgcaacaaacattaattgggcagtcattttagatgtacaattcaaaggcagatctaaaactgcaagtctaaattctcagaaagtttctatcacaaagactggaatgtataatttgttttttgtagcttgtgaacccaagctcaagggcatagtaatgagtgggaagacagcatggaaaaacccttatgcgtatttacctagtaggatggccccactaatgagtgggaagacagcatggaaaaacccttatgtttgccttaacatcatttggttttttcaatatgtgagattttgggatgatgtactgcaacttcagcactgtatcataactgtcattgctcttggattgtttgagatgattctctggtattttgagtatgtgaatttcaacaatactggaatgagacctattgtgctcacaacatgggttgtcactgttggggctataaaaaaatcaatatcacgacttcttattctctctgtttcaatgggttatggtgttgtgcgacccactttgggtggtcttacatcaaaggttcttttacttggaataacttactttctagcatccgagaagttctcaaatgcattagcagtaacagtgatctcctcagttgcttggataggatatgaggttgatccttccaacaaccttcctttggagtgtgtcataaggagagtcttcaaaagttccgagagagatgaatgtatatgttgctctgccctgttgacacgtaatcattggatgttcctggtcattagtgctgcttgtgctacttctaatcctgactttagagtaatgtttgtctatgcatacaatagtgctttaaaaattaggatcccctga

SEQ ID NO: 108406 - DNA, 210 bp, Glycine max
  Peptide Sequence Number=SeqID_225184
atgggcagaaatgtctccgcattgattggtaaatctgttccccaaatccctgaaaaatgtaaagatccagctaatagaagtgttgcctatcctgctggtttcatagaggatgtcttagttagagttggtgaactgattttccctgttgatttttatattttgaatatggaggagggattttctcaagggattaattcccatcatttctag

SEQ ID NO: 108407 - DNA, 231 bp, Glycine max
  Peptide Sequence Number=SeqID_225185
atgtactttttcgagaaaagaaagattgcatgtggaggagagttggcgagtagttttgcatccttatgcaaagaacaacttccaatgaccaaagtactcaacatgctacaagttgaaaacaactcagcgcattcattgtgtgaaagtgaaatgctcaagatgcaagcaagctttttaatgctgacaactgcagagattttggaagttttttcatttaaacatcacagttaa

SEQ ID NO: 108408 - DNA, 252 bp, Glycine max
  Peptide Sequence Number=SeqID_225186
atggaaaccgccagccccattagcgagtttgggttggcatcgacacgtggcgcagaatgcaatggtctcgccactcgtattggcgatttgaccatgcaggagagtagccacacttttttagggttcagaggcagctttttcagaccatggggatatagccagtgcaactggcgagatgacaaagatatagccaatggtactagcgagatcactgatatagctagtggtgctgacgagatcaatatgctttaa

SEQ ID NO: 108409 - DNA, 483 bp, Glycine max
  Peptide Sequence Number=SeqID_225187
atgggggattcacaagaaaataacaaagaaaagagtagagacaaagataattatgtatcttggactatggaggataccaatgagttgttgcacctcttggtggatgctatgaataggggattgcgtgatgccaatgggtcacttagcaaacaaaatgtagaacgaataatacttcctcaactcaatgcaaaaactaaattccctaaaacttatagtcattatttgagtcggatgaagtggtttcgaaaccagtataacatgatgtcaacccttatgcgcaacaactctggctttggatgggacccaattggaaaaactttcactgctcatgaggatgtatggaaagattacttaaagcagtggttctttaactatgacaccacttcaacagctaacaaaaagaactgtgaatttcagtcaggtaaaaagaacagatgtacctgtggtcccaagtcccaagttgtggttagaagaaaagcataa

SEQ ID NO: 108410 - DNA, 1485 bp, Glycine max
  Peptide Sequence Number=SeqID_225188
atggcttggttaagaaacctctcaaagtttgccaccatgaaaagagcatcatcatcatcatctcaaagacccaaaaacactgacccattttgtctattaccctccttcacttttttttccaacttcagcactaacaccattgaggagaagccctgtgtgaagccagttgagtataataattattcgggcttgcagccaacaaggcctcatgagaagccacgtgtggtggtgctgggctcaggttgggccgggtgcaggctcatgaagggcttggaccctcgtgtgtatgacattgtttgtgtctcacctcgcaaccacatggtcttcacccctctattagcctctacttgtgttggaactcttgagtttagatccgttgctgaacccattgggaggatccaaccagctatttctagagagcctggttcttatttcttcctcgccaattgtactcaaattgatgcacataaccatatggtgcactgtgagactgtaaccgaaggagtagagacaatagctccctggaaattcacaatctcatatgacaagctggtaattgcattagggtcacagccttccacttttggaattcaaggagtcaaagaacatgccatctttcttcgtgaagttcaccatgcacaggaaattcgtaggaagctgctcctgaacttgatgctgtctgatgttccaggtatttcagaagaggagaagcaaaggcttttacattgtgtggttgtggggggtggtcctactggagtagaattcagtggtgagcttagcgattttatcacgaaagatgttcgtcagagatatgtccatgtaaaggattacatccgtgtcactttaattgaggcaaatgagatattgtcttcctttgatgaccggcttaggcgctatgctaccaagcaattgacaaagtcaggagttcgtcttgttcgtggcattgtgaaagatgttaaacctcagaagatttcccttaatgatggctctgaggttccatacgggttgttggtatggtccactggtgttggtccattgcctatgattcaatctttggatctcccaaaagctcctggtgggaggattggtgttgatgagtggctccgtgttccttcggtacaagatgtgttctcaataggagactgcagtggatttgttgaaagtactggaagacaaacacttcctgcattagcccaagttgcagagaggcaaggtaaatatttagcagctctactaaacaaaattggaaaagcaggtgcaggccatgcaaacagtgcaaaagaaatagagtttggggatccatttgtttataggcaccttggaagcatggcaactattggtagatataaggcccttgttgatcttagacagaccaaggtaatatttagcattcctgagatactgctggtacttcaaaaacatagtgtgattcacttaccatgctcttacaggaggcaaaagggttggctctggcaggatttctga

SEQ ID NO: 108411 - DNA, 1839 bp, Glycine max
  Peptide Sequence Number=SeqID_225189
atggtgtttggagtgcagagttttgaggagaaaccagtatcagttggaccatggggtgggaatggaggataccgttgggatgatggtgtatattcgacggttaggcaattggtgatagttcatggggaaggaattgactcaattcagattgaatatgacaagcaagggagttctatctggtcattgaagtatggtggaagtggaggctataaaattgacaagatcaagcttgattacccagaggagttcctaacatcagttgatggatactatggtagcttaaatcaatggggaccaatcttcattcggtcacttagttttgagagcaacaagaaactctatggaccatttggagttgaacaagggacatatttttcgttgccaatgacaggtggcaagattattgggttccatggcaggtacggttggcacctcgatgccattggaatcaatgtgaagtcctctcagcaacaaaagccttccaaagctttgtctttttcacagaactacatgactaacaccaatgacaatgctagttattctgtaatacaaggaagtgttggccaaggctatgatattgttcttgctttaaaacagaaagatgattttggaaaatctccaaccgtcaagatttctagcttcaaagaaccaaacaatgttgaaccaaaagaaaaggtagttttcgtggagaaggtaccaccaatggttgaaggtgtagtgacatatgggccttggggtggcacaggtggatatgtgtttgatgatggtccctacacaggagttaggcaaattgacatgtcccgcaatgttggaattgtctggattagagctttgtatgatctggatggagagcctgtatggggatacaaacatggtggggcaggaggattcaaacatgaaaagataatctttgattttccatatgaagttctcacacatatatctggctactatggatctctgatgtacatggggcctgctgttataaggtcacttactttccacaccaccaaaaggccctatggaccatttggagatgaatatggaacttatttcacaacaaagctgagagaagggaaggttgtgggtattcatggaagaagtggcttatttctagattctctcggtgtgcatgctatagaaggaaaagtaatagtgcctgtggcaacagctccttccatggaaatcatctcaaaagaaccaaatatttctgaaatagacaatcctcaacggccagttgttgccaaaccagcccctattgaacagcattatattgaagaggatattctattcacttttgctccctatttcacatcacaggcttcgcgttgtgtgattaaagaaccagctccatgtggaccaggtccatggggtggggatggaggtagaccctgggatgatggagtcttttctgggattaagcagatttatatgacaaaagcacctgaaggcatttgctcgattcagattgagtacgacagatataagcaatctgtatggtctgtaaaacatggtggtaatggaggaaataccatgcatcggataaaactggagtacccaaatgaggttctctcttgcatatctggctattatggttcaatcaccgctgatgaacaacctataatcataaagtcactcacattccatactagtcgaggacagtatggtccttttggtgatgaagtagggaaatatttcacttcaaccacaacagagggcaaggtggttggtttgcatgggaggagtagcatgtatttggatgcaattggggtccatatgcaacactggctaggaggaattcagaaaacttcaaagttatccttcttcaagctattttga

SEQ ID NO: 108412 - DNA, 387 bp, Glycine max
  Peptide Sequence Number=SeqID_225190
agcttgcaggttgtagctcctccaggatccattctaacagtggagcagtttttagagaaggtatcttggccaggaaccctgccttctcttgagagagaaggtgggggtcccagtgctcaggtacctcagcaggtacaggatgcatcatccaagaccaccatccctgagccattcatttttgaagttggtgagacacagccagcagaccctcctactctagtgcatgagattccagcagacccgcctacaccattacttgatcttccagaggacccttctacactagtcttgggattgactaccgctccttcggccactcatgtgctacatcttacagatgaggagggcactcaggatgaggacactcagtcacaggacctatcatag

SEQ ID NO: 108413 - DNA, 483 bp, Glycine max
  Peptide Sequence Number=SeqID_225191
atggcatttttaggagaaactagcagtcagacgattgtcaactcaaggttggctttcatttatccaaatggatcgattattcacaatgatactggggtttacttccaaacttcaactccggtgcccattcgagtaccaaataggtgtgattttgtaagcctaaaaaccagaatacacaatacccttcagctatctgacaaacagtttttggatgaaattcactaccggaagccattcaccgatacagatggaataataaacttacttgaacgcactatgtctcgtattcatgacgcgatcctgtattacaacgggaaatggaacatgccaccgcagaacaaatttgttagatgcgcgttcacaggaaaaaatcctaagaaatttcaaattccttcaacatgtaccatcgatgaactgaagaatttaatcaagcaagttgcacctaaagggattccccctcttggaattcacgaatcacaaacg

SEQ ID NO: 108414 - DNA, 336 bp, Glycine max
  Peptide Sequence Number=SeqID_225192
atggagcggtatttccagcacttggttcgccagcaggcggccaaccacagggggcaggtgcagatccatgagtgtctctaccagctcagcctcagtcagcagagccagggtttcgctccttttgcatgccctactccagatcagtttagggctgaggtcgcatggcccggagattggcccgaggaccagacagaggaggcacttgcaggagctcccgacggtgcagaggatgcccgcatggatgaggagatgactcgatttcttgggaggaagcggagccacgtgaccgaggtcaccgcattttttgacatatctgttttttttcgttttgtttag

SEQ ID NO: 108415 - DNA, 267 bp, Glycine max
  Peptide Sequence Number=SeqID_225193
atggcacgaggatgcttcccaaatgaatatatgatgtggaattgcccctcaagtgcgtatagatggcatgaaacttccttttcaaatgcaagaaatggctccgagaaagcttccgcaaagagatctaggaaggatgccgcggctgaagggactagtgccgctcccgagttcgacagccatcgtttcaggagcgctgagcaccaacagtgtttcgccggcgttggacgtcgttggtcactcccatggccaagtttgacccagatgtag

SEQ ID NO: 108416 - DNA, 407 bp, Glycine max
  Peptide Sequence Number=SeqID_225194
ccctggggtttccagcattgatcacgggtctctgccagtcgtttggggttctcgtcacacctagcaaggtgattcgaccgccgatcacccaagccttcattaagaagtattgcacgcctagacaggcgcaggatgatgcgccacaggccgctgacgcaccgccaccacctcatcaggctgatccagctgggtcattcggcatggagcggtatttccagtacttggttcaccagcaggcggccaaccacagggggcagtttaggactgaggtcgcgtggcccagagattggcccgaggaccagacagaggaggcacctgcaggagctcccgacggtgcagaggacgcccacatggatgaggagatgacagatttacttggcttcttgggaggaagcggagccacttga

SEQ ID NO: 108417 - DNA, 294 bp, Glycine max
  Peptide Sequence Number=SeqID_225195
atggacgagcccaacagctccttatgcataccgcctagcaagagtgaggtcacacagggcctccactgcaggcacacgtatggtccgtcacattggcctgtcttggccatggccacctctggtgagaccataaataactcaaccaagagcagcaccgcctcgtcggtgcgtagaggctggaagtcatgtaatgcatccacaatcggcagatggagaagagccgcgacatcgtccagcatgatcgagatctcccccacaggaaggtggaaactagaagtctcccggtgccactga

SEQ ID NO: 108418 - DNA, 553 bp, Glycine max
  Peptide Sequence Number=SeqID_225196
taccctcacccttagaaggctacacgccctcgccttcagaggactacacgccctcgccttaagaaggctgcacgccatcgccttcagagggctacaagccctcgccgtcagaggactatacgtcctcacctccagaggagtacacgtcctcgccttcagaggactacacgtcctcgcctttagaggactacacgtcctcaccttcagagggcttcacgccctcgtcttcagaggactatacctcctcaccatcagaggattacacgtcctcaccttcagaggactatacatcctcaccttcagaggactacacgtccttaccttcaaagggctacacgccctctccttcagaggacaacacgtcctctcttccaaaggactacacgtcctcgccttcaaaggactacacatcctcgcctttagaggactacacgtcctcaccttcagagggcttcacgccctcgccttcaaaggactatacgtcctcgccttcaaaggactatacgtcctcacctttagaggattacgcgtcctcaccttaagaggactacac

SEQ ID NO: 108419 - DNA, 794 bp, Glycine max
  Peptide Sequence Number=SeqID_225197
atggcgctgcgctcggcggtggacaccgccagcgcccgcaactggcccgactgcacgaacggcaggccggatgccaggtcggccttgcggcgtgcccttgtagggcacgtgcaggatgtcgatcctggcgcggttggccagcgtggcgccggccacgatgccggtgctgttgccgctggcgtaggtaatgcggcccgggtgctggcgcgcatcggccaccaggtcggccacggtcttccagggccgcttggggttgaccaccaggatgaagggcaggttgccgccgcgcgcgatgggcgtgaagtccttgaccgggtcgtagggaatgttcttcatcagccagggcgcggccgagtgcgaggtgttggtggtgacgaacagcgtgtagccgtccggcttggcgcgcgcgacgtagctggcggcgatggtggcgttggcgccgggcttgttctcgaccacgatctgctgtcccaggatggtcgacagctcggcgccaaagatgcgcccgacggcgtcggtgcccgagccggccgggaacggcacgatcagcgtgatgggtttgttcggatagtccgcggcatgggcagcgggcaaggccagcaggctggcgccgccgagcagggcggcgcgcaacaggcggtgaagttgcatggtttgtctctccagatggtgggaaaccgggcgcagcttctgcggccgctgcccggggatgccggtggccccggcgcctcaggcgccggttgcgggcgcgggaaaaccgcggatgacgcggtcgggcgattcttcgtagggcg

SEQ ID NO: 108420 - DNA, 168 bp, Glycine max
  Peptide Sequence Number=SeqID_225198
ctcatcagtgggctaagcgcgcatccaccgctaagcgcagcttcagcgcgacaaaagaatctagcaaggcatcatcatcatcaaggccgtgcactaagcgcgagaccaggtagcgctaagcgcgagggtagcgctaagcacaatgtcacgaattcagagcctatttaa

SEQ ID NO: 108421 - DNA, 279 bp, Glycine max
  Peptide Sequence Number=SeqID_225199
atggcctctggtaatcgattaccaagggtagctaggagagcttctggtaatcgattaccagaggatgtaatcgattaccaggcttcaaaagggaactgggagattgtggaggcctctggtaatcgattaccagtctgtgtaatcaattacacagaggaatgggtcactggtaatcgattaccaggttttcatgtcctgaagctgtgtaattcgagtttggcctctggtaatcgattaccaaggctgtgtaatcgattaccagagatgaaaagctttaag

SEQ ID NO: 108422 - DNA, 249 bp, Glycine max
  Peptide Sequence Number=SeqID_225200
atgtcggcttcccaatttggaggggagtgtgcttattgcaactttttggctgttgaagagagtgaatatgcttttatggatgttgttgaatctaattctcttgaaattggttctactaatgttgattcagattcctctgaaatggaacttgacatgggtgatgagatgactacactttcaattttagtttctatcatgcatatctttttgatgaagaacaagcaagaacaacagcagaaaatgcagtag

SEQ ID NO: 108423 - DNA, 195 bp, Glycine max
  Peptide Sequence Number=SeqID_225201
atgggttgtttcctctgtttcagaagccattctcttatcctgggttatggagaattcgtccctaacaggagaactgccaggaaaccacattacaagcgaaacctcaaagagagttgggcttcgtcctcaaaaggaaacaacaccagaaaatctagccttccatggattcaaacagaaaacgcaattgaaacatga

SEQ ID NO: 108424 - DNA, 297 bp, Glycine max
  Peptide Sequence Number=SeqID_225202
atgagggtccatgacggagcaactccagactcgacggtgggggcgttgaagaacagcgcacgaaattacccagtggtcaaatcgaaacacgaccactgggggaccttagctggaaggagaaagaggcacgcgatcacaatgtggaagagggaggtagttcaaatgagatgggcttttctattcacacccctgttaaaaccccaacaccccagggttccaacccacaaattaataagacagctacagctacctcctggaaggtgtattctcgaaccaggaggtaccaaaagcaagtga

SEQ ID NO: 108425 - DNA, 216 bp, Glycine max
  Peptide Sequence Number=SeqID_225203
atggctctgcagctgatgggtacggaccagaagtgcgctcttgctgcccgtcgtctgaaaatgttggatcctaagtattacgccaccctctatgccgcacaactggagatgctttactacttttttgaaccattcctggctgaaatcattaagaaagtgcaaacgggattctacaaggattttgatgcgatctataacgacttaaaggataggtag

SEQ ID NO: 108426 - DNA, 432 bp, Glycine max
  Peptide Sequence Number=SeqID_225204
atggtaggttcctgcctggtgtcagggcgtgaaggcgcaattgaactcaaatcgttcactcataatgtcaatatcccggtcgacgggaataccgggaaattgacgggcacgcgcatacatatgcccgtcatgttccagaaggaatttgatcgtgtcactccgtttttatttcgggcgttgagtacggggagaacgcttcagtcagccaccataaagatgtatcagattaatgaggctggtttagagcaggagtattttaatatcattatggagaatgtaaaaataacttctattacacccgatttgtatccaggtgccaacaccggaacatacctcgaaacggttctcatacgctatgagaaaatcacctggaaacattgcgacggaaatgtcatctatagtgacgcctggaatgagcgagcaacatactaa

SEQ ID NO: 108427 - DNA, 225 bp, Glycine max
  Peptide Sequence Number=SeqID_225205
atgtccattggatttaatgatgaaatatgtgcaatttcagctcatcagtgggctaagcgcgcatccaccgctaagtgcagcttcagcgcgacagaagaatctggcagggcatcaatatcaaggccgtgcgctaagcgtgagatcagtgtgctaagcacaacagttgtcttcagccaggctcaacgcacgtctggcgctaagctcaaatccccttacttgcactaa

SEQ ID NO: 108428 - DNA, 1358 bp, Glycine max
  Peptide Sequence Number=SeqID_225206
gtgcggcaggtggctgaccgatgccagcacccggtcgtgcgcgccggcgtccatgtcgatcacattggcgccacaggcccgccaggcctcgcgcaccagggcgacggcggcggcgctgttttcggccagcggcgtcaggatgacgcagcgcccctggtacaaaccggcgtcggcggcttcggggccgctgcgctcggcgccggcgatgggatgccccggcacgaactggccgaggcgcgcgcccagcgccaggcgggcggcgtcgaccacctcggccttggtgctgccgccgtcggtcagcagcgtggcgtcgcgcagatgcggcagcatgcgcgccagcatgtcctgcaggccgcccacgggggtggccaggaacaccaggtcggcgcgggcggcggcgtcttcggcgctgacggcttcgtcaatcaggcccagctcgaccgcgcgcgccagcgattgcgcattgcggcccacgcccagcacccgtccgacctgccccgcccggcgcagcgccgcggcgaaggatccgccgatcaggcccacgccgacgacggccagcacaggaatcagggggccagcggccccctgattcggcttggaggaagcgccgttcattcggacaggatggcggccgatggacacgcgcagccactcgggcaggccgtcgccggccaccggacgcacgatcacgccgcgcttgagcagcgccaggttgatgcgcggcgcgtcgcccacgtgcaccagcacgaagttgccgtagcttggcacgtagcgcagcttgaggcggtcgaacgcttcgcacagctgcgccttgccggccttgttggacgtgtacgcctgttccaggtaggcggcatcgcccagcgcggccacggcggcggcctgcgccagcgtgttgacgttgaacggctggcgcacgcggttgagcaggtcggtcagggccggttgggccaccgcgaagcccacgcgcaggcccgccaggccataggccttggagaaggtgcgcgagacgatcaggttgggatagcggcgcaccagcgcggtgctgtcgaaccggaattgcggttccaggtattcgttgtaggcctcgtccagcaccaccgtgacccgatcgccatgggcggcatggacgcgctccaggaacgcggccacctggtcgcccggcacgaaggtgccggtggggttgttggggttggcgatgaacaagaggcgcgtgtcgtcggcgatggggtcgaacatggcgtccaggtcatggccgtagtccttggccggcaccacgatgtggcgcgcgccgcgggcctgcgtggccagacgatagaccgcgaacgaatgctgcgcgtagaccgccgaggcgcccg

SEQ ID NO: 108429 - DNA, 228 bp, Glycine max
  Peptide Sequence Number=SeqID_225207
atggattttcgcttagcgagagtaggcgtgctgagcgcgagaagagataacgtcctcattggacggtcggactacgcactgggtgagcagatctctatcttatcctcttttagggtttcctatccgctaagcgagctggatgcctcgctaagtggatgcatctcgctgagcgaatctgtctcgctaagcgagtcatcagcagcttttgccttctcttctttgacctga

SEQ ID NO: 108430 - DNA, 531 bp, Glycine max
  Peptide Sequence Number=SeqID_225208
atgatggaaaaccgcaataaagaatatgctgctcggtttgagaccttagaaacaacactggagatgacactcaaggataaaactagagatcctgggagtatatcactggctatgaacaatcacccttttaaggttgtgccctggtaccaaatgatgactcgtgaaaattcattcaaaacatggattgcttttatgcgagccttagagacagaatttggcccatcaccgtgtgaatgtcctagatctcagttgtttaaactcactcaaattggttcagttcagtcatattacgtgcagttcacggctttagctaatcgagtacaaggaattacacaagaagctctattggattgctttgtgggaggattaaaacctaatatcagaatggatgtcattgcgcaatcacctacatcactcctcagaacagtttcgttggccaaactctatgaagagaaatatacacctaaactcaaacctttttcttcgagtttttctccaaaacacaaacctcaaacacaaactcaaacctaa

SEQ ID NO: 108431 - DNA, 437 bp, Glycine max
  Peptide Sequence Number=SeqID_225209
ggttgagacaaggagaccctttggctccattactctttcacttagtggctgaaggactgacagggctaatgagggttatacgaatcggctctccacgcaatcgagagaatgttgctgctgtcttgtggtcactatgcaccggagatccactgcaattaaaactagcgaaagaacatggtgcagaagcagcactgcaggagttgtcagaaaatggaactgatagagctaagataaaagctggaagcatattggaactcttgcagcgaatggaagggggacctgctatcaagtcagcagcaacagcagaaccaggtagtcaaaacggaaagaaattggaaggtgggaggtggggagaagttaagattttgggaggacccttggacacaaaatgttataccattaatggacaaatagccaaggctgtaccgaatttctga

SEQ ID NO: 108432 - DNA, 1005 bp, Glycine max
  Peptide Sequence Number=SeqID_225210
atgggccgaggcgaaggcgccgtcgacgcggccgaaggcgctgatgacttcgtcgaagatcagcaggatgccgtgccggtcgcagatctcgcgcagcttctgcaggtagccgcgcggcggcaccagcacgccggtggaacccgccaccggttcgacgatgacggcggcgatggtcgaggcgtcatgcagcgcgacgatgcgttcgagcgcatcggccaggtgcgcgccccagtccggttggccgcggctgtaggccatctgttcgcggtcataggtatgcggcaggtggtcgacatagggcagcaggttgccgaagggcttgcgatgcccgccgatgcccgacaccgacaggccgccgaagcccaccccgtgatacgaacgttcgcggccgatcaggcgcacgcgctggccttcgccgcgcgcgcggtgatagcccagcgcgatcttgagggcggtgtcgaccgcttcggaaccggagttcgaaaagaacacctgcgagtagccggccggcgcttgctggcacagcctttcggccagctcgaacgcctgtggatggctcatctggaacgacggcgcatagtccaggtcgtgggcggtgcgcgcgatggcctcgatgatctccgggcgccgatggccagcgttgacgcaccacaggccggcgatgccgtccagcacgcggcggccgtcggggcggatgtagtgcatgccctcggccgcgctgaacagcaccggatcgcgcttgtagcgccggttggcggtgaagggcatccaataggcgtcggtattgaggggagacgacgaaagaggcgcggacgaggacatggcttcctgcttcaagggagttcaggccgaatctggcgcgaccgtcgtccccggattccccgcggaggggcgcccgctggcaaatgcgtagacgacgaaggtggaacggacaaagacggagcgatggcccgcgagcgggggatcacgattgccgcagcgaggtcttcaggtgttcgcgcatga

SEQ ID NO: 108433 - DNA, 786 bp, Glycine max
  Peptide Sequence Number=SeqID_225211
atgaattcctcctccatttatattcttgtctttgtccagctttggttgttcagcttaccatgcagagagagtgtgtgcatcccaagtgagcgtgagacacttttgaagtttaagaataatctcatagatccttccaataggctttggtcttggaatcataatcataccaactgttgccactggtatggagtcctctgccacaaccttacttcccatcttcttcagcttcacctcaacacttcagattctgctttctatcatgaccatgatggctatctctactcagacttcgatgaggaagcttatgagaaatcccagtttggtggagtgataagtccttgtttggctgatttaaagcatttgaattacttggacttgagcggcaatggatttcttggagaaggtatgtcaattccttctttccttgggacaatgacttccttgactcacctcgacctctctcatactggattctatgggatgattcctcctcagattgggaatctctcaaatttggtgtatcttgacctgagttcagatgttgccaacggaacagtaccctctcagatcgggaatctctctaagcttcgatatcttgacttgagcgccaatatatttcttggagaaggcatgtcaattccttctttcctcgggacaatgacttccttgactcacctcgacctctctggtactggattcatggggaagattccatctcagatttggaatctctccaatttggtgtatcttcgcctgacaatggctatcaagtatgtggaagcttga

SEQ ID NO: 108434 - DNA, 744 bp, Glycine max
  Peptide Sequence Number=SeqID_225212
atgaaaaaggtcatctgcacgttatgtttggtgtttgcatcggttagttctgcgctggccaccacctatcctctcacgattgaaaactgcggctataaagagaccttcaccaaaccgcctgagcgcgtggtggcgctggggcaaaataccgcagaaattttgctgctgctcggcctgcaggataaggtcatcgccagtgcgttctggccaaccaaagtgttgccacagctggctgaacagaatgcaaaaatcaaaacactgacggttgaaatccccaccctcgaatccgtgctggcgcaaaatccggacttcgttcctgcccagacgccgctgctgctgggacccgagagcaaggtggcaaaacgcgaagatttaatcacccttggcgtgaacagttatgtgtcgccaggaatgtgcgccaccaaaaaagccgcaggggatatgtatggcagccgccagcagctgtgggatatgacgtacctgtatcaggagattcaggacttcgccaaaattttcaacgtggaagatcgcggccaggcggtgattgccgatttcaaaaaacgtgaagcggcactgcgtcaggagtttggtagcagcaaaaaagatctctcgtttgtgttctggttctcaagctcgtcaccgtctgcggatgcctatgtgggcggtaaaaacagtccatccggattcatcgccagcgtgctgggcgggcacaacgccatcacgtcagagaccgaatggccgacg

SEQ ID NO: 108435 - DNA, 213 bp, Glycine max
  Peptide Sequence Number=SeqID_225213
atgggcactttaaggtgtcaacgggagattgtttccctgagttatcatcgtcatgggcctgccaggatcgcataccggacgttctgtaaaagccggtccgcagccagccggtcccccttccccactggcgtcacgtattcaatgcgcagagcgtgccaggccagcattcgctttgcggcaccgggttataggcgtccaccgattcaggcctga

SEQ ID NO: 108436 - DNA, 415 bp, Glycine max
  Peptide Sequence Number=SeqID_225214
gcgaggacgtgtagtcctctaaaggcgaggacgtgtagtcctctgaaggtgagggcgtgtagccctacaaaggtgaaggtacctggtccttcgaaggtgagggcgtgtagccctctcaaggcgaggacttatagtcctctggaggtgagggcgtgcagccctctgatggtgagggcgtgtagccctctcaaggcgaggacatgtagtcctctagaggtgagggcgtacagccctctgatggtgaggacgtgtagtcctctcaaggtgagggcgtgcagccctctgatggtgaggacgcgtagtcctctcaaggcgaggacgtgtagtcctctgatggtgagggcgtgcagccctctgatggtgaggacgcgtagtcctctcaaggcgaggacgtgtagtcctctcaacggtgagg

SEQ ID NO: 108437 - DNA, 126 bp, Glycine max
  Peptide Sequence Number=SeqID_225215
atggcacgcaacgtgtttgctccgtgcccctatttaagggacctatatgggaaagaactaactaggcttttagtgataaccccccaagaggtatcatccccttcgaagaacatactgcagcagtag

SEQ ID NO: 108438 - DNA, 399 bp, Glycine max
  Peptide Sequence Number=SeqID_225216
atgtcgatctccccccgcggaagtatcagttgggatcgcgcccacaaggcacccagtggacccgaagaagtccaacagggccctggggtttccagctctggttacaggcctctttcattcctacagggtgcccgtccccccaacaagggatcgtgcccacaagacacccagtggacccggagaagtccaacagggccctggggtttccaactctggttgcgggcctctgtcagtcctacagggtgccccatccccccagcaaggaatcacgcccgcaagacacctagtggacccaaagaagtccaacagggtcttgaggttcccagcactgattacgggcctttgccaattctacggagtgcccgtcgcccccagcaagatcatcaggccccccactaa

SEQ ID NO: 108439 - DNA, 504 bp, Glycine max
  Peptide Sequence Number=SeqID_225217
atgtccgcgcgcggcgaagcggtgggttacgtgccgctcgataagcgcacctggttcgtgccggaagtgctggaaggcatggagaatctggcgctggtttgcattgataatattgagtgcatcgccggcgaagccgagtgggagatggcgatcttcgatctctataaccgcattctggaaaccggcaaaacccgcctgctgatcaccggcgatcgccccccgcgtcagctcaatctgggcctgccggatctggcgtcacgtctcgactggggacaaatttaccgcttacagccgctgtccgacgaggacaaactgcaggcgatgcagctgcgtgccggcctgcgcggctttgagctgccggaagacgttgggcgtttcctgctgaaacgcctcgaccgcgaaatgcgcacgctgtttgacacgcttgatcgtcttgatcgcgcctcgatcagcgcacagcgcaaactgaccattcccttcgtgaaagaggcgctggggctttag

SEQ ID NO: 108440 - DNA, 558 bp, Glycine max
  Peptide Sequence Number=SeqID_225218
atgccaattgcccgcacaaaagtatcagttggtctgtgtcgtcccgacatggggatcgcacccacaaagacacccagtggacctgaagaagtccaacagggccctgggatttccatcttggttacgggcctctgtcggccctacagggcgcccgttccccccagcaagttcatgtcgtcgtggcatagggattgtgcccgcaagacacctagtggacccgaagaaggccaacagggtcttggagttgccagctctaaatacgggtctctgtcagttctagggagtgcctgtcgcccccagcaaattcatcaggcccccctaccaatcgagctttcatcaagaagtactgcgccccaggcaggcgcagggcgaaacaccacagcagcattgggatggccggtagcgggcaatagacacaccgccaccacctctagagttcacctcagctcatccacaaaaaggttagagcgttgcctacgacacatggccgaccagcaggctaccaagtccaaagccaaaggtaagcaaagtactaggtcagtgaccgacaagtcataa

SEQ ID NO: 108441 - DNA, 582 bp, Glycine max
  Peptide Sequence Number=SeqID_225219
atgcccactgggaggaaggaagccatatcttttctctgggttctatccctccacgacaagagtttccaaggtagtgaaaacctcagcacaagagttggaccgtgtaaagcaaaacagaaatggagtagtcggagtaccaaggaagtgtttggaggaaaagggcaaaggccttggcaaaatcaaggcgaatgggcttcttttattgacatcttggcgcttttgatctttggagttgtcctctttccgaatatggaagggttggtggacctagcagtgatcgacgcttttctcgcctatcataaccacaaagaaagcccggtcgtcgccattttggccatgtatgacacgttcaaccggggatgtaggcccgtctatccgctacaaggtcaccgctcgtgcatcgaaaaaggaaaggcgaattgggaccaactcttggctagcatggagaggcgtctgttaattggttccctcgctggaaggaaggaagaatcaggattctatcttcatgcgaaggatgtccaaatgtcccttgatggaacaaggggttgtattaattataatcccgtcctcgtcataagatag

SEQ ID NO: 108442 - DNA, 2322 bp, Glycine max
  Peptide Sequence Number=SeqID_225220
atggctacctctggctcatctggtgaggatgattctactccaccaccaccaccttccttcactgatcctagtcaaaacccagccaaccctttctatatccatcacagtgagaatcccacatctgttattgttactcctccacttactgccaataatttccaatcttggtcccgttcatttcgaatggctcttatctccaagcacaaaatgggttttctcaatggatctattccaattcctcagcccacagactcgatttattcttcgtgggacatgctattgatatttggaatgacctccgtgaacgcttctctcaaggtgatttgcttcgagtcgccgaattgcaggaggaaatctatgctcttaaacaagcctctctctgtaactgattactactctacgcttaagtctttgtgggaggaactagataactatcgccctttgcctccttgttcttgctctgcaaagacttaccaccaacaggattttatcatttgtttccttaaaggccttgatgagcgttttgccatggtgcgttctcaaatcctcttgctcgatcctcttccttctgccaatcgagtattttccatgatcatccaacatgaacaacaacattccaacccagcttcttcagctctgaacacaaactcattcgttaatgctgtttttggcaaaggccgaggcaacccacaacaagggggggaccaaatcaacacccactgcaacaaacttggtcacactagtgatgtttgctactctaagtttgggtaccctcctggacatccgaaatatccaggtcgcccacgtctctctaacaacaaatatacctccggtggccgcacaacctcttcaggtggaggtgcggtgaacaacgctaaagtgggaaccccaacccatggaggagaaagcaagaaagaaagctcaactcaggatcatgggtttcacatcacaatggcccaataccaacaattgatgaatcttctcagcaaatcctctagacctgatggcagtattgagcgttacaaggctcgtcttgttgccaaaggatactctcaaattgagggcatagattactttgaaaccttctcccctgttgttaagatggccactgttagagttgttcttgctctggcatcaattaatcgatggcacctccatcagttagatgttagcaatgctttcttacacgggtacctcaggaaggatgtttacatggagatccctcctggcttgcttggttacacatcaagtcaaagttgcaaattgaagaaatcactctatggattaaagcaatctagcagaaaatggtatgaaaaattatctactctattgctgacttgtggttattcacatgcccatgctgatcatagtctatttatcaaggctcataattctgaatttactgctttaattgtatatgttgatgacattgtgctgaccggtaattcccttgctgagattgaacacattaagcgtactcttcacactaattttcacattaaggatttgggaaaactgaaatattttttggggcttgaagttgcacattctgataaaggaatttcattatgccaacgtaagtattgtttggatttactaaaagattctggtatgcttgggtttggaagactggtctatttgacaagcacacgccctgatattgcctttgctacacaacaactaagtcaatttatgtctaaaccaacaaaagcccatcatgctgcagctgttcgcgttcttcgatatctcacagggtgtccaggccaaggtttattttttccaaggacttgctctcctcatctacttgggtttagtgatgctgattgggcaacatgtattgactctaggcgctctattacaggttattgcttctttataggcaattcacttgtttcatggaaaaccaagaagcaaactacagtatcacattcctcttccgaggctgaatatcgagcacttgcttctgcaacttgtgaattacaattgctttcttaccttctaagagatcttcgaattcctctttccaagactcctgtactttattgtgataatcatagtgctcttcacattgctgccaatccagtctttcatgaacgcaccaaacacttggacattgattgtcatctagtccgtgaaaagtcccaagctggactcatgttactgctctcagtcccttcttcaaatcaacttgcggatatattcacaaaggctctccctcctcaatccttcaacaccaatctttccaagctgcagttacaaaacatttttgcacctccaacttctgatgtggctgcaattccagttgcgattgccttgcaatga

SEQ ID NO: 108443 - DNA, 685 bp, Glycine max
  Peptide Sequence Number=SeqID_225221
atgcaaaacgggattaaccggcaaaaatccctgaaggagaaactgaaatcttcgctatgttgtttctccggaaccgttcatagcgacccattggagcgaggagaaggagggttcttctacgacaaactacgcataccaaaaacaccgatttctccacaggggtccacgtcatcctcgtggttcaagataatgtcaccgacgagcaccaatttcggtgacccgcatccacgtgtcagggggcggagcctgaagtcgaggatgggccgcaagctcctccaccaccgtcagtcgcagtccgctgacttcagctacgacccttcaagctacgcgctcaatttcgaggacgacagcccccaagaatttcccttcaggaacttcagctcgcggctgccatcctcgccctcgccggtggattactccaccggcggcaaggagattgttggggattggacaaaaactaacgaatttaacggtggaacagaaagaagcgaagaagggtttgtggtgaatatttgtgaagccccgtttctctgttcaccaaactccaacaatgggaccacgagcctcactccaatgacctcaccacctcatgtgccactgcctgattctggcgaccagattccaacgacttcggccctcaccttcgcgagcacctcttggagcgattcgagcaacgacaccgcct

SEQ ID NO: 108444 - DNA, 276 bp, Glycine max
  Peptide Sequence Number=SeqID_225222
atggcttatgctaaaagaagcagtcgcgctaagcagaccctgtgggctcagcatgcatccaccgctaagcgcaacttcaacacgcttagcgtgacaagggaatctggaagagcacaagaatcaaggccacgcgctaagtgcgagattagctcgctaagcgagactttgtctcttgccaggctcagcgcacgactggcgccaagcccaaatccacttactcgtgctaagcgcgagggtggcactaagcgcaatgttgtgatttcaaagcctatttaa

SEQ ID NO: 108445 - DNA, 318 bp, Glycine max
  Peptide Sequence Number=SeqID_225223
atggcttctacgtcatcatcaaagccaaaggaacaaaaaaatgcacaaataagcgatgaaaaaaccttgagttgctctctcctaggactcttcacttgttcgagcgggttacttcctaaaaaggaaacaaacaagaatggaaagctgttaaggaacgagaaaagtaacacacagcttcagtatgactcagcaagttatgccctaaattttgatgatggggcacaaaaggatgatgccggttttccatgtttcgcagatcgatacgcaaacccaatggggcataagagtgcgacaggagtcaacaaagaaacaaaatag

SEQ ID NO: 108446 - DNA, 225 bp, Glycine max
  Peptide Sequence Number=SeqID_225224
atgaatattaaaataataaagacaaagacaaagattagagagagagggacaggtcacagggtgttgtgtctagcacccctcacattatgggatttggccattggtgctcataactacgaaggcatgggttggtttattgatgaagtcactaatcttttcagcggtgattgctgctatgccacgcccttccactatgcctcatgcttggactttctttttgcttga

SEQ ID NO: 108447 - DNA, 177 bp, Glycine max
  Peptide Sequence Number=SeqID_225225
atggaaaaacacacaggttgcagtgacaatcgcggcagagacgaagtcctttgcggtagtcgcagcttaaacgacagtggtaccttcagtgcagcttcaatggtagtggtagcaagaagaaagaggacaaaggagaaacgactaagtgttgtgaaggttgtggatctgagtggatga

SEQ ID NO: 108448 - DNA, 192 bp, Glycine max
  Peptide Sequence Number=SeqID_225226
atgatacacctgcacgttgatgtagctattaagaaagctaaagaggttgttactgcatcaaaggaagtagagaagttttttgaagatttaactgttgaactaattactgcaaaagagtcattggacactacacatggtgcgcatttggaagcagaggaacaaagaatagaatttcaggaaatgggattctag

SEQ ID NO: 108449 - DNA, 1053 bp, Glycine max
  Peptide Sequence Number=SeqID_225227
atgtctcttcttcctctagccaggtcagttaactcaatagatagatcaaagcaatgtcgttaccatcagaactatggtcacaccactaaggaatgtgttgcccttaaagatatgattgaagaattaatacaagaaggaaccctcaataactatacttacagggcaacacattgtaagtatggtcacaccactaaggaatttcaagacatttcttgcaactctcacagttcttactcggctaacccccaaagtcaagttgctattatacctatctgtctcagactcgacaataagcttgacccttttgtaagaagccaagaggtgccatcaaagggtagtacttggtcgacttcatggtcgagctccttcccaatgaaggcaacaacgaacgttagtggacattatacattgatggaacttcaaacaacaaaggtagtggtgttgggcttcaataatcaagctgaatacaaagcctttatcgcaggtctaaagttagcaaaagagaataatgaccgagctaatgctttagctttccttggaagcaccaaaaagtcaggtcaacacataactctcattcaggaaacaaagcaccaagcacaaacattgctgaaatcctatttgatcaagtcgtttgaagtgtttagatgtcttcaatatggacctacctcatcaacaatattttaccttcagaagaaatggaatgaagatcatacacaatatgtcattgttgaagtgcatagaggaatttatggaatgcacacaagaggtagaaacatggcaacacaagttatacatgttgggtactattggccaacaatccgagtagattatgttgagtacatcaagaaatataaagaacatcaagagttcaacaatattcaacatgctccccttaaggaacttcatagcctcacatctccttggcctttcggcatatggggaatggacatacttagtccatttctagttgctaaaggtcaaatcaaatttctccttgttgccaactacttcaccaaatggatagaagaaactctggcaacaatcatgacctag

SEQ ID NO: 108450 - DNA, 963 bp, Glycine max
  Peptide Sequence Number=SeqID_225228
atgaatgagttagtgaggggtgttgaggttattggtgttgaagggaataagaatggtcatatccaaaatgatgaagttgatgttggggatagtaggaaagatacgtttccccctgtgaccattcctgggtatgagtgggtgtctagagaggtcaattcttactgtacttgctttcaaactcctgattcaatagccacctttaaaaaggaagttgatatgactatttatgatgattttgagagtttagttgtagaacattgtacttcagatgatcgtgtgtttctgaaagcttctaaaatcatgaagggttatgactataagagtttgagggcttttgttactaatgaccaagcaaatcctcctcttggtggtagtgattttattggagatgacattgttggtggtggcaaacttgttccacaacatcatattatagatttcacggatcgcactaataaagtaattcttcattattaccaaggcaagttgtgccgattagatcatgttttagttgccccaaatattatttcactttggaatgctgagttgattgctgtaatttggcattggaaagaaatagttgctactgctgatgaaagaattaaattgatgtctgagctattgaagatcatgaaagttgaggttagtaagattgaacaacttggagtggctctagccaaaattacaacattggagaaaagtgttatggatgctaaaactaaacttgaggaactatcattagagcttgttgttgaacaaaacaaaagtaaaactatagaggatgaaaagaaaattgatgaagataacttgacatctgctaatgaggaacttgccaacctaacaaaggttatggaaaatttggagagcaagttgcagaacaaatacaagattaagtctgatttggatactaagttagaagagtcgatggtgagattgttagagaatctcaacttgctacgatga

SEQ ID NO: 108451 - DNA, 288 bp, Glycine max
  Peptide Sequence Number=SeqID_225229
atgtcaggagtttccataccaaataggctagcatatagaagtaatccagaagaaacaaaagagagccaaagacaagtggagagcttgatggaaaaaggatgggttagagaaagtttgagcccatgtgctatgcccatcattctggtaaatcgaactctatctcaacttctaaggtgcttagtagatgcttggctacatttaggaaactacatttggaaaaaaggagatctaactgcagcaaagaagtgccttagtcttgcattagacaaggcttatcataccatgtag

SEQ ID NO: 108452 - DNA, 240 bp, Glycine max
  Peptide Sequence Number=SeqID_225230
atgcaaaaagggccactctgggaccatttgtacaatacaaacttgccaagcttgtcttggaatcaaaggcttggaatttgcattggagctgccaagggtcttcattaccttcacaaaggagtagtggtacggggaatcattcaccatgatgtgaagtcctcgaacttattgcttgatgagaaccatgttgctaaagttgctgattttggcctttggggtatcttgaacctgaatatttaa

SEQ ID NO: 108453 - DNA, 588 bp, Glycine max
  Peptide Sequence Number=SeqID_225231
atggctagagtggcaaaggaggaagagaggggtagtcctagttggggtgcttcattttttacgcagacaacacaggatgtggctagagctgttgccgctgctgtgaattctcaaaggccatgtgtggtatatgcattcaaaaatgatcatggtggcagccaacttcaaaggctgcagtttacagaatttggaggtccaattcacaaaagacttgtccaggatttggcatttgcagctgctagatttataataagaggaaggtcctttgtaaactactacatggttagttggcttaaactgattcaaaaatcgatgacgttggcatctactcttaggaaccaattttggacgaacataaacagacgtaaattagaaattactactttggaatctgtcattgctcagtcacatgaagggcttaatcgttacaaagaagagagagacaagttacatggggagagaaagtccctatggggcaaagagaataaacttactgctgaaattgataagctgagagctgaagttgagaaggctgaaaagagtcttgatcatcatgcaattcctggtgtgagtaacccctctttctaa

SEQ ID NO: 108454 - DNA, 276 bp, Glycine max
  Peptide Sequence Number=SeqID_225232
atggcgatctccccctacgaaagtatcggttggtctttgccgtcacgacatagggatcgcgctcacaagacacccagtggacctagagaagtccaacagggccctcgggtttccaggtctagttacaggcctatgtcagttctacagggtgcctgtctcccccaacaaggtcatgtcgtcgtaacattgttctacagagttgctcatcacccccaacaaggtcatcaggcccctattaacagggctttcatcgagaagtactgcgcccccaggtag

SEQ ID NO: 108455 - DNA, 1128 bp, Glycine max
  Peptide Sequence Number=SeqID_225233
atgtcaggctcagcttctaatacgtccaatccagggtccgatgaaaattcttcaaatcccccaccagaccctacccaaaatccttccagtccatatcacatccaccctagtgaaagtccctcatcagtcattattgctccagccctcgttggcaacaattatcattcatggtcgcggtcatttcacatggcccttgtctccgaaaacaaaatggggttcctcaatgctcaaagtgtgatctaccttgacagagctatcgacatctggactaatcttcgtgaacatttttcccaaagcgatttgctccgtatcgcagaacttcaagaagaagtctatgccttcaaacaaggcactcgaaatgtcaccgattacatcactggcttaaaagccttatgcgaagaactggataattttcgacccatgactgcttgtggatgttctgccaaaacatatcatacacaagacttcatcatcaggttccttaaaggtcttgatgatcatttttcagtggttcggtctcaagtgctccatatggaccccttaccctccgtgaatcggattttctccatggtcattcaacacgaatgtcaacaacctgatgctgttttttccactaatgagcctaactcatttgccaatgctgccatggatagagctcgaagtaccacgaacaaagccaactcctccaaaaagtgtggctattgtcatcgtctcggccacacaatggacgtttgctatagcaagcatggttatccaccgggtcatgcttgttaccccggaaggccaaaatttaatcctcacactggttccttagctaacagcgccgtcagtgatgcttcttacgctaaggagaaggagaccaatgagggcttcactcaagattctgggcttaatctcactaaagtccaatttcaacatttaattagtcttctccagcacactcctccttctggtagttcgagctcagtagacaacaaccagcccaaaagtgtcaatctctctctaaaaagcccaatcccttcacctggttccaatttgggtatccttttattttttgcgccaccacacacgtcctttctcacacacatgcaatgtctttttcttcacactccaccccctggattgtag

SEQ ID NO: 108456 - DNA, 651 bp, Glycine max
  Peptide Sequence Number=SeqID_225234
atgcagagtgggtcccaatctgaaccgtttgatgtagacatgggagatcgcttggaggatatgattcgtgaccttggacaagagtcttttcaacaagcgcatgcccctatgtatgaaggattgcatagtgattcaaagaagcctttgtatacaaggaaatgggcacttacagctgacatggacggtgtggatgacactgtctgtgaaaaatacaacattagcaaggagaaatgggcccaattttgtcagacctgcagagacccttcgtgggaggatgtgcggaaaaaggcacaagccatccagaagcaaaacattgccccccacgtgttgtctcgtgggggttacgaatatttagaacaaaagctcatggctgagaagaaaaaggaaagactggaggaagctgcccagtccggaagcactgagggtgtcattgatcctttgagcagtcgcgctcagcggaccatttgggctcagcgcgcatccgacgctaagcgcagctttagcgtgcttagcgtgacaagggaatctggcagagcacaagaatcaaggccgcgtgctaagcgcgagatcagcttgctaagcgagacgtttgtctttagccagactcagcgcatgactggcaccaagctcaaatccactaactcgtgctaa

SEQ ID NO: 108457 - DNA, 694 bp, Glycine max
  Peptide Sequence Number=SeqID_225235
atggctcgcaccaacaaaactgggcagatgacatctgaggcagcaaaggaaatcgctgagaagattgcgtcacagggatcgtttgtcccccatggacgtcaggatgtcctgactgtttccattgggcgaccagagcactctggtcgtgtccatgcaatacttcggatcgactccacaaacctcccgcagttcttccttcatggacttgcactgcctccggagccagaggttggtccctcaggtgctcgtgccagcacaaaggagagttgtgttgatccctcagggaacgatccaaagacgggtgactcagacaaatgcgggttgtacattgaagaaaatcattcccgcctggttgtcctaggaagactttatgagggatccacaacggtccacaacatctctttgttgcatggccaagtgaagtttggtgttgaggaggcacttaacaccttctttgcttggccgacacatctcgtgaaacatttatcagaacaggtagttgtgtttccaaaaaaacctccagaaagcccggatcctgaggtcgatgatcccctgtatctgatgacattgaccatcccacaactgtttttgaagcctctccaggttatgtgggatgctaccgtgtttagggtgtttaatcaaaacttcccgttgtacataaagcatgaaaatctctctgaaattgcacacggtg

SEQ ID NO: 108458 - DNA, 324 bp, Glycine max
  Peptide Sequence Number=SeqID_225236
atgcagagtgggtcccaatctgaaccgtttgatgtagacatgggagatcgcttggaggatatgattcgtgaccttggacaagagtcttttcaacaagcgcatgcccctatgtatgaaggattgcatagtgattcaaagaagcctttgtatacaaggtacaagaattccttgacgttgttgtcggcgagtgacaaaagctttacttcactgctccaagtagtgcacgagctgcttccagaggaaaacatgttgcctagaagttactatcaagccaagaagatattgtgtccgatgggtgaccaggaaatgggcacttacagctga

SEQ ID NO: 108459 - DNA, 1305 bp, Glycine max
  Peptide Sequence Number=SeqID_225237
atggcgtaccataaccaccacaacctttcacaacaagaccttcctccactccaccatttcccgaaccaatccatgttaccagaccaacaactacttccgtcctcacccgaacctaactccaaacctccctccgatccacaccctctccaaaccgcgccgaattggctcaacgacgcgctcctccgcactcactacaccgacaccactaacaccgccaccgtcgccaccaacagcaacgttaacgttaaggttaacggttctaatttcctgaaactgaaccccggcgcctccgacgcgcagtggctggcgcggccggcgctccaccgccaccccggcgaggtcatcgatgacggcgccggggagtccatggtggagcacgccgatttgaaggacggcggcggagacgccgtgagctggcagattgggcggtgtaagacggagattctgcagcacccgctgtacgagcagctgctgtcggcgcacgtggcgtgcctccggatcgccacgccggtggaccagctgccgaggatcgacgcgcagctggcgcagtcgcagaatgtggtcgcgaaatacgcagtgttcggacacaacaacatcgtcgccgatgacaaagaactcgaccagttcatgtcgcactatgttttgttgctctgttccttcaaagaacaattgcaacagcatgtccgggtccatgcaatggaagcagtaatggcttgttgggagttagagcaatcattgcagagtctaacaggagtttcacctggagaaggtacaggggcaacaatgtctgatgatgagaatgaccaagtagatagtgatgccaatctcttcgattgtagttttgatggggcagatagcatggggtttggtcctcttgttcctacagagagcgagaggtccctcatggagcgagtaagacaagaattaaagcatgaactgaaacagggttataaggagaaaattgttgacataagagaggaaattttgcgcaagagaagagcagggaaacttcctggtgacacaacttctgttcttaaagcttggtggcaatcacattccaagtggccttaccctaccgaagaggataaggcaaggttggtgcaagaaactgggttgcaattaaagcagattaataactggtttatcaatcaaaggaagaggaattggcacagcaatccttcaacttctactgccttgaagagcaagcgcaaaagggagaaaatccgtgttgtggctctacaaaggctattaggaatgaagagggaggttttggctgaggatccacgatctgcaccaagccaatag

SEQ ID NO: 108460 - DNA, 333 bp, Glycine max
  Peptide Sequence Number=SeqID_225238
atggagtcatctactggctctactagggttttgagtgaaaataccaaagaagaagaagatttgctcttgagaagtacaagaaaagtcaagtgtaaaccgagtgagggtgaagctgataggcatatggaagtggaggacaagggagagggaatcaaggtggctaatccatataaagagaagttgttgatgaatggaggtgttgtgcctttctcccagtatgacaaacatttctttggacaactagatatggagatacctacccttcctctcttgaaaaaagacaaggattgtttcccaaaaattcctatttctaatgaagaattcatggactag

SEQ ID NO: 108461 - DNA, 210 bp, Glycine max
  Peptide Sequence Number=SeqID_225239
atggaattgttcaatgatcaattcctagataaacctctacaacctaaaatcattgttagagtgtatttactcagcctacagtatgaaggacttcattccatttgtttcctctatggaaaatatggacataaggaagcacaatgtttggagaggaatgcaatgcctatgatgcagaagggaaatgatggttcctcgagtatggtggcttaa

SEQ ID NO: 108462 - DNA, 213 bp, Glycine max
  Peptide Sequence Number=SeqID_225240
atgggagtgagaattaatggtggagggaatattcctggcagaatagataaggaagattcgaagaatgaggtaggatcatggtcaagcaaacaagatcaagaaaaagataaggcctcaaaaatctcattagttgatcaagcttttgcctcaaaacacattgtttccaacatccaaggctctggtaatcgattaccaggcagtgtaatcgattaa

SEQ ID NO: 108463 - DNA, 594 bp, Glycine max
  Peptide Sequence Number=SeqID_225241
atgtctaagttgaaggatttcaggcccattagcctatccaatgtctcttacaaaaggattaccaaaattctatcccacaaattaaggtctctgatggagaaattggtcaacccatgccagtgtagctttcctcccaaccgtcaaagcagagataacattattatagctcaggaagttttccactccatgagaaacaagaagggtgcaacaggatggatggaaattaagatcgatttggaaaaggcttatgaatgtcttaattggaatttcattacggacactctctctaatattggatgcccagtgtggcaaacatggatcttacttttggagagggttcttgggcaagagagattgttggagaaaggtatcagacaggttcctgaggaattgcttggacaaaagtccctcatcctaaattatgtagaggtgttgatacatttgactggaagggtttcctggatggagcttagtatatccttagcttaccagcttctgagcaattatgacccatctaacctaaactcgttacataaagtagtgtggagttggaaagggcgtgagagagtgagggtattgctctacaagatttaa

SEQ ID NO: 108464 - DNA, 378 bp, Glycine max
  Peptide Sequence Number=SeqID_225242
atgttacttgattgttatcttctcgatgttggtttccaagggtaccctcacactttgaagaggggtgacctagaacaaagtttggatagggtggggggacctttcgtggtagcaaagccatacctttttgttttatggctttgtggattacacatgcaaattttcacaggaaaaaaaggcttgataaggaagttgaacaacctaaatagaaggttgggttcttcaaggaatccacaggtcatgcaagaaatggagaggatttggaaggagtatgaggaggctttggttcaggaagagttgttatggtttcaaaaatcaaggtccaaatggctctctttggaaatcgcaacacgagattcttccatggtaccattgtga

SEQ ID NO: 108465 - DNA, 132 bp, Glycine max
  Peptide Sequence Number=SeqID_225243
atggtgtacaaaattttgttaatcttgctggtagcgagcgagcatcccaaacaagattatcatgaaggttacaaccaaagtagcgtggattatgaagattctgtcaagcaactatgcacttctaagttctaa

SEQ ID NO: 108466 - DNA, 324 bp, Glycine max
  Peptide Sequence Number=SeqID_225244
atggctggagatgatgaactgtcacttcttggtaacaagttgcgagcaatggtagttgctgaggttcctaagcttgcctcagctgccgaatacttcttcaaaattggagtggaaggaaaaagatttcgccctacagttttattgttaatgtcaactgcattaaatctatcaatacacgaagcacctcctcctgttgaggtaggaggtactttgacaactgatgtacgttcaagacaacaacgcatagctgaaataacagagatgattcatgggatattggatgtttatatatttaattatatgaatgccaataactttgcatga

SEQ ID NO: 108467 - DNA, 1395 bp, Glycine max
  Peptide Sequence Number=SeqID_225245
atggcaaccaatcgacttgttcttgctctggcttctgtcaatagatggcatcttcaacagcttgatgtcagtaacacgtacctacacggtgaactttctgaagatgtctacatgattgttcctcctggtgtcatgggtcactgcagtttacagtgttgcaaattaaagaaatctctctacggtctaaaacaagcgagcaggaaatggtatgaaaagctgtctctcttactcttatcttgtggatataatcaagctcatgctgatcatagccttttcattaaatctgctgcgcatgattttactgctttgatcatatacgtggatgacattgttttaactgggaattctgtgcatgagattgcccacattaagcagatattacattcacattttcatataaaagatcttgatcttttgaaatattttctgggtatagaagttgctcattcagatgcaggaatctccttgtgtcaacggaaatactgtttagatctcctcaaggattctggtatgacaggatccaaaccatgttctacacccatggacagtgcacttagtttacatcaagattccattgaacctcttgctgatccgctttcataccgaagacttgttggtcgtctattgtatcttacaagcacacgtcctgatatcactttcgccacacaacagctaagtcaattcatgggcaatcctactcagatgcatcttcgagcagccatgagggtccttcattatctcaagagcagccccgggacaggtttgacgttcagacgtgattctcctatccaaattcttggttttagtgacgcggattgggcgacttgtgttgattcaagaaggtctgttacagggtattgtttctttcttggaaattccttaatttcttggaaaacaaagaagcaaaacactgtatctcgctcatcatccgaagctgaataccaagcccttgcttcagccacttgtgagttacaatggctgaattttctgcttagagatctaaatatcccttgttccaaacaagctgtcttctactgtgacaatcaaagcacactgcatatcgcagcgaatcccgttttccatgagcggacaaaacatctggacattgattgtcacctcgtttgtgagaaactacaagctgggttgatgcgattaattcctgtgtcatcctcgaaccagctagctgacatcttcacaaaagctctccctccaaggctattcagcttaaacttatccaagttggagttaatcaacatcttcccaccgccaacttgtggggggctaacagataaagagcccaatccatcccaaaaacaacattgtgcagcagtagaaatgggccacaatgcacactctgctacctcatatttttgcattacagaaataactgaataa

SEQ ID NO: 108468 - DNA, 558 bp, Glycine max
  Peptide Sequence Number=SeqID_225246
atgtacaaacatgagtatgaagaaatgcataaatgccccaggtgtggggtatcacggtacaaagtgaaggatgacgatgagtgtagcagtgatgaaagcacaatgaaagtccccccagcgaaggtgttatggtatcttccgatcattccaaggttcaagcatttctttgctaatgcagatgatgctaaagaccttacatggcatgcagatggaagaaattgcgatggaatgctttgccatccagttgattccttccagtggaagaagattaatcgtttgtatccgaattttgggaaaaagacaagaaatctcaggcttggacttgcccttgatggaatgaatccctatggtagtttaagcactcagcatagttcgtggcttgttttcccaagacaaccaagaaatgacattgatgtttatatcagtctgttgattgaagacttgacaaatttgtgggacaaagtggttgcagtgcatgatgggcatcgaaatgagacagtcaagttgtgtgcaattctttttgtaccttcaatgacttcccaacatatggaaatttga

SEQ ID NO: 108469 - DNA, 303 bp, Glycine max
  Peptide Sequence Number=SeqID_225247
atgcaatcacagggactcgcactgcctcctgagcttgaggttgatccttctgctgctcgtgtcagcacaaaggaaagttgtgtcaatccctcgaggaaggacccaaacacaggtggctcagagaaatgtgggttgtatgatgatgaaaatcctcctcacctggttgccattggaagagtttatgagggatcgaccatcatccacaaaattcctttggacaatgatcaagtcaaggtcggtgttgaggaagttcgagatgttgatgttcacattcttgtacacccattcaagaggttaagttag

SEQ ID NO: 108470 - DNA, 372 bp, Glycine max
  Peptide Sequence Number=SeqID_225248
atgactgagtactgggtcagccagggcaacaaatggtgcgacttttgcaaaatttatatatcaaacaaccctggaagcatcaggaatcatgagcttggccaacgccacaaagataatgtttccaagaggctagctgctatgagaaaagataatattgctaaggagaaagaacagaaagaaacagctcgtgccattgagcaaattgaagcagtaagggtttcacacttattttatattaatcatgctgatgctgcattcttcatacttattcatgataatgatatcactggtataatcatgaacaattcattcatccatagcgttttaccctctttattcacaccacaaagcctattgaagttattgaagtga

SEQ ID NO: 108471 - DNA, 384 bp, Glycine max
  Peptide Sequence Number=SeqID_225249
atggatgaggatcctctagccactagatggaatccattaagaggtatctggtgtgaccttccaatcaaggagaaaccgaatgagctacaaatgaacattgtcatctggtgtccatatgaggagcacaagcatgtgaggccctttgtaggtcagacactttactttggcttcattagatgcaagactaacctgaggccttatcttttggaaagggtactaaggcaatttggccatccatatatcattcctctaggcaatgttgtgtcgcttgggggtccttgggcttgtagctctaattatatgccttggttttacaagctttcacaccaagtggagactatgtaccaggtggagactactcttgccaggatcgattctagatag

SEQ ID NO: 108472 - DNA, 204 bp, Glycine max
  Peptide Sequence Number=SeqID_225250
atgttttcaaaaccctccaaaaagcagagcaaagatttcgggaacaaaacaatatttgtgatgacttgcaagaagcaaacatcatacattggctttcatcatgtcccctcgatctttgacagagatgcaatgacaatctacatgagagatatgtcgaatcaagctcctatgtttgggttgccacaacttatctcttgcacttga

SEQ ID NO: 108473 - DNA, 288 bp, Glycine max
  Peptide Sequence Number=SeqID_225251
atggcttcctcttcaagctcagttctctctcagttgctccacaacctaaaactccaaaaaactcaactccccttcagaaattgtgatttcagcttaaataggcactcctcgccagtcacactcgctcagcctgaaggtgaagacggtgtgcttagcgagttggcctttgctcagcgcctctatacaacccaacctccttctagaattgtccatgcgcttagccatcagattgggtgcttagcgaatgatgcgcttagccagaagataagtggcttagcgagttcatga

SEQ ID NO: 108474 - DNA, 1668 bp, Glycine max
  Peptide Sequence Number=SeqID_225252
atggcggggcgcgtcgcctcctccaccggccgggtggcgctggtctggctgctgggcggcggcttcgccatgggcgtgggcatctgggccatgcactttatcggcatgctgtcgatgagcctggatatggtgatgagctacgatccgttgcttaccgccgcctcaatggtggtggccgttctcgcctccatctttgccctgtggctggtgtgctcgtccggcgacttgccgtggcgacgactgctgggcggcgcgctggtactgggttccggcgtggtggcgatgcactacaccggcatggcggcgctgatgtttgagccgggcatcagctggaactggggctggattgcggtttcggtgctgattgcgctggtggcttccggcgccgcgctgtggctggcgttcaacctgcgcgaaggacatggccgcgtcacgctactgcgcgtcggggcggccgtggtgatgggctgcgccattgccggcatgcactataccggcatggcggcggcgaacttcccgatgcacagtcacgccacgcatcacggcgtgaacagcgactggctggcgatgctggtcacggtggtgacgctggcgatcctcggcattacgctgctggtttcgatgctcgacgcgcgtatgcaggcgcgcacctcgatcctcgcgcgctcgctggcagaggccaaccgcgagctggcacagctggcgctgcacgataacctgacgcgactgccgaaccgcatcctgctggaggatcgtctcgagcaggcgatcaacaaggccaaccgcgagcgctcgcagtttgcgctgatgtttatggatctcgacggtttcaaagcggtcaacgatgcctttggtcaccacgtcggcgataacctgctgattgcggtaaccgaacgcatgaccgaccagatgaaagggcactacacgctcgcgcggctgggcggtgacgagtttgtgctgctgattgagatcggcgatcccaatgatgccgcagcggtggcggatgcgctggtaaaagccgtggatcgcccgtttagtgtgtcacgctacgagctgatggtgtcgctgagtatcggcatcgccgtttatccgggtgatggcaaggacgagcgcgagctgatgtttaacgccgacgccgcgatgtatcacaccaagaacaatggccgtaacggctacaacttcttccagccgtccatgaacacgctggcgcagtcgcagctgcagcttaataacgatctgtggcaggcgctggatagcaacgagctgcgtctgttctatcagcccaaatactgcgcgccgagcgggccgatcattggcttcgaagcgctgctgcgctggcagcacccgacgcgcggcctgctgacgccggacaagtttttgccgattgccgagaagaccggcatgatcattaatatcggcaactgggtgatcaacgaggcctgccgccagctacacatctggcaccagcagggccatccgcactggtcggtggcggtgaacctctctgccttgcagtttgagcagtgcaacctggtcgacaccgtgacgcaggcgctggaacagcaccagatcccggcggagctactgacgctggaagtcaccgaaaccacggcgatgcgcgatccggaagagagcgtgcgcatcctcaccgagctgaccagcatgggg

SEQ ID NO: 108475 - DNA, 153 bp, Glycine max
  Peptide Sequence Number=SeqID_225253
atggcagatgaggtggttctactagatttctggccaagtccatttgggatgagggtcaagattgcacttgctagaaaagggttcatttatgtgtctgttcctcgtaccagcataactcttgctgaagtcttggttcaatgtttgatggattga

SEQ ID NO: 108476 - DNA, 1032 bp, Glycine max
  Peptide Sequence Number=SeqID_225254
atgggggtggcgattgccggcatgcactacaccggcatggcggccgcgcagttcagcgcgcccggcagcatgcagcaccacggcatggggcaggaggggctggcggtgtgggtaaccatcatcacgctcaccattctcggtctgacgctgctgatctcgatgctggacgcccagctgcgcgcggcgcgtcttgccgcccggctgcggcgcgccaacagcgagctgcgccagctggcgctgcacgataatctcactgcactgcccaatcgcgtcatgctggaccagcagctcagcacgcaaatcaaacacgcgacgctgtatgaccagccctttgccctgatgtttatggatctcgacggcttcaaagcggtgaacgatacctgggggcatcacgtcggcgatcgtttactggtcgccgtggcggaacggctgcgcacccagctggatgcggacattttgctggcgcgcctcggcggcgatgagtttgtcatgctgtgtccgcagtacgcggcaacccaggctgaagcgctggcgcagcggctggtgcacagcattgatgcaccgtttgagctggatcgctactcgctgcgcgtctcgctcagcatcggcattgtgatcttcccgcagcatggccgcagcccgcaggagatgatgttcaacgcggactcggccatgtaccacaccaagcacagcgggcgtaatggctggagcctgtttgaaccggtgatgagcgcggtggcgcagcatcaactggcgctggccaacgatttatggaacgcgctggagtgccaggagatgcgcctgttctatcagccgaaatttcgcgcgggtgggaccattctgatgggttttgaggcgttactgcgctggcagcatccgcgccgcggcttgctgatgccggatatgtttctggcgcgcgccgagaaaaccggccagattgtggcgctcggcaactgggtgattaacgaagcctgccgccagcatgcggccagtggcatgacgagggcaaccgcgactggagcgtctcggtaa

SEQ ID NO: 108477 - DNA, 3116 bp, Glycine max
  Peptide Sequence Number=SeqID_225255
atgatgagcctgcgcgccctgcttctgtggtttcttctggccctgtcgcccgccagcttcgcggccaactcgctgatgatctggccgatcgatcccgccatcaacccacaggaaaaagccagcgaactgtggctggagaatcgcggtaacgccaccaccatcatgcaggtgcgcatcttcaactggcagcagattgacggccaggaacagtatcaaacgcagcagcaggtggtcgccagcccgccgatggtgcggctggagccggggcagaagcagctggtgcgcctgattcgtcagagcgcgccgcccgccggcgtggagcaagcctatcgcgtggtgctggatgagatcccgacgccgcgctcgccgggcgagaatcaggccgggctgacgtttcagatgcgctactcggtgccgctgtttgtctatggcgatggcctgacgcgcgacagcgccaaagccgatctcagctggcgtcaggtcagccgcgacggcaaacgctggctggagctgaccaatcgcggcaacggccacgcgcgcctgagcaacgtcaccgtcggcggtcgcgcgctcggcaacggcctgtttggctatgtgctggctaacagcagccaccgctggccgctgaacagcccgcgctgccgcgcgctgatgaaactgacgccgcctccctgcgcgctggcggtgaccagcgtgctgtgcttttccccgctgagcagcgcagagactttctctgagctgccaccgccgcctgccgtcagccacagcgccagcggccagcaatacatgctggaactggtggtgaaccagcgcgaacggggcgagattgtgccggtcgagcggcgcgacggtgagttctggctgcgcagcggcgatctgcagcgcgccggcattccggcggcgaagctggctggcgaacaggtcgctcccggtcagttgggtgaggttaaagtggaatacgatgaacgccgccagcgcctgctgctgacggtaccgcccgcctggctgccagagcagacgctcggtcagccgcaaaatggcccgcgctatcccggccaggccagcaacggcgcgctgctcaactacgacctctacgctacgcgaaccgacaacgccggttcgcgcctctccagctggaacgagctgcgcctgttcggcccggccggccagttctccagcaacggtgtctatattcagcagcttgcgggtgacacccgcggccagcagcagggttacattcgctacgacacctggtacagcaacgagaacgagaacgccgcgctgagctggcgcgctggcgatttaattacggatgcgctgggctggagcaacagcgtgcgccttggcggcgtgcagatcgcgcgtgacttcagcgtgcgaccggatctggccaacgtgcagccggggccgtggtcgctgaccaatgtgccgttcgtgaacggggcgggcgatgcagtgatcaccaccactgacgcggtcggccgtcaggtgacgacgacactgccgttctacgtctccagcagcctgctgaaaaccggcctgtctgattacgccttctccgccggggcgattcgcgaaaactacggcatcaaaaactttgattacggcgcagcggcggccagcggctcctatcgctacggcctgcgcgactggctgacgctggaatcgcacgccgaaggcagcagtgacgtggcgatgggcggtgccggcgcgctggtgaggctgggcagcctgggggtcatcaacgccgcactggcgcagagccagctggacggcaggcccggcacccagtacagctggggttaccagtacaacaacagctggttcagcctcggcacccagcacacgctgcgcagcgcggatttcggcaacctggcgctggtcggcagccgcggcgatagcgccaacaccagctattcgctcgccagacgcagcgcgcagtacaccgccagcctgtcgctcagccagtacggcagcctcggtctggcgtatctggacatcgccggcggcagcggcgatcgcacccgcctgtggaatttatcgtggagtaaaaacctgtggggcaacagcagcctgtacatctccgccagccgcgaccagcaacagggcgactggagcggcgcgatttcgctggtgattccgtttggcgaacagagtagcgcatcgatcagcgtcgagcgcgatcagcagggacaaagcaatcagcgcctgtacgtgtcgcgcgccatgccgagcgacggcggttttgcttacgatgcgtcatgggcgcatcagggcggcgacagcggcgattatcgtcagggcagcctgcgctatcgcaacaacaagattgatacttccgccggcttttacggcgacgatgacaacaccacgcagtgggccgatttcaccggctcgctggtgctgatggacaaccatgtgttcgccgccaacaacatcaacgatgcctttgtggtggtgaaaacccgctatccggacgtgacggtgcgctacgaaaaccagacgatgggccgcaccgatgacgccggctatttgctggtgccgtccatcagcagctactacggcgcgaagtacgatatcgataccctcgatctgccggctgacatgaccgcgccaaaagtggagcagcgcttcgcggtgaagcgcaaaagtggctatctgctgaatttcccggtggagcgtctgcgcgccgccagcgtgatcctgcacgacagcgacggccagccgctgccggtctccagccaggtgttgcgccgcgatcgcgccaccgaatatgtcggctgggacggcctcgtgtggatggaagatctcagcgccagcaacccgatgcgcgtggtgacgccggacggacgccagtgcgagaccacgctggctatcgctgaggggcagcctaaagcgctgcagacttacggcccactcacctgcccgctgccgcctgccgcgcccggtacggccgtgatgccgccaacaactcacagtcagggatctcgccatgaggaaatttctgttcttgctgctgtggctgctgccggccagcagctacgcgctctgttcgctttcggcccccagcgccagctttggcacgcaaaccacgttttacgtgcagtcgacggcaa

SEQ ID NO: 108478 - DNA, 126 bp, Glycine max
  Peptide Sequence Number=SeqID_225256
atgggagcagaatcaaaatcggagtggactcagtcgagtttgtgcagacttgagcgagttaagagttcaacggtgaggtgcgacagtgaagggatgctctatgagaccgcgagtccacgacggtaa

SEQ ID NO: 108479 - DNA, 1091 bp, Glycine max
  Peptide Sequence Number=SeqID_225257
atggtggtgtatctggcggagatcatgccggctgaagtgcgtgcttcgggcttttcgctggcctacagcctggcgaccgcgctgttcggtggttttacgccagcgatttcgagctatctgattcatgctactggcgataaagcgatgccgggcgtctggctgtcgtttgccgcggtgtgcggcctggtgggtacgctgctgattggccgcatggtgaaacagtatcaggcgcggcacagcgcaacgggaaccgttcagtgcggtttcgcagacctgcacttcacctcaacactcgcttggttggctccttctcccgctggccctcaccctaaccctctcccgcacgcgggagagggaaccgttcagtgcggggaaaagccagctcctgctctgcctgctggccctcaccctaaccctctcccgcacgcgggagagggaaccgctcggtgcggtttcacagacctgcgcttcacctcaacatccgcgcgatcggccccttctcccgctggcgggagaaggcgggggatgagggtgccagccagctcccgtcccaccccgctaaaacgccacatccaccaccacgctatcgctgtaattgcccgctgcgggcgtattctgcgtagtcagaatctgcgccgtataggtaaagttgcgcgtcacggtatccgcgttgagcgatgtcgaggtcgcgctgctccagcggtcgctgccgctcgggccccagcgattagtggtggtggtgcctttataaatatcgtacgccagccggttggtgccgctcgccatctggcgcgtggtgccgctgaaatagctgccgttgctcagtcccacctcgttggtgatcaccatattcacggtgatcggcatcgccgtcccgctgctgctctgcaccgtgccgacgcacacgccggccacgttcaacccggcgcacacgttataactcaccgtcagcgtgatggtggtggtgtaactgccggcggcaatcacctggccaggcacggtgcggaaatagagtggaatgacaaaattgaggctgttgccgagcgccagcagcgcggaagagttcaagcgatagctgccgccctggcgca

SEQ ID NO: 108480 - DNA, 630 bp, Glycine max
  Peptide Sequence Number=SeqID_225258
atgactgaagctcagatcatttcctctcctatgacatctagttgcaagttaaccaagattggttcagatctgttttcggaccctactatgtatcaatcagtagtaggagttctgcagttcactactattacaagacctgaacttagctttgcagtaaacaaagtatgtcagttcatggaaaatcctcatgactctcattgggtggctgttaagaggattctcagatatcttaagggatccttacatcatgggtttcatctaaaacctactgtttcaggtattcctatctctgtgatgctgactgggcatctgatcccaatgaccacagatcaacgtctggagaagccttctatttggtccaaatttgatatcttggtggtctcgcaaacagcaagctgtggcctgatcaacccacaacccagttcttcattcaagaacaatcatatggagattgatatattctttgtaaaggaaaaagttctagctaaacagctgctggtgcaacatgtgcaacatgttcctgcccttgatcaatgggtggatggcttgactaaaccgctctctcccactcggtttttcgacttaaggagcaaactcaatgtgcttgaaccacagtttgagaggaggggg

SEQ ID NO: 108481 - DNA, 213 bp, Glycine max
  Peptide Sequence Number=SeqID_225259
atggaggactttatggcacaaatggcctggccaggattccagccttttcctataaggggaggtgaggcttctacagcccaggagtcgcaactagagccggaggacacaccagaagacactcctggcgccacacctttagaggccacagaggaaggagatgtcactgaggacactgattatgccgcagatatggcagcagtgcagagcacctga

SEQ ID NO: 108482 - DNA, 297 bp, Glycine max
  Peptide Sequence Number=SeqID_225260
atggtgaatcggcaggactttttctcgtcagaagaggagtttcaggtgcagctagccctagctatcaacgcttccaattcggagttccacgaggatcctgagaaggatcagatccacgcggtgacgctgctcagcttgggaggccatcgaatcgattcaacgaggaacagggacgatgtgggggaggttctatcgaggcagtattggatttgggaagttgaggatgattcatcacaaaaaatagaattttttgataagaatctaaagtttctcacaagaactaagacactctcttaa

SEQ ID NO: 108483 - DNA, 717 bp, Glycine max
  Peptide Sequence Number=SeqID_225261
atggcatcggtgtctagtcagcaacagttccgttacacgcagccaccgtcaaaggttcttcatttgagaaatttgccgtgggagtgtacagaggaggaactaattgagcttgggaagccatttgggaaagttgtgaacacaaagtgcaacgttggagcaaatcgtaatcaagcttttattgaatttgcagatttaaatcaggcgattgcaatgatatcgtattatgcctcatcgtcggagcctgctcaagtacgagggaaaactgtgtatctacaatattccaataggcaagaaatagtgaataacaaaactgcagcagatgttgctggaaatgtactgttagttacaattgagggtgaagatgcacgccttgtcagcattgatgtcttacacttggtcttttcagcctttgggtttgtgcataagattactacttttgagaagacagcaggattccaggcattggtgcaattctcagatgcagaaactgctacttctgcaaaggatgctttggatggaagaagcatacctaggtacctgcttcctgaacatatgggaccatgtagccttaagatcacatattctggacattcagacttaagtgtcaagtttcaaagtcacagaagcagagactacactaatccttacctccctgttgctcaatctgccatggagggaagtggacaggtgcagttgctcaactgcaaccttggttag

SEQ ID NO: 108484 - DNA, 552 bp, Glycine max
  Peptide Sequence Number=SeqID_225262
atgcaaatcatcgacaatccacatgtacaacctatacaggtaggcatgcctattagccttactcatgccatcgctccaagttatgtatgtgtcccaaattctccatcttttgcttcatctggttcgaccctccttgatgttgactttgacctagtgatcaagtcttatgattcaccttctctgaggaatgtgtcataccctaatttcatctggggacaattgtttgtcaacatgcgaatttttgccagtaacgttgagctgcttaaagccaattgtcgcacgatcccactgggcccatctaggcccatcaggaagcttcaacatgaagcaaccagctcgcctgggcgagcattttgtttatgcactaagccaccagctcgcctgggcgagcttggtggcaagctcctcctccatttttcctataaaatggcattggaggctgaggggaaggggttcaacacctttggcaatcagatttcacttaaaattagtgaggagaagaagaaagaaggtgaaaatcaaggccgaggtgcttccgtaatgcttctatga

SEQ ID NO: 108485 - DNA, 489 bp, Glycine max
  Peptide Sequence Number=SeqID_225263
atggatttggctcgtgctttggggtttgaccctggtgatcgtgctgagttttgtaaccaagtgaagctctttaaaggtcatccttttagatcccattctttgcttgagagaagggtattgatgtccttggaaaggattcttagtaattggtctgtggagcctgttctttttcctctacccttgaccaaggaagtcatgaaggaccctatggttgttctggagtcctctcaagtctatgagaggactactattgattactggtttgaacaatgcatccaggatggtcgtgaccccacttgtttggtcactagcagggttcttaagtccttggagctgaagccgaatattgggttggctggggaaattgaagagtgggttggaagggttgttgaatatcaaatcaaatctatagtgcagtatctgagtgaggaacccttgtctgttgatcatgttgagcatgctctggatcctgtttataaggtttcttaa

SEQ ID NO: 108486 - DNA, 843 bp, Glycine max
  Peptide Sequence Number=SeqID_225264
atggcaaactctacctgttctaaatccaaccttgatcatttggaagatgctatcgccaagcttttcgagacccaaatgttgatgtctaccaaactcgatgacctctatcagaaattggcggttatggagtccactcaaccttctcctacttcatcttctgcacatccgccatcaccttctccatctgctcagccacaccgaataaaacttgaagttccacattatgatgggtttgacccggtggtttggctcttcaagataaatcagttctttgactaccatgtcacgctggaacacgactgtttgatgatcccctctttttacatggatggtcaggcacttgcgtggtatcaatggatgacatgcaatggccagattacttcttggcctagcctcttgcaggccttggaagctcactttggtccctccaactatgaatatccaacggggtcattgttcaaactcacacaacaaggctctgttaatgattacttgtccgcgttcgaggctttgcctaaccgaatcattggtctcccacctcccttcttattgagttatttcatctctggcttctcaccagagatttgtcgcgaggtggaagcacttcaacccctttcttatacccaagccgcagctctcgggcatttgcaggaagaaaaatttcttgactgccattattcacgccctcgtccatttcctcagagttcctttgttcctcgcccttctcaaaccattctcaacccaactccaccattactaccacctcctccatttttacccacaccaccaaaaccatcagtgcccttcaaactcttgtccctggaggaaatagccataagttga

SEQ ID NO: 108487 - DNA, 774 bp, Glycine max
  Peptide Sequence Number=SeqID_225265
atggagtatccatccttgtccaatttagctaaggaagtcttgaggcagatgaaaagggtagaggataatgttcaatattttgcagcagctgaaagatttggaccgttgatttcacggttacatgatggttctgttggtgtaaagattgagatggcttctctggtgggaaggatgaccttgacaaatagctgtaaagaacaaattgcaaggcaaggtggcagagattcatcatatgagctgaagtcattagctgcttcaacaattgcaaatattgtatctaagccagggcattgggaattagcatctgctgacaagaaaggaaacccaattcagtcagaaattattgttttaagacttttggggcttttaaacagtttgcactctcagtgtcaagtgatgtttcttcgcattctttgtggtattgcatcatctcctcaagcatcagagttagtagccagtcatatcacgtccaagggtggctttggatcggtcataccatttcttgaacatccagaagttgaacatagacaaatgagcttagactcaaacaaacttaaatttctcaaagaaaagctgttaaataaccaatctacaagtgatgagagatcagatgcagcacagatacttgccaatctttccctctcagaaggcgaaatacagacacttttaggaggcgagtttgtggaattgactgcttttaaggtcttctcatactgcatcaagcatgcaggaaggacttataggtctcttgcttcacttcataaggaaccttga

SEQ ID NO: 108488 - DNA, 285 bp, Glycine max
  Peptide Sequence Number=SeqID_225266
atgccgacgtggcaggggaggtacctggcgcgagatgcacctgatgccaccaagaaaccaaaaacaaagagaaaaagtggaatggagggaaggtacctgaaggagacacaagatgtcatggtggcgaaagacgtcaacactagagtggaagaccaaagttcgaagacacaatgcttatacaagtacagacctgagatagagacgccaagagtggagacgaagagggtgctgagacggagaagacgagagcacgggaaaatagggctttggttcatatttttttaa

SEQ ID NO: 108489 - DNA, 2271 bp, Glycine max
  Peptide Sequence Number=SeqID_225267
atggctttgtgttcagtttttctcaatcttcatcttctgttttttgtttgtttgacgatagaagcgttaggtgtggcaaagccttcagtagctagttacctttgccaggagatactggcagagcaagaagctgatagagtgcatggattacctgcgcagcctccggtgaagttcaacaatatggtggttatatcattgtcaatgaaactcaaggaagagcactgttctatttgttttttgaggccactcacaaaccagaacaaaaacccattctcttatggttcaatgaagctggtgagtattcttgatcctgggttggatttgttgttattaaaggtggttcttgtttttcctttggtgcagaggaaatctaggtgcaaattgcttgtcttgaatagaatgccaggagaagaagtattagctcaagaagatgagaggggtagatgttttgagcctgaaacctctgaggatgagtggcggaagtctcgaactagatctcttaggagaaaagcaataactgcttcaactagactcgcttatagtctcaggaagcgtaatacacgtgtagcaaatagtgactttgcttcaattttcatagaagatgtccgtgatgctaacgaggaaaaagctgtgaattcatttcgtcaggtgctacttacaagagatctgcttccagattcccatgatgattatcatgaaatgctgaggtttctgaaagccagaaagttcgacattgataaaaaagtccagatgtgggcagatatgttgcattggaggaaggaatatggagtagattctattttacaggaatttgtatataaggagtatgaagaggtacagtgttattatcctcatggctaccatggtgtagacaaagagggccaaccggtttatattgaaagacttggcaaagttgaacccagcaagttgatgagtgtcacgacagttgatcgatttttaaaatatcatgttcagggatttgagaaaatgtttaaagagaaattcccagcatgttctattgcagcaaagaggcatatagataaaacaacaacaatacttgatgtgcatggagtgaattgggttagctttagcaaagttgcacatgatcttgttatgcgtatgcaaaaaattgatggtgataactaccctgagacattaaaccaaatgttcattgttaatgctagtagtgggttcaagctactatggaatactgcaaaaggcaacaagtttcagagcagactgttacagattatagacacaagccaacttccagatttcctcggcggcagttgttcgtgcccaaatgatggagggtgtcttagatctgataagggaccttggaatgatcctgacattttgaaactattgcattctagagaagcaatgaagctaacaaagtttggaagttcttctgttgctgatggggttgatgtgaagtcatatgccagcaaggttaaaagcactggaatatctgaacctctatcagcgtcagaagtaagattgaatccttcagccttcgtacaatctgttccttctagtgaaaaaagactaggaattaattttgatgcaacacaaaatgttactcacgctcatctgataggagagaaacacagagctctatcatggagaaataataaggacataacatccttttatttctctcatttcccagactctgtgaatgaaacttacctctggaatctattccaggagtggggaaaagtgtgggaggtgtttatacctcaatcaaagaataaacagggtcaacgttatggttttgtctgcttcaaaggtgtggaggacgcaggttggttggagagacaactggataacaaaatctacatagaagggaagaagttgtttgtcaacaaacccaagtttcaaagaggaggtaaaagggaagtgggaagaatagggggtgaagtggttcgagtaaggaaggtatccatgaatcctatggaacccaaacaagccagaatcaacagtacgacctccactagtatgaaatcatacgctgaagctgtcaagcacgaccataagacgaaagagaaggagattacgatgcctttgatggggaagaagggaccagaagttcctgacgtttccgtagttattcaaactgggaaggacaaaactagctggttggataatctctgggtgggccgtttaaaaaatagaggtatgtttgagaaggcggtggatgaggttcaggagatggtaggtatggatgtgaaggtatcatactggggggacgacaccattatcctttaa

SEQ ID NO: 108490 - DNA, 216 bp, Glycine max
  Peptide Sequence Number=SeqID_225268
atgaagcttcattgtaagaattgtgatgacgagagtgatgagcaaaatgacggcgacagcgatgaagtctatttcgttgaagcctttgggaagagacggcaccgtgaggcgccatttggtggaggagattccgattgtggtgcgaaggtacaccgtcaagcctctggtgacagtgacattggaaagcacggaccaaagggtgctaaggctggataa

SEQ ID NO: 108491 - DNA, 462 bp, Glycine max
  Peptide Sequence Number=SeqID_225269
atgaagcacgcttggttgggaaacaccccctctcttactagaggcctaaatgttgttggggaggacaacactatttttaacaaagaagtgtttagtggtatttatcgaaggaacaagattcatagcctatatctccaggatggatccttgaatatacaaccaaaggtagtaaaggatgaggcaaaaatgtactttcaagatttattttctgatgatggcatgtccaaaccttatttcccccggggggaaaggggtagcttcattcctagtaaggggacaattgacaatgatatcttggcccaggaagcacttcactacatccaaaagtggaaagtaaagaagggaatgttagccataaaagttgatcttaagaaggtttacaacaaggtttgtaagctcgagccaggtaggggaggagttagcaacttgcttagaggagtttctggggatttgcaaagctaa

SEQ ID NO: 108492 - DNA, 207 bp, Glycine max
  Peptide Sequence Number=SeqID_225270
atgcagttgaggtttcaacttcaggggagaagctctgtaatgaagggaaaacaagggagggttaaggagacagagggtgttttgaatggagcagtttattctcactgccatggcttcttctcagttcagaagattctcaggctaatttttttgtcatcttccccatatgggtttgcgcatcctgcaaattccacgctgggtgtctaa

SEQ ID NO: 108493 - DNA, 213 bp, Glycine max
  Peptide Sequence Number=SeqID_225271
atgtggttcgttgtgctgcatgtaattggaagtccaggatttacaaaggatcagtttcaccgtcacttatttttggaagcagaacaaagagagttgcgacctatcattgaaaacaaatcccgcatcattcttgtgcatacaagttcaggatacaagtatggttgctttctttatttgcaagttataggactttacaaaagctttgttagataa

SEQ ID NO: 108494 - DNA, 228 bp, Glycine max
  Peptide Sequence Number=SeqID_225272
atggctgctagtgaccaagcaatcttgcgtgatggagcacacatcccaaccaaaagaaacctgttggagctttcatcacaggacgctttgttggccaaaaacaagttgttatctaaggtgccttcagccaggctaagcacgagactggcactaagcctaattccacttgctcgcgctaagcgcgaaggtggtgctaagcgcaacgccataatttcagagcctatttaa

SEQ ID NO: 108495 - DNA, 378 bp, Glycine max
  Peptide Sequence Number=SeqID_225273
atgtccatgaaaaacattgatgggaaacatcaaaaggagaaactaaagaatgccactcaatatgaccttgaacagaacactaacgcactagcatctaaacttatacttagtctttttgaagtaatcaacttcaaaatgcttgaagctatgaagaaaatgtccattagaaaggttcctcataatggaaacctcaaaatgactacctcaaaatggttttacatgttgtcagttcatgacaactgtaaaatgtacctacttgctctagaagcttgtcagttgagcggagtccacctcaacgaccttcttggcattttcgaagaacatgatggacaagttgaagcgttccaaaatagcaacatcaagagatctaattcttga

SEQ ID NO: 108496 - DNA, 255 bp, Glycine max
  Peptide Sequence Number=SeqID_225274
atgacgaaggaagtgatccacggtcacaactctatagcacctcagctctactttttctcttcttcttcttctgcgtttttctctactagtttcaggctgctggatctcttttctctcttctcctgcatggctatttatagaaaaagccatttagtgcaggggaaactcgcccaggcaagctgcttgcttagggctgaagatttgtgcaccgtttctattcgtgttgcacgtggttacatattgctatatatttga

SEQ ID NO: 108497 - DNA, 447 bp, Glycine max
  Peptide Sequence Number=SeqID_225275
atggcacatgcacaacttggacctattgatggctcattgttgcgcttacaacacaatcatatttccaatcaagtatgggaaggagaagagagaatgatttgtccaaggggtcaagctataaagcctttacaaacagatatcggaggatgtttgttgcttctacaatcaggggcatgtgatagcattaaatgcattgtcctatggatagatgacctatctgacgaagaagtacaacaagaacttggatttcctcttgcacaaaagtttggtaccactttcaacactccgccatctgcatacaacccaccaccatcgagctcttcttattgtccattattacctattcaaatgcatgacatgagttatgaggatgaggatgaggatgatgataacaacaataccaacaataatgatgatggccatggtggtgatggtgctcctcaataa

SEQ ID NO: 108498 - DNA, 384 bp, Glycine max
  Peptide Sequence Number=SeqID_225276
atgtctggtgaagaacccataataagagataatgttagtgactttagtgataatgatcaggagcacgatgttcacgaatgtaaagaaccaagcaatcaaaaagagaacatgagtgacaagcatgttgttaagtgtatacaatatggtaatggatgtcattggagggcgagagcatccttcagcaaaatacataggaggtgggagataaagaaaataaatgtgaaaacaaatcctagtatccaaataaaaaccttgattgcagacatgctacaatgcttaagttatattgtgacatacaaaaaggcatgggcagctaaacaggaagcactcaaattgcatttggaagttgggaagaatgatacaattatctgcctatatgaatga

SEQ ID NO: 108499 - DNA, 516 bp, Glycine max
  Peptide Sequence Number=SeqID_225277
atgggtttgtcaggcttaaaggagcactcaaacccggtgacccccaaggcctacactccgaagaatccgtcagggcctctccctcatgattcagaacacaaacctgacaaagaacaagtagaatccaatgaatctaacggcctaccagaggaaaatctcgacactaaggtacacatagaagaggaacgttgcggtagtcaagtagaagagcacttctctaacaaagggcaagggataaacaacaaatggcacaacatagacggcgacaaagccgatgacaacgacagagacaaaggttccggtggagagaatggcaccgaagccgatgcggcattggtcggcgcggagggcaatgagggggaagatgtcgagggtgctgttgccgagggagaggaacatgacggtgtccatgctgggaaagaggttgaggtgcgaggtgagctttgtggtgacgagggagaaatggtgttgtgcggtggtgatgaggatgtagaagcggaggaggatgaagagtga

SEQ ID NO: 108500 - DNA, 375 bp, Glycine max
  Peptide Sequence Number=SeqID_225278
atggctgcagaacatcaaagaattcatcctgctcatgatgtggaggcaccacacagaccattggtgcctcaaaacattgcaaaatatgatgataaggatctacagagacgcgtgctcgaagcggaagtcgttctgagagcttgtgatgagtttgtgagtgattgtgagatcctagagttgaaggagacatcctcaccacttgaatcggggtacaagaacttagttgtgtatgtgtgtcttaatgcggtcttggttgagtttagtcttacaagaagaatctgcggacgaggcttgatcaggactaggctaggctatcatgaggaatcggggtctagcagtccaggagacaacataggaacgcatgaacattgttag

SEQ ID NO: 108501 - DNA, 318 bp, Glycine max
  Peptide Sequence Number=SeqID_225279
atgccgatctctccctgcggaagtattagttgggatctcactcgcaagacacctaatggacccagagaaatccaacagggccctggggtttccagctctggttacaggcctctgtcagtcctacagggtgcttgtccccccagcattggtggcgactccgcgcatttttctttcttggaagacgcacccgtgagcctcgcgtcgccctcccgccgaagggtaggttgcgatagaggtatatggggtaattgtatgggtatctctgctttgaaagcttcctcgagaattttggctagatttgtttccaaaggtgtataa

SEQ ID NO: 108502 - DNA, 108 bp, Glycine max
  Peptide Sequence Number=SeqID_225280
atgtcggatgagtcttccattgagaggtttatggcctcattgattgagggactgaatctctcaaatctatcagatagaggaatcaggattgattccaaacatccatag

SEQ ID NO: 108503 - DNA, 240 bp, Glycine max
  Peptide Sequence Number=SeqID_225281
atgagaaaaagtgacagggcacgcgattgggaaaaacaaggaaatgctttggagaccgagacagtcagaactcccaaggatcaaagaaggaaccctagcatttgtagagagcaaagatccactccgtcggtggccaagccactgggcagcacccaaggacagaaggaacctaggttaattcagtggcttctttcttgcacgcacacatcagaagatagtaaaactaagtcttggatttga

SEQ ID NO: 108504 - DNA, 1071 bp, Glycine max
  Peptide Sequence Number=SeqID_225282
atgaagaaacaaggaattgaagagaatagactccaactactaagagacataagtggagctttcaggcctgggattttaacagcattagttggtgtaagtggtgctggaaaaactaccttgatggatgtacttgcaggaagaaaaactggtggttatattgagggaagcatcagcatatctggttatccaaaaaaacaggcaacttttcctaggatcagtggttattgtgaacaaaatgatatccattccccaaatgttacagtctacgaatctctggtgttttctgcttggctgcgtctcagtaatgatgttaataaggaaacacaaaagatgttcattgaagaaattttagagctggtagagctccacccagtgaggcattttatagtaggccttcctggaataagtggcttatcaacagagcagagaaagaggcttaccatagctgttgaattggttgcaaatccttccattatttttatggatgagccaacaactggtcttgatgctagagctgcagcagttgttatgcgtactgttagaaatacagtagatactggtcgaactgttgtctgcacaattcatcaaccaagcatcgatatatttgaaaattttgatgagctgctattgatgaagagaggtggacaagtgatatatggtggtcctcttggtcgaaattctcagaatcttattgagtactttgaggctattgcaggagttcctaagattaaagatggatgtaatccagccacatggatgctggagatctcttctcctgttgttgagtctcagcttaacgtagactttgcagaattatatactaagtcagacctttatcaaaagaaccaggaagttattaaggaactctgcacaccagtaccaggaacaaaggaccttcactttccgtctaaatactcacagtcatttgttactcaatgtaaagcttgcttctggaaacagaactgctcctattggaggaatccacagtataatgccatcagattcttcaccacaatagttattggtatcatttttggactaatctattgggacaaaggaaaaaagacgtaa

SEQ ID NO: 108505 - DNA, 351 bp, Glycine max
  Peptide Sequence Number=SeqID_225283
atgaaaaccatatccaagtttggtattgtgaaacacaaaattcaccgtactattcttcttgctcacatggaacctaagtctactaagcaagccttggctgatcctacatggctagttgccatgaaagttgaatatgatgcattgattaaaaatgacacttggttgcttgttcccttgccccctaatagagttcctattgactctatcacttatgggttaccacttcgtaatggcattcttgaagaggaggtgtgcatgcaacaacttctagggtttgaatcttctaccaaatcaatggtttgcaagcttcataaggatatctatggcctcaaacaagctccaagggactag

SEQ ID NO: 108506 - DNA, 447 bp, Glycine max
  Peptide Sequence Number=SeqID_225284
atgacttggaatggaaaacataatcgccataaatatgagcatacattgacaattttttcaaagtttctagtccggtgccgccatggccctttaagaagtctcctctccagggcttcaaatacgatttgcccttggagcttcctcgcatcaccccccaagcccgcagccccatcagacctctccctcccatcctgtgcctccaccctctcacccaaaatccctcacacaaatcataaaaaactccttctccttcctctcaatcgtctccctaagccatgcctaaaaggggatccattagccattaagatctctaagtcagagtaccaagctggttgggcagattgcaaaaacatccttcatggaaggttttttctctcaaaaggggatgttcctatcaagatttggggacctgtgggccaagttcttgaccctgtggaagcccattga

SEQ ID NO: 108507 - DNA, 2280 bp, Glycine max
  Peptide Sequence Number=SeqID_225285
atgggagggagaggtctgatggggctgcgggcttggggggtgatgcgaggaagctccaagggcaaatcgtatttgaagccctggagaggagacttcttaaagggccatggcggcaccggacctgctagggcatcaggaagagtcacttactgtggtcacgagttgtcagagttttttcctcaaagaacatgtgcttatattagtcagcatgatcttcaccatggagagatgacagtgagagagacactggacttctctggacgctgccggggagttggaacaaggtataatttgctggcagagttatcaagacgggaactagcagccggcattaaaccagatcctcagatagatgctttcatgaaagccacagcaatggaaggtcaagaaacaagtattgttactgattacattctaaagattcttggattggaaatatgtgctgatactttggtgggagatgagatgaaaaggggcatatctggtggacaaaagaagcgtttaactactggtgagatgctggtaggccctgcaaaagcattcttcatggatgaaatttcaactggtttagatagttccacaaccttccaaattgtcaggtttatgaggcagatggtccatatcatggatgttacaatgataatctctcttctgcaacctgcaccagaaacatatgacctttttgatgacatcatattactttcagaagaaaggaaaggagttgcagactttttacaagaggtaacttccaaaaaggaccaagaacaatactggttcagaagggacataccttaccaatatgtcactgtgcctgagtttgtagcccatttcaacaattacagcattggtcagcaactttctgaaaagattcaagttccatatgatcctaatgaaagccatcgggctgctttagtgaaggaaaagtatggtctctccaaatgggaactcttcaaggcatgcttttcaagagagtggcttttaatgaagcgcaactattttgtatacatattcaagacttgtcagatcactatattagctataattaccatgacagtattttttagaacagaaatgaagcatggtcaacttgaaggtgcaggaaaatattacggtgcactatttttcagtctcattaatgtaatgttcaatggagtggctgagcttgcaatgaccattaatagacttcccgttttttacaagcaaagagatttcctgttttatccagcatgggctttcgcattgcccatctgggtcctcagagttcctctctctctattggagtcaggattatggatcatcctcacttattatactattggctttgctcctgcagccacattcttctgtgtgaatcaaatggctctatccctattccgcttcattgctgcagttggaagaataaaagttgtggcaagcacacttggttccttcacacttttagttgttttcgtcctaagtggatttactgtttcaagaaatgatattgaaccatggatgatatggtgctattatggttcaccgatgatgtatggtcagaatgccatagccatcaatgagttcctagacaaaagatggagtgctcacaatattgatccaaggattcctgagcccacagttggaaaggcttttcttagggccagaggcatattcacgaaagactattggtactggatatctgtcggtgcccttataggattttctcttcttttcaacatttgtttcattctggctctaacttacttgaatccatttggaaactccaaatctattatagtggaagaggaagaccaaaagaaaagcacatttggttcatcctcagtggataaaatggcaacagaagcaacgacagagaagagttcaacttcaattgctaattcgtttgaaggcaccactgatacagagtgtatcataccacctcagcattgttgtattagtaatatgcaattcacttcaagctctcttggcaataaacacaaagataatgtaatcattacaggtattgatatggaagtaagaaacacagcacatggctcaaatcctaaagctgaagaaaatacaaaatccaagaagggaatggtgcttccttttcagcctctgtcacttgtgtttcaagatgtgaattattacatcaatatgccacattttgtaggcctaggatcttcttcatcaatggattcttttgcttcttggaagatgaatgacaacagaatggagaaggaagagagagaggagacgccacttcaagaagaagatgagtctagaagaagctcaccaccatag

SEQ ID NO: 108508 - DNA, 660 bp, Glycine max
  Peptide Sequence Number=SeqID_225286
atgtatgcagctgtttttttccttggagcctccaatactaacagtgttcaacctgttgttgcaatagaaagaacagttctctatcgtgaaagagctgctggaatgtactcagaattgccttacgcaattggtcaggtagccattgaagtaatttatgttgcaatccaaagtctagcctataccattctcctctactggatgattgggtttgaaccacgggttgaaaatttcttgtggttctactacttcatattcatgtgctttatgtacttcacactgtatggaatgatgactgtagctctgaccccaaactatcaaattgctgcacttgttatgtcattcttcatcaacttctggaacctgttttctggttttgttatcccaagaacgcaaattccaatatggtggaggtggtattattgggggtcccctgtggcttggactatatatggactggtaacatcccaagtcggtgacaaaaatagtccaatagaagttcctggctttagaaccatgacagtaaaagattaccttgagaggcagttcggctttcagcatgagttccttggagttgttgcactaactcatgttgccttttgcctcctcttccttcttgtatttgcatatggcatcaagttcctaaacttccagaggagataa

SEQ ID NO: 108509 - DNA, 195 bp, Glycine max
  Peptide Sequence Number=SeqID_225287
atggggagtggcgactccaatggtggttctatagcaattggtacgacgatgcagggagcgaaggaacacaaaggagaaaagtgggaaattgcggaaaaggtgaggttggggaagcatgggtgggggttttcaagtttggggcttgggctagggttagggtttggagaaaaggaagcttttgagtctatgatctaa

SEQ ID NO: 108510 - DNA, 612 bp, Glycine max
  Peptide Sequence Number=SeqID_225288
atggcaaaagaagagggtggcggagaagaaattgtagggtcaatgagtgaaggaaggagtttttcatcccccagaagaagttgggccacagaaagctttcatgaggcagtgagtggagagagtgatgcgtttcacacatgtgaaaaggagatagatgaagaggaagagctgaagtgggaagctttgaggaggcttccaacatatgataggatgaggaaagggattttgaaacaagttttggagaatggaaacgttaactatgaagaggttgacatcaccaagcttggagtgcaggaaaagaagcatctccttgagagcatactgaggactgctgaagaggacaatgagagtttcctcaatagaatgagggagaggattgatagggtggcgattgagattcccaagattgaagttaggtttgagaatttatcagttgaaggggatgcatatgttggaaccagggcgctgccaacactgctcaattctaccctgaatgtaatagagggagctctcggctatatcaagcttttgccacacaataaaagggttgtcaagattctccaagatatcagtggaattgtgaaaccatcaaggtacttaattaatgattga

SEQ ID NO: 108511 - DNA, 414 bp, Glycine max
  Peptide Sequence Number=SeqID_225289
atggttgcgacggtggtagttatcagcctaacagtggtggctccaacagaggtcacagtggtggcagatttgtcaattttaagtgtcaactttgcctcaagtttggccacactacaaatgtctatcactttagggaccaataaagtctttcttcggggagttgttggtgctgatggtctttgctcctttcataatctcaagcttcaagaacatttttcactgttgttgtttacttcaacttcactagttagctctgctacacataatggcttgtctagtgcaattactgctgctagtaaaagtcctaatgtagtttctaattctgtaatttcatcccctagcaatgttagcttgtggcatgctaggctgggtcaccctaatagcccatgtcatgaagctagtcaatcattgtaa

SEQ ID NO: 108512 - DNA, 288 bp, Glycine max
  Peptide Sequence Number=SeqID_225290
atggcagaggctttggttgtggaagtggccgacgcagcggcaatcgtggtcgtggaggacattactctaattttcagtatcaagtgtgctataaatttgggcatactgcttcagtgtgtcattttaggtttgatcaaggatatcaacctaattcatcactttctcttcaagatcctacaagtcaaggcaactccttcttcaacttcctatcacctttctccttctactgcaactgtgaattccattgttcataccagcaagctcagctccttgtgcaaacccatctaa

SEQ ID NO: 108513 - DNA, 480 bp, Glycine max
  Peptide Sequence Number=SeqID_225291
attctattcgagaagatggtcaacacaatcatgattgagaaattcacaaggaagaatagtttcaagctttgccgcatcaagatgttatccttgttgaaagaacaaggcatctgggttcttctctcctatcaatcgtcgaagattgatatgtcagtgcttgagttacaagaggaaaaggcacattctctaattatcttatctctgtctgatgaggttctttataaagttttggaagaagtgactactcttaggctttggctcaaattagagaaactcttcatgacaaaatcaatctacaacaagatgctagtgaaggaatatcttgatgagctaaattctattctgatggagctacatgacactaatgtaaagatggaagacaaagatctaacaatgattttattagcctatctccctcccttctatgcaaattttgtgagtgctcttagtgtaagcaaggattcccttacacttgaagaa

SEQ ID NO: 108514 - DNA, 222 bp, Glycine max
  Peptide Sequence Number=SeqID_225292
atggctctgtatatggctttcaaccttctacaagtcaaggaacacattggcacgatccgagcttcattggcaaaggaaaaacaccaccttgagctattggaaaaggaaaaagggagggagatatgggcaaaccaaagatggtggtttccaattgagatgaaggaattggtgattattgatagtagggagagtagggccaaattggagaatgagagtggttga

SEQ ID NO: 108515 - DNA, 468 bp, Glycine max
  Peptide Sequence Number=SeqID_225293
atggctaaattattttgggtgtgtggggtgaaagcacgggagatgacaaaagaagtgctattccactctagaaggcatcgattgggacgaagtgctctcaatctagggctcgacacgaactcaacgccaccagttctctctatcgccactaccacctccgccaccttcgtcaccacccgctacgagcgtgcatctgatagaattgatgggaggtatcggcggtctttcgcaagcgagagcgttgattctgaagaaaatatgagaactagtattggagggatggttggaaatttttatgtatcttcaagcatactagcttctggcatgcttctgcttttcttgttcaccctgttcgagtttttaaccaagtccttatttaatagggttgtatatgaggaattggggaaatatggagatctggataaccaagttttgtgtcgtgagcaagttgaggaactaggaaattag

SEQ ID NO: 108516 - DNA, 333 bp, Glycine max
  Peptide Sequence Number=SeqID_225294
atggtcctcttggagtacctcccgcgcgtgatggaggaagccgaggtggtgcgtgagcggaggaagacgctgaagctcttcacggcggcggacatgaggatggtgggaatgagaggaagctcggaggaaagagatggtgtcgaagaaagaggggtggttggagaccaaagggagaagctcggaggagagagatggtgtcaaagaaggaggggtggttggagaccaaagggaggagctcgaaagaagttagtaggagagaggggtggtcagagacgaaaggcagaagttcgaaagagagagaagctcagaggagagaggggtgatcagagatga

SEQ ID NO: 108517 - DNA, 144 bp, Glycine max
  Peptide Sequence Number=SeqID_225295
atgacattgtatatctttcaaagtggaatctatagttgcctcatgtggatagctttcctattcatcctggctttagctgaggtagatggatttgcatgtgtatcgttttgcatgttgtcaattgatatcgatgaagctgtttga

SEQ ID NO: 108518 - DNA, 225 bp, Glycine max
  Peptide Sequence Number=SeqID_225296
atggatttacagtttttgcaagcacatgatcttatacttgtggctattggaaggtatctaaaggccttgattgcaactatgtgccattatcagactactgcctctagtttagtgaggagttctgacaatgtgctggagagaatgtttgcattgctcatggagcaagggagcttatggcaagaaatatgcagcttgcctgaaattgaaggctcagttatatcatag

SEQ ID NO: 108519 - DNA, 450 bp, Glycine max
  Peptide Sequence Number=SeqID_225297
atggagcctcaagatactaggctatggtgggctggaagactcttattaaacctaggtagtatggagatagctcattcaagcttcgttaggtgcctaggagagcctctggaaacatgtttggaaactacagttcttgttggcattttgggttggtcctactccataccccccttcatgaaactaaacattgacggaagaaaaagggataatcttgggaggatgggaattggtggcgttttaagggactgtgtaggtcattgggtgttggactttgctaaatctttgggcaaagcagagactccccatgcaaagctattagtggtcaaggtggggctcgaagcttgctggaacaagtccttagtttgtgaaatagattatttggaggtattctcattgttcgacagtagaagtcaaaagtctcattgggatgtctttcatgacggtgactag

SEQ ID NO: 108520 - DNA, 372 bp, Glycine max
  Peptide Sequence Number=SeqID_225298
atgaggctgccgttgttgattctggcgacgccacggtggtggtgggagaattcctcacggatctcggcctcagaaatggtgtgcatgtcatacggaagcttgggtttcttggcggtgccgtttcggtgggtggtgttgtcgttttccgtcagcggtgaccttcctgataaagtttccaccagagtttgtgacgaaggcattgccgcggtggtcgacggtaacgtcattggcggcattgatctcttcggaggggagggaggagaggaagaggcggcagcgagaccggaggtcgtaggcggcgagggcgttgaatggaggaatccgaggaggaagtgttgtggtggtgatggtgtgggtggtgttttggtgtaa

SEQ ID NO: 108521 - DNA, 300 bp, Glycine max
  Peptide Sequence Number=SeqID_225299
atgtggcaaagacaacgatcaacctgtactaaggtcattgattcactgcttaattggtatggccttcatcaactactttttcttatactggtatgtacattggcagagttaattggtcaatcggcggatgaagtcaacgagctcaaaatagaagatggtgatgttgatttaaatgcctctcctcaagcactagataggctattgggttgtttccttgcattcaaagtcaagccatgttgcaagatcaagagttcaatacttgactcgactgaccctacagagcttgaatttgtaagctaa

SEQ ID NO: 108522 - DNA, 495 bp, Glycine max
  Peptide Sequence Number=SeqID_225300
atggctcctattgaatctaaaaaagctaggctgagaggacaaggctctccaagatttactactgatttggtagacaaaaataatgcaaccaggcagcattcaatttcatcctcactcaatggcaagtcaggttcattttccccaagacctaaaaagctgataggcgtgagcggcagaggagggataaggtctttcacggtcactaaatatgaagtggtcttaaaccaaatagctcttgctttcacttcaaaacttccatctcttatgccaacaaggctgcatttgctcgtggatggcctggaaggagtaaccagggtcgacgtcaatgtcagtgaggtcgacgatgtcgagccgagaggatttgagccagctgaggacgtggtcgaaggagcgattctccatgaactagctgcacaggcactagcaagacgctgggaaggtaagagagaaatggaaggcttagggtttcgaaaaagagagggtatcgagaagtga

SEQ ID NO: 108523 - DNA, 396 bp, Glycine max
  Peptide Sequence Number=SeqID_225301
atgcatagtcctacaagatccttcgagggaagtaataactttaaccaatggggttcaccttatcagcctcctaaccaagagcccaccctacaggaggaaactgctaagctagaagaattgctgatacaattcatgcaaaagatcgagtcacatatgaagtggattgatgcaacaataaaaaatttggaggtacaaataggccaactagctgagccagttgctgaaaggctcactgaaacctttgcggcaaatactgaaatgaagcctaaagaggattgcaaggtaattttcactgagagagaagagaaggaaaagaaaactgaggaagatatgcgtgatgaggaaggagaaaagaaggaagaaagagaaagaaatgaggagaaagcacaacaatag

SEQ ID NO: 108524 - DNA, 1783 bp, Glycine max
  Peptide Sequence Number=SeqID_225302
atggtttcctactatggcaaattaaagacactttgggatgagctcgcgaattatgagcagatccctcggtgttcatgtggaggatgcaaatgtgatattgcaaccaaactcgaaaaacgaagagaggaagagcgggttcatcagttcttgatgggcttggatgatgcgagttatggtactgtgcggtctaacatattagctgccgatcctctaccttcattaaatcgtgtatacgcaattctagtgcaagaagaaagggtgagaacaatcagcataacaaaggaagagagaggagcagtcatgggtcttgcagtacaagcaggacataaaagtaagtggagaggagaaatcaaagacaaatcgatggtgtgttctatttgtaggaaagcaggacatgatgataagaattgcttccaagtcgtcggatatcctgacgggtggggtgatcgcccacgaagtgaaggcaaatctagtggcaaaaatcagcaacgaaatgggacttcagctggacgtggcagaggaggcatggcccgagctaacgcaacacacgttgagaaatctgagctgcctggtttaagcaacgaacagtggcaaactcttgttgagatgctaaacaaccgtaagacagatgagattgagaaaatgactggtaagcatcctgataatttgtggataatagacactggtgcttctaaccatatgacagggtatttgaagaatttatgtcaacaaagaacaatacgaggatgtccggtgggattgcctgatggagaaaaagtaattgccaccaaagaagggacggtgattcttgatgggggtctcaaacttgaaaatgtcctttatgtaccaaaattacaatgcaatcttatctctgtgtcacaaatgattgatgaaacagattgtgtagtccaatttacaaaaaaaatatgtgccatgcaggaccgcactttgaagacgctgattggagcgggtgagcggaaagatgggctttatctgtatcatggtgttcgaaattccaaggcttatcataccagtacaaaatatgaccttgatatcttgcacaaacgcatggggcatccatcctttaaggttgttaaattgatccctaatgtaacttgtagtggtaagcatttgaataaagtctgtgaaatatgtgaaagagcaaagcagacaagagaaaaatttcccttgagtacttatcgtgcatcaggcatttttgatttaatacattgtgatctatggggtccttatagaactccttcatcatgtggtgcatcctattttttaacattagtagatgattattcccgttctgtttggatatatttgttgagtgaaaagagggaagtgtctcaaacaatgataaatttctttgctctaattgaacgacaatttgataaacacgttaaagtgattagaagtgataatggaactgaattcacttgtttgaaacaatactttcttgaacatggcattctccatcaaaaatcatgtactggcactccgcaacagaacggaagagtcgagcggaaacatagacatattttaaatgtagcaagggctctaagatttcaagggagacttccaattcgcttttggggtgagtgcattttaaccgcaggttacttgattaatttgacaccatcgcccatccttgatggaaaaactccatatgaactcgtccatggaacctctccttcctatgaccacttgcgcgtgtttggttcgctttgctatgcacacaatcaagatagaaagggagacaaatttgatagtagcagcc

SEQ ID NO: 108525 - DNA, 207 bp, Glycine max
  Peptide Sequence Number=SeqID_225303
atgaccaagttgagaagttcaaggctcaccatggaggttgctccaccaaggtttgtgtcggtgacccggtgccgggtgaagaaaatgctggacatcattaaggaggaagagaatgattttgctgctgacaaacgcttctcttcaccatcttgtggctcttcctctctaagccttgtagagaggccagttttgttgaagaacttctag

SEQ ID NO: 108526 - DNA, 861 bp, Glycine max
  Peptide Sequence Number=SeqID_225304
atggcttctttccaaggcatcaacaacaacattgaaaccctaattccaccagagctcctcataactcagatcatgcaactccatgcaagcatctccaagcttgaaaccctaaggccatgcaagcaagtcaatagcctcttcactcacctagtgaagctttgcaccctcccttcctccattgacattgaatccttgccccaagaggtgcaagacatgcgtgagagcctcattaacctaagtggccgcgccgaggggctcctagagctcgaattctcgaccttcataagcctcacacccgagccaatgaaaaacgtaaccctattcccttactacgggaactatgtcaagctagcaaacatggagagcaaaatcctcacagaaaacggagtggtaaaccctaagaaagtggcctttgtagggtcagggccaatgccactcacctccatcgtaatggccacacaccacatggaatccacccactttgacaactttgacatcgacgaaaaggcaaacgaggtggctcgaaagatcgtggcttcggacgtggcacttgagaagaggatgaagtttgagacacaagatgtcatggaagtgagggagaggttagggcaatatgattgcatctttttggcagcgcttgtgggaatgagtagggaagcaaaagtgaagattttgggacacataaggaagtatatgaaggaaggaggggtcttgcttgtgagaagtgcaaaaggggcaagggcttttttgtaccctatagttgaggaacgtgacatggtgaattttgaggttctcaccatctttcaccccacaaatgatgttatcaactcagttgttcttcttcgcaagcctaaggcttaa

SEQ ID NO: 108527 - DNA, 354 bp, Glycine max
  Peptide Sequence Number=SeqID_225305
atggatcgatctggagctgggagtttccataaaaaaactctttctatttctcacagggccaggatcactaaacaccatgttggccctttggattctcctagcaatgtcagtctcatggagcttgatgggttggatgattctaaggagtaccttgcaactaagagagctatggaggttgttgggataaattcttatgagcaggaactcatatgctccgtgtctatgagttatgatagaaaagttgagaaagctcatgtcttcaaaatggatcgagaggaatatacaaaggaagagacaaattggagttatattgagttcgttgataatcaagatgttcttgatctcgtagagaag

SEQ ID NO: 108528 - DNA, 684 bp, Glycine max
  Peptide Sequence Number=SeqID_225306
atggcaactaattgcataattgcattggttcttcaattgtcaatcacagtgcctgtagctgtttttgtgcttggggtagctgcaggacttgaggtaatgagctacaaaatgctatcaatcatgtctgtgattagttttggtgttctagtagcttcttatggagagataaatataaactggattggagtagtttaccaaatgggaggtgttgttggtgaagctctgagacttatcttcatggagatttttgttaagaggaaaggtcttaagttgaaccctatatccgtgattgcaatttgtttattccttccatggatatttctggagaaaccaaagatggatgaacatggaccgtggaacttcccacctgttttgcttatcctcaactgcctttgtacttttgctctaaacttatcagttttccttgtgattacacatacaagtgctttaaccattcgtgttgccggagttgtcaaggattgggtggttgtcttactgtctgctgttctgtttgctgatacaaagttaacacttatcaatttgtttggttatgcaattgccattgctggggtagcggcatataataattgcaagttgaaaaaagaaacctctcgtgacacctcagatgattccaaccctgaatcttcccaaaggcaagagtctcagcctttaacaagtagatag

SEQ ID NO: 108529 - DNA, 2985 bp, Glycine max
  Peptide Sequence Number=SeqID_225307
atggatgaggaatgtatggttgaaaatggccatgataatgacacaaatgcttacattagggggggtgctagtgaagcaagcaatgaaccccaaagctttgcaccaccactagaaaaacagaattgcatagatgttgtacaatgtagtagtgaaggaccggaaacaagaagcaacattcctcccacctctccacttggaaaaggtcatcggatcaagcgaccgtctgtgaagttaagtgattatgtgaccaacaccatgatcaagttgagcccatctacttgttcctccgcttcatcacatgattcaggtcgagaaccgatgcatttttcagaggccgtacaagatgaacgctggcgagaagccatggcaagtgaaattgaggcactacaaaataacggtacatggaccattactaccttgcctccaaagaagaaagctcttggttgcaagtggatttacaaaatcaagtatcactcagatggaaccattgagagattcaaagcaaggctagtcattttgggaaatcaccaagttgaagggctagactacactgaaacttttgctccagtggaaaaaatggttactgttcgtacagtgttggctgtggcggctgctaaagcatgggaacttcatcaaatggatgttcacaacgctttcttacatggtgaccttcaagaagatgtgtacatgaaactacctcccggtttcatgacagaacacaaaggaatggtatgcaaacttcgtaaatcactctatggtttgaggcaagctccaaggtgctggtttgctaagctttctactgcattgaagaattatggattttgtcaatcttgctctgactattccctcttcactttacggactacaactgtacatcttgtggcgctagtttacgtggatgatcttattgtttcagatattattcttgagactgggttacttggagccaaaccaatgtctcttcctcttgaagaaaatcatcggttagcattggctgagggttcgttgttctctgatcctggtcgttatcaccgacttgttgggcgactcatctacttgtgtttcactaggcctgaactctcttactgtgtccatactctgtctcaatttatgcagcaacctcgcaaagaacattggcatgttgccttacgtgtggttcgatacttgaaagggaaccccggccaaggtattctcttgcgcagcgacaatgatctgaaattgtatgggtggtgtgactcagattgggctggttgtccacttactctggaatatcgctccatggctaacaccatatgtgaattgaagtggctgaaagctattttatctagtcttgttgtgcttcaccctcaaccaattcaactctattgcgataaccaagcagctcttcacatcgctaagaacccgccgtcttatgttcctagtcgtattcagcttgctgatatattcaccaaagctcttgggacaaagcaatttttgttcttgttaagcaacgtcgcattgaatatctcgaccacattgtctctgtacaaggagttgaactcgactcctccaaaatacaggccatgctgcattagccggtctcgtcctctcccaaatccctgcgtggatcttgggcttgattgggccatgactaccacaccagtgctatctctcccagatttcagtgttcctttcgtcatcgagactgacgcattagggtcgagaatgggagctatgttaatgcaacaaggccatccaattgcttttttcagtaagcaattttgccctaaattgcttcattcctcaacttacatccgcgagctacacgctataaccaccattgtgaaacagtggcgtcagtaccttctgggtcacgccttcatcatcctcacaaaccataaaagcttgcgtgaactaatgtcgcaaccgattcagaccccgaaacaacacgtgtaccttgctaagctcatcgcggaagcttttgggattatatcagtgccccaattcaaatttctggatggcctcaagactgaactagatgcgacggaggaattcaagtcccttataactcgcgttcgcaaatcagctctgtatcacccagagttcgacatcaggaataatcttctcctccacaaggtcacatggggttggcaaaaactcttagtcgcctccaacagagtttcttctaggaagccaatcccgtcgtcatcatgcccattggaagatatcgccctggatttcattaccgacttaccaaactatcagggagcaacagtaattatgactgtggttgatcgtttctcaaaaggggcccatttcagaacacgtcctaccgattttacggctcacacaatggcccagatgttcattgatctagtgtgcaagctctatggcttccctaggagtttaatctcccaccgtgaccccattttcgtaagtagattttggagcgagcttttcaggttaagcgacactaaactgtgcatgagcatcgcctaccaccctcaaagcgacggccagacggagtggtgctgcaacaccacatgccattcttccaccaatttatcgttgtatgaggtcacctacggcaagcccccgctgggaattctagcttaccttccaggttcgtcgtcagtggaaatgaaacgcttcgccaactctcatcgttgcgaggttacttttgctattgggtattgggtttacgtaaagttaagaccatacagacagacttcattagccgataacaagtttcaaaagttgggcaaagtgacctatcgattagcactacccccgacagccaagatccatcttgtgttccactgctccaagctaaagcttcatcaaggccccttagtgtcggaccaaccccttccatcagcttcatgggataataaccctatcgtggaaccactgaccatattggatcttaagtgggacaatagcatgccgcctcaactatcagtcttagttcaatggtctggcctgcaacttgaggattcaacttag

SEQ ID NO: 108530 - DNA, 2073 bp, Glycine max
  Peptide Sequence Number=SeqID_225308
atggccctgcagatgacttggcagccgagtctcctgagtcagaaacgcaaaaccggaaccggtcctccgttagggctccgtaacctaggcaactcgtgctacctcaacagcgtcctccagtgcctcacctacactcctcctctcgccaatttctgcctccgtctccaacactcttctctctgtgattcttctgcgtcttcgtgtccgttctgcatactggagaagcagattgcgcgttctcttcgattggatctcacgtacgacgcgccgtctaagatccagagctgcatccggatcttcgcggagaacttccgctgcggccgccaggaggacgcgcacgagttcctccgctacgtcatcgacgcctgccacaacacctgcctccgcctcaagaagctccgccgcaaaggcgccgaggctaatggcggcggtggcggtgacactggcggcggtacggtggtgaaggaaattttcggtggcgccttgcagagccaggtgaagtgtctgtgttgtggatatgagtcgaataaggttgacgagataatggatattagtcttgatgttttccatagtaactcgcttaaagactccatgcaaaagttctttcagcctgaggttttagatggcaacaataagtacaagtgtgatagttgtaagaaattggtggcagctaagaagcagatgtccatacttcaagcacctaacatccttgtgatacaactaaagagatttgagggtatattgggtggcaagattgacaaggctgttgcatttgaagaggttttggtgctttctagcttcatgtgtaaagcaagccagttattgaaaaagcatttttatgcgggtgaacctctcaaggtcttagttattaagcttttaatattcagaaaatccatgagaaataaggaaagcattatgatagaggatccccaaccggaatataagctctttggcactattgtgcattccggctactcccccgaatctggtcactactacgcttatataaaggatgcaatgggtcggtggtattgctgtgatgattcttgtgtaactgttgcaaccctgcaggaagttttgtcagaaaaggtttacattctttttttctctcgaactaaccaaaggccagtggcaagttgtaattctcttgcttcaaatggtgtaaagcctcattccaatgggagccaaacatctgaatgcccaaaggttggtgtaccaccaaaagcagtgcatgtgaaatcaaattctgagctatctccttgtaaggatatgccaagtgtatctaagactgctaaagcaccttccagctcaagagtgaagtttgacattaatggaagttcttctaaaagaaatcctgctcccgtgagtgtgaatgggaaagttgatgtttctaggaatcagccttcagtaataaatgggcatgtgaaagattcagtttctttggagaatggtaagaaagattcttcactacccaccagcaatggcattgacaaaaataaagttgctgttgacaaattgaaaagaaaggagtcaacagttacaaatggacacactggtaatcagacagttgatattcattctgtaaagtcagatctcaaggaagatactgatagaagcagggtaatagcaggtagagtgcctgacaattttaagcatgaaagcaatgacctcaacaacaaacctacaatattggggaataagagaaagctacaggaggacccatgcattttacttgcacatgatggtcagtctcaagcaagagttcaagaactgaaggacattcttgggaaagaggcaaagtcagttttgaggtcatgtggctggacagataaggtctatgaatttatgcgttcaaagaagttacatgcacaggaggctggaaatttgacaaatggagatgaaataagattgggatttttagcatttgttggaacaaaagggatggcgaggcttggcacaacgattaagttgtgccttggtgattggttggtcatgggttcgaatttggaaacaacttttgcatatgaaaggataaggatgcatacgatgatcctccctcataccttcgcatag

SEQ ID NO: 108531 - DNA, 987 bp, Glycine max
  Peptide Sequence Number=SeqID_225309
atgaggatgttgcggtggatgtgtggtaagactcgacaggataaaattagaaacgaagctattagagagagggttggagtagcgcctattgtagagaagatggtggaaaatagacttaggtggtttgggcatgtagagagaagaccggtagactctgtagtgaggagagtagaccagatggagagaagacaaacaattcgaggcagaggaagacccaaaaagactataagagaggttataaaaaaggatctcgaacttaatgatttggatagaagtacgaatgaacagcagtctcacttgccatctgtcatgttccacatcgttatcccacttgcttatcaagaagtgtcccctgatctggcacagctgctcgcaatgcttgtgcagattcttggagcagaacagtgtattgaagttggtgtgtatactggatactcatcactagccttagcattagttctgccagaatcaggtcgtttagttgcctgtgaaagagatgccaaatctcttgatgttgccaagaagtattatcagctagctggtgtttcacataaggtggatgtaaaagttggacttgcaatggattctctagaatctttaattctaaatggtgaagcaggaagctatgattttgcgtttactgatgctgagaaaaaaatgaacgagaaatattttgaactgctactacagctggtgagggttggaggtcttattgtaattgataatgtcctttggcatggaaaagttgctgacccattggtaaatgaccctaaaactttcagcattagaaattttaatcagaagttaatggaagacaagcgtgtaagcatcagtatgataaattctgtcgagttgatttataatattttaactcttttggagagtccaggtacctattggagatgggatgacaatctgtcgaaaaagatgaccatttttgaaaatttgtttggctcctttcagaaggatctgagaactgcctactga

SEQ ID NO: 108532 - DNA, 279 bp, Glycine max
  Peptide Sequence Number=SeqID_225310
atgcataaggaaggtttatggattagaggacagagcagcacgaatcttgcgaaagggaaacggaccaattacatcgtgccatttggccatgacatcagagaagaaagaggggtcaccagcgcgccaccattgtgggcctcttccacgccaccaccactaccgccatccttgtggcggcctcgcatcgcgatgccatgcaccaatggagttagggaggcacgccaccctccgtggtggcttctcctattgaggcctaaatgtaggttgtttcaaccttga

SEQ ID NO: 108533 - DNA, 291 bp, Glycine max
  Peptide Sequence Number=SeqID_225311
atggacatagtcatagaggaagggagtgagactaacgacctgcttcttgccatagttgtcatcactggcaataacaaactcagtggttgttatgaatgggaagctacgtgtgcagcccataaggaaagcatgcaacctgctcaatgttatacttggatttcgagaaccaagtgcctcccagaaattgcagagaagaagaagatgaaagtagcgtatattctcattcctttgaacaccttattacaagctatttataaggcaaggttcttaacagaatatagaatcctctaa

SEQ ID NO: 108534 - DNA, 276 bp, Glycine max
  Peptide Sequence Number=SeqID_225312
atgcataaaagcgaaaaaaggaaggtctctggattagaggacagagcagcacagatctcgaggaaaagaaatagaccaattacatcgagtcatttggccacgacgtcagagaagagagtgggatcaccaggtaactcctcattccctcactctctcacgtttcttctccctatttctctcttcttcctcttctccatttttcttcttcttcttcttcttctcctcctacaaagcctcactgtttgtctcgctggtgaactccatggtcaccagtga

SEQ ID NO: 108535 - DNA, 321 bp, Glycine max
  Peptide Sequence Number=SeqID_225313
atgggggtgttggaatctcaaacttccaatgataaaggcatagtttccaaagagaaaagggcaatgggaattggaattggaattggcaagaatctaaagtgggatttgaattttgctacatcaaggaagaaaaaggtggtcacgctcttggggcgcgttaaggtgacacccttgtttgaagaagttcaaaagtactttcaaaacgctagaaaaggaaaagcatgtcttgtgagcagtgagtccgatcagaatgtaactggtgatgtgtcagtggcattaagtttaggaaattcttttgggttctgcagccgaagatactga

SEQ ID NO: 108536 - DNA, 1338 bp, Glycine max
  Peptide Sequence Number=SeqID_225314
atgaagaagctctcatcaacttcttcttctcatgcatccccttcatcttcatccaccacaagtttggacccaactatgtgcacctccaaaagcgcaacttcagggtgtctcactgctatcttgcgcaaaattctttgctctgatggccttccaagggaccaaattagagaacttgattcatcaaatgcaatgttgagtgacaaagatcaaaacttcaaggctaaacagaattcggagaccgatactgcttctactgctactaccactgctgctaccgttactactactactactactactcctggtatagtggcaagattaatgggtttggaatcaattgagataccctttggaccaaaaccaagttcactttcgcgcagcagatccatgaattctgtggaatatttgggagcatacaatggaatggaggaggttctgcataagagggttaagtccacattgtcttttagggaggctccaacttttcttctacatgaaagtgagaagtttttggagctgagtttcgaaggtggaggtggtaagagtagagaattcagatccaacaggagaaagagggagcctgtttgtgcagaattgaagcagaacgtgcgatcagagagaggtgaattgagggaaaacaagagagaaaaagtgtgtgatgagaaggttttgattgagaaggggaaacttggaaagaaaagggtctctcatgtgtctagtgggagtgttggaagtggtggtaagcttcaagaaatcaccaacactttgcatcattccaaggcttcatctgaaaagaagtgttttgatgattctgaagcagggaaattgtcacagaacatgaagggcaaggaagttgcagttggtgaaaagcagaagaggaggaggaaaaagaagaaaacaatttgtcagaaaaaaaacaagatagaagttgaaaccaaatcagaagattcaagcccagtttctgtccttgattttgagcgtgaagcttgtgcaacagttggtttgagttcaagaagaaaattatcaccaaagcttgacaatgatcagcaccttcctgtgcaatctgatggtaacttgatgattgatgagagtaaggttgaggcaattgacaacaacaaagatgaagggtcaaagaaaaaggagaagaatgaccaggagtatatagatatatggggtgaagtttgcagaatagttgaagatgaattggctgaatcaaataagatacatatatggaccaataaacaaggagatttaggtagcataagtgcagattttgaggcagaaatttttgataacttgctaaatgagcttgtggatcaacttgctggcatccactga

SEQ ID NO: 108537 - DNA, 357 bp, Glycine max
  Peptide Sequence Number=SeqID_225315
atggaaaaaaaggcaaaagggtacttgacagtgaggggtacgaggaaggggtcaatgttgccccatgaacttcctgtagcttctcaactgatacctgcaagctttcgttcattttcttcaacttgggctactaccaatggagcccttcatgtatcagcacaaaggtggaactgcagtgcgtcttcttgttgtttccgtgtcagggaatgcagatgcaaatggaaacgggttctcagatgctgctccaccactgttatgaatgggaagctacgtgcgcaggccataaggaaagcatgcaacctgctgcatgaagcattcatagcgaggaagttagttaggaagtgtcaatgctgttag

SEQ ID NO: 108538 - DNA, 1329 bp, Glycine max
  Peptide Sequence Number=SeqID_225316
atgggggatgagcatggaagacaagaagggttgcatcataaaatttcagctttgcttgagttttcggccgcagatgatgtgacgtctttcaaagatgctgttgaaaaagagggtcatgatgttgatgaggtggggttgtggtatggaaggagggttggctcaaaggaattgtgttttgaagagaggacccctcttatgattgctgccatgtttggaagcaaaagtgttttgtcttatattcttgggacgggtcgtgttgatgttaaccgggcttgtgggtcagatggggctactgcccttcattgtgctgttgctgggggttcttccgcttcccttgaagtcatcaagcttttgctcgacgcatcggcggatgttagtactgttgacgccaatggaaacaggtcgtgcgacttgattttttcggtgtctaatggtgtattcaattcaagaaagaggatactacaagccgtactagaaggtgcagatggtattgatgaggcttgcctcagatttgaggaagcagttggccaaatggagaaacagcaacagcaagatgtagatgcacttcaggtttcaaaagatgggactgagaagaaagattatcctgttgatctctctcttccagatataaaaaatgggatatatagctcagatgagtttaggatgtatacattcaaagttaggccttgctcaagagcttattctcatgattggaccgagtgcccctttgttcatcccggggaaaatgcaaggcgccgtgatccaaggagatatcaatatagctgtgtcccttgccccgagtttcggaagggattctgcagcaagggggatgcctgcgattatgcgcacggtatttttgagtgctggcttcaccctgcgcaatataaaacaaggctttgcaaggagacaggatgcaccagaagagtttgtttctttgctcacaacgtggaggatctccgccctgtgtatgcttcaactggttctgctatgccttctcccagatcatattctgttagttctcctccattggaccctttcacactgggctctccatctgccttgataccacctgcctcatccccacctttgactccgtctggaggatcttctcctgcgggtggaaccatgtggcactctcagattcatgttgctgtccctacccttcagctgccccaaagcagattgaaatctgcgctaaatgctagagatgttgaattggacatggaattgcttggaattgaaaatcatcgatgcttgatgcagcagctaatgatggaggggacggctggtctttcatcaccttctaactggaataactccaatgcctaa

SEQ ID NO: 108539 - DNA, 858 bp, Glycine max
  Peptide Sequence Number=SeqID_225317
atgaggaagacagtgttggactatattgctggggagttgagtaaaaagccgcactcggtcgtctttcttgaaaatgtggatcaagctgatttcctggtgcagaatagtttgttccatgcaatgagagcaggtaaattcccatactcacacggaagggaaatcagcatcaacaatgcaatgtttattgtaacctctagtgtgtttaaaagtagtggctcttttaacttggaggaggatcctaaaatgtttccagaggaaagaatcctagaagctaaaagatgtcaaatgcaattatcacttggacatgcttctgagggtgccaaaaggagtggttgcacaaatgtgaaggttgcagagagaaaagggaaatccaaaacaacatttctgagtaaaagaaagctaatagaaagtggtgatttaaaagataaagcaccatgcaagacactgaaaccagtcagggaggcatcgaggtcctatctcgatcttaatatgcctcttgaggaggttgaagagggcaacaattacaatgatgatgaaagtgaatcaatagttgaaaactctggagcctggttaaatgatttgtgtgatcaagttgatgaaaaagttgtttttaagcctttcaactttgattctattgctgagcaagtaattaaaagcattgacacacaatttcaaaagatgttaggatcagagtttatacttgaaattgagtatgaggtcatgacacagatacttgcagctgcttggttatcagacaagaaaaaatctttggaagattgggttgaacatgttcttggaagaagctttggtgaagctcatcaaaagtaccactttgcacctgaatttgtgatgaaactg

SEQ ID NO: 108540 - DNA, 345 bp, Glycine max
  Peptide Sequence Number=SeqID_225318
atgcaaccaccaacacaaatacaccatgaacaaaacaaatcaagaatcttggcagtgaaaccgccaccatcaacatgtagaaaagataaaatgaagtcaaatcgcactcccccacttataccttctccacatgccaatcaagagagggaagggaagctttgtggttgtaacaatgttctttggggagcaagaaggggacgtgctactcaactccattttgaaaatcgatttatgcaaaggttacaaggtctctatgtctccaacagaggttcatcttctcatgtctatgctcctcaaggcctctattcaaaggttacaaggatcgatttatgtgctaaaacttga

SEQ ID NO: 108541 - DNA, 216 bp, Glycine max
  Peptide Sequence Number=SeqID_225319
atgacggtgtcctcaccaccgacgttgacatactgccaaacaacgtcggtgccactgacgttgtattcttgcattacaaagatgggtcctaggatgaccgatgttgttgttgtcgacatacaacgacatctggaacaaagacggtgtggggcccgtcgtagataccggttttcaaccgatgtagaagcttctttttgtagttgtgaacctaaatga

SEQ ID NO: 108542 - DNA, 273 bp, Glycine max
  Peptide Sequence Number=SeqID_225320
atgattggcagtgctaagatgatggatggactttactactttgagaatactttcaaaaataaagaagctcagggtctaagtgattttattgatcaaacaaatgaaaacaaaggaaatcctatgccagacttaggtggagcccaagcaggaaaagaaataccacagtcaaataaagagtgtcgtgtttatactcggaaatatcctaaaaggataaaagaacagtccatcatctcagcaccaaaccaagaagaatttctggaggaacactactag

SEQ ID NO: 108543 - DNA, 135 bp, Glycine max
  Peptide Sequence Number=SeqID_225321
atgtgggtgatggggacagaaggattgtgtagtgaggccttgtcgcacatgttggagactaaaggccatgtgtgcacggaggctcaaagtcaaggttatgcgcaaaatgagaaaggaggtggcgatgcaatttga

SEQ ID NO: 108544 - DNA, 486 bp, Glycine max
  Peptide Sequence Number=SeqID_225322
atggcggatttaggtggcggatttgcgaaaaaacgccaccgaatagcggtggcgtggcgggtttgggatggcggcgccatggcggccaccatagccatggcggtcgtgacgattatggcggggtggcggaaaatggcgggatttgcttggtttttgtccgcggtaggagttgggccgacccgacccaaccctacccggttatgcattcaattaaatgttgtcccacgccgcacctcacctctgcgtccttccctcacctctgcgtccttccctcaccccgtcgcacccagccgccgccgcgacaggcgacacccgcacagtccgcgcacccaaccgccgccgcccgcgacacccttacacgaagacgaaggccaacttcgcgcgagccccggcaacgcagcctcccgcgaccgcgacgcctcttctttctgtctcgtgaagaagacgaagaagacgaagacgcagacgcgggtcagccaaccttga

SEQ ID NO: 108545 - DNA, 372 bp, Glycine max
  Peptide Sequence Number=SeqID_225323
atgccttcaccagtgcagccaagtcactctccatctgctgaaggagagaaacacaagcaattgaataaagagatcaggggcatgctctctgccatcactcacagggtcacagattttcacaagccaggttcaaccaaccaaatggagaatgatggagaacatgccatcaacaactcggtcatgcttggtggaagttatcaggccaatgatcctggtgtgcacatggatatctcagatttctccactgcgcatgagcatcatcatcaaagtcactaccacaaggaagaaaggcatgggaagaagggaaagaaaatagagaaaaaagcttccaaacccaaagaatcatcatcatcatcatcatcttctgattga

SEQ ID NO: 108546 - DNA, 1265 bp, Glycine max
  Peptide Sequence Number=SeqID_225324
gattgattgtgtaggacggactcaacaaagctatggcctaaatggtgattggaattctgagtttggcaattgttctagtcaatattttgatgtgagacaggcttcaaatatgggaacttgcaatcagccacttgcaatggccagtggtggaggagtggaacaggaaccacacataggccaaaacaaatcatctagcagcatcataagccgtttcaagtctcctgcttcagccttttatgcaacagaaatgtgcatgggtggtttccctcaatatgatagccaaattggcaatccatctttgatgtctcattcctccaacaattttcttccaattgaacaacataagttattcattgatgatgctgccccaattagtagaagcccttcaattccttctaagggaaatcagggtcaaacagtttcttgtggctcattcaatttgccttctgcacagcttagtttttcttctcagcaagagatgctgtctccaacaggtagcatgccaactaattctggaaactctagttcaaatggatcagtagtttcaagtaaaacaagaataagatggactcaggagcttcatgagaagtttgttgagtgtgtgaatcgcctcggaggtgctgagaaagcaacaccaaaagctatattaaggctgatggattcagatggattgaccatcttccaagttaaaagtcatttgcagaaatatagaattgccaaattcatgccacagccaactcaagggaaatctgacaaaagaaccaatgcagagaatgtgcatcttgatgtcaaaactggcttccaaattagagaggcacttcagttgcagttagatgttcagcggcgtcttcatgaacagctagagattcagagaaaattacagttgaggattgaggagcaaggtaagcagctgaagatgatgtttgaccaacagcagaagacaactgatagccacttgattactgagaatagtgatagaccaattagttctaaagatgttctgggtaaggctgcgtacaacatccctcccccataccttcgcatagcgaagagcctctgggcaatgggcaacaacctgaatagtggagctggtggtggtgacaatggttgtagtagttctgaaagaaacaaaaatgatagtggtgattgtagtggccgcaataatagtgtcgtaatggtggtagccattaaaatcaagaacttcttaacaaaaactaaggttgatctagtggtaaacggagaaggaaaagggaaagaggttacag

SEQ ID NO: 108547 - DNA, 594 bp, Glycine max
  Peptide Sequence Number=SeqID_225325
atgattaaagtcaacctgttgccgcatcggcaaatcaggcgtgccgtacgccagcgcgagttcggcctcatggcttcattagtgaccgttccgacggcagccatccttttcgtgagctggagctatatccacaacaaaattcaggcccaacaggcgcgtaaccagcgattgcaggatgaaatgtcacgcctggacaaagagattgcggtaattggcactttgaaagagcaaattaaacatgtgcttgagcgtaagcagattgtggaaggattccagagcgaccgcaaccagccggtgttgattttggatgagctggcgagacagttaccagaaggtgcctttctcaagagcgtcaagcaactcggggacgagattgagctcaagggggtggctgataccaatgcccgtattgcaacgctggtacataacctcagtgactctgccattatgcacagtcctaatctggttgaaatcaaggcgaacaccaatgcgctgggcgtaaaagaatatgagtttgtattacgggtgtcattgaagcgtgaagtcgctcaagaaggcgccgacaagcagaagctcatgccagccaaaggataa

SEQ ID NO: 108548 - DNA, 585 bp, Glycine max
  Peptide Sequence Number=SeqID_225326
atgaaagcggtattgctgtctatcctggcagcagcactgctagtgctgggctatgtattcctgttgagccccaacctcaaggagttgaaggctgaaaaagaaaaagagcaaggcttgcgggatgaatacatggctaaaaaaatacaagccgtgaagatcaaggcttatgagcaacaggtggtggagattcaacgtacctttggtgctttgctcaagcagctgccagataaagccgagatggaccgcttgctgaccgatattaaccaggcaggattgggtcagggtctttcgtttgaaggctttgtgcctatgccggaagtattcgccgagttttacgctgaaaagcccatcaatattaaagtgctgggccactatcatgagctgggcgcatttgtgactgaagtcgccaaactatcccgtattgtgaccctacacaatctgcaaatccaggctgccggtaaagatgacaagcagccgcacaaggacatgctggtcatggaggctgtcgcaaaaacctaccgttacctggatgcggatgaagtggctgcccgcaaagcccaagagagcaaggcagggaaaaaatga

SEQ ID NO: 108549 - DNA, 456 bp, Glycine max
  Peptide Sequence Number=SeqID_225327
atgatacagcttcctctttccaagctttccaatgttggaactactattttcagtcagatgactcaattggcaaatgaaaatcaagccatcaatttatctcagggatttccggattttatgccggatccagaattactgaattacgtggataatttcattaaaaaagggtttaatcaatatgctcccatgggagggatgattggattaaaggaagaaattgccaggaaaattgaaaacagccatcaggccatttatcatcccgactcagaaattacagtaacggcagggggaacacaggctatttttacagccatagccacgttcatcaagagagacgatgaagtgattatttttgaaccggcttatgattgttatgagccgaccgtagaactttttggaggagttatccggcgttttgaaatgaaggccccggattatgtgatcgattggaatgct

SEQ ID NO: 108550 - DNA, 273 bp, Glycine max
  Peptide Sequence Number=SeqID_225328
atggtggttatatcactgtcaatgaaactcaaggaagagcactgttctattggtttttcgaggccactcacaaaccagaacaaaaacccgttcttttatggctcaatggagtgtcaaaatcttcttctcgaactcgctgattactctgtctatcaatgtggtggctgtggtgccgttcttcgagcgaagcataaaggttatgtgagtggtagcttgtcggatgaggggaaggttgtacttggaggagattctggtaaattagaaagttcttag

SEQ ID NO: 108551 - DNA, 153 bp, Glycine max
  Peptide Sequence Number=SeqID_225329
atgcactctatcaacttcttgctctgccagtatctcctggctaaggtgtgcgatatatatccacgcattgaattggctaacggcaaaaccaaatacgccaaatacagtgattcaaaaagcattcaaatgcctaagctacgtcgtatacagtaa

SEQ ID NO: 108552 - DNA, 599 bp, Glycine max
  Peptide Sequence Number=SeqID_225330
tccaacccatttcgtgcctcgacgataattgccgcagaatcgtcgaagtaatcaccaggaagaccaaaaggaaccctcttttgatgggggtgtacgccaaaaccgctctcaggagcttcgttgaagttgtgaagaagaacggtaaaggtggagtcttgccttgtgagcttaacggtttgagcgtggtttcggtggaaaaagagattggggagtttctgagggaaggtgggaggggtgagatgatttttgagcatgtgggtcatttggtggagcatggtggtggtggggttgtggtgtgttacggggagattgaggtttttgttggggggtataaggaagaaggtagtgttgggtttgtggtttcgcagttgacgaggttgttgggggttcatggaggagggaaggtgtggttgttgggggtggcgggaacctctgaggactattctaagttcctgaggttgtttcctactgtggacaaggattgggatctgcatcttctgaccatgacctctgccaccccttccattgaaaaactctaccctaagtccaggccaattacactcatgcaagctggaatggtcgcaatcagtcttcattag

SEQ ID NO: 108553 - DNA, 198 bp, Glycine max
  Peptide Sequence Number=SeqID_225331
atgtatttgagaattggaaaggaacagaaaggaaggaaaagaggagagaatgagtcaatacagtgtattatgggatcaagatatgagaagtggagggtattaattaagtgggctccttctcagttgaatcatcattcgagaactaagaatgcatctctatatccaaccccccaaagcttggctttttcccacaattag

SEQ ID NO: 108554 - DNA, 437 bp, Glycine max
  Peptide Sequence Number=SeqID_225332
atggggtcctttgtgccatttggtgggttcttttctacaccttctgagttcaaaaatcccgtaggccctgctgctacttcaacttctgtttactcctccacgagcttgcctaggttacaaaaggttaatgtggactcagatagaggattggatgtggcaaaggaagtagcagcagagatattaccagtttcggtaccttttgacactgttagtatcactgatgaagcagaccaaataccaaaagtttcaaagactgatatgcatggtacttgggtttctccttcccctaaggccaatataagccttcttgatcccacaacattttcatctgtgactcctgtgaccacagatttgggattgggaacaatttacacatcagctgctcatgagccagacacaccaaaactaagtgatcataagaagcctctccatcactt

SEQ ID NO: 108555 - DNA, 915 bp, Glycine max
  Peptide Sequence Number=SeqID_225333
atgaaagaagaggtgcaaaaagaagttctcaagttacttgaggctgaacttatttaccctatttctgacagtgcttgggtgagtttcgtccaagtggtgcccaagaaagaagaaatgaccgtgatccgcaatgaaaagaatgatctcatcccgactcgtattgtcactgaatggaggatatgcatagactaccgcaagctcaacgatgctacaagaaaggatcactttcctttgccattcatggatcagatgctggagcgcaaatttggtgctgaagtgggagaaatatcacttcatggttcaagaaggaataatgttgggcctcaagggataaaggtggacaaagcaaagattcatgtcattgaaaagctacctccgccattcaatgtgaaaggcataaggagtttccttggacatgcaggattctatcggcgattcataaaggatttctccaaaattgcgagacccttgagcaacttgctgaataaagatgaagtgttcaagcttgatgaagaatgcttgacaacctttcagaccttgaagaatagtttagtgtctgctctaataatagtgacacttgattggactaaagaattcgagctcatgtgcgacgccagtgactatgcagtggcggcagttcttggacaacaaagagataaggccgatttgaagccaagactagttagatgggcccttttgattcaagagtttgatatagtgattaaagacaagaagggctctaggaatgtagtggttgaccacctcttcaggaaagaccttggtttccatatctggccaactacaaagctgcaagtattattccaaatgacctcaactggaatcagtggaagaagttcctccatgatgtttgtttctgtgtctggcatgatccccattttttcaagattggagtag

SEQ ID NO: 108556 - DNA, 504 bp, Glycine max
  Peptide Sequence Number=SeqID_225334
atgaagaataagaaggttgaagcaactggtgtctcgctaagcgaggcactcaactcgcttagcgagttaggagaatatgccaagcatacatgcgctcagcccaccatcagctcacccaacgagtcatttgtctcctctggtgctaagcgcgcctcgctcgctaagccaaaagctaagtttgacgagggatccgagaacgaggtcccaggctccctatgcagcggtgatgtccacaacgcagtcatcattagctccgatctctgcaacatcatcatcaccaacactagaggtatcacccccctacaaaaggtagttggactcctagccaggcaacctgagagagaaattcctttggtgtcatcactagctgctggagagatagtcgatgaaggctatgggccaagagaagttggccatggtagaggctctagggcatggggaagagttgctcctgttgagaagaaggctggccagtgggagaagaggcgattagaggagggataa

SEQ ID NO: 108557 - DNA, 339 bp, Glycine max
  Peptide Sequence Number=SeqID_225335
atggaatcaatgatccctcgaactggctcatcaaaggaaaagctcgaccaagcacttgccactcctgaatggattgatatgttcccttccttcaagcttattaatgtgaaaagatttcattttgaaaacacttggctccttgaactggaattaaatgatgttgttgagcttggttggtctcacctaaatggtcaaaatttcctctcaaaattatctatcacatccgctgaaatgaattcatggggaaaccaaatcagagggaagtattgtaccaaaattgttgaagtcagaaccaagatggaacaaactcgtgaaatgaatgatatccattcaacataa

SEQ ID NO: 108558 - DNA, 150 bp, Glycine max
  Peptide Sequence Number=SeqID_225336
atggcgagttcttacttcttgatcagctcttcagtctcgacattattcttcttcaaggatctcaccatcttcacaatcgaagttcaatcgcatcgtgcaatatttgagggttttggtttataccaacttcaagcctttaatagtgcataa

SEQ ID NO: 108559 - DNA, 381 bp, Glycine max
  Peptide Sequence Number=SeqID_225337
atgcttacaattttttccttcaaaaaatttgttttaggtctcattcttggtttgtccagttctgacgagagcgaagcaaaggcgttattggaccgcagcgttgcggtaagaaagtactcgccggacccttacgcggacttccggcagtcgatggaggagatggtggcggcgcgtcccgagttgatggacgtggcggccaaatggcgcgagctgcacgagcttcttctttgctatcttgcgctcaacccgaagagcacgcacaagttcattctccgtgctttttctgattttctcctcagcctcatatcgcgttcttatttgccgccgcaggatcccggttccggtgacatcgccggcgacggtggtggatgcttgagttag

SEQ ID NO: 108560 - DNA, 105 bp, Glycine max
  Peptide Sequence Number=SeqID_225338
atgacggaggagttgacgccagacgcgaccatggctggagacgcgaccatgtccttcattgttggtgccagcgaagatgacgtaattaatgaggaaggattttga

SEQ ID NO: 108561 - DNA, 429 bp, Glycine max
  Peptide Sequence Number=SeqID_225339
atggagcgtgcaaattcaacaagcaggccacactacgaagattccaaaccaaacaacaacaacaaacaaaaagaaaatgtgtcaccttttgcggcgcagttaatgagggtaatggagcttctggacacaaatcttgaaggaaaagcgaagctgtacaaagaagtaccactaagcctcatatttatgatgagcaacagaaggtacatagttcagaagataaaaggctctacagagatctacgaagtgatgggagaaacgtggtgtcgcaagagatccatggacctgagaacttaccacaagaactaccaggttgaaacgtggagcaagattctgagttctcttagccctaaaggtttgaacgagaacaggaaggtgcacaagttagtgctgaagaagcggttcaagagcttcaacctgacatttgagtag

SEQ ID NO: 108562 - DNA, 135 bp, Glycine max
  Peptide Sequence Number=SeqID_225340
atgaagcgtctttcacgcgcggaagacgcttatggccacgcggaagaacttcgtcttcaacctcgcgcaaaaaattcctcacaaatgtcatctaacctaaggccagcctacgctattcaaagagaaatgaggtaa

SEQ ID NO: 108563 - DNA, 246 bp, Glycine max
  Peptide Sequence Number=SeqID_225341
atggacctctgtgcagcacttgttttgatgggccatctgaaggaagagataaaagattcatcacttatccccaatatggttaaatctacttcttttttagatgcttgcaacctattgaaatgtagcaatgaggttgatgcaaatattgatgagctaagtacaagtcttggtgctgatatagaaacttttcttagaagtcctccaacatccaaacaaaagaagcagaaagttggaagccgagaatga

SEQ ID NO: 108564 - DNA, 1488 bp, Glycine max
  Peptide Sequence Number=SeqID_225342
atggttagaacacgaggtttaggtcgtgacttaggaactggtagaggcagagacttgagtcaggatgcgcatgagcctgaagttcgtcggcgtcattggcctactgcttcagtacattggcaacaggttcatgtgactgaggacgttactcagaaacctaaggatgtgcctcagttgaatgaggatgttcctcatgtgtctgacgctactccggagatgacaagcgccgttgatgttgcggacgcagagggagtggctagtgatggtagcttgggttcacctgctgttgatgagggattccctggtgggccacgcgacccatcagttttgactggttttgctgagcatgtcgcacacagcatctggagtggagaggaacgacccaatctgaagttggtctcccatggtagaaaagtagataaatttgggagactagcgcctgagatagaagacatgattgcagccaccagattgagtccactgatcaggtgttctataatcaccactgatcctggacttatatccgccttcgtcatgaggtggcatagggagaccagtaccttccacctgccaccgctggttacttttgatgcggtggggcttttgacggagctgcttgaggtcacccctgaggaggctatagctgagacccgtcaggctggtgggcctcatgttcggttgtcctggcttcaggacgctttcaaggacctggcccaggaagggggattctcttggggagcggatgcattgatccacttgtatgagcatctgaatgaggcgtcgcagacccctacacgacaaatggccggttacattacactacttcagtgctggatatacgagcacttttcgatggtgcatcagtgcatcgttgatgatgcttatgttgaggcaagcccacgtgcctccaggtggcttacgggtaaggctcatatgacggggatcaagggagccccataccgggcatgtatggaagccctgactgtgactgacattgtcgtctacgttcgaccagagtgggtgcttcgacagttcgggtacattcagaccgtccctccgccgcctgttcgtgatttgttgataggtcatgatatagacgatcggtggctgcactttttagaccatctagtgcccacgagggagatctgtgtagttcctggccaggtggcaccagactacatggattggtttttccggatttcgcacctgttcgtcacgcagaccgaggacggcgctgagccgagacatccgcctaccccacatgatgaggagttcgtcgagccacctatcccggaggttccagttgcgtctgatctccgtacgcattcagtggatttgggagcgatcgctgaggatttggagcgggtcatcaacctcaggatggtcactgaaggcactaacttatatgacatcttggctcgttgcctgatgatagctagaggtgatgccgcagatgaagtcttaggccgcgacaaagaggacgcatag

SEQ ID NO: 108565 - DNA, 213 bp, Glycine max
  Peptide Sequence Number=SeqID_225343
atgtcatggctgcaagttaagggtggttttccattaagcccacaacaacacttccttcatcatttgggtgttcaacctgctggtctgtttgaagaagccatattccttctatggtcttggcttaggggttttgagaaggatttcacagtgcatttcaatcactggtcaagtaatctaccacaaagttttatgtatcagcaggggattgcatag

SEQ ID NO: 108566 - DNA, 2518 bp, Glycine max
  Peptide Sequence Number=SeqID_225344
caacatagccattggtgactctcacacagcaggagccagcacctccccatggttggtttcatcaccttctggtgactttgcctttgggttcctcccacttgaggacactcctgatcacttcatgctttgcatttggtatgcaaagattcaagacaaaaccatagtttggtttgccaacagagacaagcctgcaccaaagggctcaaaagtagtgctcactgctgatgatgggttggtgctcatcactgccccaaatggtaaccagttatggaagactgggggactcactgtgagagtttctagtggtgtgttaaataacactggcaactttgtgcttcaggatggtgactccaacactgtttgggagagtttcaaggactatagagacaccttgctgccttatcaaactatggaaaggggtcaaaagctttcttctaaacttaggaggaattacttcaacaagggaaggtttgtgctctttttccaaaatgatggtaaccttgtaatgcactctataaatttaccatctgggtatgctaatgaacactactatgaaagtggaaccgttgagtccaacatatcaagtgctgggactcaattggtgtttgatgggtcaggagacatgtatgttttgagagagaacaatgagaaatacaacttgtcaagagggggtagtggagcttcttctaccactcaatttttttaccttagagcaactcttgattttgatggggtgttcacactctatcagcatccaaagggttcttctggtactggaggttggaccccagtgtggtctcatccagataatatctgtaaggattatgttgctagtgcaggtagtggtgtttgtggatataatagcatttgtagtttgagagatgataagaggccaaattgtaagtgcccaaaatggtactcactggtcgaccctaatgatcccaatggtagctgcaaaccagattttgtacaggcatgtgctgtagatgaacttagtaacagaaaggatctctatgactttgaggtgttgatagatactgattggcctcaatcagattatgtgcttcaaagacccttcaatgaagaacaatgcaggcaatcttgtatggaagattgcatgtgttctgttgccattttcaggctaggtgatagctgctggaagaagaagttgccactttcaaatggtagagttgatgccacacttaatggtgcaaaggccttcatgaaagtgaggaaagacaactcctccttgattgttcctacaatcattgtgaacaagaataggaacacttcgattttggttggatcagtgcttttgggtagttctgcttttctcaatctcattttgcttggagcaatatgcttgagcacttcctatgtttttcggtacaagaagaagcttagaagtattggcagaagtgacactattgtggaaaccaacttgcgttgcttcacttataaggaacttgaaaaagccaccgatggctttgacaaagtgctaggaaagggagcttttggtattgtgtatgaaggagtcatcaacatgggttccgatactcgtgttgcggtgaaaaggttgaacacttttctcttggaagatgttcataaggaattcaagaatgaactgaatgccattggcctcacgcaccataaaaacttggtccgtatacttggattttgtgagactgaagaaaaaaggttgctggtttatgagtatatgagtaatggcactttagcaagtcttcttttcaatattctggagaaaccaagttgggaactgaggctacaaattgcaattggggttgctagaggacttctatatttgcatgaagagtgtagcacacagatcatccattgtgacataaagcctcaaaacatactccttgatgattactataatgcaaggatttctgactttggattggccaagcttttgaacatgaaccaaagcagaaccaacactgccataaggggaacaaaagggtatgttgcacttgaatggttcaaaaacatgccgatcacagctaaagtagatgtctatagttatggggtgttgttgcttgagatagtttcatgcagaaaaagtgtagagttcgagacagaagataaagagaaagcaatcctagctgaatgggcttatgactgctacactgaaagaactcttcatgccttggttgagggtgacaaagaggcattggatgacatgaagaacttggaaaaattggtaatgattgccctttggtgtgtgcaagaggatcctgatcttagaccaactatgagaaatgtgacacaaatgcttgaagcttcaatgaaatcctttaatggtaattttccaccatggagatgcaacggaagacaaaggagaagaggtgagaggaggcgccatccactagggaataagccatggaagaaggagcttcaccaccaagatgagccttggataagaagcttgaagaggatgcttcaatggatgaaaagaaagagggagagaaagagagaggggggagcaagaaattga

SEQ ID NO: 108567 - DNA, 186 bp, Glycine max
  Peptide Sequence Number=SeqID_225345
atggttgagccagataaaaattgcgagactagggttgaagatgttgcttggccttgctccctttcagagtctgagattgcttggctaatgtattccgatcacattgggatggcaaacgtcaaaaaatattctgaaaagagtgtaggaagcaacttaggaagtgctggaagtaacaaccttggatga

SEQ ID NO: 108568 - DNA, 561 bp, Glycine max
  Peptide Sequence Number=SeqID_225346
atggtaaattttataataaactcccctcacctatcacaagctccccatcggttcctctttgcatcacttagaggcctctctttcgttcactcatgtcggtccaacgcaagtctctattacatcaaaatgaaggaaattactatggatttcagaaataagcaatgtgatcggggttcagtgaaggtcacaaaaataacaccattttcagaaaaagataacctttacaaagtctcttcctctagtcggaaaagatgcaaagataaactgaaactaacaaggaacaagcatagaatcacggttaccttgaagaaaactgtgaatgccagattgggcttcattctctaccgaaactgcgagacaagcttggaagattacacttcgattgaagggttccctcggtgtggggtttcaacagagaacaacggcggtccgtggtggccaccggtagttgtgggtggtggagaagaagcttgggacgttggggaagggttttggaagaaagaaggagaaaggaatgactgttatccaaggctacacaaaaaatatgacttgaaacactaa

SEQ ID NO: 108569 - DNA, 159 bp, Glycine max
  Peptide Sequence Number=SeqID_225347
atggctgagtctgatggctcaaataacaattttagaaagagacactttgatgacaagaaaaagaaaattttgatggtcgtctgggatgactcaaacaatgaaaagagtagcaattcagacaatgagcaagttgttaaacaagtggcctcgataacataa

SEQ ID NO: 108570 - DNA, 201 bp, Glycine max
  Peptide Sequence Number=SeqID_225348
atggcagggtgtagggacgacgaggcgggtcgttacaaggggcgtggcgtaggcgaggagggaggtgaattgggagagctcgggcatggtggagaggagggcaatgaggaccaagttcacagctggcattacatcaacaactgcatacaaggcatacatattgctttagccatggtggaaggggattcggaagagacctga

SEQ ID NO: 108571 - DNA, 390 bp, Glycine max
  Peptide Sequence Number=SeqID_225349
atgtctttaaaagggaaattggttgttaatgatatgctggtagatgaggattctaaaagtgatgaagcatttcgtccaagtacaactgaagaaagtgatgaagatacaaatttggagagaaaggatggtggcgttggagggggagtacggtgcgggggagcaaatcgagatgatgccaaattggaagtcgtgggtgagattcacggagctgaagttgtcagtgacactggcagtggtttgaaggagcatggtgatgagcttgccagaaggggggagggcatggaggtcggactagaagaggaactggaggaggatgtgatagcgaaggatgtcgatgacggggggcgggggcaaggagaggtggttgttagagataggggagcaacatga

SEQ ID NO: 108572 - DNA, 402 bp, Glycine max
  Peptide Sequence Number=SeqID_225350
atggaaactggagggaggacagggttggatcagtggcagcatatgaaacaagaggaacttggagagcatcagcaatttgagaaaccgtgtgagctacggcagatgactgcggaccaattatggctgcaacccctttctcaagtacccccaagtttaaatttggaaatttcacatccaaatgttccaatggacaatgtttgtgtactgcctgaccaagataagggtcggctatgtgggtccttcagcagacccagccctaagaatgcagccaagctgaccactgcagctatcttattctactacacaattattacagggccagaaaaatctataagtctcaaacccataggcctagagcaaagagattctagtgttttctcacatgtgactaaggtgctataa

SEQ ID NO: 108573 - DNA, 351 bp, Glycine max
  Peptide Sequence Number=SeqID_225351
atgatgaacagtggctatgtgtggattgcaagcgatgatgcacttgcttcaacacttgattcattagacccagttgatactaagacaatgaacctcctacaaggggttttggttttgcgtcatcacactcccgatactaatgaaaagaagagttttctctcaaggatgaagagaccaaaaaccaaggagactccaagcttcaattcctatgcattgtatgcatatgatactgtttggttcgtagcccgtgctcttgatgcttttctcaaaaaaggtagtgtcgtatctttctcctctgaccctcgacacaaatggaagcatgttgcatttacaatcgcttcgtgtttttga

SEQ ID NO: 108574 - DNA, 1602 bp, Glycine max
  Peptide Sequence Number=SeqID_225352
atgaagaaatttatggtcttgcaccttctgacatggatttggctatgtggtgttgctcacagcggaaggcctgccagtgtgaacattggtgcggttttttctttcgattctatcataggtagagctgcgaagacggctatggaaatggccgtttctgatgtcaatgaggaccccacagttctcatgggaaccaaactcaacttgattatgaaggatgccatgtgcaatgcttttcttggatcaattggagcttttcaggtacttgagaaaggggttgcagccataattggtccgcagtcatctgccgtagctcacacggtttctcaaattgctgatgctctccaagttcctcttgtttcatatgctgccactgatccaaccctgtcctccctccagtttccattcttcattcgaactacgcaaagtgacttggcacaaatgactgcaatggctgatataattgactttcatggatggaaagaggtcattgttgtattcttggatgatgattatggaagaaatggactatctgctttgagtgatgagcttgaaaaaaggaaattgaaaatttcttataaactgcctttaagtattaagtttgatttggatgaaatcactaacttgctcaatcaatccaaggtggttggtcctcgtgtgtatgttgttcatgtcaaccctgatccgagattgagaattttttttattgcccataaacttcaaatgatggccaaggattatgtctggcttgtcacagattggctctcagctacactagattcattatctccagtgaatcagacctctttcagtgttctccaaggggttgttggtctacgtcaacacattccggactccagcaaaaagagagcttttgtttctcgatggataaaaatgcaaaaagaaggattagcaaatactggtttgaactcttatggaatttatgcttatgacacagtttgggcagttgcacgtgcaattgatatattcatcaaagtacataataatattaccttctcgcttcctgataactataacttatctcatacggtaggaattggtattctgcttgacaagctcaaaatctttgctggtggatctgatcttgtcgacatattgttacaatcaaattttactggtgtgagtggccaacttcattttaattctgacagaagtattgtaagtggtggttatgatattatcaatgtcaatcagatgggaatttctggtgttggtttttggtctaataattcaggattttcagttgtaccccctacagctcttaaaaaaagaaaatataacaggttttcccaagatcagaagctcggcaaagtgatttggccaggtggagtgacagatcaacctcgtggctgggtaattgctgataataccaagccactgagaattggagtgccaaaaagagcaagttttgttgaattcgtaactgaactgccagatagtcatcaaattcaggggtactgcatcgatgtcttcaaaaaagccctagaatttatcccatatgaagttccttttgtattcaagccttttgggaatggcaaagaaaatcccaattatgacgcacttgtgaaaatggttgatgaaaat

SEQ ID NO: 108575 - DNA, 2907 bp, Glycine max
  Peptide Sequence Number=SeqID_225353
atggaggtgctgtgggtcacaaggcatggacgaatgtttgaggggagggtgttgttgctcttggttttgttcttgtggattcccgcacaggtggtggtgggaaggacaagaactaccatcacaaactctactacttcttcagcaccaagagttttaagagttggagcactgtttactcttaattctataattggaagatcggcaaaacctgcacttatggctgctttcgaagatgttaatgctgattcgagtgttctccctggcattcagctgaaagttattttacatgatacaaattgcagtgggtttgttggaacaatggaaggatcagcaaacatgctcttagaattcaggcaatatggatataatcttcctgtcctcgcgcttcttcacatgttgatggaggatgaagtgattgctgccattggtccacagtcctcaggaatagcccatgtcatctctcatgttgtcaatgaactccatgtccctcttgtttcatttggggcaacagacccttctctatcttcccttcagtacccatattttgttcgcagcacgcaaagtgactactatcagatgcatgcaattgcagacttggttgattactacagatggagggaggtaatagccatttatgtagatgatgacaatggaaggaatggaattacagtacttggagatgctctgtcaaagaaacgtgccaagatctcttacaaggctgctttccctcctggtgcgctcaagaaagacatcagtgacttgttaaatggagtgaacttaatggaatcacgggtctttgttcttcatgttaatcctgaaacttttttgaatatcttcactattgctaataagctaggaatgatgaacagtggctatgtgtggattgcaagcgatgcacttgcttcgacacttgattcattagacccagttgatcctaacacaatgaacctcctacaaggggttttggttttgcgtcatcacactcccgatactaatgaaaagaagagttttctctcaaggatgaagagactaaaaaccaaggagactccaagcttcaattcctatgcattgtatgcatatgatactgtttggttagtagcccgtgctcttgatgcttttctcaaaaaaggtagtgtcgtatctttctcctctgaccctaagttgctcgacacaaatggaagcatgttgcatttacaatcgcttcgtgtttttgatgatggcccttcgtttcttgagacaattttgagcaccaatttctctggtctgactggaacagttcagtttgatattgaaaggaatagaaatcatccagcatatgatatcttgaatattggtggttctggaatgcgcagaattggttattggtctaattactcaggtctctcagttgtgactccagaaattttgtataagaaaccacctaacacttcaacaagcagtcagcaactgtatggtgttatatggcctggagaaactgcagctaaaccaagaggttgggtgttccccaacaatggaaagccactgagaatagcagttcctaaccgagtaagctacaaggagtttgtttctaaagacaagaaccctcctggagtaagaggctattgcattgatgtctttgaagctgccataaacttgttgccttatcctgtcccgcgagaatatatattatttggacctggtaatagaaatcctagctatgatgaccttgcaagtcaggttgcactaaataactatgatgcagctgttggtgatgttacaattgtcccaaacaggacaaggattttggattttactcaaccttatatggaatcagggctggttgttgttgttcctgtcaaggagaccaaatcaagtccttggtctttcctcaagcccttcactgctcaaatgtggtgtgttactggtgccttttttatctttgtgggaactgttgtatggattcttgagcaccggcacaatccagagttccgtggtagaccgaagaaacaactcatgacagtcttttggtttagtttctcaacaatgtttttctcacacagagagaacacagtgagtggtcttgggagattggtgctaatcatatggctttttgtggtgttaattatcaattcaagctacacagctagtttaacatccatcctcacagtgcagcaactgtcatcacaaattgaaggcattgacagcttgatatcaggtactcaaccaattggaattcaagaagggtcatttgcacgcaagtatttgacagaggaactcaatatacaaccatcaaggatagttacgttgaaaaatatggaggcatatattgatgccctcgagaaaggaccaaaagatggaggggttgtggccgttgttgatgagcttccttatattgaaatattaatgtcaagtaccaactgtaaggtcagaaccgttgggcaggagttcactaaaagtggttggggattcgcattccagagagactctccccttgctgttgaaatgtcaaccgccattcttcaactctcggagaatggtgacctgcaaaagatccatgataaatggcttttgaaacatgattgttctgcaccagataatgatgctgatttaaataaactatctctgagtagcttctggggtctctttcttatatgtggcattgcatgtctccttgctttggttgcattctccattagagtgctatgtcaatacacaaaattcagcccagaacccgagcaagacgacgaggaaacttcaccaaataggcctactaaaggtaaaaggcttttcagaagcactactagcttcagggacttaatttattttgtggataagaaagaaaaagaaatcaaagagatacttaggcagaagagtaagaaaaggagacgcaacttgagcttagatggccaatctagttcacccacctaa

SEQ ID NO: 108576 - DNA, 276 bp, Glycine max
  Peptide Sequence Number=SeqID_225354
atgagtagttcatcaaggccggtgccgaggagagagagtccatggggagtcaccggagagaatcatcctgaacccaaagctcaccgctgcaatgaccgtgtcgaggacgttattcaggcttgctttgagggaaacccattcaagactgttccgggacctttcaagctcttctggcagtgcatgcgttccaaacccgggtcagattctcatcttctcttgtcttatgaattttgtgaattgattcaacattttgcttcaaaggagccattgttgtaa

SEQ ID NO: 108577 - DNA, 4152 bp, Glycine max
  Peptide Sequence Number=SeqID_225355
atgaataggtttagagagagaaacactagttttagagcgagaaacactgggtgggtgagagatagacttaggagaaaggcagcggcgaggatcggcgacagcccttggaaggtaacccaatgggattccgcaggaaacaggtcacgaggcctgcaactacacaaggtgtctaactggagggaccacaaagacatcgcaaccttctatttcactcgttttggagaagaaattacagaggaggagctatggcaacatttcaagaagtggggagatgtcagggaggtgttcatacccaatcgtagaaactactcaggaaggagatacggttttgtcagatttaaaggggtacgggacgttccatacttggcacggcagcttgatagaatcatcattgggggattgaaactgtacgtcaacattcccaagcatggaagagaaaaaccagcacagggaggtgcagggatcaagttacagagaaacgaagggggcactcaaacacaagctgaccatgctcgacaaccacaccaaacacacccagcttcatacagggaggtgggtgcgtgggtaggacgcctcagaaacccagctacttttgacagattggaggatgatctctggtgggagataggattgaaaatagcccctaaatacataggagatgatttggttctgcttcttggccttagtgaagaggatgaagaacaaattatgcatgggggacaagatagaagctcaccgatgttctattcaatggagaagtggagcccaagcttacgtactgggaataggctggtatgggttcattgttggggaatcccacttcaagcttgggataagaaatacatacaacagatcatgtcagtgatgggagaaatggtggacatggatgacgaggttgaagaaaagcggaggttggacagggcaagagtgctcatcaagacttcatggaggccaactatccaacacaccattcacgtcctcactgctgatgaaacattcgcggtggatgttatcaaggagacaacaagtacatatcacgaaggcatccgagggagaaggagtgtcggggggtcgtctgatgatatcttctccgatgacagctcctatggagatcgccacagccaaacgcatagccaaacccattgcggggatgcggcaacgtcgtcggcggctaacgcgatgccagaagcacacatgcaaacgtcgacggtgccggaaacgcaagttgaacgtggatgtagaaccgacggcggactcgaatctcacggcaccatccttttacccagcggactgtcgaacttcgaatacccagtggataacatcgttaaccagaggacgattgctgaaccacagtgggtaacagcggcgccacacaagtttcaccaaaacggaaacttcgaaaggagggagaaagaaggcctgacagagacccacaatgattcaatagctgctacacctgaccacagcagcataggtgacccgacagagccaaaagatcaatcatgcagcaacggcaaattcaaaaatgtggaggaggatgaagacagaggagtggagacaccacgtgagcagcggatgggtatttgtgaggatattagtgggccaaaccatataaccagcagctctatttgcacccccaatggaaaaatgcataaactgggccttggcccaatagctactaaggcagaaacagaaaataatacctggcaggtgtattccagacaaaagaggtaccaaaagaaatccaaaccaggcctcaatgaatgtaacacagtggaaacagagcaggggagtagtgcacgaaaccagcccctacaaatattggcacgaagggattctgcttattgtgaaactaataactgtgcatcagacatatccaatcataatgggggtaggggaccaaatactgagtcccatcaagacagaatatcagagatgggaagccagcaagagggatcaatgaatatagtctcttacaatgtcagaggcttagggaggggagtaaagtgggcagcaattagaagaatgattaagaaggaaggtgcagacatgatatgcataaaagaaacaaataaagaggtggttgacaaagcaatgtgccaggcactatggggggatgtggaggtctgttgggagatgctgccagctaacaatacagctgggggtattttatgcctatggagtgaaataaatttcaggttacagagtaaaacaattggaaatggattcattcacttgactggggagtggataaaagaggggcaacacattaacatagtttcagtatattcaccctgcgacattcacggtaagagattactgtgggataacataaagcaattgaaggattctttgcatggagggctatggtgtatcctgggtgacttcaacaacattaggcacccagatgaaagatatggcacaggtcagaggatctcaggggatagcagtatcacagaattcaacgattggatacaagacttggagctcattgaggcaccatggattggtagaaactacacgtggtatagaccaaatggggagtctaggagcaggattgacaggttcttggtctctcatgagtggattgaaagatggcctggcagctatcaatctactttggcaagaaacttttcagaccactgtccaatccttcttcgttccaaggtaacagattggggtcctaagccttttaggatacttgattgctggttatcagataaatcctttaaggagattgtgtaccaaagctggaattcgcatcagcaaccaggctggggtgggtatgtcttgaaagaaaagattaagagactaaaaagaaggttgaagatctggaatcaggaacagtttggagatactctcaaaagggttaagaaggtggaggctgaaataaataaactagaggaagacacaagccatagacaactatcttctgaagaagtctcaaaaagaaaacaacttcaagaagctttatggacaactgcgcaagctcatgaatccttgctccgtcagaaggctagatctagatggatcaaggagggagattgtaattctcgctactttcacttgttgatgaatactaatcgcaggaataattccttaaaggggatcatgctagatggcatgtggactgatgagccacataaggtgaaggaggcagttagatctttcttcttgcaaagattccaagaaccagattttcaaaggccaaggctcgatggtatcaattttcgatctatcagtcaccagcagaatagtttgttgtcggcaccttttcaagtggaggaggtagagcaggctatacgggactgcgggagtgataaaagcccaggtcccgatgggctgaattttaaatttattaagaagttctggcagctaatcaaactcgatgttattagatttatccatgaattccatgctaacgggatctttcctagaggctgcaatgcatccttcatagcgctaattcctaaggtggtagatccacagctcttgaatgaatacagacctatctctctaataggttgtatgtacaagatcgtggcgaagctattggcctctcgaatgaaggaggtgatgtcatccatcatagatgaagtccaatctgcattcattgaaggaaggcaattactacacagcgcactaattgcaaatgaggtcattgaagaagccaaaagaagtaacaaagcttgcatcgtatttaaagtagactatgagaaagcgtacaactccgtctcatgggattttctgttgtacatgttaaggagaacaggattcagcccaaaatggtctaaatggatagagggatgtctgaaatccgcttctatctcagtgttggtgaatggtagtccttcgtctgagttccttccacaaaggggactcagacaaggggatccgttagcaccattcctttacaatgtagtagcggaagctttgagtgggttgatgaggaaagctgtggaggaaaacctttatgaaggtttctcagttgggtccaatcaagtcaagataagtatcttacagtatgcagacgacacaatattttttggggaagcatctatagcgaatgttaaagcaataaaggctgtacttaggcattcacattggggccaacccgaggcgctgtcagatgtgggagccaattattcatag

SEQ ID NO: 108578 - DNA, 555 bp, Glycine max
  Peptide Sequence Number=SeqID_225356
atggatccaaattttgatgttcctggatcaggcaatcagttgtttaccatggctatctcaagcaatcagccaacgtggactaagcagacgagtgacaaacaggaatatgagccccaggggtcccattttgtcgttcctggatcaggcaaacaatcgcttaccacgactacctctgctaatcatcagtcgatggcgatcaaacaaacaaacatttaccatgtggagtcgactacccttgggaatcatcggccaatatgggcagaaccaacaacctcaactccatcattgatagatcctaatgtgatagttgatgttatcaagaatcatttcaagattcagctgaagctcattggtaaaccaatttataaaaaactttatctaaaatggatagataaggttgctcctttgttgagaggtgacgaagtccctaacttttctcattctcagtcattgggaaatgcaccatcagctgaaggagaagctgataatgcaagattgtgcaaacctttctcaactgacgaccaaagctataagggtggaacaatgtgtccttga

SEQ ID NO: 108579 - DNA, 360 bp, Glycine max
  Peptide Sequence Number=SeqID_225357
atggctcggcgatcttacaagacggagttggggtgcatagcgtgcgaggagctgggcgagctcggagcggggaagccccactggctggtggagacccctcagctcctctgcgccatcgacactcactccctcatcctcgccaaccgctccaccatcctcctcctctcctggtcctccgactcctccgccgcaccgccgcccctgaagattcgacccgacctctcgcccatcgacgccgagtccatctccgccctcgagtggctcgccttccgtgatcaccgcgtcatcgtcgccggcacctcctccggcaacgtcctcttctattccctccgcggagaactgattcaccgccaggtttaa

SEQ ID NO: 108580 - DNA, 288 bp, Glycine max
  Peptide Sequence Number=SeqID_225358
atgacgaaagagtgggggaggtattcattctacccaaaatcacaagacaacaagagtataatgcaaaacaatggggttagtctaagggctgaatctcaacagtttgctattgtatatgatgacaatccccatgtagcttccatgccttactttggagtcattgaagaaatcagggagcttaattatgtaaaattcactttctgtgttttcaagtgtaagtgggttgatagcaatatcggtgtgcgaactgatgattttagatttgaagaagctcgcttatcaaaatga

SEQ ID NO: 108581 - DNA, 106 bp, Glycine max
  Peptide Sequence Number=SeqID_225359
atgtcggccttcattctgctcttgcacctcctctacttcacttattgctcttgctctagcacaggaaagaatgtaatgagcaatgcaaccaatgaacaacatggat

SEQ ID NO: 108582 - DNA, 804 bp, Glycine max
  Peptide Sequence Number=SeqID_225360
atggcatataacaaccacactctcaaggaatgggctacaccagatgttgtgtatcaaacttggtgtattaaatatcctaagatcgaggttagctatgagctaaagtctagactagcctatttgctgccaaagtttcagggtcttgcaagtgaagatccacacaagcatctgaaagagtttcatgtagtacctcaacagcaacaatataatccttactccaacacctacaatcctggttggagagatcatccaaacttgaggtatggtcctagtccacaacaacagttccaaccctccatcagccaatatcacgctcctcccttcagaccacaacaacaacaattccagcagtctacacctccactttcacaacctgtgcataatagcagttttggaccttccttagaggagttaataaagcaaatggccatcaacaacattcagtttaggcagaagctacaactatcaatcagtcacagtgacaaggttctggcaatattcccacacaaccaattatcaatccaaagggggaatgtgagtgttattaccttgaagagtgatagagagcttccaaagccaacagatgatggtgccaaaattgatgatgtgagtgttgttaccttgaagagtgtcgcaacctacccttcggtgggagggcgatgcgaggctcacggatgcgtcttccaaggaaggaaaatgcacagagtcaccaccatcgtttattcgaggaaaacattaggaaaaaccaaaaggcggcctacaaattttaagagtaaaaggttcgggagttgtttttacgcatag

SEQ ID NO: 108583 - DNA, 969 bp, Glycine max
  Peptide Sequence Number=SeqID_225361
atgcagatacctcaaggctacaaccatgaacctccttctagatcatatgcacctcttgtttgcaagcagaataagtccatttatggtctgaagcaagcttcaagaagttggttcaatatgtttaaaaccacattgacatctcaaaactacactcagtcaaagtatgattacaccttgttcaccaaaggaacaggttcatcattcatagccattttggtctatgttgatgacattgtcattgctagccctaataagataacaattaattctgcaaaaatcatgctccaacactacttcaaattaaaagatttgggtgatataaaattcttccttggcctagaactctcaagatctcaagtaggaatattcatgtgtcatagacattatactatgtcaattttggaggatactggaatgcttgcttgtaagccatcagcagtacctatggaggctgatctcaaattgaatgcaaaatcaggatcacaacttccagatccaagaatttacagaagactcataggaagacttctttacctaaccatctcaaggcacgatatttgttacactgttcacaaactaagaaattcattaatttcatggaaggcaaagaaacagaagacagttagtaaatcatcttcagaagcagaatatagagctttatcatctgtgtcaagtgagcttacttggctacgaaacgatttaaacatcaagacatcatttgcagttgtctactgtgacaacaaagcagtaatccacattgcaacaaaccccacatatcatgaaagaaccaagcacctagagatagatttgtactatgttagagaacaagttggcaaaggagcactaaagctgattcatgtcagaaaacatcatcaactagcaaatgttttcacaaagtctttgcctcgaagtacttttcttagcatcatctccaagctgggcatcgagaatatcttcctcccatcttga

SEQ ID NO: 108584 - DNA, 474 bp, Glycine max
  Peptide Sequence Number=SeqID_225362
atggcttgtggtggccactggtggtcatgggtggtggaagaggagtttctagggtttaggatggagtttagagaaagaggggggggatttttgctggtcacgttgagctgcttaaagccaattgtcgtgcgatccgtaatgtttcgtgatgtttcgaaaggaaacgagccaaaaactcaaaatggagggggtgagctgatcaatttagggggggtgctatttagccttgggcccatcaggaatcttctggaggaagcaacagctcgcctgggtgagcatgttgcttcaagcttaagccaccagctcatatgggctcaagcgagctgggcggcaagctcctcctccatttttcctataaaatggcatttggaggttgaggggaaggggttcagcacctttggcaatcagatttcacttaaattagtgaggagaagaagaaagaaggagaaaatcaaggtcgaagtgcttctgtaa

SEQ ID NO: 108585 - DNA, 336 bp, Glycine max
  Peptide Sequence Number=SeqID_225363
atgcaacagttgaggctcctccgcaaccttcccttgaagaacttattaccttctcaatctgtccagaatcccaaaaatgtgagtgtcattgcattgaggtcgggaaagcagtgtcaagaacctcaaccagcaacatcttcctcatccacaaatgaacctgcccaacttcactctactttagaaaaagatgatgacaaaaatttaaagaagaagcagtatatccctcttccattccctccaagagcaatttccaacaaaaaaatggaagaggcagagaaggagatcttggaaacatttagaaaagtagaggtaaacataccttccagcggtgcatga

SEQ ID NO: 108586 - DNA, 528 bp, Glycine max
  Peptide Sequence Number=SeqID_225364
atgccacccaatgttgcacgcacacctgaagagaatgttgataactccggtcacatacccattaagagcaacaaccccaatctggtcatccacaggtccctcaacccatgggggagacacatgaaagtgcctcctgctatggtggaaagggagaaatttgatcatatagaggaaaggctgagggccattgaaggaggaagagattatgcttttgctgacatggcagagttgtgcctagtgcctgacattgtcatgcctccaaagttcaaggtgccagattttgacaagtacaaggggactacttgccccaagaatcacctaaagatgtactgcaggaaaatgagggcatacgcaaaagatgaaaaattgttgatgcatttattccaggaaagtcttataggggaaaccgtcacctggtatactaatttggaaccttctcgggttcattcctggaaggacctaatggttgccttcattaggcagtatcattacaattctgatatagccctagatagaacgcatctgtag

SEQ ID NO: 108587 - DNA, 1092 bp, Glycine max
  Peptide Sequence Number=SeqID_225365
atggcgcagggcgccgcgaaaggcgccagcggcctgccgctgccgcgtttcgtcagcctgaaatccaaacgcgtgaacatgcgcatcggtccgagcacggattacgccgtgtcatggatgtatctgaaatcggggatgccggtggagatcatccaggaatatgaaaactggcggcgcatccgtgatgccgatgggacggaaggctgggtcaaccaggcccttctctccggtgagcgcacggccgtagcagccccctggatgcggggcaagggcaaggaagtttatgtgaacatgcgccgtgaagcgcagtcgggcgctgccgttgtggcacgacttgagccgggcgtggaagccggcggcgaaaagatcgcccgcacccgtcgtgtcgaccacgtcatgcaccggataggcctccaccttcacacgttccgtgccgcgcaggatgacggcgccttcctcgctcatcgtcaccgccgcgatcttgcagtcggctgcgatcctggtcagcgccagttcgaagtcgttggtttcgtagagcgacagtgcttcctgcttgttggcgaaaacgatgtccaccgtgccggagcgcatcaggtcgagaaactcttcgcggtagcggccgacgcagaagctgtcggaaagcgtcatggagacttcgcggccgttttcatgcgcaatgcgggcgcattcgcggatggcgtccttggcgcgcggcggatcccacaggtaaccctcgaagtaggtgactttcgtatccgccaccacatcatcttccacatcttccggaccgagatcgacgcaggcgccgagataggtgttcatcgagcgctcgccgtcttccgtcacgaagatcatggagcgggcggtcggcgggaaggtgccttccggtttcgtttcgaaatagacaccctgggcgcggatatcgtgctggaagatttctccgagctggtcttccgccaccttgccgaaataggcggccttaccgccgaaattcgctacgcctgctgccgtgttgccagcgctgccgccggaggcttcaagagccggccccataagcgaataaagcagctcggcgcgttccgcgtcgatgag

SEQ ID NO: 108588 - DNA, 470 bp, Glycine max
  Peptide Sequence Number=SeqID_225366
cattcgctaagcgcgacactcagtggctaagcacgaggaagaatccagaagaagatgagctatcaggttcgctgagtgcaccgctccaggtcatcaagcgcaccgcttcagctcatccactaagcaagagaagcgcgctaagacacaatccacctatgcacgctaagcgatccagatttgcgctaaaagcctctgcatgcacgaaagtctggtcttggcttgaagcttttgcatctttaggatgttctagagagaaaaaggtccaagttccaaagagttctaagagattttgctgtgtgaagatctgcagagatgagagctcgaagcgaaagccgaggtttctggaccatggaaagctatatcctctattggatcttccttgtaggtacctaatgattaggctaggctatcatgaggaatcagggtctagcagtccaggagacaacataggaatacatgggcattgttag

SEQ ID NO: 108589 - DNA, 263 bp, Glycine max
  Peptide Sequence Number=SeqID_225367
ggctacacgccctcaccttcagaggactacacgtctgtgcctttagaggaatacatgtcttcaccttcatagggctgcacgtcctcgctttcagagggctccacatctgcgtctttagaggactgcacgtcctcgccttcagtggactacacatcctcaccttcaaaggactacatgtcctcgtcttcagagggctgcacgtcctcgctttcaaagggctccacatttgcgccttcagagaactcaaggtcctccgcccttaa

SEQ ID NO: 108590 - DNA, 189 bp, Glycine max
  Peptide Sequence Number=SeqID_225368
atgtggggttaccttatggttacccacacttttcgtcaaccaggggcaaacgagcccgttgacgcacagagactaacatcgtcttctgcaccttttgtcgtcctgacccgtgaagtcagggttaccatatggttacccgcacctttcatcaaacaggggcaaacgggcccgttgacgcgcagagactaa

SEQ ID NO: 108591 - DNA, 225 bp, Glycine max
  Peptide Sequence Number=SeqID_225369
atgattttgatagattgtttgagtggcggtggggcctggcaaggactccgcgttgcgaattgggagtggatgagccacttgcagcacaagacacgtgtcggtaaaaaccctcaagctcaagtggtggcgtccttagccgtacactcaactgtgacagaatctcctgcctcaaaaatcaaaatcccaatgctcatcactcctttaactacacgccacactatttag

SEQ ID NO: 108592 - DNA, 273 bp, Glycine max
  Peptide Sequence Number=SeqID_225370
atgaagaacgatgtagaagtcgattacggtcgtaattcgcctccctcacacctatttatagcaaaagatgacattaagggtcatggcagctcgcccaagcgagttggagctcgcccaggcaagggagctggttacttcacccctaagctatttgggggcctaggcgagccagaggctagcttgggcgagccaaggttcagaaaaccccttgaaatgacccttttgccctatcctttcggtatctttcacattcttgatcaaaacattgaatga

SEQ ID NO: 108593 - DNA, 120 bp, Glycine max
  Peptide Sequence Number=SeqID_225371
atgactttaggaattagtgccagcactgtatttgcagaagatgcaacaactgaagcatcttctgataatgacccagggggtgacttaatcggattgagaaaaattgaggatgactctgta

SEQ ID NO: 108594 - DNA, 1023 bp, Glycine max
  Peptide Sequence Number=SeqID_225372
gcagaattgtacagggtcaaaaaggcatttgacaaagcagaacccttgtatttggaagctatcaacatattagaggaatcttttggtcctgatgatgtacgggttggggttgctgttcacaaccttgggcagttctaccttggacagcggaagttggaagaagctcgtgttagctatgagcgtgctttgaagcatgtgataatgactatttattcagataaaaaggcgtgttctggggtatggccattcagaatgttcagatacaatgtatcatctaggagtgttggaatttttgctcaaatgaggattttattctacaataattgtgttcaggtactgtatcttcaaggaaaagaaagggatgctgaggcccttattaaggactctataaggatgctagaggaaggtggtgaaggagagtcttttgtatgcattagaagactacgatacctttcacagggatggtatttcttggacactgttattgcagctgaatctttggctctgaccctgcaagcatctggcaatacaaaagattctaaagagcttcttgaaagatgtcttaatgtccggaaggacttacttcccagtgaccatattcagataggtgcaaacttacttcatctagcaagagtggcaatgcttgattgcagtcaacataaaaagttggatgtttctagagctaaagctgagcttgatatggcaaagaatcatttgtataattccataagggagaaacctggtagaacaatcaactacctcaccgcagtgagccattatgctttcaacctccttggacctgcttcgaaggtattgaaacaaaaggacaagttaaagaaattcagtaagcctggagattctagaaaggaaggccaagtagcactggccatattgttgcaatcactctatacgttgtcatcagtggagttagataagcaagaattgcaggagattcaggaaagagataatattaacatcgaggctcaggaggcacttcttcaatgcatttctacttacaaggag

SEQ ID NO: 108595 - DNA, 291 bp, Glycine max
  Peptide Sequence Number=SeqID_225373
atgtcagcgtctttcgaccgacactatgaaaaattctcattcgctatccgtaagaatcaaaggacgatagcaacctgtgacaaacgtcgtccgctgcaacctttccagagatgtcagcgtcttccgaccgacactatgaaaaagtctgatttgctattccgtctttggaccgacactacgaaaaagtcgcatttgctatccgtaagacacaaagcacgattgcaagcagtgaaaaacgtcgtcacctgcaccctttccggcgatgccagcgtcttccgaccgacacaatga

SEQ ID NO: 108596 - DNA, 711 bp, Glycine max
  Peptide Sequence Number=SeqID_225374
atgatttatccaagtcgagttttaaagttaagagttcgtggaacaaagaaagatttgattcaagatacctcctcagaagagttttgtctcattatgtcaggtgtaattgcccattttgatggctctgatattcagaatatgctgcagaaatggtttgaagaatcacactctcgattttgggatcaaaacccaaagagccacgattcagaggattttggaaatactgatgtaaaaataccttaccagttgtggaatattggcaagtatggtacttgtgctgaagcagcaattactggcataatgccacctccacttatggaacaacaacagtcaagtcaacgttattattgtgcagtggctgttggagaggatgctgtaatttcggcatacagactttctgagaacaaaggcaggtctttagtgggagctatcttgtctaaagttgtacctgcaacgttttccacaataagttctttttctaagttgatatggcgaagtgaacagtcgtctccaaagaaatcagatcagaagcctcagccatttgctcgagcttcacctctgacatgtttaaaggatcaccctaggaaaggtgagaagcttaccttatcaccgagtggtacgttggctgctataacagattcacttggtcgcatattgctgcttgatactcaagcacttgtggtggtgcgcttatggaaggtttgcttttga

SEQ ID NO: 108597 - DNA, 165 bp, Glycine max
  Peptide Sequence Number=SeqID_225375
atgctggtgtatgagcacattccaaatggcactttgatggatagtctctcgggaaagtctggaatctggatggattggataaggaggcttaaagtagcattaggtgcagccaggggtctggcctattttcatgaacttgctgacccacctatcataacttattaa

SEQ ID NO: 108598 - DNA, 300 bp, Glycine max
  Peptide Sequence Number=SeqID_225376
atggcacccgaggttgtaatgaatacaaatggctatagtcttcctgttgatatatggagtttgggatgcacaattcttgaaatggcaacatcaaagcctccttcgaatcagtatgaaggggtagctgcaatatttaaaattggtaacagcagagatatgcctgaaattcctgagatatgcctcggatcttgggttcttgagctctcgtctgaacggcctcagaatctgcttccccaaattgccacccacacccctcactgcttctcccttccccacacccctccctatcgttgccagtga

SEQ ID NO: 108599 - DNA, 369 bp, Glycine max
  Peptide Sequence Number=SeqID_225377
atgggatataccagtggccgaatgaataatggcacgaatgtattgttcgagggtgcggttgaagacctttgtttggtcgtcggtcttcggatgagcgaggtcttctcagatagaggatggaataggaagaggttgaagcaggccagccggcttgcagctagtgtctcgctaagcgaggcttgtgcacttagcgaggatcatgcgctaagcgaggcattcagcctgtttagcgagttgggagaatctgcaggaaaatctgagaagcatctgcacgctcagcgcatcatcagctcgctcagcgaggtgtttgtctcttccctcgctaagcgcgcccagctcgctgagcggattttcactaactcgcgctaa

SEQ ID NO: 108600 - DNA, 537 bp, Glycine max
  Peptide Sequence Number=SeqID_225378
atggagcattctctgaatccttctatgggaaaagcagtgtctggcagtgccaatgaggaaagtggctggacttcttacttcgaagaattctctaaaggcatggagcagcaaagttactgttccaatttaggtggctcctctttggtctcagatgctgcttcttgtgctgcatggaaactctcacatcacaatcaccttgtttcccacccttctaataataatgttgtctctaagaaacttcgtttcaagaaaacaagaacccaacagatatcagatgatgatcctttggaggacactgctagctccccagtcaatagtcccaaggtaggagtcttgaaagtttctagcaagattgataatcaactagatggttgtacttctaggggtaaggagtttaactcagagcatcatccgaagctgcaggctgatgaatgtgacataaattttaatggaaacaatattgagtgcaacacaaacttgaagaaaaagggtctctgcttggttcctttgtccatgttggttaattattatgggtga

SEQ ID NO: 108601 - DNA, 522 bp, Glycine max
  Peptide Sequence Number=SeqID_225379
atggcttctagaggcctaaaaatttgcttggctgtgtctctactcttgttgatcatttttacaattgcaattgtgaccttatttatgaccatctttaagcccaaaaatcctgaaatcactgtccaccctgttggtctagaagactttcaatcttccttttcacccaatttgaccctaaatgtgactctaggcatgataattactataagaaatccaaactatggaagcttccagtacataaactccactagttatgtgaaatttcatgataccgtggtagctgaagttccaattgaagcagagttagtcccagcacgtagccaaattaatgtgaacacttcagcagattttatggtagcaaagttaatcaatgatcctaattttttgtcagatgttctaggtggaactttgaatttcacatcaacaattgcacttcctgggaaagcccgaactacatttgtattggagtatatatatgccttctttggcattaaagaatatgccggtatcatgtacaagtag

SEQ ID NO: 108602 - DNA, 1263 bp, Glycine max
  Peptide Sequence Number=SeqID_225380
atgtctgagctcaaagtggcaaaggagaaggaggtgaataaggagcttgaggatgagctcttaatatttaagaaggaggttgtggagcagcacgagaagggatttttcaagtccgtcaggttggcaggattctttgttgagggtcttgagtttagcctctttgacccatttaaagatgtaaaggacgggcaactgcttgacgaggacaagattgttgttggggaagaggacgacgaactcaacaagataatatttgatcatctcaagtttgatttcaacttggttgaaggtcttgccagtcatctcgggcttgttggctgtgagactaactcgagtggcatggcgaaccttaggcgtagagaggcttatcaagagtggaccttgggtttgacaagcttttggagattcgaccaaggacacgtttgtcctgggtttggcgagactcacccagggtggaccttgggtttgacaatcctttggagattcgaccagggacatgtttgtcttgggtttggtgaggctcaccaagggcggaccttgggcgagctgagcttgcctaagcgagttggttacttcaccatgaagttatttggtggcccaggcaagccagaggctagcctgggcaagccagggcccttagacttgtcaagtctcatgcatagggctttaaggatgaccctgtttgctgcttctacttggcctgcctttgttagtgacaatggcgtagggaagattgcatctgcatgtgaggtgcttccagttaaggacatcagccttgagtgtcggccaataatagccaatgtgtactaccttggttgccagggagcgcccccctatgtgaaggccatagattcctacatgcaactctctcatgttacagtctgcttgctggctgtacaggaagctcaacaattggatgtcggacgcgccatccatgagcttatcgatcttaggcaagggatatgcatccttggggcatgctttgttaaggttggtgtagttaatgcacatgcactatttctcattggccttcttttccatgataacattaagcaaccaggtcaaggtgtagaagcaaagcttcatggtgaatcaaagaatcaagaagaattcaagactcaagaagaaagtttagagtcaagaatcaagattcaaggttcaagatctcaagaatcaagatcaagattcaagactcaagattcaagaatcaagagaaggcttaatcaagataagtatgaaaagtttttctcaaaaattgagtag

SEQ ID NO: 108603 - DNA, 324 bp, Glycine max
  Peptide Sequence Number=SeqID_225381
atggacatactagggtcattgccaaaagccccaaggcaagtcaagttcttgctagttgtcatcgactattttaccaaatggattgaagcaaggccactatgcaatcttccctacgccattgtcactaacaaaggcactcaatttaaggcccaagcctatgaagaattcctatcaaggctgggcattaagcactttgtaacgtccgtcgagcatcctcaaacaaacggccaagtagaagcagcaaacagggtcatccttaaagccctatgcatgagacttgacaagtctaagggcctgcggaaagcaccccccaatatactatga

SEQ ID NO: 108604 - DNA, 210 bp, Glycine max
  Peptide Sequence Number=SeqID_225382
atggcattaaagtgtacacgtcaaccctcctcatcggccttagatccagagcgtcagtgctacttactcaacaaccaggtacccttgttattcctccaatggaggatacctgcaagattgacacaggagatcatggagcccattctaatgacggtttaccctattgccagtttgctcaagattttgggatatattggattaggattttaa

SEQ ID NO: 108605 - DNA, 240 bp, Glycine max
  Peptide Sequence Number=SeqID_225383
atggcggcacgtggcggcgggggagtggtttgcgacattgaggtacaggttgttgaggttgacgccgcagtagtaattgagaataaagcaacgaaagaagctgcaatggaagaatgttctaaagaacgctactacatcttgatccgtttggtccaactagaattgcgtccacttgtggaaagaggtatggacttgtcgtattcgacgactactctagatggacatgggttatgttcttaa

SEQ ID NO: 108606 - DNA, 246 bp, Glycine max
  Peptide Sequence Number=SeqID_225384
atgggtggtcgcgggggaatttttatcgcttccccacagtgggcgccaaatgtacttaccaaattcgatgctcaacttgataaaaggataacaacattatcattaagattcaaatatatcgaaagtttgatggcccaattacctagctgctcagcaagtagcactgactctctggatctagggctatcgaggagggttgacgtgtacactttaatgctgcgtcacttgctatgtcatttgtgctag

SEQ ID NO: 108607 - DNA, 489 bp, Glycine max
  Peptide Sequence Number=SeqID_225385
atgaggaatctcaatcctaaggtggcattacattccatgttgctggcactacaacctagcaagttcatcaacaattgtacaagaaacatcccaacagcatggaagagttacatgagcatgctaagggctacatttagatggaagagatatcgaggttctaaaatgaagttcgataggctagacaaaagcgtgagaaaggggaaggacaagcgtcagcctcttccaagaggacccatctacgagcattatacacccttaacgaagaatcaagccaccacccttgaaatagctttcaatgtggagacagttaccccccatacctgctcccagacctggtctcgacaaaaccaagcattcaaataccatcacaaccatgaccataatactaaagactattgggccctcaaggacaagatcgaggaactcatacaggccaaaaacctagcacaattcatgaaaaagcccgatgataaccgaactggaggttga

SEQ ID NO: 108608 - DNA, 489 bp, Glycine max
  Peptide Sequence Number=SeqID_225386
atggctaataaaggcctcaaattttgtttgatcgtgtctctactcttcttgatcattgttaccattgtgattgtgaccttgtttttcaccgtctttaaacccaaggatcctaacatcactgtccaccctattggcctcgaacactttgacttttcccttttacccaatatcaccgcgaatgtgagtttaggcatggtgatcactatagagaatccaaattatggaagcttcgagttcacaaactcgattggtcacatcaattttcatgatactgttgtaggcgaagttccaattggggcagagttggttccagcgcatggccagattaatgtgaacacttgggcaaattttatggtagcgaagttaatcagtgttcccaaattttggtcagatgttctaagtggaactttgaatttcacatcaacatcttcactgcctcgcgatcgctcgcatgttcaagattttcaaattgaaggccacggcctatag

SEQ ID NO: 108609 - DNA, 243 bp, Glycine max
  Peptide Sequence Number=SeqID_225387
atggacgcaccacgtggagactgcataggactcactcaaggaaaggtgcaacttcacactccacctcctgaagcaccaccgccatgcgctccactcgccatacctcgagcacatgacctcacacgtcgaggagttcgagctcgtctcaggctagcggaggctattcaccaaccacacccccgcttctggctcgttcgagtcaggttgggtcttcatccccttctgtcacttgtccacctttga

SEQ ID NO: 108610 - DNA, 732 bp, Glycine max
  Peptide Sequence Number=SeqID_225388
atgactcctaggtcgacagctacaaaatcaaaaccgtggagctggaggggaaaaccgtcaagctacaaattttgcagtgttcagatgctcaggttttttggaataggttacgactctcccacttttgccactgcaatgtttgatttaatccctgcttttaccttcatacttgtcatcgtcttcagtatggaaaaattggattggaaagctaacagtactcaggccaagtccattggcacattggtatcaatcgctggagccttaataattactctgtacaaaggccaagcagtcataaagaatcatccatcaaataaattgttccccaaaaaacatgtttcatctgagcaatttgactggacatggataattagaaattaccttgcagagcttgtgatagtgctcactcacgctattgcattgcaagcaataattggtgtatcccttcgaagtattgttcatatatgggtcatgagcaagaagggccctctctatgtggcaatgtttaagccaattggaatcatctttgcggtcatcataggaattgcctttcttggtgactctatctatcttggaagtgtgcttggaacagccatagtggttattggtttttatgctattatttgggggaaaagccaagagcaagcaaaggaagagtgtaaagtctatgatgactcggaatcatactcgcccattgtccctcttttggagaacaaaagaatggaggaatag

SEQ ID NO: 108611 - DNA, 360 bp, Glycine max
  Peptide Sequence Number=SeqID_225389
atggagctacatcacatagtctatttctatagaggtaatgatggagggtctagaagcaaggacatagatgatgaaaacctcaccaagttctggaatgtaggttttccaggtattgatcatttctcttattcatcttgggataccttgcttgaagaggagtacacatttggcgtatatggtaataaagaactagtggtcaaggagttcccttcaagacagactgctactcccgaccctaacattctaatttttcagcattggcctacagatagaaaaatgtatcctcctggtgcaagtgtatggaaaagtagagagtctgagtctgctgaaatgcctttctctactcccttggatctataa

SEQ ID NO: 108612 - DNA, 381 bp, Glycine max
  Peptide Sequence Number=SeqID_225390
atgccccactgcactggcagccaaaagattattcacagagatataaagtccgcaaacatacttttggataatgcttatgaggcacaggtttctaactttggacttgcgaggttagctgatgctgccaatacctatgtatcaactagggtcatgggaacctttggatttcctctagagttgttaggaaagatgagtacagattgtcttgtcatgcaaaaccatcatttcttaaacattaagatactgataggaaacccagatccaattaactcaacaaaccacaatccaactaacccagcaactactaaggctgggtttgttactaaaagccctcacaagcacaatctaaaaggggcaagaggatttaggaaagagagttag

SEQ ID NO: 108613 - DNA, 279 bp, Glycine max
  Peptide Sequence Number=SeqID_225391
atgaaagaacgcgttttacgatgcccttaccgaacgcgtgccagggctagagtaataagtgaaatagaggaggatgatggaggtcaatatggctacagtcgctgcccagcaaagatttctcaacctccatttctcagaggatacaacctcaacgtgacatgtgcttatcatgggggagttccggggcattccattgagcattgtataaccctaaaacataaggtgcaaagtctgattgatacaggctggttgagattcgaggaggaaaatcgcttgtga

SEQ ID NO: 108614 - DNA, 213 bp, Glycine max
  Peptide Sequence Number=SeqID_225392
atggaaaacgtagtgtttgcagcacagtgtggaatggggataagaatcacgcttcagtttcaagaaagggatcacttgattagatgttatgtaccagcgtatgtgatgctcccagtgggagttattacaaatgacaatgtcttacgtacaagacaaattaaagtagtactagctagagaaccaactaagggagctacatgcagcaggtgttga

SEQ ID NO: 108615 - DNA, 483 bp, Glycine max
  Peptide Sequence Number=SeqID_225393
atgttgctcatgttgctccccttatctctaagagattggtatgccatgaagaggttttatagactaaagaaatgttgctttggtttggaccctaatgagaagccacctacagatgcaattgatcatgaagttgggcgatactatcaaaccttaaaccatacttgcttcacccaagaaactcctttcaacatggtatgtacatggacaagggagttatatgttatgtctgattgcaccttctcctttgtggtgttcctacccttctccaaattcttcttcacacaccatgtggatcctatcattggagaagttgaatgttatgttgaagatgcttttgattccatggttgtccagaaacctcctcgtcctccaatgccacctggtagccttattcatctctcatctaattctggtgactctagtgaagagtttctcaggaaacttgatgaagaagttgccaaacaaaatggggagaaaaagtaa

SEQ ID NO: 108616 - DNA, 774 bp, Glycine max
  Peptide Sequence Number=SeqID_225394
atgaagcaaggacaccaagaggaagaaaggttcggaaatcactgtcctgaacctgatgaagaagggttgttggatttcaaaggtggaggaggagcagttcctaatggaggagtttgtgaaggctttgatggtggtagtaacactagtgatggtggaggttgtgaaggctttgttggtggtggtagcataagtgagggtggagggtatgttaggagtggagaaggttctaatgggcattactatgtacaacagcctatcccatcgcctcccctggtaaacaactatggaaatgggaatatgagcatgcggcatttaggcgcttttttcaactcaactcaattcaaaagtgatcagatattttttacctatgaaatgattatggaaatgaccaatgcattttctactcaaaatgttattggggaaggagggtttgggtgtgtttacaaaggttggctgccagatggaaaaatagttgcagtaaagaagcttaaggctggtagtggacagggagaaagggaattcaaggctgaagtggagatcatcagccatgttcatcatcgacatttggtggcattagttggttattgcatatgtgagcagcaaagaattcttatctatgagtatgttttcttcaaagatcatcacttgcatgaaagtggaatgccagtgttagattgggccaagaggctagagattgcaataggtgctgcaaagggcttagcatatctgcatgaggattgtaaacatatctgtatttattttcttctcccataa

SEQ ID NO: 108617 - DNA, 246 bp, Glycine max
  Peptide Sequence Number=SeqID_225395
atgacctatgcacaaatctctgcacacgaagttggagatgccggggtctatggtggtggtggcaactatctgcacaattgtgatctttgcaacatcgtgccaccatcgcaactgttggagatgccagggtccgtggtggtggcggtgactattggaaatgttggggttcgtggtggtggttacggctgggtgcacggttgtaatttctgtgatgttgatgagaatcctaaaactgctcaaatatag

SEQ ID NO: 108618 - DNA, 718 bp, Glycine max
  Peptide Sequence Number=SeqID_225396
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatatccttccgacatagagaagttcgaggtcttgaaaaacgctgcagaaactgcgcaatttggttcgcgtggagcagcaggcgttattgttgtcacaacaaagaaaggccgcgaaggaaaattccaaatttcttatgatggcaactatggatgggaaagtgtttatcgtaatcttgaaatgctttctgcacaagagtatgttgctgaagcacagcgattaggagttccttacataaacggtggatacaatgagaattatacggatttcccatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 108619 - DNA, 342 bp, Glycine max
  Peptide Sequence Number=SeqID_225397
gaatttaaaatccctgagacaggtcctgggcatcctgagtctgagcctcctcctcatctatcagatggaaaaataggggaatcagagagagcaacaacttctccatataaggaatcagaaagatcagcagcttctccagctggggattcagggggagcagcaacttctccagatggggaatcagagatgataatcaaaggtggagatgggggaactacttcaagctcaggggaagaaggtggattcaccactggagattgtggattagctggcactggttcaacccgtgcaggtgtgggctcaggaggagcagcctcgttgggtctcaccaatggaggttaa

SEQ ID NO: 108620 - DNA, 464 bp, Glycine max
  Peptide Sequence Number=SeqID_225398
atgacaaccaaaagtaactgcaattgtggaatcaaaagattcaccaacatttctcttgtcactctctttgggaaacttcaaggacatgaaatggaacttatgagactcaaccaacatgatgagaatgaaaaaaagaaaaaaggcattgtactcaaagcttcatcttctattcatgaagaaagtgacaaagaagacttgaatgaacgtaataatttagaagaagatgatgatttcagtctctttgtacaaagattcaataaatttctaaggaacaaaggaaatcaaaggggatcgaacttcaatccaaagaagaaaggagaagatttctcctcagttccaaaaagctatgaatgtgatcaaccaaggcacctgagacttgattgttctatctttaaaagaagaatgaaaaaatttgacaagaaaactttcaaagataagaaaggaaagaaagcatatatcacttg

SEQ ID NO: 108621 - DNA, 264 bp, Glycine max
  Peptide Sequence Number=SeqID_225399
atggctgtcaacgaaaatggattgttagggagaagaaaagacgatggtggggaggaaagaattaaaaaaaaaacattgccaccggaaactgcctttggaggcaacaaatggtggttgggactcggaaggttgtcgaagggaagaagatttgtgcaacaaaagaggataacaatgggagaagagaacaaggggatggacattggaggaggagaagatataaaccttggttggggagaagaagaggatgagcgtaggagaagatga

SEQ ID NO: 108622 - DNA, 294 bp, Glycine max
  Peptide Sequence Number=SeqID_225400
gatgagattgattgttctcaatttgcatccactgcagaacaacctccaacagtgtcaatggttgactctggaggtcaacctaagcctataacagtgcaaacaagtcttctaccacaagaaccaaatttcgtgtctgttcagccaacacctacatttaggcctcttctaactaggcctactgcacctatcaggataccattcctagctggaccttcaccaaggatgataaaacctaacttcatgagcttcattctcagaccagggatgccacaaagggaaaacaagaagaagtga

SEQ ID NO: 108623 - DNA, 216 bp, Glycine max
  Peptide Sequence Number=SeqID_225401
atgactaggaggatgactttaaagaacctcgtgctagaggacgctgagacacaatgctctgataagatggtgtcacattttgtgtcccaaaaagttttgatcttggcaaggaagtcaacagtggaagatgtgcttgctataagagatgtcataggtgatggcggtggtggcgaaaccatggttgttaactacggtaatgatgagaatgacgaatag

SEQ ID NO: 108624 - DNA, 522 bp, Glycine max
  Peptide Sequence Number=SeqID_225402
gtcctccaagtccttcaagtggatccttgcccttgctcttggtcatgtcctcatcacttgtgcaaggcccgaggagccacctcagattctcttaccttcgaggacccaaaaatccagggctacaagatctgaggccccatccccttcagttgtccctactccccctacttttgttctcccttcaactccagcagccctagttcttccagagcctgaaccagggccaactcctgattatgcagagcttgcaagatgtggtctggcaacgaccagttatgagcatggaggagtttatgcagaaggcctctgcagcccaggagcctcagccggaccaagaggattgatgagaatcctgaaattggccaaatacaggctaaaggcccaagtggagaagggcgaaggcccaagtaatccttgtggcgtctacccagacttatcttccttcaccggaagtggcgtctaccctgacttatcttccttcatcggaagtggcgtcatccaaaactctacagcctgtatcaa

SEQ ID NO: 108625 - DNA, 526 bp, Glycine max
  Peptide Sequence Number=SeqID_225403
atcgcgtcttttctggtttttccgacgttttcctcaaataaacgttggtggcgactccgcgcgtattcctttcgtggaacacgcatcccgcgagtcacgcgtcgccctcccgccgaagggtaggttgcgacaatcgtcaaagaaacgtaagggttcatcagcctccgcttcggcttcaagagctcatcgtgccggagccactagcgcatccacagcagcaattccaccctcattatcctcttccacattgttttcttctgaagaacagcagaaacggtattcaaatcttttctcatctcgttccattatcgaccctaagtttattgatatggaattcttttctgctgaaacttttgattgcattcaagcctttcagaacctaggtcttatacctttcatgataaaaatggtcattgaccaatcccttttccatgacttaacccaattgtccagtgacggtgtaccatttgaaggtacactgaatgacgattggaagtttgatttttctgcacatgatgcccgctga

SEQ ID NO: 108626 - DNA, 459 bp, Glycine max
  Peptide Sequence Number=SeqID_225404
atgtcctcgcctttaaaggactacacgtcctcgccttcagagggccacacgccctcgcattcagaggactacacgtccttgccatcagaggactacacgtcgccaccttcagggggctacacgtcctcgccttcaaagggctgcatgccctcacctttagaagactacctttcctcgccttcaaagggatacacgccgtcatcttcaaaggggctacatgccctcaccttcaaagggctacacgccctcatcttcaaagggctacacgccctcatcttcaaagggctacacgccctcaccttcagaggactacacgtcccctttttcagaaggctacacgctctcgcctttagagggcgacacgtcctcaccttcggagggttgcgctctccctcgccttttgagggctacgtgtcctcactttcagtggctccatatccacaccttaagaggatttaa

SEQ ID NO: 108627 - DNA, 693 bp, Glycine max
  Peptide Sequence Number=SeqID_225405
atggcttctaggaaaaggaaagccatagcttccaggccccagcctcactatgatacttacagactcacctatgaggacacctggaactgctgtgctgacaacattcttggccagaacatccttctggaaaggaacgcaaagctttttgtcacaaagtttgatgagttcaggatagagctagtcagaagaaactggcacaggacgctgaccaacctcatggaggggagcatagatgtggctctcgtgaaggaattttatgctaatcgttatgacccgaaggataagtttccaaagcaagttagggtcagaggacatttaatcaagtttgatgcggattccctcaacacttttttggagactccggttgttctagagccaggggagactcttcctgcttactccaggttctgcagactgagaccagaccctcaggagctggttgcccgatttgtatccctgacttggaacgttatgtcttatttcaaccttgcccctacatcacacacttctgatctgaacatggatagggcaagctttccagggacccgcaaggccagggctagaggatctgagggtccatcttctgctactccccagacatcaactgcaccagctcctattcctttagcactagttcccgctactttcgatccctccactcagagcacagacctcatgatggcgatgctgtag

SEQ ID NO: 108628 - DNA, 234 bp, Glycine max
  Peptide Sequence Number=SeqID_225406
atggaaatcatatctaagcgatttaaggaacttgatgtttgtggtaaagtaactctaaagagtaaacttcaggaaattgcatatcctaatcaaaactctatgtgccctcctccagaaaaggtatgggtgaagattcttagtccttggtgcgcaaccatttggttaaagaacttggcaaatggtcagatgactatatcaagctctttggtggcacaaacagattcgaggaattaa

SEQ ID NO: 108629 - DNA, 660 bp, Glycine max
  Peptide Sequence Number=SeqID_225407
atgaccaccctgactcagatatggatgactttgctgctcagcaacatcctgcccaccgaccataattccgacctccccctgccaaagtgtcagctggtgtacgccatcctgacgcggatgagcatccatgtggctcagctaatcgctgatgccatctatatttttgcaggtatgatgcctaccaggcaccctttggatccagataagtccaacagggccctgggatttcccgtgctgatcacaggactctgccagtcgtttggagtccccgttacacctaccaagagacaggctcagcgggatgctccacaggccgcgggcgcaccaccaccacctcatcaggctggcccggctgtgtcatttgacatggaacagtatttacggcatttggttcgtcagcaggcggccaaccaccgggcacatgtacaaacccatgattgtctgtaccagctgagcctcagcatgcaaagccagggctttgcttctttttcatgccctactccagaccagttcagggcagaggtcgcatggcccggggattggcccgaggcccaagcaggggaggcacccccagaagctcccggcgatggagaggaggcccacgaggacgaggagatggccgatttgcttgatttcttgggagggagtggagctacatga

SEQ ID NO: 108630 - DNA, 261 bp, Glycine max
  Peptide Sequence Number=SeqID_225408
atgtgggttctgtggggttcgagcgacgacaatgtcggttttccagcagtgcagggggttctgatggttccaacgaggacaacatggcggtttccgacagatttcaggcgggaggagaaagagaagagcgatttcaggcagaaggatgacaaagagaagagagagggcaaggttttcgagcgcgcgcggcttgtgaaatctcaatttttattaacttataaacataacaacatcggtttttttatggataaccgatgttaa

SEQ ID NO: 108631 - DNA, 430 bp, Glycine max
  Peptide Sequence Number=SeqID_225409
atggacttgaaggaaaattgtacttatgtcatgcacaattttaaagtgctaaaaaacaacggtcagtacagagtctgtgatcaccaatttaaattggtgtttattggggttactgttgtaaggcagtgtgttctagacgacgtcccttttagaaaatacaggtttgctagatttgcggatgttgtggctggccagtttgaacctgggccattggttgatgttattggtgttgtggaggaggttgtctttcgccaagtttcaggaaaaggtagaagggtagtctttaaactaaaggacttgagccagcaattgctatcttgcactttgtgggatgattattgcttgcagtttttaaagttcttagatgattatgaaggtgatggcccaattacagttctattgacccatggtagaataaaggaagctcggg

SEQ ID NO: 108632 - DNA, 963 bp, Glycine max
  Peptide Sequence Number=SeqID_225410
atggccaccggcggcgacggtgacacttccaaacaagagctcttccagctcatcaaacgcttcggagcttacgtcactttcaagatctccaatctcttccctctctctctccacaacctcgatttacgctctatcggggcagttgctggtcttgctgttgcaattgttttcacatggaggctcttgagatctccttctgggtctcaacggaggcaacagaaacggcaaggtccttcatctagtaatcctggagtcggtacaaattcaaattcaaatgcgtcggtggttccttcggatgcttgttcaccctcagatgattcaagggcgcaaaatgttgttgatgagttctttcagccagtcaagccaaccttggggcagatagttaggcagaagttgagtgaaggaagaaaggtaacttgtcgccttcttggagtgatccttgaggaaagtagtccagaggagctgcagaaacaagctactgtgaggtcctctgtgctagaagtactattggaagtaacaaaattttgtgatttatatctcatggaacgagttctggatgatgaaagcgagtgcttttccaacacactgttattcattttagtccctatcaatgttgtggaaaaggctaaagtgaatgaagtttacaaagttcggggccaaaatgaggattttgtgaagtcaggtgctaaaaaaagagttcttgtagcattggaagaagcaggggtattcacttcaggtggtctggtcaaggacaaggttctgttctgcagcacagagaatgggcggtcatcgtttgttcggcaattggaacctgattggcatattgattcaaatcctgaaattgtcactcagttggctaggtttatcaagtatcaacttcatgtatctccttacaaaactgaaagaactgctgcaaatgtgttcagtgctccatctctggaacagttctttggatccatatga

SEQ ID NO: 108633 - DNA, 1083 bp, Glycine max
  Peptide Sequence Number=SeqID_225411
atgggaagcaacttgaggtttttgagtctttgcctcttggcattgattgcatcaactcatgcccaacttcagcttggtttttatgcccagagctgcccaaaagctgagaaaatcattttgaaatttgttcatgagcatatccacaatgctccatcactagcagctgcattgataagaatgcatttccatgattgttttgtaaggggatgtgatggatcagtccttctgaactcaacaaccaatcaggctgagaagaatgctcctccaaatctcacagtaagaggctttgacttcattgacagaataaagagccttgttgaagctgaatgccctggtgtggtctcttgtgctgatatcctcactttggctgccagagacactattgaaaatcttaagagtataagcacaacttctgcttcacctttattatctttacactttctttttgagaacaagatgacccatttgctggtttatgccattactgacattggtgttcagggtggaccctattggaaagttccaacaggtcgaagggatggggtcatctctaacttggtggaagccagaaataacattcctgctccatttgacaacatcactacgctacagacactctttgccaaccaaggacttgatttgaaggacttggtcctgctctctggtgctcacacaattggtatcgctcattgttcatcattatcaaaccgcttgttcaatttcactggcaagggtgatcaagacccttcactagacagtgaatatgctgcaaatctgaaagccttcaagtgcaaggacctcagtaaattgaacaccacaaaaattgagatggaccctggaagtcgcaagacatttgatcttagctactatagtcacgttattaagagaaggggtctatttgaatcagatgctgcattgttgactaactcagttacaaagtctcaaatcatccaattgcttgaagggacagttgaaaatttctctgctgagtttgcaacctccatagagaaaatgggaagaattaatgtgaagacagggacagagggagagatcaggaagcattgtgcattcgtaaatagctaa

SEQ ID NO: 108634 - DNA, 1023 bp, Glycine max
  Peptide Sequence Number=SeqID_225412
atggagagcctgagaaagatgatgcggtatggtgttctgtgctccgggaaccctcggcgtttgtacgccacgaaagtggacctgaaaaagctccggccgatgattctgaagagaatcgagaaacgggcacatacttacccggttcgcggcatggttccggttgccaatgaggtcctccaagtcaggaatgatctcatccatggcgtttccacccttcttaacttccttcctctcatggcttgcaaattctgtccagagatatatattggtgagcaggggcatttgattcaaacttgctcgggttacaagcatcgtgccaagaaccgggttcatgaatggatcaaaggtggtttgaatgatatacttgtccctgttgaaacatttcacctggacaacatgtttcaaagtgttattaggcacaatgaaaggtttgactttgatcgcatccctgctgttgttgagctatgctggcaagcaggggctgatttccatgatgaaaaccttaattcaagtagttggaacttggaagctgacaatggaagtgttccagaaaccgagtctttgtcaccaaatgatcttacctctatagctaataaaacattaactgcttgggagactcttaggtctggggtggagaagttgttgttggtttatccagtaaaagtttgtaaatattgttctgaggttcatgttgggccatcaggccataaagctagactctgtggggtgttcaagtatgagagctggaaaggtgctcacttttggatgaaagctaatgtggataatttagttcccccaaagattgtatggaggcgaaggcctcaagatcctcctgtccttttgaatgaagggagaggcttttatgggcgtgttccagctgtgttggatctgtgctcaaaagctggtgctgttgtgcctgcaaagtataattgtatgatgaaggtgcaagagaatcaaactcttgagagcaacagtaagttgaattacaggtctgatcggaacgaggcacccaatcagggatag

SEQ ID NO: 108635 - DNA, 567 bp, Glycine max
  Peptide Sequence Number=SeqID_225413
atgacgtacatgcgattcataatgatcatgatgaaagtttatgggagaacattcatgcttaactgcgttgtatcaatggtcatgggaacaccgccaaggtcccctccacagtcagatggtaattcggaggctacgcctaagaagacaagacaatccacacgtcttagaaggttgacattaagaaccttatatcagcctagaccaacggttagtgtcgatcctgcaactagaagaggatcaagcccaaaaaaacaaaagttccacagctatttaggggtcgtagctcaacaaaagatcccaattgtccatagcaattggaaagatatgctgaaaactcttaaggacctagtatgggatgacattttgtgtatcacaggtgtcgcaacctacccttcggtgggagggcgacgcgtgactcgcgggatgcgtgttccacgaaaggaatacgcgcggagtcgccaccaacgtttatttgaggaaaacgtcgaaaaaaccggaaaagacgcgatctacgaacttttaagtgaaaggttcgggagttgtatttacgcacggggaaggtattag

SEQ ID NO: 108636 - DNA, 162 bp, Glycine max
  Peptide Sequence Number=SeqID_225414
atggtttgcttgcaagagcaggacgctcgcaaaggcaaatctaggctatgccataatagggaacgtggcactgctccttgttgcgacgaggctagtccttattatgcggcccctggggatgatcaaggagggtcatcgatattcaataggattgaattttag

SEQ ID NO: 108637 - DNA, 549 bp, Glycine max
  Peptide Sequence Number=SeqID_225415
atgtttgggggtgttaacgctcctgctaatagtccacacttacgcaagtctgggagtagacctgttgtttatgatcttgatgaacatgaggtggaaaatggcatcgaggagggtttattgcatcccgtagaggcagatgattcaaagggtggtacgcccgtgagtgctgctgcaatgatgccatcgcccattttgttgtggagattcaaggttggatgggattctgtcatgagaatgagtgcagacaagcgggatttgttcctttatgaagcatttttgtattttaatcctcttcttctagcggttagctcctcccttcttacggctttgatggtttggctgtggggaatcaacttatggttttttgctcaaggtggagtcaattatgcaaaaatatttgatcttgatcaaagtcatctgactcatagagaaatatggaaggtatcaactcaccactttgacttatctcttgtttggcacataaaatccgcttttgccagatccgaggggaataaaaatggtagtgtcatgacttgggaacaagagtag

SEQ ID NO: 108638 - DNA, 600 bp, Glycine max
  Peptide Sequence Number=SeqID_225416
atgcgatcaaagaagaaaccatggtcgccactcctctgtgacgaactcttcgaggaaatcttgtctcgtcttcctgtgaaacctttgatgcaattcaagtgtgtgtgcaagggatggaactccctgatatcagatccctatttcatcaaattgcaccttagcaaatctgctgcgaaggacaatttggaacaccttcaactgatgaaaaatgtctgcctcggatccatccctgaaatccacatggaatcacgtgatgtaagttcgttattccattccctacaaattcaaacgttcttgttcaatttcgcaaacatgctaggttaccatctggtcggttcatgtaatgggttgcattgtggggttagcgaaataccagaaggataccgtgtttgtttctggaacaaggcgacaagggtgatatccagagaatcgccaatgctgtctttttccccgggcatcggtcgtagaacaatgtttgggtttggctatgatccgtcaagtgacaaatacaaggttgtagcaattgcgttgactatgctctcacttaacgtatctgaaaagactgagatgaaagtttatggcgcgggtgacagtagttga

SEQ ID NO: 108639 - DNA, 627 bp, Glycine max
  Peptide Sequence Number=SeqID_225417
atgggtgatcatgaagaggtgagaagcttggttgtggaagaggaaatgagggtggtggaaagcaaagaatggtacttggtatcttatgctccacacggtgttccaaccaccgatcatctgaaactccgcaaagttcgtctatcgattgcacctgaatcaatccctgatggccatgttgccattgagatgctgcttttctctatagatccatatcttcgcggaagattaaatggaaccttagatggcctttattttccgcagtttgaactcaatcaggtgatcacaatatatgggattggaagagtaaagcgatcaaatgacagtgaatacaaagagggagatatcgttttgagcgcaaattttcctgctgctgagtattgtgtgatgccttcctgtgagatcgttagaaaaattgatgctgcctgtgggatttcattgccggattatctaagcactctaggagtgcctgggtttgcagcatggttggggatagaggttctggcagaccccaaacctggctcaaatgtgtttatatctgcagcttccggtggtgtaggaatgattgctggtcaattggctaagatcagagattgtagggtcatcggaagcactggatctgatgaaaaa

SEQ ID NO: 108640 - DNA, 1440 bp, Glycine max
  Peptide Sequence Number=SeqID_225418
atggagtcatttcacaaacctatcaaaaaccaaaaagctctaatgaaattctttgtattctcctcttcattttttgccatttctctgtgtgtatcgatgctactcctagccaaaacaaagttagtagtagacatgagttcttcactacaatcactactacgcgtgtctgagtctgatcctactaccactgctgaccatcttgtgtttggaattgcctcaactgggactgcatggaataggaggaaggtatacacaaaactctggtggaacagaaaaccctataatacaatgagagggtgtgttttcgtagatacacttccacatgaagaaaatgccaacaacaacaatgatggttctcttccacctctctgtgtctctgaagacacttcacagtttccctacacttacaagaatggtcaacggtcagcaatccgtgtggcacgtgttgtgaaggagactgtggcattattgaaccattctggtgttagatggtatgtgtttggggatgatgacaccattttcttccctcagaatttggtcaaaactctttccaaatatgatcataggctttggtactatgttgggtccagctcagagatttacgatggcgcccaggtttttggctttggaatggcttttggtggaggtggttttgctatcagttcctctctagcacatgtcctagccaaggttcttgattcgtgtatacaaaggtatcctcatctgtatggaagtgattctagggtgtactcttgcataacagaactaggtgtgggattaacacacgaaccaggttttcaccaggttgatttacggggaaatatctttggcctattggctgcacatccattaactcccttggtgtccctacatcacccagaattcactgatcctatctttcctaacatgacaactacacaatctctgcaacatttatttgaagcggttaatgttgattccgagaggatgctacaacaaacagtttgttatgaaaggagtttgtcatggacaatttcagtgtcatggggttatgctgttcaagtattccagaacaatatgcttttgccagatgttttgagagtgcaaaaaacattccagcaatggttgtggggagatgttttgaaaggaatatataatttcaatataagagaacttcaccctgacccatgtgaaaggccaacgattttctatttagataaagtgttttctggcaaagatggcatagcaagcagttacaggaaacattttcaaaattgctcatacaaggaaccaatgaagaaattggaagtgatcaaagtggtttcaaataagttataccttgacaacaaacagacaacaagaaggcactgttgtgatgtgttgccctctaataatgctggtgacttgatggaaattgcaatcagagagtgcaaatatgaagaactgatttacatgctctga

SEQ ID NO: 108641 - DNA, 1488 bp, Glycine max
  Peptide Sequence Number=SeqID_225419
atgtgcattcccatcataacaattatacagtcatcattcgaacacttgcattgcttagagatcaacgcagaagaaggattgcaagatcagcaaccaaccatattttttctgtatgtgacgtttgcatcccattcccatttgatgcaaagctggcatttccaacttgcaatgttactcctagccacaccaaagatagtagaggtgggttcttcaccacaatatgtgtctgatcccaccactgttgatcatcttgtgtttggaattgcatcaagtggaatttcatggcctaagaggaaggaatacagcaagatctggtggaattggaaactcaataaaacaatgagaggatgtgttttcgtagatacacttccacatgaagaaaatgccaacaacaacaatgatggttctcgtcctcctctctgtgtctctgaagacacttcacagtttctctacacttacaagcctggtggtctccgatcagcaatccgcgtggcacgtgttgtgaaagagactgtggctttgaaccattctggtgttagatggtatgtgtttggggatgatgacaccattttcttccctcagaatttggtcaaaactctttccaaatatgatcataggctttggtactacgttgggtcgtactcagagatttatgagggctcccaggtttttggttttggaatggcttttggtggaggtggttttgccatcagttcctctctagcacaagtcctagccaaggtttttgattcatgcatacaaaggtattctcatctatatggaagtgatgccagggtgtactcttgcataacagaactaggtgtgggattaacacatgaaccaggttttcatcaggttgatttgaggggagatatatttggcctattggcagcacatccattaactcccttggtgtccctacatcacccagatcacactgatcctatctttcctaacatgacaactacaaaatctctgcaacatttatttgaagccgttaatgttgattccgagaggatcctacaacaaacagtttgttatgaaaggaggttttcatggacaatttcagtgtcatggggctatggtgttcaagtgttccagaacaacatgcttttgccagatgttctaagagtggaaaaaacattcaagcaatggaaggaaggaaatgttttggcaggaatatatactttcaatacaagagaacttcacccagaccaatgtaaacgacccaccattttctatctagataaagtgtcttctggcaaagatggcatcataagcagttacaggaaatattctcaaaattgctcatacaaggaaccaatgaagaaattggaggtgatcaaagtgtttacaaataagttataccttgacaataaacagattccaagaaggcactgttgtgatgtgttgccctctaacgctggtgactcaatggaaattgcaatcagagaatgcaaatatgaagaaatgatttacatgcactag

SEQ ID NO: 108642 - DNA, 1074 bp, Glycine max
  Peptide Sequence Number=SeqID_225420
atggcagacgacaaacttttctcaaagtgcttggatcgccttaaggccgccattgctaatctcgctgtcacccaagcctccatgactaccaaactagatctccttctcctaaaaatggataacctattaatcagccaatacccttcatcttcttcctctgcgaaggcaccccctgcacaagtacccatgctgactttgttgtccatgccgactctgtcgcccatggcgattccgcttccatgcctcgcacccatgcaaccaagtcccgcatcattatcggcttcgctttccatgccgattgcgcctctatgccttgtgccgatgcaacaaagccaagcacccatgcctgctcctcaccttgccgccaacagcaagcaccaagtgccccacgggctatcctccgtcttcaaccagctcgaccacgttcgtgttgttgtttccctcgacaacctcttaagtgttgttgttcattatggtcatgcagcggttccacatgacaagcttttggaacatagagacattgcactgtttgagatggtagttgagtcctatgggtctgccatggtcgcacgcaagcgccaaccagttgcttttgcactatggacggctgctaaactaagtgaattttgtcgggacagaccttgggatcttggtattacttttggaagccatggtttgaagccccaacaccttgaggacaaaggtgttgttgatgggccaaggaatcaacatgcggctcagcatggccagattcccgaagtcttccggaatctcaccgtagaactgattattgatgaggtcgagtttgtcgacatcagcgggaatctcgccagagagcttgttgccaatgaggttcaggatgcggagggagggaagcactgtgactcaggcgaggatctcctcgacaatgtctttctaatcagcgacgacaagggtggtgaggccggagcgaccaactttctcaaagattgggtcttcggactccccgtggaggttgatgtcgctgacgcggccggtggtggcgtcgcaactgatgccgtaccagttgagacagcagttggagcccatccatga

SEQ ID NO: 108643 - DNA, 1155 bp, Glycine max
  Peptide Sequence Number=SeqID_225421
atgagaggatgcgtattcgtggatacacttccacaagacaaagataacaacaacaatgccagtacccttcctcctctctgtgtctcccaagacacttcacggtttcgctacacttacagtggttggggagggggaatgagatcagcaattcgtgtggcgcgtgtggtgaaggagacagtggcacggatgaaccattctcatattaggtggtacgtgtttggggacgatgacacgctcttcttccctcagaatgtggtcaaaacgctctgcaaatatgatcacaggctttggtactacgttggtgctaactccgagagttataagcagacatggttttttggatttggaatgggatttggtggggccggttttgctatcagttcgtctctggcaacagtcttggtcaaggtctttgattcttgcatagaaaggtacccagaactgtatggaagtgatgccagggtctacgcttgcataacagaactaggtgtaggattaacacatgaacccggttttcaccaggttgatttaaggggaaatgcctttggcctattggctgcacatccattaacacccttgttgtccctgcatcacttggacaacattgatccaatttttcccaacatgacaatcataaaagctctacaacatttatatgaagcggctaaagttgattcccagaggcttctacaacaaacagtttgttatgacaaacggttgtcatggacaatctcggtgtcttggggctatgctgcccaagtgttccataaccatttgtctttgccagatgttgtcagagttcaaaaaacattcaagcactggaccagaggaactgctttggcagaccaatttacttttgacaccaaagaacttcacactgacccatgtagaaggcccaccatattctatttggaaaatttgtcccgtggtgaagatggcataataataagcaattaccggaaatctatccaaaattgctcatccaatgtggcacctgaagttatcagagtggcctcaagtaagctagagcttggcatcaaacagttgctggctcaaagaaggcactgttgtgatgtgttgccctctagcgtttctgaccaaatggagattgcaataagggaatgcaaagaggatgaattgattagcatgcaatga

SEQ ID NO: 108644 - DNA, 1420 bp, Glycine max
  Peptide Sequence Number=SeqID_225422
cctgacgtccgccgtgaccaaagtggtggccgatgccagcaccaatcaggatgccgtgaacaatgccatccaggcacgtaccggtatgccgaccaaaatcaacggtcagccgggtgaagcccagcctgcgccggtgatggtacaagagtcttctgacgcgatgccgaaagaagagccgatgacgccgcagggtgccaccgccgtcgcgccgcaggccgatgtgcagcagcccgctgaagccgctccggttgagcaggccgcgccggcacagcctgccagcaacggcaacagcctccgcagggctggcttttttattgcccgatcgccgggatcattaccattgtgcgattgtgtcgcggcgcagttgcgcactcaatcgtgcggtcggcgtaacgccagccagcccgccaccagagtaaacaccagcaccaccagcactaacagcagaaagccgtgcggattgttcgccagcggaatgccgcccacattcatgccaaaaaaaccggctacgatattgatgggtagcgccagcacggtgattgaggcgggcagcgatctcctcctgcagcaggcgaatgcgctccatcaggctggcaagatcgttaagcgctacgctgaactcctcggtgaaaatccgcagctcactgagcggttcccggttgagccagtttggcggccggttaagcaggcgaaacagcgcggccggctccggcgccagcagccgctggacgcgcagcagcatgcggcgcagatggcccagctcgctgcggttggctttgatcgccgcgctcagcagcccctcttctatcgcatccaccgcctggctggagcgccgcaccacctgctccagctgcgcttcctgttcgccgagcagccacagcagcatcgcatccggcgcgctgaagcacagccgatcaatctgctgatgcatacgttcaatcatgccaaccgggcgatagcgcgcgctgaccatcacctgcggccggcaccagatccacaacgtcgcattttgtgtgttgcgctcctctttactaaaggtgacgtcattcagcaccgccagcagcgcatcgttttgctgcgccagccgggtgcgcggcgaggccgaatgaatctcatcgaaaaaatcgtcatctacgctgaagtggtcctgaacccagcgctcggcgcgggcatgattcaggtaaccgtgaatcagtccggcaacttcgttgttgaagtcgggcagcgaggcaagcggcagaacaggctggagcatagcggcgtgaagatcccagagcggtcagatccacagcctgcgacaggtctgttacagcatgatgacagcccgcgctggcatcatcattctgtcatacaaaacccgtatcacactgcagttaacgggtgccattcgtgcatcgttaattcaccccggggggtgtga

SEQ ID NO: 108645 - DNA, 738 bp, Glycine max
  Peptide Sequence Number=SeqID_225423
atgtcttcctcaaagctcagctctcccgtaaccttcttgctaatctttgctcttgttttccaaacatgttttggagctaaccctctctaccatttctgttcaagttctcagaacttcaaagccaacagtccctatgaatcaaacttgaaaacactcatcaactcgcttatatacagaacaccttcaacaggttttggtgttggctcagttggtcaataccaaaacgaaaaagcatatggtcttgctctttgtcgtggcgatgtgtcatcatcagaatgcaaaacttgtgtctctgatgcaaccaaagaaatcctcagtcgctgtccatacaacaaaggcggcatcatatggtacgacaactgcatgttgaagtacttagacactgatttcttcggcaagattgacaacacaaacaagttctctttgttgaacgtgcgaaatgtgagtgatcctgccatgtttaactacatgaccaaggagttgttgagcttacttgcctatagggcttctttgagccctaaaatgtatgcaagtggagagctaaagattggtggagaatcaaaggatatttatgggttgactcagtgcaccagagacctttctagcagtgattgtaacaagtgtcttgatgatgcaattagccaactccctaattgttgtgatggaaaagagggaggaagagttgtggctggaagttgcaacatccgatatgagatttatccatttgtcaaagcatag

SEQ ID NO: 108646 - DNA, 525 bp, Glycine max
  Peptide Sequence Number=SeqID_225424
atgctctccatctttctcaatctcttggtctccaaggaggcaattctattagtcccttatttcgtttctgatcccagcccttatggtgccaacttaaaccagttgtttgagctgttacacaccaaagtacctcctactggttttggacatggttccattggccaaggcacggaccaagtgaacgcaaccaaaaagcttcaagagaggtgccccccaaagaagaaggggacaatagtttggtacgattactgccttattaagtactcaaatgaatacttctttggtgaaattgatgagaagaacaagttctatattgttaacatctacgacgtggatgaccctgctactttcggtgataaagtcaacgaattgctaagtggtttgtcttatactgcttctcaaattcccatgttgtatgctattagtgatcatcccaattattgtgatggaaagcaaggtgcacgggttgtgcgtgggagttgctatgttagatatgaactataccctattgttgaggctccctag

SEQ ID NO: 108647 - DNA, 300 bp, Glycine max
  Peptide Sequence Number=SeqID_225425
atgaccaaattagcattacgttgttacagtacagaggagccaagactacaagcgcaagaaaatagtatagatggcatcagccataggtacgaatgtatcacaactggacaagaatcaagcaaaatcaaaggaaaatccgatgtagatcccattttggcaagaatgtcagcacatgaatttgtttcgctgatacacgtgctgaaaactcagactccattcttaagattggaaggtcttcaagattgctgcataaggatgatgctgggaacatccttgattgatcaaatttataggagttaa

SEQ ID NO: 108648 - DNA, 684 bp, Glycine max
  Peptide Sequence Number=SeqID_225426
atgggtgttcctgaaatgatgttcagggtatcttttgttgctatactcatcaaattggccttggccacaaattacattgttggaggaccaaatggtgggtgggacacaaactcaaaccttcaatcatgggcatcatcccaaatattttcagtgggagacagtcttgttttccaatacccgccaaaccatgacgtggttgaagttacaaaggcagattatgactcttgccagccaactagcccaattcagtcttacaatgatggcaccacaaccatccctctcacttcactagggaaaagatacttcatctgtggaacaataggacattgcagccaaggaatgaaggttgaaatagatactcttgccagtgcaacaaattctgtcacaccagcagcatctcctgaagattctactacttcacctgcagaatctcctgaagtttctagtgcttcacctgaagaatctcctgaagatattattccctcagccccaagtccattgttccaagcacatctagaaagtcctactttctctccagtctttccttccactgaatttcctgcttctgcttcacctctagcacaacattcatcagacttgtcagcttcatcaaccagtaaaggaaatctacaagcctactttgtggtagtgttaagctttctaatcatgtttataaccttctga

SEQ ID NO: 108649 - DNA, 666 bp, Glycine max
  Peptide Sequence Number=SeqID_225427
atggacgtgaattcctcaggtggtgcctccgattggctttatgattatggctttgatattcctgttgctggttctgacttcatggcttcagactctggtggtttccgttgggggcctcagagtcacaacttcaagggtccctcaaatatgaggtggcttggaaatggaatactcactggattcaactgtcatggaaaatggtccttcaaagcggttaaggacagaatcatgtgcatctggctccaaggcatgtcgtttctggaattgagttccatcctggagcctagtaggcagcccaaatcagacaaagttgcaatattaagcgatgcggctcgagtggtaatccaattgagaaatgaagccaagaggctgaaggaaatgaatgatgaactacaggcaaaagttaaagaattgaagggtgagaagaatgagcttcgtgatgagaagaataggttgaaggaagagaaagaaaagttggagcagcaagtaaaagtggcaaatatacaacccagcttcctgcctcaagccccagatgctaaaggacaagttggtagccacaagctgatacctttcattggataccctggaattgccatgtggcagtttatgtcccctgctgcagttgatacatcaaaggatcaccttcttcgacctccagttgcataa

SEQ ID NO: 108650 - DNA, 138 bp, Glycine max
  Peptide Sequence Number=SeqID_225428
atgcgaccaagtccaaagccaaagaagctccccgcgaagcggtccaggaagggcaccattgaagaggattccagtgtggccccacaagccgacgcaggctttgacaaacaccgattccaaagcgtggaacatcagtag

SEQ ID NO: 108651 - DNA, 351 bp, Glycine max
  Peptide Sequence Number=SeqID_225429
atgaaaaatcaaaaggaaaatacttcggtaattaaaacttctacttttgtaccaggagtttataaaggaaatatcccttcaggaaactcaaaacagaatgttgaaatcactttcaaagatgataatactttcgctttgtctgaaacttttcctggtagtacaactcctatgtcaagtacagggacttggaagtattacaaagacaccaataaggtaattttaaagtattcaaatattgcagaccgtgtaacaaccttctcaattgtcaatgataaaacaattcaaatgcatagcggaagcgcatggacaaaagaaacagcaggaacagaatataatcttgttcgtcagtaa

SEQ ID NO: 108652 - DNA, 641 bp, Glycine max
  Peptide Sequence Number=SeqID_225430
ggtggacccttgggtacttgtacctatcacttttagaggactacacgtcctcgccaacagagggctgcacgccctcaccgttgagaggactacatgtcctcgccttgagaggactacacgtcctcaccatcagagggctgcacgccctcacctccagaggactacatgtcctcgccttgagagggctacatgccctcaccttggaggactacatgtcctcgccttgagagggctacacgccctcaccttgggtactagttaccctcaccgtcagaggactacacgtcctcgccttgagaggactacacgtcctcaccaccagagggctgcacgccctcacctccagaggactataagtcctcgccttgagagggctacacgccctcaccttggaggactacacgtcctcgccgtcaaagggtcatgtgccttcacctttgtagggctacacgccctcacattcagaggactacacgactacatgttccccattttcaaagggggtcatgccctcacctttagaggattgcacgtccttgccatcataggactacactccctcgccttcgaaaggcgacacgtcgtgaacttcagagggctacacgccctcgcctttagaggactacgcgtcctcactttca

SEQ ID NO: 108653 - DNA, 622 bp, Glycine max
  Peptide Sequence Number=SeqID_225431
atatttatcagaagttggtttctgctcaagaagagcggcagataaattactggaagaagggagaataaaaatcaacgggcagattcctgaattgggaacgaaaatttccgacgaagatgttgtagaagtagacgatacaaaaagagaaaaaaacaatattgtagattatatcaatcatcctaaaagaatttttccgattggtaggttggacaaacctagtgaaggcctaatacttctaaccagtgacggggatattgtcaacaaaattttaagggccaggaacaatcacgaaaaggaatatcttgtaagagtcgataagccgattaatccgagatttttggagaaaatgagaaatggagttcccatcctggataccgtcactaaaaaatgtgaggtagaaaaagtagatgatatgacgttcagaattgttcttacccaaggcctcaacaggcagattcgcagaatgtgtgaatatttgggctacgaagtgaaaaaacttaaaaggatgcgtatcatgaatatcaagctggatttacctgtaggaaaatggagagatcttaccgatgaggagctatccgctttgaacaagttgcttgaagactccagtaaaacggtagattaa

SEQ ID NO: 108654 - DNA, 1434 bp, Glycine max
  Peptide Sequence Number=SeqID_225432
gccgcgcagcacgacgaagacgctggcgtaggggctctcgttgcgcgccaggcgcgaaccgatggcggccagcacgtggatggcgtcgtccagcaggtcccgcgccacggccgggtcgatcacgcccaggaactccaggaacaacggcacgtggtccggcagttccgacaccaccggttcgaagccgtgctggcggtaggtctcgagcaggtcgaccatggcctggccacggtcgcggctttcgccgtgcacgtgctcgaacaggtgcagcgaatgggcgcggttgcggtcgaaggtggcgacgtaggcttcctgcagcgcgatcaggtcctggctggccaggtggccgatcagcggttgcagggtttcctcggcctcgggatgggcggccagggcggcctcgacctcggccgcggccttcttgcgcgatttcggcatgtcgatgaagatctcgctgccctgcggcttgcggccgaacagcgtgccttccgagacgccgcccgagcagccgttgccgaaggtgaagccgcagctgcccttctcgttgaagctgtcctcgacgatttccttgtggctgctgggcaccacgaagcggtcctcgtagttggcgatggccatgatgcggtacatgtcctgcacggtttcttccgacaggccgacctgttccagcagggccgtgtcgtgttcgccgtgcacggtctcggcgcgcttgtaggcgcgcatcgccagcatccgctccagcgcctgcagcaccggggcttccttgcccgcggtcagcaggttggccaggtagcgcaccgggatgcgcaggctggccacgtccgggatcatggcgctggtgccgagcgtgcgctgcggcatcttgccggcctcggccgcggtctggatcggcgacagcggcgggatgtaccagaccatcggcagcgtgcggtattccggatgcagcgggaaggcgacgcgccattgcaccgccatcttgtagaccggcgactggcgcgcggcttccagccaggattccgggatgccctgctcgcgcgccgcggcgatcacctcgggcgagtgcggatccaggaacaggtccagctgcgattcgtacaggtcctgctcgttgccgacggcggcggcgcgctcgatctggtcggcgtcgtacagcatgacgcccaggtagcggatgcggccgacgcaggtttccgagcacacggtcggctggccggcctcgatgcgcggatagcagaaggtgcacttctcggccttgccgctgtgccagttgtagtagatcttcttgtacgggcagcccgagatgcacatgcgccagccgcggcacttgtcctggtcgaccagcacgatgccgtcgtcctcgcgcttgtagatcgagcccgacgggcagctggcgacacaggccgggttcaggcagtgttcgcacaggcgcggcag

SEQ ID NO: 108655 - DNA, 354 bp, Glycine max
  Peptide Sequence Number=SeqID_225433
atgcgatcaatctgggcacatgagattcaattattctgtcttcaaaagaagaatgaaaaatctgacaagaggaatttcaaagagaagaaagaaaagaaaggatacatcacttgggaagataatgtcataaattcttcaagtgattcagaggataaaatcataagtctgggtatcatgatgaaaggatatgaaaacgaagaagagcaaagtcgatacattgatagcaatttctccaaacacatggcatgcatcaaagtttattcatatttctccccaagacaacaaaggccacttgatcaacaagtccaacaagtgatatcaaatgataccaacgggtcacttgtctttgattga

SEQ ID NO: 108656 - DNA, 1221 bp, Glycine max
  Peptide Sequence Number=SeqID_225434
atgacggtaaccggagaagaagccccggctaacttcgtgccagcagccgcggcggatcgatcagtcaggggtgaaatcccagggctcaaccctggaactgcctttgatactgtcgatctggagtatggaagaggaacaccagtggcgaaggcggcttactggtccattactgacgctgaggtgcgaaagcgtggggagcaaacaggattagataccctggtagtccacgccgtaaacgatgaatcaacgcgcagaaccttaccagctcttgacattcggggtatgggcattggagacgatgtccttcagttaggctggccccagaacaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggggaacctgcggctggatcacctcctttctaaggaagctgtggaacagtaagacgcctgtcttgaacaggatgaactttcccgttcgccgtccacgtttctctttcttcaagaagacaaaagccgcatcgaccgacttgggtgatcgagctggatggggctgtagctcagctgggagagcacctgctttgcaagcagggggtcagcggttcgatcccgctcagctccaccatttaattgcgctcacgggtgagcggtccttcggacctaccctccgcgagggcgccgaacgatcggcgacgcgctaccgcgcttttgcatcgtctgagaggactgatgcctgttctgaatacattgtgaagagaagatatgtctggaagcttccagggattggaggtaggccttcatctgatgggaatgctggattgatgttgcctgaccgcgcatcaccggatgatatctcgagaagctggaaggacttgattgtaaaaggtaatcaggttgccgttcctttggaacggctatggatgagcatagacaatgagaacgaagaagcgaagaaggacgtgatacgctgcgaaaagccgtggggagctgcgaataagctttga

SEQ ID NO: 108657 - DNA, 346 bp, Glycine max
  Peptide Sequence Number=SeqID_225435
atgaccgcacaatcccgggaccatcattcacctgaagcattgcgcgccgtggttatcggcgtgctgagcgagtttgagcatccgacgctgcaacacaatctgactaccctcaaagcgctacgccacgtggcgctgctcgacgacaagcttcacattgaactggtgatgccatttgcctgggccagcgcgtttgaggcgctgaaagcccagaccagtgcagaactgctgcgcctgaccaacacgcgcgccatcgactggcggctgcgtcatgacatcgccaccctgaaacgcgtgaaaaatcagccgggcgtcaacggcgtgaaaaacatcgtcgccgtcagctccg

SEQ ID NO: 108658 - DNA, 3292 bp, Glycine max
  Peptide Sequence Number=SeqID_225436
atgaccaaagccgattttcttgatgtgagctttgaggactggcgcaaagtctttaccgttgacgtagacggcgcctttgtctgcgggcagattgccgcgcgtcatatggtggatcagggcgacggcgggcgcatcatcaacatcacttcggtgcatgagcatacgccgctgccggacgccgctgcctataccgcagccaaacatgcgcttggcgggctgaccaaatcgatggcgctgagcctgctgccgcatcacattctggtgaatgccgtggcgccgggcgccatcgccacgccgatgaatgacatgagcaacagcgaggcgcacagccggcgcatgccggaaatcccgattggccgccctggcgatacgcgcgaaatcgccagtctggtggcgtggctgtgctcggaatgggccacttacaccaccgggcagtcattcgtggtcgacggcggcttcatgctggccaacccgcagttcaaggcggcgaatcacaaagcgcagcacgatgccgaacacaattgccgccgccagccagatgaagtgcttgaggtgctgatcaagcttgtgcagccacggcgtaataatttcaccggcgaagtagccgagggtgacaaaaatcagcgcccacagcgcggcgccaatgacgttaagcacgaaaaagcgcagcggcttaagacggctggtgccaataataatcggtccaatcaggcgaaagccgtacatgaagcgcacgccaatcacaaacaggctggggtgcttctgaatcagccggttagcttttttaatggtgtcctgatgtttgcggaagcgccgcagaatgcgtgtgccatagcggcggccaagccagaacagcagctgatcgccaataatgccgccgcccatcgccgccagcaccacgccgctgaaatgcagcaggccctcgtgcgccgcgacgccgcccagcagggtaaaggtttccccttcggcaatgcagccaatcagcagcgccagcctgatcgctggggcagcccgtcgcatcagaggagtgattgtatgaatcatatctggggtcttctggcgcatcccaatcaggagatgcgtgatatcaagcaggaaaacgagagcgtttcgcaccattacacccatcacgttctgctgatggcggcgatcccggtgatctgcgcctttattggcactacgcagctgggctggaatctgggcgaagggcagttcgtgcaactcaacatgctgaccggtattggtctcggcattctgttttacctgatcatcttaggcggtgtggcgcattcagcgctgtaccgtatttgccggctatgtggcgacgccgctgtttatcagcgggctggtggcgctctatccgctggtgtggctgtgcgtgctggccggggcgatagcgctgatgtacaccggttatctgctcctgcgcttctccggctcgacgctggcgattggcgtgctggtgttcgaggtgctgctggcgctgacggtgattctgtggggttacgggccacgcttgttctgaccgtgataaagacgagcgcgtatgatagcgcagccagcccgcgtcgcatcaggcctgacgccggcggcctgtgtttcgacacagcgcaaacctcctcaccggatttttttgacacgatgtctgtaaaaatgcgtatttctttgctgtcgctggcgctgtttgtcgccgcgccagctgcgatgactccggcgctcgccgccgcagcaaaactggccgatctggcgccgattgcccagccgcaaatcgcctccggcagcgcgctgattgtcgatctcgataataacaaagtgctgttttccagccatccggatcgggtgcggcctatcgcgtcgatcaccaaagtgatgactgcgatggtggtgctggatgcccggctgccgatggacgaaatgctgtctgtggatatcagccagacgcccgaaatgcgcggcgtgttctcgcgcgtgaagctcaacagtgaaatcagccgccgcaacatgctgctgctggcgctgatgtcctcggaaaaccgcgcggcggccagcctggcgcatcactatcccggcggttacgacgcctttatccgcgctatgaacgccaaagcgcgcgcgctcggcatgacgcacacccactacgtagagccgaccggtttgtcgctgcataacgtttccagtgcggaagatctggtgaagctgctcaaggccacgcgccagtatccgctgattggtcagctgagcaccaccaaagaggagacggcggtgtttaaacaccccagctacgcgctgccgttccgcaatactaaccacctggtgtacaaaaatgactggcgcatacaactgaccaaaaccggttacaccgacgaggccggtcactgcctgataatgcgtaccatgattaataaccgcccggtagcgctggtggtgctggatgcgtttggcaaatatacccactttgccgatgccaaccgcctgcgcgactggctggaaaccggcaaggcggcgccgtgcggacgtggagtaacgcaacctgttactcagcgtagcggcgcaagggagtgcgccgtgtgtcgtggtggcgcgtggctgacggctgttattgcgctggaatctcactcatatgttcaagtttcgttctctgtttaccccgttcctgctgctactggtgaagaagacgcggcaccgaaggtcaatccggcggttgaactgccgaagatgcagaagatcctcgacaaaattaagggccaggtgtctggcgataccaatgaaaaccagctcaaccagctcaatgagatggcgctggagctgtcaggtaacgcggaaaccctcggccaggcgctgattccgcagcgtcagcagctggatgcgcagctggcggtgctcggcccggcgccgaaggcggacagcggcgtgaaagagacgccggaagtgacgcgcaaacgcgccgcgctggagaatcagaagggcaagctggatgatcagatcaagcaggccgacggcatcaaaaacggggcgctggtgctgtcctcgcagatcgtcaacctgcggcgcgatcagctgaaaagccagctggcgctcaactccggcagataccgccgcgctgtcgtgggagccgggctggcgcgtgggcacggtcggctggctgctggcggcgctgctggtgatgacgctgggccggcgttacagcgaagagtttctggcgtgggtcagccattcacaaactgccggaagggcggcttgcgccgcagcttcctcgcggccggcgattgcgctgactacgctggcggccgtg

SEQ ID NO: 108659 - DNA, 867 bp, Glycine max
  Peptide Sequence Number=SeqID_225437
atgaatgccgaccctacacgcttgtgtaacgtgatggtgaattcggagtcggcatcaatgccgacccgacggttggtagggtggccatttatggccaccgggacagcgttaatcccttcaggctttcaccgcccagcctttttgcttactggttttcccgatgcccgggttaaaggtattggtcggatcgagctggcggtaaaacgcctgcagctgcggtttggccgcatacagatggccaacgttatgctctgccggatactccgcgccgcgcgccgcgaggatcgccagcatcttctccttcagcgcatgggcatctacgcctttcttcacaatgtaatcctgatggaacacgtgacagaagaagtggccgtagtaaaggcgatgaatcagatcgttatcaaactccggaggcaggcgctcaaaccactcatgatcgctggggcgcagcgcaaggtccagcgccagaatatcctatacttcgtcagcgtgcaccgcgtgatagcgcacggcggcaccgggtgcggcaaaacgatgcagaaaggcgtgcgcgccatcttcggcgtcgcaggcaaagaactcaccgccgccttcgcggaaatactcctgcagatacgcttgcgcttcggccacgccgtcgccggacatgttcagcatcaggtgatgatagtatttgtcacgatactgcttcaggcgcttcggcaggtgtgccgggaaccagcggctgatgcgttgcagcaggcgatcggtcaggtgcggcttaacgaagctcagctagctaagccaggcatccacccggcctttgagggtgaaaaacagcggcatcttatcggtgccgagtttatcaatcatcacaaaggtgtctaa

SEQ ID NO: 108660 - DNA, 1254 bp, Glycine max
  Peptide Sequence Number=SeqID_225438
atgaatcccttttccgttacccgcatccacgatcgggtaaatttcatggtgtcgttaaacttcaataacggaaaaacggcgcaacaatggcggtcgattgattgcaaacagggcaaagcacagctcctgtataaggatctgttaaatgataagggcttaaccattgctcgttattacggtaacagctatctccggtacgcgcctgcacaggatgatcagcaaattaccgcagacgatattcataaggtgtgcaaactccccataaaagaggctcagtgggaaaagttatcagccacgtctgaaatcggcaccaccaaactggtcgatgtgaatagcattcaacacactggcgatattttatcggttcgtctgggatatgattacgcagatatcatctgggaaccgccttacgatgcgccgctgggattaaaaacagaacactacctgtacaactgtaaaacccatcagggtgctgtaattgctgccatgaatttcgacagcgaggggcgcgttacagattcactcatcactgctgaccttgttcgccgcaaaagtagcttcaaaattgatactcagatgacacaacgtttcgatcagctctgccagttacccgcaggaaaaaagtttaccgctgaaggacattttgtgtccgctgcgaataagccagcatccacgttgatggggccattaatgccagacctgagtaaaaataattcgcagtggctggataagtattctctttctgctgaaattgaacggcaggcacaagcactgattaaaccctgggcgctgccacgcttcaaacaaatccgttataccgaagtaagcacgctcggtaaggttgaagtgcagctggatgcacagccaaatggttatgtacgtaagctggaagattacggtatctggaaggtgcaacgtttgacgctggctaatcagttgcagcttaagttcaccatgcccatcagcacaggcgcatcactccttaataagttgcagacggatctgcgttttccgctagtaacgggtcaacaatatcaggcgcaatgggaaagtattgactccgataagaaaattacgtcttcacggttacgctgcaaggtaacctcgatgggagacgcaaagagcattgcggatgaatttagcggcaaatatctcttagtcgagtgtcagcaaactgattcaggacaagcgggtagccgtgtcagactcgcctggctgcaggatctcaatgtgttcgtcaccgttgctatgcag

SEQ ID NO: 108661 - DNA, 264 bp, Glycine max
  Peptide Sequence Number=SeqID_225439
atgttaaaaaccacacaatcccgtttcaccgcgaccttagtcgcattcttcgttgttcttatgctggtcaccgtcctggtgatcaaccagttcatcgcgccacagcttagccagaacgaaagccggctggtgcgctatgaggtggatggtctcgccggacgtatcgtcgagcagatgaaccgcgtgcaggcgcagcagcgtgcgattaccgaagcggcgggcgtgatggacagcgccgccattgatacgctgctgccggcgctg

SEQ ID NO: 108662 - DNA, 1830 bp, Glycine max
  Peptide Sequence Number=SeqID_225440
atggaaaacgtagtgtgtgcagcacagtgtggaatggggacaaaaatcacgcttcagtttcaagaaaggtataatttacagcatgggatttcaaggaggtatggagctatatgtgtggagagagcgaggaaaccaagaacaacacattgcttcttcaaatcggattgtggccacctcaagaaagaacgaggtgttagagtgacgttaaaagccgaaactgctgaatctaaggaacagattcatacaagttataaagacccaatgcttgcaagttatgtaccagtatacgtgatgctcccattgggagtcgttacaaatgacaatgtcttacaagacagtgcgggactaaagaaccaactcaaggagctacatgcagcaggggttgatggggttatggttgatgtctggtggggtatagtagaatctaaaggacctcaacagtatgattggtctgcttataggaccttgtttaaattggttcaagattgcaaaatgaagttacaacctataatgtcattccaccaatgtgggggaaatgtgggagattctgttttcattccacttcctaaatgggtacttgaaattggagaattagacccaaatatcttttacaccaacaacaaaggtatcaggaataaggaatgtatatccctcggtgtagacaaccaacctctgtttcatggacgaactcccattgagctatacaccgactacatgaggagcttcagagaaaatatgaaagattttcttgaatctgagctcatgatagacattgaagtagggcttggacctgcaggagaacttagatatccttcttacacacaaaatcaggggtgggtattccctggtattggacaatttcaatgctatgacaaatatcttaaagatgatttcaaagaggctgcaacaagggaaggtcatcctgaatgggagctgccagataatgttggagaattgaatgatgcacctgaatctacaaaatttttcaagtcaaggggaacttatctaacaaagaaagggaaattttttctaacatggtattccaacaaattattgatccatggtgatgagatcttggataaagctaacagtgtattcctaggttgcaaagtgaagttagcagcaaaaattgcgggaatccactggttgtataaatcaaagagccatgcagcagagcttacttcaggatattacaacttgaatcgtagagatggatatagacccatagcaaggatgctttcccgtcacaaagctgttttaaattttacatgtcttgagatgagaaaccatgagcaaccaattgaagcccgaagtggagcccaagaacttgtccagcaggtccttagtggatgctggatggaaaaactagaagttgcaggggaaaatgcacttgcaagatatgacagtgaagcttacaaccaaatccttttaaacgctagaccaaatggtattagcaaatggggccctccaaaactaaaaatgtatagcatggcatacctccgcttgtcagatgaattactacaacaaacaaactttgatatattcaaagcctttgtgagaaagatgcatgctaatctggattattgtcccgagccagagaggtattatcattttagggtacctatggagctgtcaaagccaaggattccactggaggttcttcttgaagcaaccaaaccagtgaagccttatgcatgtttctatcattttacgtatattcaaacatatattcaagctaaaagtaaactaaaaatgcaaatggaaaggaaggaaggaattgatgaccggaaaggatcaaaggggatgcaaaatgtggaaagcgagctatag

SEQ ID NO: 108663 - DNA, 1422 bp, Glycine max
  Peptide Sequence Number=SeqID_225441
atggttgctgctgtcagttgggagttgttacaaatgacaatgtcttgcaagatagagtgggacttgagagccaactcaaggagctacatgcagcaggaccttgtttcaaatggttcaggattgcaaattgaagctacaagctataatgtcattccacaaatgtggggggattgggggaatgtgggagattccgttttgatttctctccctaaatggatacttgaaattggagaattagaccctgatatcttttacaccaaccgcaaaggtgttaggaacaaggaatgtttatccctcggcgtggacaaccaacctttgtttcatggacgaactgccattgagttgtacaccgactacatgcaaagtttcaaagataatatggaagattttcttaaatctgagctcatgatagacattgaagtaggacttggtccagcaggagaacttagatatccctcttatacaaaaaatctagggtgggtatttcctggtattggagaatttcagtatcttaaagctgatttcaaagaggtagcattaaaggcaggccatcctgaatgggagctaccagataatgctggggaatcaaatgatgtacctgaatctacagaatttttcaaatcaggaggaacttataaaacagagaaagggaaattttttctaacttggtattccaacaagttgctgacccatggtgatgaaattctaaataaagccaacaatgtattcctaggttgcaaagtgaagttagcagcaaaagttgctggaatccactggtggtataaaacagaaagtcatgctgcagagcttacttctggctattacaacttacataatagagatggatacagacctatagcaaggattctctcccgacacaatgctattttaaattttacatgtcttgagatgagaaatcatgagcaaccagctaaagccaagagcggagcccaagaacttgttcagcaagtgctcagcggtggttggttggagagtcttgaagttgcaggggaaaatgcacttgcaagatatgaccgtgaagcttacaatcaaatccttctaaatgctagaccaaacggtgttaacaaatatggtcctccaacactaaaaatgtatggtgtcacataccttcgtttgtcagataagttaatgcagcaaacaaactttaatatattcaaagcctttgtgagaaagatgcatgctaatctggattattgtccagacccagagaagtactatcatttcacagtacctatgaagcgatcagagcccaagattccactagaagttcttcttgaagcaaccaaaccagtggagccttatccatggaagaaggaaacagatatgaaccttgatgttactggttttcttgattatatagttgctattatcgtacgtatattcaagctaaaagtaaactaa

SEQ ID NO: 108664 - DNA, 264 bp, Glycine max
  Peptide Sequence Number=SeqID_225442
atggaacacagcacattaatatggggacaagaatcactttccagcacggaatgtctggggcgggtgaagctatacgtgtggagagagcaaggaagccaagagccacccatggcttcaaattggaccgtggcctcctcaagaaacaaccgcgtgttggagtgccgttcaaagctagctgctgcaactgctgaatttgagctgtggccagaagttgctagcagctgggtaagacttcaagagtttttaatggttcatcatccttaa

SEQ ID NO: 108665 - DNA, 429 bp, Glycine max
  Peptide Sequence Number=SeqID_225443
atgtgttacgtggggaaagcaacaaagatcttcatcttcattgtgacggtgctcgttgttctgggtctagttttgggattaggactccttcgccgccaccaccacaacacttcaaataaatgctccgatgagtcttgcattattccttcaccagcaaccacatttccgaaccccaatttcaatacaccaaccccaccttcccccattgacaacaaccccacaaccccacaaactcctcctcagcttccaaatccaaatccaattcctcctcctcctcctcctaattccgataacccatctttgccaccgcctccgccgccggaggaaacgacccctccgaatcctcctagtgtggcggcgccacctatgaacacaccaacaccagggtcggcgcaggtgaccccaggtcctgtgcatgctatggcctag

SEQ ID NO: 108666 - DNA, 234 bp, Glycine max
  Peptide Sequence Number=SeqID_225444
atgatcaccatctatcctagcggtgttgcccacactgttcagctttcaaaagcccctaaagatatttacacaaaaaggcacactgtctgtggtgactcaaccacgatggtggtcggaagtgatgctaaagccttgggccattatgtattggctatggctctttttgctgaccaatgcccttatgaattggccatggctgtggtgagtttaccacaaccattgtcagatctttga

SEQ ID NO: 108667 - DNA, 396 bp, Glycine max
  Peptide Sequence Number=SeqID_225445
atggcaagcgatctattgagccttccctactgcttgtctaccacacaaattccacctagatcacatattagacatagaataaatgtgtttgagagtttcaaagatgaagaaggaaaattcaaggttaaaattagcaacgatgtgcaaggattgttaagtctctatgaggcatcatacttgagctttgaaggagaaactgtttgggaggcaaaggcattttcaagaacacatctcatgaacttaatgaaagaagggatagagagtactgaagtggcagaacaagttaggcatgtgttggaggggcttccctttcaccaaagctttcagagactagatgcatacggcgatattttgacatatacaataaaaaggaacaacataatccctctttgttag

SEQ ID NO: 108668 - DNA, 1065 bp, Glycine max
  Peptide Sequence Number=SeqID_225446
atgagtttcaaaggaagcaacacaatccaaaggaggttgatgagcgtgaccgagcttgccgggtatgtggatctaattccttggcataggtttgggtattgtgcgtccaacaatgaaatttacaaagcaataacggggttccaaagggtacatattgtagattttagcataactcattgcatgcaatggcctacttttatagatgggttagcaaaaaggccagaaggacccccttcacttagaatcacggttccatcttgtagaccacatgtaccccccttggtcaatatttcaatacacgaagttggattgcgtttagggaattttgctaagttcagagatgtcccttttgaattcaatgttataggaaacacagaaggaccattaacacctgcggaattgagcgatgaatcgactagctttcactttgaagcaatgttaagtctcttaaatcctaccatgctaaaccttagggaagatgaagctttggtcataaattgccaaaactggctacgttatttgtctgatgatagaaagggaattagctgccaaagtttttcccttagggatgcttttttgaatctaatcaaaggccttaaccccaggattgtgctcttggttgatgaggattgtgatcttagtgcttcaagtctcacatcaagaataaccacatgtttcaaccatctatggataccctttgatgcattggagacttttttgccaaaagatagttgtcagaggtcagagtttgaatccgacataggccagaagattgagaacatcataggctacgaagggcaccaaagaattgagaggttggaatctggggtgcaaatgtcccaaagaatgaaaaatgtgggctacctcagtgttcctttttgtgatgaaactgttagggaagtaaaaggtttgctagatgagcatgctagtgggtgggggatgaaaagagaagaaggtatgttagttctcacgtggaaaggaaacagctgtgtgtttgcgacagcttgggtcccctgtgaaatattgagggatcatcatatcggtatggatgcaagcctgtcttaa

SEQ ID NO: 108669 - DNA, 528 bp, Glycine max
  Peptide Sequence Number=SeqID_225447
atggtttcacaacaacaaagtgattccaccattcaacgagttcctcaaaaatggatagatctcgtccggaggtggggttgttctcgctcattgctacttcttatagtctgccaagaccaagacgtcacggagcaagcacttcattctttagctaactaccatgacttcttgcgccctgcaatgatcattttaaggctttgcgatgatttaggaacatcaacggacgagatgaagatgggtgaaatctcaacttcaattgcaagctacatgcacgaaaacggtctttcagaagaaaaagtccatcaatacttcaagactttgattgataaagaatggcagtacttaaataaaggccaagttatgggctctacactctccaaatctgtcatacaagttgcgattgaccttggtcgaacggctcgatatacataccaatgtggagatggcattggaagacaagacggtataacaaagaggagaatgaagttgtggctcgtagatcctgttgaagttaatgaggcttcatga

SEQ ID NO: 108670 - DNA, 101 bp, Glycine max
  Peptide Sequence Number=SeqID_225448
atggctcagtgcatctctacaagtgttgagaaaggtcatcaacgacgttcgagcattggaagaaggagattctctgccacgttgaaagagtacagaggcag

SEQ ID NO: 108671 - DNA, 123 bp, Glycine max
  Peptide Sequence Number=SeqID_225449
atggaggtactgtcttgtgcagtgaaggtcaaggtgcgttgcggtggtcggcggcagcaaacgaggtacgcagaaggtggtggctgtatcacgaacatacagcttagttacggatcaagttga

SEQ ID NO: 108672 - DNA, 1707 bp, Glycine max
  Peptide Sequence Number=SeqID_225450
atgtctttaaatgcaatggcatttacaaaacttagagtttcatcgtttacaagctcacttgctagtaacaattcaaggccatccatttatcaaccatggaacttatcgttgcaatcatcaaaaataggaatggtgccaaataaattatccatcaagtccgttgcttttagtgacaagattgttgcgaagacagagccatttgagagtgacgagaatggcgaagaggagaaggaggaggaggaggaggaagggttggtggagatttgtgtccctgattgtgacgacacacacaacaaaaagggagaagcggatgttgaagggaaggatgcagcggttggggggctctgtgcgggactgttaacgggaaggtgggaagctgccatgggaaagggaggcgacgtgatttctgctgttggtggaggcgacgtggttgctgctgttggtggtggctttgtaaaggaagaagatgggaaaagttggctagttaccttaggaagtagaggcggcatggtgccgactaggggtggtgacttcgcaaaggaagaagatggagagggttgtctgggtatcatggtattcaatttcaggagaatggcatcaagtttggaatccatggaagcttgggctgcagcgagtttggccttggcggccccgaggcagtccacgcaggcggcaaaaagtttggcgtacatcattgaagagcgacaggtgcctagtcaaacttatcttggtacgaaagatttggatcaagttataagaaaaggccaagaggcattgttaaactcaagtgatccattgagaacattgaagataattgacaccatccaaaagttaggaattgagcaccatttcgaaaaggaaatcaacttacagcttggaagggtaggggattgggacactgccgaagacctttttgccacagctcttcaattccgcttgcttaggcataatggttggcctacatgttctgatgttttcaacaaatttttggacaagagtgggaatttcaaggaatctgtcaccagagacatttggggcatgttaagtttgtatgaggcatcatatttaggtgcaaaaggcgaagaagtactacaacaagcaatggactactcaagggctcatctgtgtcaatcactcccacacctaagccctaaagtaagaagtatagtcgctgaagccttaaagcttccaaggcaccaaagaatggttgggttggaagccaaaaactacatggtagaatatagccaagcaagcaaccaaataccagctcttctagaattggcaaggctagactatgacatgattcaatcgatgcaccaaaaagaattagcagagatctcgaggtggtggaaagacttgggacttattgaaagacttggttttggaagagatggaccaagagagtgtttcttatgggcattggggatttttccagaacctcgtcattcaagttgccgcattgaacttgcaaaagccatctgcgttttacaagttatagatgatgtgttcgacacttacggaacattagatgaacttgttctttttactaaggcaatcaaaaggtgggatcttgatgcgatggagcaactacctgaatatatgaaaatatgttatatggcattgtacaacaccacccatgaaattgcatacaaaattcagaaagaccacagcctaactgtagttgcttgtttgaaaataacagtatga

SEQ ID NO: 108673 - DNA, 1320 bp, Glycine max
  Peptide Sequence Number=SeqID_225451
atggtgtgggcagaggagatcgttatgattccgatgatgctccacaatgtcgatgacctatcgcatccgcatggaggaagcgataagccagtgctccctacaccagatgtagaggctgatgtattctcagatgacccgatggcaccaactgatgtagcggacactggcgtagacattcctgcagacacaagcacccaggctgctgaggatgagcatgagggatttctggggggtccgagcgacccatccgtgctgacccagtatgcggatcacgttgcttgcagcgtatggacgggagaggagcgtcccgagttgaagttatcctctcacgggacgaaggtccatagtttaggcaggcctgtccctgccattgagggactagttgttgggacaggactaagtcctctgatcgcgtgtgacacagggagatgtctagtttccatcttgtcgcttctgcatctgcttgtggttggtgacttgcacgcctttcagcccttgcacgtggatgatgcggttgccaaggctgagacagggcagtttcatggaccatacgtacgcctgcaatgggaatgtgatatctatgagcatcgatgccaggcaggtcattggatagttgcggctcgcgcatatcttcttcatcttctgggttgcactctgtttgctaacaaaagtgcaaccaatgttcatgttgtgtatttggaggcccttcgtgaccttagtcagaccgggagtgctggatatacgagcattttccctcagtcgtggagtccactgctgatcaggactacgacgaggattcactgcgtgcctggagcgcctagactgactccggattccagatgtctgttggatcccatatggggagcatcgaccgatctgggacttccatttgatttcatgctattccggtctcctgcactggaggcccgttgctgtaccattcctgcttcgcctatcgattcatgggtgtcgtatgatgatatacacgacaggtggatgcactactcggatcatatggttccagcaggtgaggtgtgcgttgtgccaggccaggcatcagatcctttgccagatggtaatgctccgcagccccgggtcgtccctcaggccccacagacagatatccctcatgtgccagatctaggagcaccgtcgacatctgtaaggcccgctgtggaggagcctagacatgtagtggaagttttccatgggattgttgagaggtcggagcgccatctgagcctagggatggtcacgccaggctcatcgacacatgaggtgatcgaagaatgcctcaggatggccaagagtgtcacatag

SEQ ID NO: 108674 - DNA, 657 bp, Glycine max
  Peptide Sequence Number=SeqID_225452
atggacaacataagattcaccgcacccttcaaagttcagaagaaccttctccaagttcctttctcttatcacagacaatggctccggaactaccccaaatatgttttattccactgcgatggcgagatacatttcatccgggtaagaacacatggtactaaatgcttttttgctgatggcttgaatgattttagaaaggcacacaacctcaacgaaagcgtcattctacgtttggttgccggtgacaaaaataccactttcaccgtttatattgacggacctgcacaccaccactctagcctaaagcccatcatatatagaagaagatacatcttcacagttgatatcacacatgatatgctacaacaaaatctgtctttgacacttcctgcagcagcttccaaatttgtctatggctcaaaaaaaagtattaccatccaccacggacttccaaaatccaccaaatggccactcagcattcacaatcacatgccagctattacagaaccatggttcaacctgattcatgaaaaaaatttgagacccagagatgaggtagctttttactaccgttttcatgaccatgcatgggagctggtcattaggaaaaccatcaaatggaacaacaacaacaccgaccttgactttgatgaataa

SEQ ID NO: 108675 - DNA, 246 bp, Glycine max
  Peptide Sequence Number=SeqID_225453
atggttgcaattagtaaaactgttttgatcaaaagtgtagccgcagaattaaaccttctatttagagtgaaaggaagagggaatcctgagagggaaagggaaagaagagtaggcaacgaggggtttcaaggaagtgaacttactcggggaaggtggttttggaagggtttacaagggtcttcttgcaacgggagaggtactcttcctgctaaagtgatggaaaaagttggtatcacaggaagttaa

SEQ ID NO: 108676 - DNA, 231 bp, Glycine max
  Peptide Sequence Number=SeqID_225454
atggaaaagtgttcagcatcacctgttccaattcagaaaggagacaaatttagtcttgcacaatgtcctaaaaatgatatggaacgaaaacaaattcaatataaagcatctccatgctctctctattccctgttcatgtataagtttggtgggctcttagtggaaagagaaagtagagaatcttcaagtggaactgtagcaatgctacaaagctcaatctcgactgtttaa

SEQ ID NO: 108677 - DNA, 792 bp, Glycine max
  Peptide Sequence Number=SeqID_225455
atgaggagtcacgcgatgtcaattgcagagaaaattccggtcaaagagaaaataggctatagcctgggcgatgcagcgagtcatattgtatttgactcatcagtggccattctggcgtattactatacggatatctatggattacccccggccgtcatgggaaccatgtttcttctggtgcgtttattagatgcgattaccgacccgattatgggcgcaattgctgatgcaacctccacgcgctggggccgttttcggccctggctgctggcaatatgcgttccttttgcggtgagttgcgtactggtttattccattccggattttaccgaaaccggaaaaatttattatgccgtcggcgcatatatatttatgaccctgatgtataccgccattaatatcccgtattgctccctgggggcggcgctaacgtccgacccacgcgaaaacctctcgttgcagtcctggcgttttgccatcacaccgattggcggtgcgcttggcaccgccctcattctgcccctggctgattacctctacccgggcgacagagcgacaggtattcaggtggcgatggcgctcttcggcgcgatcggctgcctgatgtttatcgtctgttttgtcactaccaaagagcgcgtgcagcccatcaaagaggagaatctcaacattgcccgtgatgttaagatcctctttcgtaacgatcagtggcgcattctctccatctacaactttatgatgctggtagcggtggtgatccgcggcggcgcggtggtctattacgttaatact

SEQ ID NO: 108678 - DNA, 147 bp, Glycine max
  Peptide Sequence Number=SeqID_225456
atgacaagacagaccacattgggagaccagtcagggtcacattgttttgcgagaatgctccaaccatgtggaatcaacacaaacttaaagaagcactcaaaccgggtgtatttacctccaagacctagactccgagaagtctattga

SEQ ID NO: 108679 - DNA, 126 bp, Glycine max
  Peptide Sequence Number=SeqID_225457
atggcaaaggcaataactctgcctggcaagagagaaataatggacatgatgaggttgcatatcctgatgttgttcagactttcaccaggaagtagtgtgcaagtggaaaataacaggagctcatag

SEQ ID NO: 108680 - DNA, 466 bp, Glycine max
  Peptide Sequence Number=SeqID_225458
atggttggttgtgaccctaaagggaccttctcagttggggctaagctttcccgctctaggatcttttttggcttcctctcagactcgccatacgaggtcgccagtctctttgtcgatgattccccaccttctatggggatcatggtgtctgtgccatatgcctttaaacttgtcaagtctagtacgcagggccctgagaatgactcgattagctgcctctgcatgtccgttagtctaaggatgttcaacagaggtgaacttttccacctcgctggccgtaatttcttgaagtggtcttgcttctatccacttggtgaagtagttaataatgacaagagaagtgcatggaacgtctgcaaactcttgacatcttcggcatctcttggtaaagttgagggtgtctatcctaagtgttggctagttgtagcccgctcgcaccgctttagtggccaaggagcgtcctctg

SEQ ID NO: 108681 - DNA, 465 bp, Glycine max
  Peptide Sequence Number=SeqID_225459
atggaactactccttttgagagttgggcttagggaggcagaaagaacaagtattgttaggtttcttagtgggcttaatatggaagtaagggacaaggttaagctccttccatatagggacctagatgacctagtccaactttacataaggaaagaccaaggtcaaggcatcttaagggctgcaccttctaagcctaaagatgataagggaaagataatagaaaagcaatcccctaaggctagtatgcaagagaagactagctctataaagtgctttaaatgtcttggaataggacacattgcttctcaatgccccaccaagaaaaccatgattatgagaggccaagacatttatagtagccaagatgaggttactacttcgccttcctctagtgaaagtgaagaagcaaaaggggaagaatctagcgaagaaatctacccccaagaagaaggggaccttttaatg

SEQ ID NO: 108682 - DNA, 171 bp, Glycine max
  Peptide Sequence Number=SeqID_225460
atgaacactgaaatcaagacggttgtcgctgttgttggtccgggtgccatcggcaccacagtcgcggcggcgttacacgaagtcggccgcacaccattgctgtgtggacgtactccccgcgatcacctgaccctgcaagacggcgaccgctttatcaccgtacccggtccg

SEQ ID NO: 108683 - DNA, 885 bp, Glycine max
  Peptide Sequence Number=SeqID_225461
atgaaaaatgaaaatggtaacagagtttcagaaagcgagcagcggttacagcaatggcttggcagcattcacgcccgaagcggcgacctcgctgcaagtgaggctaaagttgtcgatctcctgcttgtcgatcctttgtttgtcggtacaagcacgacagcacaggttgccacccgcgcaggtgtatcaccgccgacagtaatacgcgctgcacgagcgattgggttcaccgggttcactgaacttaagatagagattgcccgggctcgtggtactgcccggttctttgcaccgcctgaagttctcacagcggatgcgacgttggcatcggtgctggaaacatcagttcgtgctggtgcagacgcgctgactgcgctcagtggtgctattgaaatctccgcccttgatgaggcggtcgatttaatccagagcgcacgccaggtatttgcatttggtgccggcccctctgcgacggttgccgctgatgctgtatttcgtctgcggacggctggtgtgataaccatcagtatccaggattatttatcagcgatgattgctgcccgcctactcggttcaggcgacgtgatgatcgtcgtcagctcgacaggtcgcacatcatccacactcgccgttgctgatgccgcatcctcggccggagcatcgcttatcgcaataactaaccagtacgatacaccactggcgacactcgccaacgtttcgctcgtggttggcggagcgccattaccggcacagatggccgctgccggcagtagactggcccagctagtcgttattgatacgctggtcgctgccctcactctgcgggataaagaacaaagtcgccgggctgaacgagcgggtattgatttgccggatatgtcctga

SEQ ID NO: 108684 - DNA, 1467 bp, Glycine max
  Peptide Sequence Number=SeqID_225462
atgccaaccatagaagaggagctagagaggagatcaatgctttatagcctcttgatgccagtgatggatcagtttgtgcccgatttggacaaaggcaaaggcatgtactttttgttcacaaaatcagaagccaaaacccctggtggactccttgctcgtccagttttgacaagctattacaaaagctcacatttcaagcaccgcaaacacgatccctacacaaactacacaagccccaatgaaaccattctctgccatgactcttaccaaagcatgtactctcagttactttgtggcctttaccaaaacgaggaagttcttcgtgttggcgcagtcttcgcctcaggtttcattcgtgcccttaagttcctcgaaaaacactttgtccgtttgtgcaatgacctaagaactggtaccttagacgccaaaatcactgacccttctgtgagagaggctgttatgaaagtactcaaaccaaatcccacgcttgcggatttcgtagaaactgaatgcatgaaggggtcatggaagggaattattactaggatatggcccaacaccaagtatgttgatgttattgtcacgggaaccatgtctcagtacattcccatattggattattatagcaatggtctccctcttgtgtgcaccatgtatgcttcttctgagtgctattttggcctcaatttgaacccctcgtgtgatccaagtgaggtagcttacacccttattcctaccatggcttactttgagttcttgcccctcgatgagatcaacggacatactaattcaatttctcaactggagcaagagcatttggtggatcttgcagatgtgaagttgggtcaagaatatgagcttgtggtcaccacttatgcaggactttatagataccgggttggtgacattctccgtgtagccggattcaagaacaaggctcctcaattcaacttcgtgtgccgaaagaacgtggttctgagcattgactctgacaaaaccgacgaagttgagctacataatgcagtgaagagtggagctgagcaacttgctgaattcaatgcatctctaacagaatacacaagctgcgtggacacatcaaccatccctggccactacgttctgtactgggaaattagcacaaatgaccataccccaacaattccttcttccgtttttgggcattgttgcctttcgattgaggagtctctaaacagcgtgtatcgccaaggaagggtgtcagagtctattggaccattggaaattaaggtggttgagaatggcacatttgacaagctcatggactttgctctcagccagggtgcgtccattaaccaatacaagactcctcgttgcgtcacatatgcgcccattctggaccttctaaactctaaagtgttgtccagttacattagcccaaaatgcccaaattgggttcctggtcacaaggactggtgcactcttcattga

SEQ ID NO: 108685 - DNA, 726 bp, Glycine max
  Peptide Sequence Number=SeqID_225463
atggagtttttgttattcccaattgtaatggtactatggagggcaactaatcactggcttgcatttgcattagatattgttttaaaaaatttcataatgtttatactgttcaacttgaattgcacgcagatgttagccaaggcccataacaaaggggatggatctaagtccctggctaagatactggcaaaatggaaagaatataatgcccagattgattccagcagtgatgcagataagccaattcgcaaagttcctgccaaaggatcgaagaaggggtgcatgaaaggtaaaggggggccagagaactcacggtgtaactaccgaggtgtcaggcaaaggacttggggaaagtgggttgctgaaattcgagagccaaacagaggcaataggctttggctaggtactttccccactgccattggagctgcccttgcatatgatgaagcggccagggcaatgtacggttcctgtgcccgtctcaactttcccaatgtttcagtttccagtttctctgaggaatcttccaaagattctccgtctgcgaatcattgtggttcctcaatggcagtgtctgcaaacgagtccatgatttcacctagtaactctggggtagatgcagaagaggatgttgatatggagcccatttccttatccttaagtgtaaagcatgagaatggggaaggtgaatcggggataagttcatcccctccttcttcctcatga

SEQ ID NO: 108686 - DNA, 159 bp, Glycine max
  Peptide Sequence Number=SeqID_225464
atgaattgtccaaagaactacgccacattatatgatttctttggtggattgttaagtgttgctgctttgattggggtactagattctcaaaagtctatctatttcttaagcatttttctttgggcaggaaagataccttcggaaaataatcaagcatga

SEQ ID NO: 108687 - DNA, 1347 bp, Glycine max
  Peptide Sequence Number=SeqID_225465
atgcgtctctaccgttattcccaaagacagagacattctccctccaaaagaatcacattctttgttttcttcttcttggccatggcttattcccgttggtgctggttcccactctacttagcagcctcaattgccctcggaatcatcgccatctcctcagcgatacgttccacttccaacaagaacccaccccaagatccacccataccccacgacatctcactcaacgcctccaacgctctccgcaaagcaggcttcatagtaatggcagatcttctccaccactctccctcattcttcaaaccgccgcaaaactcaaccatcttcgccatcaaagactccgccatcaaaaacacctcccaccctctctggttcctcaaaaccctcctcctctaccacaccaccacctccaacgcctattccttcaacgacctcgtcaaaattccccaaggaacgtgcctccccaccctccttcgtgataaaaatgtttctctcactaagcttgaccttgaccatgcaccaaactccgtggagattaatcacgtcttgatatcaaaccctaatatcttcctcggagagcaacttgccgtgcatggcgttcttgcgccgttctctccccttcagccgcaagaccttcttcaacggggttttggttttgctattcgcacacccacttgccgctccaacgacgtcaacgtctccgtttccaagaacggggttgagtggaaccgcgtcgttcacttgctccgtgcaaaagggtatgcttcgttctcgattgcgttgcattctgttcttgatgggataaagagagacttttctgggagtttgggttatgtcacaatcttcgctcctcgcgatttgactttacttggataccctttgactattcttgatagagctgtgaggcttcatattctgcctcaaaggtttgtttacaaagaaatctcttctctgccggttaggagtttgttaaagacgctcatgcctgatgagcatcttgagattgatggggttctggattttgtgccgggcatggttgttaatggtgttgtgattgtggcgcctgacatgatcatttcggagaaatttgtggttcatgggatttctagagcttttaagatggctgagtgcttcaactggcgtctttcagaagggttcacaaaaattcaggttgaaacagattcgcaagttgttcaaaggcttatcattcgtggttgtcttagaaatcagcaggctgccactttggttagagctataaatatcaagattctagcctctcagttatctttttacatgatggaacaatgtctacagagaaacaaatttcgttggagacgctcaagctaa

SEQ ID NO: 108688 - DNA, 330 bp, Glycine max
  Peptide Sequence Number=SeqID_225466
atggcactagagtctgaggctccaatgccaggactcaaccctttggaggttaaaattcaaagagaagttaaggtaagtgatcaaaagagagacaaagttgtagttcaaccagttgctgggtctagagggtcgtcatcatcacatgaagagggtgagtctaaagcagaagaagctgaggctccaagtattagaaagctaggaaaacatcattccgcagacaagtcagtggcaggtggaagtgtgatcttaggtggccttgttactgtcacttttgctgctgtcttttgctacattcgggttacaaggaaaagggataatagtgatcactga

SEQ ID NO: 108689 - DNA, 347 bp, Glycine max
  Peptide Sequence Number=SeqID_225467
atgcctgaagctccaaagcacttatgccacgatccaaaggataaccttgatgatgatgatgatgatggtagtagtaacaacaataagagagcactcgaatacattgaggaggtcaccaccaacgctgatgaaattcaagaaaaggtgcttgcccagatcctttctcgaagtgcaaacgctgaatacctccaacgccatggcctagaaggacgcactgacagaaacaccttcaagaatatcatgcccgtggtcacttacgaggatttaaagccagatattgatcgtatagccaatggtgatacctccccaattttatgctccaaacccatatcagagttcctcactag

SEQ ID NO: 108690 - DNA, 3000 bp, Glycine max
  Peptide Sequence Number=SeqID_225468
atgagaactggtgagcttctgttgttcttttcctttcttgtttctttggcgctatggttccaactctgtttcgctggagatactttgatcgctggccaggagataactcagaacaggactgggaaccttgtttcatctagccgcacatttgagctgggcttcttttctttaagtggagaaaaaaaatactacttggggatatggtatcgcgagttggagaaggaaacacaaaaagcggtatgggttgccaatagagacaagcctgttgaagattccagtagagtttttcgaattgcagaggatggaaatatggtggtagaaggtgcttcatcaaaaagatattggtcctctaaacttgaagcctcctcgtccacaaacagaacagtgaagctcctagattcagggaacctagtactaatggacgataacttgggaattacgagttacctgtggcagagcttccaaaacccaacagacacgtttctacctggcatgaaaatggatgcaaatttatcgttgatttcttggaaagacgccactgacccctcgcctgggaacttctcctttaagctgattcatggtcaaaagttcgtagtggaaaagcatttaaagcgttactggacacttgatgcaattgattatagaattgctaggttgttggaaaacgccacttcgggtaaagtaccgtacaaattatcaggaataactttaaatccagggagagcttacagatacgggaaatcaatgctattaatgaattatagcggggagatacaatttctcaagtgggatgaggatgaccggcaatgggataaacgctggtcaaggcctgctgacaagtgcgacatatataactgttgcgggagcttcggcttctgtaacaaaaataatttgaatctgaatctggagccttgcagatgtttaccaggattccgtcgccggcctgccggagaaatccaagacaaaggatgtgttagaaaatcaacatcatcgtgtatcgacaagaaggacgtgatgttcctgaacttaaccaacataaaagttggtgatctcccagaccaagaatcctttgacggaacagaagcagaatgtcaatcattatgccttaacaataataccaagtgttctgagtctcagtgccaggcatattcatatagtaatagtacgtcatatgatcgagatcactcctcgacatgcaagatctggagaagagatttatctactcttctagagaggtacaatagtgattttctagaggagttcgttcctggtcctattctgtctatcctggttaagagatcagatatagtaccatatgcaaaatcttgtgaaccatgcggcatatacgtgattccttatccgctaagcactgggccaaactgtggagaccccatgtacaacaacttcaattgtaataaatcgacaggccaagttaccttcaagatactgggaggaacatcacaccaagttatttggatcgatgaagataccagaatgttttacattcagccaaatggttcatatccctgtaattccagcaatcaaaatatcacgcctaattttccatttaatgtaactgatcagtgttctgaagctgatgatgatggaaagattaaaattacttggctaccagcaccagaaccgccctgtactgagctaatagattgccacaattggccccattcgacatgcagagaaacaagtgaaggaggaagcaggtgccgttgtgactcaaactataagtggaataacacaatcatgagttgcaccttagaagagcattcaaccaaccagctggaattgattcttatagtaattcttagtggcatggctattctggcatgcacaatagcatttgccatagtgcggagaaagaaaaaagctcatgagcttggtcaggcaaatgctcggattcaggagagcttatatgagagtgaaagacatgtgaaaggtttgattggcttaggaagtttagcagaaaaagacattgaaggcattgaagtaccctgttatacctttgcaagcattctagcagctacagctaatttttcagattctaacaaacttggaagaggaggttatgggcctgtgtataagggaacgtttcctggaggtcaagatatagcagtaaaaaggctttcaagtgtttccactcaaggcttacaggaattcaagaatgaggttattttgatagcaaaacttcaacatcggaaccttgttagactcaggggctattgcataaaaggagatgaaaaaatcttactttatgaatacatgccaaacaagagcttggactcatttatatttgaccggacacgaactttactcctggattggccaatgcggtttgagataattctaggcattgcacgtggccttctctatcttcaccaagactcgagattgagagtgattcatagagacctcaaaaccagcaacattcttctagatgaggatatgaatccaaagatatcagactttggccttgccaaaatatttgggggaaaagaaactgaagcaagtacagagagaatagttggaacctatggatatatggctccagagtatgccttggatggatttttttcaatcaagtcggatgttttcagctttggagtagtcctactagagattcttagtggaaaaaagaacaccgggttctatcagtccaaacaaatttctagccttttgggtcatgcatggaagttatggacagagaagaagctactggatttaatggatcaatcccttggtgaaacatgcaacgaaaatcaattcattaaatgtgcagttattgggctattatgtatacaagatgaaccaggtgatcgacccactatgtcaaatgttttgtacatgcttgacatagagacagcaaccatgccaattcccacgcaaccaaccttttttgtgaacaagcatttttctagttcagcttcctcttctagcaaaccagaaataagtctgcaatttgagagtagttatcaagaaggtcgatag

SEQ ID NO: 108691 - DNA, 288 bp, Glycine max
  Peptide Sequence Number=SeqID_225469
atgatcgtcaacagtcaccaccaacatgacttgttgtcaccattactattcaccaccactaccaccaccatgatcaccgtgattaccaacaacgatggtggtgacaaccacgatgatgatcatgttgatggcgatgatggtgatcatgatagcaatcacaatagcggtggtggtggttgtagtggaagcatattttgcagcagtttgaaattcaaaatgcattgcgggaagttgtcagggaggctacagataatgcctgaacaaaccaatagcagtggcaagccatga

SEQ ID NO: 108692 - DNA, 282 bp, Glycine max
  Peptide Sequence Number=SeqID_225470
atggagtcaggaaatgttaggtgcatccagcaatattgctggtgcacccagcaattagaagaaccttcttctggagaagttaccggaagaattttttccagtagctttgttcttccagaaaaaccttcttccagagaagcttactggaagaagttcttccagataaacaatttattcttccggaagaacaaagttaccggaagaagttcttcaggcattgcacatggcatatttggaggcaaagaaactggatcaagtacagagagagtaatgggaacctag

SEQ ID NO: 108693 - DNA, 471 bp, Glycine max
  Peptide Sequence Number=SeqID_225471
atggactctctcatcactaggctgcttcgtgtgcctcatgcactgaaagaagaaaatccagctgagctaatggaaacatcagtcatggtttcacctcgggggagagggggaggacgaaacagtagaggaggtcgtggaggaagaggtggacgtcctcaatgcacatattgcaagaggatggaccacactcaagagaattgttactccctgcatggcttccctgacaaagtagctcaggtaactcagacagaaaaaccagagtctaagttctctgataaagaatatcaggagtatctgaagctgaaatccgagaaatccagcagccaggcttcatcttcctctgtaccatgttattcaacagcatgcatttctcaatctgttgacggtcccagtccttggatacttgattcaggtgcctctgatcatatttctggaacatggcacgggtcgactgattggagaaggatgtga

SEQ ID NO: 108694 - DNA, 607 bp, Glycine max
  Peptide Sequence Number=SeqID_225472
atatggcgagtccgatgacatgcgagcgtaccttatggttatccgcacattttgtcatccacagacggcgagttcgatgacattcgaggggactaaaatcatcttctgcaccgtttgtcatccagagatggcgaatccgatgacatgcgggggtagcttatggttatctacaccttttgtcaaccagagagacgatgagtccgatgacatgcgggggtaccttatgtttatccgcaactttggtcaaccaaatgcaaacgagctcgttaacacagacggtgagtccgatgacatgcggcggtaccttatgtttatccgcaactttggtcaaccaaaggcaaacgagctcgcaagcgagcccgttgacacgcaaagactaacgtcgtcttctgcaccatttgtcatccagagaaggacggcgagtccaatgacatgcgggggggcaagcgagtccattgacacatgggtacttatggttatctgtacctttagtcatcaaaagatggggtatcttatggttattcacaccctttgtgatcaagagacaccgagttcgatgacatgcgggggtgccttatggttatctgcaccttttgtcatccagtga

SEQ ID NO: 108695 - DNA, 318 bp, Glycine max
  Peptide Sequence Number=SeqID_225473
atgaaagttttacttgtaaagaaaacaaaacatcagtccagagttagtggacttatagtcttctataacattggggttgtggttttcatagtccaaccaaatatatttctagaagataatacagaaagagagaactgggaacaccactccttatcacttccctcgtccaagtcccagcatgggaaagtgcacagaaaaaaagaatttaatccaacaggatccgataatggctggtattcaaacttgaggaaggataaaatggttattgaaaaattgcagaagttattcatgccttacctgaagttagtagggaaatag

SEQ ID NO: 108696 - DNA, 1497 bp, Glycine max
  Peptide Sequence Number=SeqID_225474
atgacattttgtgttctcctctcattcaacaatcccaaaccaagttctttcctaagttccacctttgttcttggccaaacaacacctttatccttctctatcaatgaaaaactaaaaccccgcaactatctcaacagtgtcttagtttcaatttcttgttcatctatcaaactcgtacgtgaccgttcactcgacagacatgttgtcacgaagaacaaaactaggtttgttcaaaagttaaaaactttacttctctccaaaccgaaacactatatcccacttcacattctgtcaaaatgccgcacttatctttgtctttctaagcctcgttccatactttccatgattcatcgttatccatccatttttgaacttttcaatgtgccatggccacccacaccactcaacgcaaccaagttgcatccccaactctgtgttcgattaactccagctgcagctgcccttgctgctgaggaattgagtcttcaatcttccatttccaacatgttggcaaccaaactccaaaagcttcttatgttgtcttcgcaccgccggttgcttctgtcgaaattggttcactttgctcctgatcttggtctccctccgaattttcgatcccggttgtgcaacgaccatccggacaaattcaagattgttgacacgccctatggccgtgcacttgagctagtatcttgggatgtcaacctggcaatgcctttggtgcctcctgcatcatcatcccattctcttggtttcatagttgaccgtcctttgaagttcaagcaattgagccttcgaaaggggcttaatttgaagagacgtcatcgggatttcttgctgaaatttgaagaaatgccattggtgtgcccctataggaatcctgctgaggctttggccaaggagtcattggaggcagagaagagatcttgtgcactggtgagggaggttcttgcaatgacggttgagaagcggactttaattgaccacttgacccatttcagaaaggagtttggcctcccaaacaagttgagagggatgataataaggcacccagaattattttatgtgagtttgaaaggggaacgagactcagtgttcttggtggaggggtttggtgagaagggtgacttgttggagaaggatgaggatggggttttattcatacaagataaatggatggatttggctcgggaatccaagagaatgagacgagagagaaggaagggtaggattagccaagatgttggcagcttgaatgatgctgatcaaaataattatgacagtgatgatgattacgatgataatattgagatagataactttaaagaaggttatgatgatggttttgaggatatatttgaagagttggattttgaggatgaggatgatgatcatacaaacaggttttttgcccaaaacaacagtggagaattttggattgcaggaccttttcctattcaacatggtttggatgaagtgcagacgcaaccttggtag

SEQ ID NO: 108697 - DNA, 1422 bp, Glycine max
  Peptide Sequence Number=SeqID_225475
atggtggacttgatttatatgatcttagatgagtttggatataattcaactccaaaaactagttcacgcgattcagattctctgtggcagagttttgatcacccaaccgacatgtggcttccgggcggcaaaatcaaactcgacaacaaaacaaagaagcctcaatacctcacttcatggaagaataaccaagatcctgcaatgggtcttttttctctggaattagaccccgaaggaagcacttcttatttgattctttggaacaaacctgaagagtattggacaagtggtgcttggaatggacacattttcagcttggttcccaagatgaggttgaattatctctacaatttctcgtttgtgacgaacgagaacgagagctatttcacctattccatgggctggtcaagcaactctcgtggctggataatgctcttgttttggtcacagccgcgacagcagtgtgaggtttatgccttttgtggttttgtgccaaagtcaccgtttgattggaatctggttgattactcaggtgggtgtaaaaggaaaaccaagttgcaatgcgagaattccaatccctttaacggggataaggactgggaatgtgaagcaatttgcttgaacaactgctcctgcacagcgtatgcatttgacagtaacggatgttcgatttggtttgctaaccttctgaatctgcaacagttatccgcggatgatagtagcggagaaactttgtatgtgaaacttgcagcatctgagtttcatgatagtaaaaacagtaatgctactattattggtgtggcggtgggagtggttgtttgcattgagattctgttgacaatgcttttgttttttgtgattaggcaaaggaagagaatgtttggagcaggaaagcctgtggagggttcgttggtggcatttgggtacagagatttgcaaaatgcaacaaggaatttctttgagaaattgggaggaggagggtttggttctgttttcaaaggaacattgggtgattccaccagggagagaaacagttcagaacagaagttagcaccaatggggacagtgcaacatgtcaatctggttaggctccgcggattctgctccgaaggtgccaaaaggttgctagtttatgattacataccaaagggctccttggatttccatttgttccataacaagaactctaagccagaaaacattctcctagatgctgaattttgtcccaaagttgcagactttggccttgctaagcttgttggaagggatttcagcagggttctcgcaaccattagaggaagaagaggctatcttgctccagagtggatttctgggatgggtatcatagccaaagctgatgtttacagctatggaatgatgctttttgaatttgtatcaggaaggaggaactctgagccatga

SEQ ID NO: 108698 - DNA, 1322 bp, Glycine max
  Peptide Sequence Number=SeqID_225476
atgagaaacgtttcaaagaataggttcttaacctgtttccgtcctgtggttgacatagatgacatgctcgagcctaaagctgctgttgttgatgattctgctagttgtcgttttgcatgtatcccggttgcagacaaacatgacgccaaaaattcaacgaccaaagccacgctttctgaccaagatatgttagcacagaattggattgtcgtgcctcgtcctcaaaaacgaacgttttctaagataattaaagccgatttgtttttattgcgtgattattcggcatacacagaaagttcatcaaccggtgatgagaagaaacaagcttttgtgggcaccaacattcagaaaatcaagcccccagaatggtcttcgtcgatttcatcttcaaattcgcccgaatcaaagaacgagtcccctaaagaccaagtagagaagcaaaagaagtttcggtgcttaggaatatactgggttcttgtaagcttagtggttacggtcttttggggtaaggttctcaagttgcggaacgcagaatccaaagcacacaagaatagccgtagggaccgtaatggaaggagtggtcgaaacaaaggaactctgcagttgctcattggagtcagagccacaccgatgtacagcatgagaaaccaacggttctgcgtctatcttctcaccctctttttcaatttgttcacccacaattttcttgcagctctcacaaccatttctacaaaccaaactctcactggagatcaaactctagtttctgaagctggggtcttcgaactgggtttcttcaagccagacaaccctgtctctgataagagcactgccaagttaacaatatctggtggcaatttagttctcttagatgcgtcttcaaatcaagtttggtcaacaaacataacttctcccatgtcagattctgtcgtagttgctgttcttctagattctgggaatcttgtgttaacaaataggcctaatggtgcttctgcttcagattctctgtggcagagttttgatcacctaactgacacgttccttccgggtggcaaaatcaaactcgacaataaaactaagaaacctcaatacctcacttcatggaagaataaccaagatcctgcaacgggtcttttttctctggaactagaccccgaaggatccaatgcttatttgattagttggaacaagtctgaagagtattggacaagtggtgcttggaatggacacattttcagcttggttcccgagatgaggttgaattatatcttcaatttctcgtttgtgtcgaacgagaacgagagctatttcacttattccct

SEQ ID NO: 108699 - DNA, 273 bp, Glycine max
  Peptide Sequence Number=SeqID_225477
atggaaattgctgaaaccactgaagaaaacctttgtaagaggaaggtagagtatgtgaacccagatggaaatgagttctacctaaagagaaatcttgagaaaaagctattgagtgttaaggctgggaaaccatttaagtatcttacttatgataaggagagcgagagctatatttatgatgaggaaatcaaaattcccaatggaagtctttttcatgctttaagggaggatgggaggttgaagttgtacatgcactttttggatgaagagtga

SEQ ID NO: 108700 - DNA, 285 bp, Glycine max
  Peptide Sequence Number=SeqID_225478
atgtttaaacttttaaataatcagacgaagaaaaggaacctgatcttggtggaggaatcagagcccgaggtagcgatcaaagaagtgataaagaagattgagaacaagaaattgggagatgggtggctggtgaagcagactgtgcggtttggcattggcgatggtttgggtaacatgcagctgaccctcgcggaggctggcagggtggctgtgtcagtggcagatatggggaggatggtgaacaaattcggtgagtattatccgagtggcctcaatagggattaa

SEQ ID NO: 108701 - DNA, 297 bp, Glycine max
  Peptide Sequence Number=SeqID_225479
atggtggttttggtggtggcagtgggttcagaggtggtggtaagggtgacagaggcagaggaaggggggttggagaaagaggaggaaacaggggcacacccttcaaagctagaggcaatgatccttcatggagggcctcatgatgtctctttgtcatacttttcaaagtatttggtagcaaatatactcttgaactttcaagcattagtttgggccaatatagttaaacttatgcctagagagatggatggccctcatacagataaaaatggatttaaggctgttgcttttttatga

SEQ ID NO: 108702 - DNA, 315 bp, Glycine max
  Peptide Sequence Number=SeqID_225480
atggcttttagctctggttgtgttctaccgacaaggatcaattgggttcagatgcatggtgtgcctgcacttgttcagttgagaacaccgccacctgcaatgatggggcttcctaatcttccagtatctttaacaggcccaacacaaaagtataaaaggagggcagtgacaagtgcaaaggtatcgtcagaagaacgaaagcaatggcttcagctaaaaggtgaagtggttgatgatgctgatgcagaacaggctgctaaggagaatctgctatatggagagggagagtttgatgaaggcaaagtacaaggttga

SEQ ID NO: 108703 - DNA, 285 bp, Glycine max
  Peptide Sequence Number=SeqID_225481
atggtggaaccatcgaagaagcgcaagggttcttcaagtagaagccaacgacattctgaggctcaggatactccaattccttcctccatttcctcctcctcattgttctcatcggaagaaaaacgtatacggtacacaaacctcttctcctctcgttctatcattgaccctaagttcatagatatggatttcttttctgatgagagtttcaaatgcattcaagcatttcaaaattcaaatctcattccttttatgtctttaaaactgcttgtgtattctgaattg

SEQ ID NO: 108704 - DNA, 882 bp, Glycine max
  Peptide Sequence Number=SeqID_225482
atgtctactgaggtaaggggaggtaaatttataactgctagaatggaccttatgattgcaatgattgatgcttgtagtctcattgatatggaagctactggattgaaatattcttggtataagaagcaagtgggagaggttataatgaagaggcttgatagagctcttgttgatcaaccttatcggcttgctttcccagaagcctttgtggaaaatttatgtcgagtatactcggatcattgccttatgttgattaagtgtaagggtatgcagaaacctcatgggaaaagaccattccgctttcaagctgcatgggtcacttataatcagtatgatggagtggtttgtattgcttgggctaaaggatcccccattgtgttgagaggccttacgaaggttcatggccttcctaagctccctgatgaggctagagaagccatttctactccagtgttgaaggagaaagtccagcgtgcaatgaacatgaaatccttcaaggctcttagccttgatggatttcaacctttctttttaagcattattggtctatggttggggaggatctctagaatatggcctatcaatctctgcaatgttgtatacaaggtaattacaaaggtcttagtctcttgccttcaacctttcctgaatgatttgattgggtcattccagggcaacttcatccatggatgtggtactacggataatgcaatccttgctcaggaagctatccattctattaccaagtctaaggctaagaagggcttcgtggctattaaagtggacttgggaaaagcatatgataaggttaattggtctttcttgaaatcaactctccttgattctggaatccctcctgatactgttaatcttatcatatag

SEQ ID NO: 108705 - DNA, 1710 bp, Glycine max
  Peptide Sequence Number=SeqID_225483
atgacgaatgggatggggaagtcaagagtgctatttttctctatgcttgttcttgcaacctttcagaaagcagtctcagaagagcaccaacccctttcaaaagttgccattcataaaacaacacttgctcttgatgaacgtgcttttatcaaagccactcctaatgtccttggcttgaagggacaaaatacagaatgggttacactgcaatatagtaatccaaaacccacagtagatgattggattggagtgttttctcctgcaaacttcaatgcttccacctgccctgcagaaaacatatgggtgaatcccccatttctgtgttctgcacctatcaagtatcaatatgccaatttctccagtcatggttacaagaacacaggaaaaggttccttgaagcttcagttgattaatcagagatctgacttttcatttgcgcttttcacgggtggcttaactaatccaaagctcgttgcagtgtcaaataaagtatcattcatcaatccaaatgcaccagtatatccccgattagcacaagggaaaacatgggatgaaatgactgtaacttggacaagtggatatgaaatcagtgacgctgaaccttttgttgaatggggccctaaaggagggaaccttgtgaaatctcctgctgggacactgacttttgatcgcaacaccattcaagaataccaattcaaagcatctccttatcctggtcaaaattccttacaacgagtagtcatatttggtgatatgggaaaggcagaagcagatggttccaatgaatataacaatttccagcctggctcactcaacactactaaacagatcattcaagacttaaaagatatagatattgtcttcaacattggtgatttaagctatgctaatggatacctttcacagtgggatcagtttactgcacaaattgagccaattgcatcaactgtaccttatatgacagcaagtggcaatcatgaacgtgactggccagatactggatcattttatgggaacttggattctggtggtgaatgtggtgtactggctcaaaccatgttttatgttccagctgagaaccgggaaaaattctggtactcagttgactatggtatgttcagattctgcatagctaacacagaactcgattggagaaaaggatcagaacagtataaattcattgaaaattgcctagcatcagttgacagacaaaaacagccatggctgatatttcttgcacatagggtacttggttattcttctgcaggattctatgtggcagaaggctcttttgaagaaccaatgggaagggaggaccttcaatatctttggcaaaagtataaggttgacatagcaatgtatggacatgtccataactacgaaaggacatgcccagtgtatcaaaatatctgcaccaacaaagaggagcacaattacaagggctccttggatggtacaatacatgtagtggttggaggaggaggagcatcccttgctgaatttgcccccataaacaccacatggagtatatttaaagaccatgactttggatttgtcaagcttacagcatttgaccattcaaacctgttgtttgagtacaagaaaagcagtgatggacaagtttatgactcattcaaaatatccaggcagtacagggacatcttggcttgcactgttgatagttgtccccctacaacactagcatcttga

SEQ ID NO: 108706 - DNA, 303 bp, Glycine max
  Peptide Sequence Number=SeqID_225484
atgaacattgaaagttacaaagtcaaaaaggaaagtaaagacctgcaagtagtagtgaaggcaccaggaacctcaaagatgatgactttcttgcagttggttgtgttctacccacatgatccaaatgtgaaccagaagagaagagaagaaaatagaagaagaaaggaaggaagaggcagccaaaactgtgtgggactcgcgggtgcagatgaaaatccaaaatggggcaaaaaggaaacagtctctaaatgcaccgagaacatggagccatgcaaagttgtcgtttccagcgaacctctctag

SEQ ID NO: 108707 - DNA, 153 bp, Glycine max
  Peptide Sequence Number=SeqID_225485
atgcagattggacttcaaggacaagctcaacccaaaagtgaagaaggacctcttttgttgaagggagtgacctttgtgaagatggggattgttgacaaattcctaaaatatgctcagaaacacgtaaagaagaaggtcaggaaggaaccataa

SEQ ID NO: 108708 - DNA, 330 bp, Glycine max
  Peptide Sequence Number=SeqID_225486
atgagtttaagagtactcttatgtgatgatgacgacaatgatgataatggtgatgtcaggagtaatgatgatgataaagatatcaatgattgtcatagtggcagtggtgatagtgacggtggtagtggtgatggaggtgacattggtggtggcggtaatgctgatgatagtggcagtgacaacgtggtggtggtagcaatgttggtggtagtgccgtgtctagaggaaaagattatgatggtagataacaataacaacagtcaattcattgttgaggaagcatccctcacgaggccaccaagcttcgcgggaaagggttatccttactag

SEQ ID NO: 108709 - DNA, 276 bp, Glycine max
  Peptide Sequence Number=SeqID_225487
atgcaggctagtgataggtttaacatcaattctcagctcgagcatctccaagccaaatatgttggaactggccatgctgatttgaacagatttgagtgggcagtgaacattcaacgtgatagctatgcatcatatattgggcactaccctttactgggattctttgctattgctgaaaatgaatctattggaagagaacgctacagctttatgcagtgttctactgtattgggagagttcatgagggaggtggagtgggaattaccagtagtgtaa

SEQ ID NO: 108710 - DNA, 303 bp, Glycine max
  Peptide Sequence Number=SeqID_225488
atgtacatcaagtccaaccactatagactccggctaatcatcacaaatggagatatacccattcctcaacttgaagcagaattaatagacgtaaaccttgctataatggagttaaacacaaaagctcgttatactctgacatgcgctctatctaagaatgagtacaacgaggttgtcactttgatgcgacattatgaaaacttctccatgaaagaaggagaatctatggatgacatgtttagaagacttcaagtgcttctgagtggtcttgaacctctaggacacaccttcaccaaagcttag

SEQ ID NO: 108711 - DNA, 258 bp, Glycine max
  Peptide Sequence Number=SeqID_225489
atgattttaatattcaatcaacatccccatgataagtttggtctaagactagaaaaaggagcatcatcttctaagtcacaatttgtcttagacaaatgtgacttctatggggaaagctttatgttccttgacctaaagtcaattgaaggagtaatagttgcctttggaggaatgggtaagggaaatattactagtataggtaaaatcggtattccttctttagcctccataaacaacatcttatatgttgaagtataa

SEQ ID NO: 108712 - DNA, 1074 bp, Glycine max
  Peptide Sequence Number=SeqID_225490
atggagaaaggaattcaaaactggagcgaatcggtggaagaccttgtagacgccggcgacgtggaatccgcaatctcactcctcgaatccgtcgccgaaaccctaaacccttccgattcggcctctgctctctccgacttggccaacctttactcctccagaggcttctctctcaaagccgatcaccttctctctcgcgcttctctcctcaaacagcttcaccattccaatacccctgccgaacgagttccgaaagagtccaaggaggacggagtcgttaaatcaaccactgttgcttcgcgtcgtgctgctgaaggaagcgttgaaaagcgtggggagtttcctgctcagacctccgccgccggtggttcttccgatgaagattgggaagcaatagccgatcttgaacctgatgagttactgcccacggtttcctgggattgttcatctggaatatcgaatcttaaattggagaatgccaaaagtggaaccccaaaaagacgcggaagaggaacattctcttatgagaaaaaggagctttatagtgaccagttacttgataggtcggtcgttgatgttgagcgggaagagactccccgtagttcagaagataatacagatgtacaaatatcaaaatatgggaccggtcatgttcttgttctggctgacttttcaccaagtactaggacgacagagctagagaagctttttgagaacttccaagatcgtggatttgtgattcgttgggtcaatgatacagttgctcttgcagtattccgaacacctgcagttgcactagaggctctaaacagtgttcgttgttcattcaccacgaggatacttgatgaagatgatacacttcttagttcgattaaagcaagagacttggaaccaccacggctacgaccgaaaacttcagcccaagcagcacagaggttgattgctcatggcatggggttaaaattgtcatctacgggcgttgggtcccgagaatatagaaagcaagaagatgctaggagggaacgtatcgttaccaggcaaaaattgagagatgaggcttggggagaccattaa

SEQ ID NO: 108713 - DNA, 117 bp, Glycine max
  Peptide Sequence Number=SeqID_225491
atgaccactaaggattctgataaaaatagggatcttttaggggcatattgggataagctctccgtagaagaggcaaaggaagttgtgtcattcaagaatgtgattttggagatatga

SEQ ID NO: 108714 - DNA, 1196 bp, Glycine max
  Peptide Sequence Number=SeqID_225492
tgccccgatcggtgtggatatcgtcgccaacgccttcaacggtgccgcaggcagcatcgtggatgtctccggcggaggtgagttgaccggcgctgcgttcgtcgccgggcgcggtggctcggtcgatgtcctgcggcattcgttggcggatgccaatccacgctatggcttcagtcgcgcgggcaatgcggtctacgcaatcgtgccgggccgagcggacgtgcaggcaccgctggcgaccggtgacggcagcgtcgatccccgtgtcggccaggagatcgtcattccggacggcgtgcctggactcccggcgggaacctacacgttgctgccggcgaactacgcattgcagaagggcgcattccgcgtcgagatcggcgccgagagcgcgatgggcaacgtctcgccggtggcgaccggcaccggctcctggcgcatcagcgggcaccgcgcgcagggcctgggcggggcggtgtcgccgttgctcaccgacctggtgctgacaccagcggaggcggttcgccgccacgccggctacaacgaaacctcctacaacgcgttcgtgcacggcgtggccgagcggcgtggcgaagcgctgcgctggcggacggtggatgccgggagcctcaacctggtgttcggtgaaggcgcaggacggtcgggtaccccggcggcaaccttcctcggcctgtcccgctttggcgccggcagcagtgacgggctcggcggcacgctctcggtcaatctgcgtgtctccaatggtgcaacgctggagatcgccagcgagggcgccgatgccgccagcgggcgcggcgctaccgtctccgataccacgctcaatgcattccgtccggtaacgatgctgatcggcggcacgctgcggcgcgatgcaaccacctatgcgctggagggcggcgcacagcacatcgtggtgcgcaacggcgtcaacctgacggcgcaggaagtgctgctgtcggccgcgttcggaggcaggggtatcctggtcgagcagggcgtttcgatcgacaccctgtcccagtcgggcccgtcgagcgtggcgcagcccacggcgccctacctggtcgcgggcggcctgcttgccgtgtccaaccagcgcctgacggcgctcagtgcacagggcggaagtgccggcgggccggtagcgatcgacatcggcggttgcgaggcggactgca

SEQ ID NO: 108715 - DNA, 1191 bp, Glycine max
  Peptide Sequence Number=SeqID_225493
atgacttggaaaagcaggggagacctgcttcctaaaagtgtcatgtctcagaaatggatgatttttctctgtattggatgcttctgtgctgggatgtttttcaccaacaggatgtggactattcctgaacctaaaggacttgcacggacaacagctatggaggctgaaaaattgaatgtagtttcagagggttgcaattcaagaattttgctagagaaggaagtgaagggtgaagctaaaggcatctatagtgaggttttcaagacacaaaatgccatacaaaccctggacaaaactatttcaaacttggagatggaattagctgcggcaaaggcagctcaggagtctattcgaggcggtgctccggtaccggaagatatcaagatgagtgaatcatctggtaggagaagatacctaatggtcgtgggaattaacactgctttcagcagcagaaaaagaagagactcagttcgagagacatggatgccacaaggtgagaaaagaaagaaattagaggaagagaagggcattatcatccgatttgtaattggtcatagtgccacatcagggggtatcctagacagggctattgaagcagaagatagaaagcatggagatttcctaagattggatcatgttgagggatatcttgaattgtcagcaaagacaaagacatactttgccactgctgttaacttatgggatgctgacttctatattaaagtcgacgacgatgttcatcttcttacttggccactttcttgcagaggggtaaggtaccatgaaccagaatactggaaatttggagaggctggaaacaagtacttccgccacgccactggacagttgtatgccatttcaaaagatctggctacatatatttcaaataacaagcacgttctccacaagtatgccaatgaggatgtctcactaggttcttggtttattggacttgatgtgaatcacatagatgatcgaagactctgctgtggtacaccaccaggggtttattacactgttagaaagattgtgaatggaaagcacaagcaggcaacgtttgtgttgcttcatttgattggacgtgcagtggaatttgcaggtctgctgaaaggatcaaagaggttcacaagagatgtggggaaggtgagaaagccttgtggaatgcctctttctaagtggcatggcagctag

SEQ ID NO: 108716 - DNA, 582 bp, Glycine max
  Peptide Sequence Number=SeqID_225494
atggctaggaagaaggtggacctttcatacataaccaacgcccggaagaggaaggctacattaagcaaaaggaagaatggtttgatcaagaagatggatgaaatcagcactctttgtgggattgaagcatgtgctatattttatactcccaataatccccagccagaggtttggccatctgattcgggagcccaaagtgtgctttctaggtttaggaaagtgtctgaactagaacaaagcaaaaaaaagttgagtcaagagagttttttgaggcagaggattaacaaagcccaagtacaacttgggaaactaaggaatgaaaataggaagaaagaggtgacccttctcatgtttcaaaaccttaatgctaagaacaattttgaaaattcaaatatgattgatttgaatgatgtctcaaacttgattaatcataacttggaggaagtaaaaaggaaaatcaatatgagccaagcccaagaggtgaaaccaattgttgacaacgaaggagaaaccatgagtcaaggagggaaatcacttgtgaatcatgtccaagggacagagactaatgtggatgccatgtag

SEQ ID NO: 108717 - DNA, 774 bp, Glycine max
  Peptide Sequence Number=SeqID_225495
atgaagcaggagaaggacgctttctacgtcgttcggaaaggggacgttgttggaatctataacagtctggctgattctcaggctcaagttggatcttccgtatgcaatcctcctgttagtgtgttcaagggatactcgttgtcaaaggacactgaggagtatcttgtctcgcatggactgaagaatgctttatacacaattagggccactgatttgaaagaggatttgtttggcatgcttgttccttgccctttacaggaaccttctaccaaagagagcacatcaaataaggatgtatctaagaagagatctttgggagtgcttggacaagatgagaaagtaatatctgaagatcccttgagaaagcaagtcaagttagatcatgctgctgtggctgaagcacctttacatgcaactgtaagtggaaatgataccgatgcaggaaatcctggaaaagctggtgctggggctattctacgagctaatgatggaagtgtgggtatagcaacaaacaatgctgctgaatatcgtgcaatgatattgggaatgaaatatgctcttaaaaagggatttactggtattcgtatccaaggtgattccaaacttgtttgcatgcagtgcggtgtttcaacaccccactcaactcttcaacctcccaccattcccaattacgttggtggttccacttcaaatgcactattgacagcaagctactcatctgaaccaattttagagacactacagaataaccttggcaaactcaacagtcaatga

SEQ ID NO: 108718 - DNA, 606 bp, Glycine max
  Peptide Sequence Number=SeqID_225496
atgaccaagtcttgctttgttttttcttctgctactttgtggtctccttatgccaccgttgttgcttttgttcatcctcctacaaataatcttgctaccttttatgatgaacccaacagttgggtgttgagtgggacatttgtgtatttgagcttaggaatagaagtagagggaactagtgaagagataaagaagacggaggcgggaagaagaaagttctcaactttaccattttcatccaccaaaaggctcgttacaagagccgctgagtacaaattcccagaccctattcccgaatttgcagatgccgagactcaaaaattcaaaagccaccttctcaaaaagctttcaaagaaagatatgtatggagaatcaattgaggaagttgtaggaatttgcactgagattttcagcactttcttacactccgagtatggaggtcctggtacactcttggtccttcctttcgttgacatggccgatgccctaaatgaacaaggattgcctggtgggccacaagctgcacgtgctgcgatcaagtgggctcaagatcatgttgacaaagactggaaagaatggactaatggtgataacaacaaaaaatag

SEQ ID NO: 108719 - DNA, 462 bp, Glycine max
  Peptide Sequence Number=SeqID_225497
atgactataatggagctaaacacaaaagcttgttgtacattgacatgcactctatctagaaacgagtacaacaaggtatgcagattaaagacaactaaagagatttgggactctctaagcattaactatgaaggaataaaagatgtccaactaagaaaggatgtcactctatcacaccaatctctagggcacaccttcaccaaagatcatactatcctaaagatcctagatagttttcccaaggtgcgagaaccaaaaacaacaattattcaagaagctagaaaccttaagactttagcatgggatgaacttctgggtactctaagagctcataaaatggctgagtctgacagcttagataacaattccgagggatccacagatgatgaagtggctcttatgtccaaaaatttcaaacaaatgataaagaagaaaggaaagttccaacgttcctccagatga

SEQ ID NO: 108720 - DNA, 771 bp, Glycine max
  Peptide Sequence Number=SeqID_225498
atggataaaggaatcttcatagggtattttgatacatctaaagcctacatagttttcaatacaaggactttggttgtagaagaatccatccatgttaaattcaatgatggactaacgtctgatagggagctatcagatcttaagaatgattttgcaaatatgcaaattagtccgtctattgcacctaaagaaaatgaagtaaaaaaatctgatgaaattcttcctcaaattgaaggatcttcagatcaacaacctcaaatgaagaacttgaaacttgaagctataagaatcatgcttgtctttgctgctcatataaacataaagcattatcaaatggatgttataagtatttttctaaacaactttattgaagaggaagtgtatgtcaaacaacctcctagttttgaggatcatactgtttcagaccatgcaccacgtgcttggtatgacaaactaagcttttttctttttgaaaatggctttatgagaagcaaggatttctccgatatgatgaagagtgagtttgaaataagcatgataggagaatttaagttcttcctagggcttcaaatcaaacacgatatcaaagcggaatggagaaggaagagagagaggagacgccacttcaaggagaagatgagtctagaagaagcttaccaccataggagaccatggataagagcttggaggaagaagcagatgaatgaagggagaggaaaagaagagcacgaaattttgtgctctaaaagagctctgaaatctggagtttaa

SEQ ID NO: 108721 - DNA, 342 bp, Glycine max
  Peptide Sequence Number=SeqID_225499
atggaagctttgtctatggaagagaataagaaaaagttggatggagatgcaaggttgggtgccttggaaagaaagagaaaagcaacaaaagaggctaccatggttgatgatgagccagtgtatgaggaacatggagttgaattaatttctgcaaatgttgctgcaaggcaagcagaggttgaagtggctatcattcctgaagacttggacctaaaagagaaagaatatcttgaagaatctatggtcaagtctttgccaccaccatcacctctaagagttgttcctattaagcctgatgtccatgttagatactaccctggcttcagaggactagagtgctag

SEQ ID NO: 108722 - DNA, 633 bp, Glycine max
  Peptide Sequence Number=SeqID_225500
atgttaaggaagcgaagaaggcctttccataagattggttcatctctaggaagtggaacaacaagacatgacagagtcaacattcgaggaaccatcaatggaaaagagtgttgtccagaggagggtttggtttttgacaaagattgggaggaggatataacccaggagacattggacattatgctatatggaaagccatatctagaaaccactagcgaggaggctttggtcaacttcttgaggatttggaacctcacatatatgtgcagactcatccacaactttctgttgaacacagtgatgcccattctgggagcaaaagactatgtgatggtgggtgagaaggtgaatctgcctgaagtcatcttttttaattggcttcaagcattcaaggatatatttcacacaaaggacaagaaaaatcgtattccttatgagatgtttttcactcagatcataaggaatggtggcatggatgtgtctgtgttagaactatctataggtgccactcaaataaaatgtgacctttttaagatgggggtagctgctaacttcctagaatatgctcagaagcatatcaaaagaaaggtaaagaataagcctaagaaggaatcacaatatgtggctggatag

SEQ ID NO: 108723 - DNA, 324 bp, Glycine max
  Peptide Sequence Number=SeqID_225501
gaacgaggataagggctacgtgggagtacgtgagctcagtgaaggtgggcaactgaggatggtgggtttatgtgtgatctgtggatgtggagagttgacttgcaccatcgcccgaccgccacctagtaccacatgtgatggagtggtacctggagatatgtcgcgggggttaggagaccttggggacgtcaggcgaactcctggcagtcaaccgattaaagaacaaagaccacaaagcaaggaggcttgtgtggtggctggccagctgcttaaaaacgagatcaggaagctaagagggcttctggtaatcgattacaaaggggc

SEQ ID NO: 108724 - DNA, 630 bp, Glycine max
  Peptide Sequence Number=SeqID_225502
atgaggaatttcattaagaataaggagagaagtgcatttagacagttacataataatccccgactagggggactagccacttatgatcaaagcaaaactagcaatcttataaaaaattcattagaagaaatcaagaagattcaagattcaagagaagttgatttcaagattcaagaaaagacatcaagaagaatcaggattcaagagaagatgaattcaagattcaagagaagaaatcaagaagcaacaagtcaagacttcacaagggaaattcaaaggactaaccgcctgagaattctttgtcttaacacattggagggtacatcctttgtggtacaagtagagggtacatctacttgggttgttgtaactaagaacaagagagggtacatctcttgtggatcagttcaagtggaggatacatccacttggttgttcaaagagagcaaaggagggtacatcccttgtcgatctttgcttgtaaaggattttacaaggttgaaagaaatctcaagaaccgatggttgcttggggactggatgtaggcacggattgttgtcgaaccagtataaaattcttgtgtttgtcttcttcttccctacactctttaatttccattgtgcactttaa

SEQ ID NO: 108725 - DNA, 1140 bp, Glycine max
  Peptide Sequence Number=SeqID_225503
atgaccgaccctctcgatgagtcgatctcttgctttctcatgagggtgaacccttgggtactagtacctatcaccttcagagggctacacgccttcaccttcagaggaatacacgtcctcaccatcagagggctacacgccctcgccttcgtagggctacacgccctcgctttcgtagggctacatgtcctcaccttcaaagggctacacgccctcgccttcatagggctacacgccctcaccatccaaggactacatgtcctcaccttcagaggactacacatcctcaccatcagaggcctgcacgccctcaccttcagagggctacacgcactcgccttcgtagggctacacgccctcaccttccgaggactacatgtcctcaccttcagagggctacatgccctagccttcgtagggctacacgccctcaccttccgaggactacatgtcctcaccttcagaggactacattccttgccttcagaggacaacacgtcctcgccctcaccttctgaggactacatgtcctcaccttcagagaactacacgtcctcgccatcaaagggctgcacgccttcaccttcagagggctacacaccctcgcctttggctacacgccctcgccttcgtagggctacatgccctcaccttccgaggactacatgtcctcaccttcagaggactacacgtcctcgccttcagaggacaacacgtcctcgccttcaccttccgaggacttcatgtcctcaccttcataggactacacgtactcgccttcagaggacaacacatccttgtcgtcgccttcatagggctacacgccctcaccttctgaggactacatgtccttaccaccttaccatcagaggactacacgtcctcgccttcagaggacaacacgtcctcgccttcaccttcgtagggctacacgccctcacctttagaggactacacgtcctcgcctttagaggactacacgtcctcaccttcaatgggctacacgcccaggccttcaaagggcgacatgtcctgaacttcagagggctgcatgcccttgcctttagagggctacacgtcctcactttcagtgggctccatatccacaccttaagagaatttaaggtcctttgcccttaa

SEQ ID NO: 108726 - DNA, 402 bp, Glycine max
  Peptide Sequence Number=SeqID_225504
atgggtttgaaggtgaaagaagtgatggaggacatcattgctgatcttgagagggtggtggtggtggtggttgggatggtggtgatgaaaaatatgatggaactcacaaaccaagaaagggggatggaagagtggatggaatgcttactggtggttgaggttggacgggtggaagaggtgttttcacaggagtttgtcatgctcaacagttggactaagcatgcatccaccgctaagcgcagcttcagtgtgcttagcgcgaaggagaatctagcagggcatcagcatcaagcccgcgcgctaagcacgaagggcacagaattgcacagacaccacagtgcctacttcgggaaaagagctctagaggcagtaagaggggcagcttttgtagagataccttag

SEQ ID NO: 108727 - DNA, 177 bp, Glycine max
  Peptide Sequence Number=SeqID_225505
atgtctttctcaagggatttcctctctggtaatcgattaccaaagtatgtaatcgattaccagtgcccaaaaacgaattacacagcctttgcacattggaaactaaaaattacactgtgtaatcgattaccagtagcaggagctcgcctgcttaggtacgtcacaggttctcactaa

SEQ ID NO: 108728 - DNA, 411 bp, Glycine max
  Peptide Sequence Number=SeqID_225506
atgaaacaggccaaatacagtctaaaggcccaagtggagaaggacgaaggcccaagtggagaaggacaaagcccccgagtggagaaggatgaaggcccaaacttatcttccttcactggaagtggcgtctacccagacttatcttccttcattggaagtggcgtctacccagacttatcttccttcactggaagtggcgtctacccagacttatcttccttcaccggaagtggcgtctatcctgacttatcttccttcaccggaagtggcgtcatccaaaccttcgtagcctgtatcaaacgatccgttcctactcaggttcacatcaacgtcgactgtcaattttttcaatcaatatcggagaaaaatatttttttgccgagatgggctaatgttttcgtggccgaataa

SEQ ID NO: 108729 - DNA, 198 bp, Glycine max
  Peptide Sequence Number=SeqID_225507
atggaagatcagtgcactttgccccccacgaacatacacaacatccaacgtatgaacgtggcccaaagcaagtgccaaaggccctggaaggcagatattctcatagctaggttccctaaccctaactatggtgtcaaaatggggtccaacgacaagcaacagcggctcacggaggacaccagtggtcttgggtggtga

SEQ ID NO: 108730 - DNA, 435 bp, Glycine max
  Peptide Sequence Number=SeqID_225508
atggctgattcagagatttgcaaacagatatacactcctcaacaatatcataaagaaattaggagaaaaagaccccagtacaaacctcctagtaaacaaccttccaggaaaaagaacccaacccgaaggtattcaattagagcctctaactccagaaaacctactctcaacaaagagagacatgttaggaaacttagagataacaaaagatacacgaagcaattagaatgttatgctcgtcaccaaccaagacattactcgagagattgtccaaataaaactaatctgtttacaagagaagtagaactgataaaaagttgtaggatgaatcttattcctatagatgagacagtctctactgactcagaaatatattcaatagatcagatcataaggaatgtcatttctgtaaaagatatccccataaaacattaa

SEQ ID NO: 108731 - DNA, 138 bp, Glycine max
  Peptide Sequence Number=SeqID_225509
atggctctctacgggtcggcgttcgcttactcgaacccccttaaggttgcgcttcccgcttgtcccgagatgggcaagggacgacaatctatcggtcgtgaccctagcctctacttgcgtccgtccctaagtacctga

SEQ ID NO: 108732 - DNA, 540 bp, Glycine max
  Peptide Sequence Number=SeqID_225510
atggttctctccgtgctagcaagtgcgcaatcacgtaactatagcctggccttacggcaaggctggcgtaggggacgggggatggttaacctggtctgcttctctattaacactgccttttatggttacacagcaccgcttgagtctgatatggcccagtctgacgttttccaccttggcatcaccaaagccgatttgaaaggagccacgctggcgattgttcctggcgatccggagcgcgtgaagaaaatcgcggcgctgatggagaatccacagcacctcgcgtcgcatcgtgaattcaccacctggctggcggagatcgacggcaaaccggtggttgtctgttccaccggcatcggcggtccgtccacctctatcgccgttgaagagctggcgcagctgggcgtgcgtaccttcctgcgtgtgggtaccaccggcgcgattcagccacacatcaacgtgggcgatgtgctggtgaccaccgcctcggtccgtctggacggtgccagcctgcactttgcgccgatggaattcccggcg

SEQ ID NO: 108733 - DNA, 237 bp, Glycine max
  Peptide Sequence Number=SeqID_225511
atggggttccgaataagatttgatggtggaggatgcacgaacagcgctaggcaatcaattcgtggggctccggactcgatggcaatcaattcgtggggctccggactcgatggtggaggatgtatgaacgacaatcaattcatggggctccgaataagatttgatggtggaggatgcacgaacagcgctaggcaatcaattcgtggggctccggactcgatggtggaggatgcatga

SEQ ID NO: 108734 - DNA, 1515 bp, Glycine max
  Peptide Sequence Number=SeqID_225512
atgactgaagaaagtgctggaaacacagttgcaacctctattaccccattcaattggtggtatctccaggcaaattctctttcttcctggaacgatactaatagcacatggagcaaccaaccaaaccctaactcttcctcttcttgtgaggaggatatatcagtctctacatctttcactaatgcttccaaccattcaagcctcaccgttgagtcctctcgcagactcattgagccacctgctccttcctccaccgagttgatgggagaacacgcatcagataatcaactttggagtcatgttttatcaggtgttggatcagacggcgagttacacaacagccaagaaattggagagaattttctggatgcactgtcatccaaaagcatgacaagcactatgtttcaaccagtgtgtgactacttgaagaaactagatcatacaagttgggagtataatggttcaacttcactaaatagctttgagaagcacttaaatgggttcagtgaggcgatgcttgagaataatgaaaggttgaccaagttatctaatcttgtgagcacttggtctattgccccaccagacccagaagttagtagccactttgatccacaaaaaacaaacaacatgtccttgagttctaattccatggatcatcacttcccacaatttgaacacttcaagcaaccttttgaagaagcaagtagaaactctggagtgttccctaattgctatgatcatgacatgaaggtcaagcaagagtatcatgcaagtgaagtgtcaccaggatcagtatttggaaaaccattaaatgcaaatggatatcgaaatggatttaatagcctttcagtggtagatagttgcaaactctaccatgacatgcccaatatttcttcatgcacaagaaatttctcagatgttatatcctttaatagtagattgggatggccagttattggagtccatggtcaaaagcctagtatgaagtacctgaacgtatctgaaccaaagaagcaaggtcttcagacaccatcaccaccgataagaactaatgttaatggaaaaggggaggggacaacacgtgaagtaaagaagaaaagatctgaagaatcttcagatgcaatgttgaaaaagcctaagcaagatacatcaacagcttcttcttcaaaggtgcaggcacccaaagtcaagctaggggacaaaatcacagcccttcagcaaattgtgtctccatttggaaagacagatacagcatctgtgctgtttgaagcaatagggtacataaagtttcttcaagaacaagtccagctactgagcaaccctttcttgaaagctaattcacacaaggatccatggggaagcttggatagaaaagatcataaggaggacacaaagctagaccttcgaagcagaggtctgtgtttagttcctacttcatgtactcctctagtttacagagaaagcagtggaccagattactggacaccagcatacagaggatgtttgtataggtga

SEQ ID NO: 108735 - DNA, 2904 bp, Glycine max
  Peptide Sequence Number=SeqID_225513
gccgtcggattagcgtgtttgcaggagaagttgcacgatcctcgactgccaccgcggtttcgccctgccccaccatcaaccccgactcctctgactttaccccccgcgcacattccactatctcctgctctgctaccttcaccatcgcggccgccaacatcactcaccgtgcatcgccttactcctgaggaactagcctctcggcacgagaaggggttgtgtttctcatgcgacgaaaagttccatcgcaggcacaagtgcgcccctaaggttcaccttctcattgctgaggatgatgacccaaacgacccttcccttatagagtcgggtgacccaacctcgtatccaattgatgggcctgacccgctcgcggcccacattagcttgcactcgctaacgggccttgtggccccagagacgttgaggctcatcgcaaccgtcgtcggccatacgattcttgtcctaattgacgatggctccacccacaacttcattcagcaggccttggcggaccagctcggccttccccggcagaccacctctgcattgcgagtcatggttggcaatggtcaacacctcgattgcacctctttttgcaaggcagtcaccattgacatgcaaattacttcatttatggtggacctctacatcttgcccattgccggagctaatatcgttcttggagtacaatggtttcaatccctcggtaccattttaacatattacaacactctccatatgcaattcttttataagggccaactgatcgagctcagagggcctcatccagcccagcacgagcccttttcatctccagtgttgctggttaagaagcacgatgcaaggtgtttttcgaagctcggccttcttcaggggtatcatcagataaggatgcacccagacgatgttcccaagacagcattcaaaacccatcatggacattacgagttcaaagtaatgccatttgggctctgcaatgccccgtcctccttccaggccctgtcgtctgcccctatgctagctctgccaaactttgagctccctttcactgtggaaatagatgcgtcgggtgtgggcatgggagctgctctttcacaacagggctatcccatcgcctttttcagcaaagcttttacacccaagctcctacgatcctcgacatctgtccgtgagcttttcgccattacatcggtggtgaagaagtggagacaatatctcctcggccaccacttcactattatcatagaccatcgcagcttgaaggaattggtgaatcaagtgatacaaacacccgaacaacacatgtatctcgcgagcctaatgggtttcgactacacaattccatatcgttctggcaattgcaatcaggctgcaaatgccttgtcccgcttaccgaagcaggatcatgttgctttcatggttctatctgtaccatgtctgacatttatcgaagaacttcgtgctcagattgtcgaaaacacagagtatcagttgttacttcagaaaattcaatcacacctagaggatcatcaggactactccatagcacataatttgatactgttcaagggtcgcctctggtttccacgtggcttaccgcttaccaccacgctcctcactaaattctatgctactccaacgggtgggcatgtcgggattgcaaagacaattgctcttaccaaatatgaagccaagcgcctcgccggactcttatgtcctcttccggtcccatttcgaccatgggaggacttgtcccttgattttattactggccttccaaactatcgcggcaactctgccattctcgtggtggtcgatcgtttctccaaggggattcatttgggcatgttgccaacatcccacacagttttctcggtggcttccctctttgttgacattgtcatgaagatacacgagttcccgcgtagcctcatctccgacagagacccccttttcagtgatggccagatggaggtcctaaaccgggtggttgagcaatacttgagggcctttgttcatcaacgaccgggtcagtggggcaagttcctgtcgtgggtagaatggtcacacaattcctcttggaatgctggaacagggtctactccatttgagataacctttggccgaaaatcgtttacttttccagagtatattgtaggttcttccaagcttgatgttgttgattccagcttggtcgagagagatgtcgtcattcaagcaattcgaaagaaactcctgaaagctcaagaacgtatgaagcggtacgctgacaagaagcgtaaagaggtgactttcaattgtggtgagtgggtcctggtcaaattacgaccacaccgtcagacttcggccaagggagctcaacatacctccgacaagttatccaagcatttctatggcccatttcagatactggagaggattagcccagtggcataccggttgcaactgccggaaggaatccgcattcaccctgtatttcatgtttcttcattgaagctgttcaaagggccaccagacatggaagcaattgaattgccggacaactttgagggtgaccaaccactcatcttccccatcgccatcctgaactcttgtagaaaggattccactccgaatgctccttgggaggtgttggtgcaatggcgcggtttatctcccgatgagacatcttgggaagattggtcccaactctgccaggactttcaccttgaggacaaggtgactctgcaagggccaagggatgatacagaggcaagggtagaaaagggagaagagacaacaatagagaaccaagaggcaaagatgaaagcaggggtaagcatagcaggaacaatagcagatcaacccaagagaactaagaggaaaattactaagcccaattaccttggtgattacgttcagtga

SEQ ID NO: 108736 - DNA, 582 bp, Glycine max
  Peptide Sequence Number=SeqID_225514
atgattggccctctcgatgagtcaatctcttgctttcgcataagggtggacccttgggtacacgccctcaccttcagagggctacacgccttcgccttcgtaggactagacatcctcaaattcagaggactgcacgtcctcgccatcagaggactgcacatcctcgcctttaaagggctatatcccctcgccttcagagggctacacgccctcgccttaagagggatgcacgacctcgccttcagaggactacacgtcctcgccgtcagaggactatacgtcctcaccttcagaggactacacgtcctcaccttcagagggcttcacgccctcgccttcagagaactacacgtcctctccgtcagaggactatatgtcctcaccttcaaaggactacacgtcctcaccttcagagggcttcacgccctcaccttcagaggactacacgtcctccactttagaggactacacgtcctccactttagaggactacacgtcctccacatcagagggctacacactctcgccttcagtggactccacatccacaccttaagagaattcaaggtcctttgcccttaa

SEQ ID NO: 108737 - DNA, 258 bp, Glycine max
  Peptide Sequence Number=SeqID_225515
gcctgccagaccctaactaaagggggattagcctttcattgtcatgagagacttttacactttagggggttgatgtggatagaagaagatggatggatagaggaggaaaagaggataatggacatagaaagagggtttcccaagttggagatactcaggcttacgatgtattcattagagaactctaagtcttcgggcgtggtgttatctcggtgtatgggttatggccttcccttctacttcctaatcttttcatag

SEQ ID NO: 108738 - DNA, 221 bp, Glycine max
  Peptide Sequence Number=SeqID_225516
gtggccttgttggtgcttgcacgcttagcgcaactctggatcgcttagcgcgcattagtgaattccaacttagcacgcgtcttcttgctcagcagatggactcaagcggtgcgcttagcgggatggtccctcactcaacgaacatgcataactcatcctttttccagattcttcctcgcgctcaaccaaaggggtggtgcgctcagggaatggctagctaa

SEQ ID NO: 108739 - DNA, 447 bp, Glycine max
  Peptide Sequence Number=SeqID_225517
atgggtgaagtagaggaggtacaagagaagatgaaggccgacatggaggccatgaaagagcaaatggccgcaatgatgaaggccatgatgagcatgaagaagataatggaagccaatgcggttgcagttgccgctaccagcattgttgctaaggtgaacccgaagtccccatcgggcctcaaccaaatgaatcatccaacctcagctatggtaggcaaagatttgggaagtacgggcggcccccattatgcgcaaagtcaaaacaagcatgccttcccgccatatggcctgcctcccaactatacaccacccaatgtggcgtacactcccaataagaatgtcaataactccactcctatacccattgagagccaacaaccccgaatgatcatgcacatgtctcttaaaccgtgggggagacacatgaaattccccatcacaatctag

SEQ ID NO: 108740 - DNA, 144 bp, Glycine max
  Peptide Sequence Number=SeqID_225518
atgacgatctcagactcataccccgttggatcatcgttaaatttgaagcagtcgaaggaaaaactggaggaatctcaaggaactgctagagatgccgctatcgatgtcagaagacacgtgagcccgcttagaggtaagggatga

SEQ ID NO: 108741 - DNA, 219 bp, Glycine max
  Peptide Sequence Number=SeqID_225519
atgaagtttggggcattcattaaccgctttttctttttgttttccttcgaggtgtttaggtactgtagaagggcaaaagctgttttcaaagagttgaaccaagttccacatgttgttgagctcgacgagagagggttcattagctcatttgctattgctgagatagagagacttctttctcgcagaggatggttcaaagattcaggatatcatgattaa

SEQ ID NO: 108742 - DNA, 852 bp, Glycine max
  Peptide Sequence Number=SeqID_225520
atgcctgaatctaactggggttcgcggtggtggaggaactggataggaaaaaagagcgattctagttgtaagatatctaatgaaaccattgctggaattgagatctcattcaaagagaaagatatcaaatatctggagttcctttttgtatattatatggatgatccgatccgtaaggaccatgattgggaattttttgatcgtctttctccgagaaagaggcgaaacataatcaacttgaattcgggacagctattcgaaatcttagtgaaagactggatttattatctcatgtttgcttttcgtgaaaaaataccaaaggaagtggagggttttttcaaacaacaagggactgggtcaattattcaatcaaatgatattgagcatgtttcccatctcttcttgagaaacaagcgggctatttctttgcaaaattgtgctcaatttcatatgtggcaattccgtcaagatctcttcgttagttgggggaagagtccgcacgaatcggattttttgaggaacaacatgtcgagagagaattggatttggttagacaatgtgtggttggtaaacaaggatcggttttttagcaaggtacggaatgtatcatcaaatattcaatatgattccacgagatctagtttcattcaagtaacgggttctagccaattgaaaggatcttctgatcaatccaaggattatttcgattccattaggaatgaggattcgaaatatcacacattgatcaatcaaagagagattcaacaactaaaagaaagatcgattctttgttgggatccttcctttcttcaaacggaacgaaccagagatagaatcagagcgattccctaa

SEQ ID NO: 108743 - DNA, 531 bp, Glycine max
  Peptide Sequence Number=SeqID_225521
atgattatgaggggccaagatatttatagtagccaagataaggctactacttcaccttcctctagtgaaagtgaagaagcaaaaggggaagaatctagtaaagagatctacccccaaaaagaaggacaacctttaatggttaaggaggagtgtaaggtgacacttgttagcattgtcacacctcttaggcttgagtttattcctcaagtaaaggagttgttggatgagagtttggttcgcaagagcttaaatccttgtgctttgttggtgcccaaaataggggttccaatgaaccctaagagaataaaggtaattcaggagaggcccactccaccaagtgttgaggaaaaaagcctagagtttcaagaaccttgggatttgaggtcaaatccttttcaaggggagggaatgatgcaatcctaccccgcaagggcattggatagaagactccaagaagattgggccaaagatgcaagagaaggccctagggttctcatgagccttagggtagatttcaggcccatgggttaa

SEQ ID NO: 108744 - DNA, 450 bp, Glycine max
  Peptide Sequence Number=SeqID_225522
atggagatagaaaaagattggactcatgggaggcagcaagaaacaattgtgggagctcaaaaggcaacattcaagatggagcatgtgatatcggggagctggttgaaaagagtcatggtggctgcagtgcttagcagccgaagattactattaagggatgaaaataaatgcaaagatgatataactcatcaactggccatgatcataaggcacaatgagaatctgaagagacaagagaagaatggatctcctgcacatattatatctgagtttgtgcagttattgcttttccaagtagcaaaatactttgataatgagttcaaatgcaatgccaactcttccaacataggatttcagctattgaagaagcatgggtggaaagaagggactggtcttggagtctctgagcaggttttctttcttactccctcttttttctccattgaatga

SEQ ID NO: 108745 - DNA, 525 bp, Glycine max
  Peptide Sequence Number=SeqID_225523
atgaatatgcctaggcgagctagttcctttaccctaaagtcttttggtggcctaggcaagccagaggctagtctgggcgagctaaggagcattagaagaaatactgggtccaacaaaatagaggaaaaccacacaaaggtgtataaatctccacacaggcaagtgtttcatcttaattccaaatcacagatatgtcataaattgattttgcaagtcatttcccatctaatcaaagataatgtgcataatcatcatggatcaataggactttttaaggtcgaacttgtaggaaattttggctttagttgctctggtctttcttttcttggtgtgagtgggagagcaggcataaagatttgggtagggttggaaactttcatcctaggtcaggattctggtaaaaatcaaatgtctggcttaaaaggcttgcaaatggaagaaaataatgtatattgggacaactatttggccaatggcttagaaagaatgaatgcccagatcacttccatgaatcatatgctatga

SEQ ID NO: 108746 - DNA, 789 bp, Glycine max
  Peptide Sequence Number=SeqID_225524
atggagccagaatattgggacaaaaatccctttaaggcaactgcaaaggccttcccaccaggattccattacaggccaacgaccctcaataagaccaggaaattttatgagtttatcttagtggatacaaattcagtgtccattaaacatttcaaggaccccaaagacccaaatttaaacacccattctacaatccaaatcttaaaagtaatgcaacctcggcattacggatcaaacttaaatcaacccaaaaagttttctgcaccatttgacccaacaagatacacttattgggattatattgatgcctggaccaacgtgttttggcatcaaaacaacaaatataaacactcgtggttgatttattttaaaaacaacacgacatataatttcccgaactggttcctccaatggtggaattatttcggaccaatcccacaaatttacccagaagaagttcaacaagaattcgacaattcaaaggcagctctagaccaggtcaagaactggttccaagtccacccagaattcctaaaacctgctgatccagaaacatcattgtttttgaataaaaaatctcagctagcaatattcctagctggatccaaatccaaagaaattcttgcaaagaatctaaaggaagttctccatctacttcaacaacaagaagaagaagaaaaaccttcaaaaaagaaggtcgaatcctcggatgaaaatgatgatcaagacgatgatcccttctaccagaatgaggatgattgtttcggcatctctttagaagaggattaa

SEQ ID NO: 108747 - DNA, 423 bp, Glycine max
  Peptide Sequence Number=SeqID_225525
atgcccccgactgtccctggtaatcaatactccgatcccgaaggccaacacaataggatcagaatcctgtggtgttatcccatgctaatgtatacagagcgcaccggaggcacgacccggccagttaaggacaggagcgcatcgccggcagaagggacgagccgaccggtgcacaccggaggcggaccgatcgacccaacccaagctggaattaccgcggctgctggcaccagacttgccctccaatggatcctcgttaagggatttagattgtactcattccaattaccagactcaatgagcccggtattgttatttattgtcactacctccccgtgtcaggattgggtaatttgcgcgcctgctgccttccttggatgtggtagccgtttctcaggctccctctccggaatcgaaccctaa

SEQ ID NO: 108748 - DNA, 240 bp, Glycine max
  Peptide Sequence Number=SeqID_225526
gaacattttggcgccaaccgtgaggttatggtgaaacttttcctgtcgccctttgttaagcttatgttctttgacgaaatgagtggacaaatgaatgacgattccatgtcaaggacacgtattgtgcccccgatgctagaatctcttatggcagaaatggtgaagatgaggagacaagccaaggagtctatgaggatagcaaataaggcattaagaggtcaagacgacctacatctctaa

SEQ ID NO: 108749 - DNA, 237 bp, Glycine max
  Peptide Sequence Number=SeqID_225527
gtaacaaatgatgtaatccagttatatgataagacaatgctctctccatatcccagaattgaacctttgttggttcaagttaggttttcagatgttgcgaagctcggacaagttaaaattgacaacactttggtaactgttttggttgaaaggtggagacctgagtcacacacgtttcatcttcctgttggtgaatgcacaatcaccttggaagatgttgttctacaactgggttaa

SEQ ID NO: 108750 - DNA, 711 bp, Glycine max
  Peptide Sequence Number=SeqID_225528
atggattgcaatttggaaggaagacgcaaatatgtgttaatcggccaaccaattctaggaaagattgaacatgagtcaccacttgaattggtaccgaacaaattcaaaaattttcctaaaacgttcttcagtgctactggagaagaccatattagcaatctcatgggtatagatcttcgaacattggagtctgcttatgcatacatgcaaagtatgctcataccttcttttgcatcctttcaccaaagtattgtcggcagttcttctactaatgacttcttccacaaagaacaacctattgttcttgatgaacaacttgaaccacaagaacatggacgagtacgtcaacagccgtcgttgtatgagtcatatgaaaacagtaaatcgcttaatatatatagcaatagagtggttagatgcaagtctgcacctttgtttgatattcaccctatctcatcatcttcaaaccatttatttttttcccataaagtctcattcatcatggacaataatccatgggagttttttgttattgatgactcagacctctcatcctttgtttgcccttctaacccaaatttgtcatcctccaattcaacaatacttattcctagtcccagaggggttgtacaagctgtcaggatcaatcaacaatatagggagacactcccaactcaagaattcataatgcgtgtccaccaagtaacctaa

SEQ ID NO: 108751 - DNA, 1527 bp, Glycine max
  Peptide Sequence Number=SeqID_225529
atggaagttccaatcaagtatccggcaaaactcacccttagggtggttcttacttgtatcatggcggccaccggtgggttgatttttggctatgaccatggtgtttcaggtggagtgacctccatggattccttcctgaagaagttcttcccatctgtatatgaaaaggagtctaacgtgaagccttcttcaaaccagtactgcaaattcaacagtcagatactgacactgtttacatcttccctttatctaagtgctcttgctgcgggtcttggggcatccagcataacccgaatgttgggaagacgtgcaactatgattatgggtggaatattctttgtggcaggtgcattactcaatggattagctgtaagcatctggatgcttattgttggcaggttgttgcttggttttggcattggttgtgccaatcaggtctcaattgagtcctgttttgattacagtcctttgctaaccaataatcacttgtattttcagtcagttccaatctatgtgtcagagatggccccttataaataccgtggagctctaaacatgtgcttccaattgtcaatcacaataggcatctttgtggccaatctcttcaactactacttttccaagatactgaatggtcagggatggcgcttaagcctggggctaggtgcagtccctgctttcatttttgttataggctcattttgccttcctgactcaccaagctcccttgttgaacgtggtcttcatgaagatgccaaaagggagcttgtaaaaattcgtggtacaactgaagttgatgcagaattcagggacatacttgctgctagtgaagcctcacagaatgtgaaacacccttggagaaccttgatggatagaaagtataggccacagcttgtttttgccatttgcattcccttcttccaacagttcactggcttgaatgtgatcacattctatgctcctattttgttcagaacaattggttttggaagcggggcatctctcatgtctgcagtgatcattggcagctttaaacctgtttcaaccctggtttcaattcttcttgtcgataaatttggaagacgcacccttttcctggagggtggtgctcaaatgttgatttgccagatcatcatgacaattgctattgcggttacatttggcacaaatgggaacccaggttttgcttggtcatggggtcctctaggctggttgatacctagtgaaatctttccccttgagattagacctgctgctcagagtatcacagttggtgtcaacatgatcagcactttcttcatagctcaattcttcacatcaatgctctgtcacatgaagtttggtttgttcatcttctttgggtgctttgtggtgatcatgaccttattcatctacaagttattgcctgagacaaagggcatcccacttgaggaaatgagtatggtttggcagaaacaccccatctggggcaaatttttggagtcggacaaccccatccaaaacgacaaaatgaactccaaatgttga

SEQ ID NO: 108752 - DNA, 168 bp, Glycine max
  Peptide Sequence Number=SeqID_225530
atggatataaaacaagtagtgttgatggataaccgtggatacgagtatttcagatacctacgggttaacaaatattttagcaaatggagtgaggtagcagttagacactacgtgtgccaccccgtgttcgttgtgatccctacttcagtcatgggagtgttgcactga

SEQ ID NO: 108753 - DNA, 393 bp, Glycine max
  Peptide Sequence Number=SeqID_225531
atgtcttttagaggccccatgcaagtagtcctcaaaaaggatggaatgacagtgataaagaatgacaagaatgagttgattcccacaaggatcgtgactggttggagaatgtgtgtcgattaccgcattctcaacaaggcaacaaggaaaaaccactttcctcttcccttcatggatcaaatgcttgaaaggatcaagagaagacaaccttcacttgcctatttggagtctttgcctatcggagaatgcccttggactttgcaatgcaccatccacattccaaagaaccttgcacttaattggaaaaaatcgcacttcctggtaaccgaaggtataatgcttggtcataaaatttcagcaagaggtattgaagtagatcaagccaagatataa

SEQ ID NO: 108754 - DNA, 204 bp, Glycine max
  Peptide Sequence Number=SeqID_225532
atggcttgtggtggccaccagtggccgtgggtggtggagaagaaggtgttagggtttgggtgggcatttggagagaagaagagtgaaaaatcatgtgatccaacggttaacgagtctgagatcgggattttaccggaacaggtttgggtaaaacttgaaatctcacaatttcaacataggtcaatcaaactccagataacctaa

SEQ ID NO: 108755 - DNA, 267 bp, Glycine max
  Peptide Sequence Number=SeqID_225533
atgcaggtgcagggtgatgcacatcaggccgcagacgcaccgccaccacctcggcaggccgatcccgctggatcactaggcatggagcgttatctccagcacttggttcgccagcaggcggccaaccaccgtgggcagctcggagactggcccgaggcccaggcaggggagaagcctgcaggatcccctggtgaggcagaggaggcctatatggatgaagatatgactgacttgctcggtttcttgggaagtagcggagccacgtga

SEQ ID NO: 108756 - DNA, 954 bp, Glycine max
  Peptide Sequence Number=SeqID_225534
atgcttcgggcttccggaatacaatgggatctccgtaaagtggataattatgaatgttacgaagaatttgattgggaagttcaatggcaaaaagaaggagattccttagctcgttatttagttcgaattggtgaaatgatggaatccataaaaattattcaacaggctttggaaggaattcccggcggaccatatgaaaatttagaaattcgctgctttgatagagaaaaagagccagaatggaatgagtttgagtatcgatttattagtaaaaaaccgtctccgacttttgaattgccaaaacaagaactttatgtaagaattgaagcccccaagggagaattgggaatttttctaataggggatcaaaatggttttccctggagatggaaaattcgtccgccagagatacaagatatccatttttttttcagattggaatcttttaaagagatatatggaattatatgggtatttgcccctattttgattcttatattgggaattacgataagtgtactagcaattgtatggttagaaagggaaatatccgcagggatacaacaacgtattggacctgaatacacaggtccttttggagttcttcaagctctagcagacggaacaaaattacttttcaaagagaatcttattccatctagaggagatattcgtttattcagtataggaccatctatatcagtcatatcgattataataagctattcagtaattccttttggctataactttgttttatctgatctgaatattggtgtttttttatggattgctatttcgagtattgctcccattggacttcttatgtcaggatatgggtcaaataataaatattcctttttgggtggtctacgagcagctgctcaatcgattagttatgaaataccattaactctatgtgtgttatcaatatctctacgtgcgattcgttga

SEQ ID NO: 108757 - DNA, 252 bp, Glycine max
  Peptide Sequence Number=SeqID_225535
atggctaccacaactgatatccaaaaccaaagtcaaagtcacaagcaattggaagcagaagggagattaaaaagcaaaattgtttgtaacaatcagttgttggaagaggcccagcaattatgggacttggggacaagcataggcttagaagcagacacatgtcactctgattttattcaaagctttgcagatatggaggccagagacagaaatgaagctatggatttgggagagaggaaaactcatagatga

SEQ ID NO: 108758 - DNA, 249 bp, Glycine max
  Peptide Sequence Number=SeqID_225536
atgtgggtgtcgaggaagcggtttccggcagattttaggcgggaggagaaagataagagcgatttcaggcaaaaggatgacaaagagaagagggaggacaaggttttcgagcgcgcgcggcttgtgaaatctcaatttttattaacttataaacataacaacatcggttttttatggaaaaccgatgttaactatatcggttttgtaaaaaccgatgttaacatcaaatacattacatcggttttttaa

SEQ ID NO: 108759 - DNA, 450 bp, Glycine max
  Peptide Sequence Number=SeqID_225537
atgaatgtaaagagaagagaagatatggttggtgtgcttccaaagagaagaatattaatgcggcatggaaagtcacaggggaaccaagacacagtggcgtacaccaccatacccgaccataacattcagtcaatggcgcaaggcatggcccaggccctccgcactagcaagcacctccgccgcatgatgggtagcgacggttgttcccctgactggcgggtgcaattcaacgtgtccccctatacccacacccaatcgatgttccacaagcttaagcggtgtttcttgaagaagaggatcatcggcgtgaggaaagaatcgcgagttcgagaacaggatttcgggaactttctggtgaaagagaagatgaaggttctaaatgtgaatgttttggaagattcttctatcaagaagagaatttcaatttctcaccttttagaaggaaattga

SEQ ID NO: 108760 - DNA, 519 bp, Glycine max
  Peptide Sequence Number=SeqID_225538
atgagatttggtgaatgtagtagcggcaaggaaaatggagagaaagcagtgggaaattacctcgggaatagatctagaaaatgcatcctccatggaggaaagaagaattggattgagaacgagagcctcgaggttcagaaagaaggagaacgggagcctcgtggcgacttcttttctttcccttcccttttcgtcgcggaggaatgtcacaagggcgtggatggagcccgagaaggctccgatggtggccttgttaacatggaggacgacgaggctagtgaggagggtggcggcgagggcgcgacagtcagaggggcagcggaggagaggaggccatcgacgacgaggtcgaccttggcgtcgtcatccagggagaggtggaggaggagggagaggggcgggcacgagggcgccaacgtagatgccaccaacgaatacacacggcaaggcaaggaagcggtagtcgaggatggcatcgagctcatcgtggaagcgggtgatgctcttgtgtgggcgtga

SEQ ID NO: 108761 - DNA, 213 bp, Glycine max
  Peptide Sequence Number=SeqID_225539
atgtctgttaactcatgctctcgctgctgccctcaaagaggggagaaattctcttgtcatggatgcaatcttctttcacaatgttgcaactcttatgaatactgtgtttcctgctacttcaatcctgctttgataagtaaggaacaagtggtgaagatgaaggttgccaagccttctactgcaaagttgtatttggagccttggactgactag

SEQ ID NO: 108762 - DNA, 219 bp, Glycine max
  Peptide Sequence Number=SeqID_225540
atgcttctcaacaacactgaagagatgcaaacactctcttcgtcctcaaatctaaaggtgaaggattatattgcaacccctaaaccaaatggctaccagagtcttcagaccactatgattccatttttgtatgagaggatgtttaggctagaagtccagtgtataaaggaaggagttgcaacaaaagaaaaaatcggtgtcaaaaggaaaatgagataa

SEQ ID NO: 108763 - DNA, 284 bp, Glycine max
  Peptide Sequence Number=SeqID_225541
cttggaggggttgatggggacccagtgctgagaggaacgaggataagggctatagtggtacctggagatatgtcgcgggggtcaagagaccttggggacgtcaggcgagctcctagcagtcaaccaataaaagaacaaagtccacgaagcaaggaggcttgtgtggcggctggccagctatgtatcttgggtgggcttaaaaatggagacaggatgttaaaatggcctctgggtgacagggcactggtaatcgattaccagttgggtgtaatcgattacacagg

SEQ ID NO: 108764 - DNA, 168 bp, Glycine max
  Peptide Sequence Number=SeqID_225542
atggttaggggtaaaagggctatgaaagaaaggattagagaggctcaaaaagtgtttaagggttacattgaaaaacaaatatgctttggctcggcaggggtagcaaaggataaactagtgtttaggatgttgaaacatggtcatgtgtcatttcaaatcttgacttag

SEQ ID NO: 108765 - DNA, 666 bp, Glycine max
  Peptide Sequence Number=SeqID_225543
gtgcatgacaacgccgcagatgccgccgcgcaaggtggcacctggctgctggcggtgaagccgcaggtgctgcgtgaggtctgccagtcgctgcgggcactggcccaggcaaaccagccgttggtggtgtcgattgccgccggtatcaccagcgcgcagctggaacgctggctgggcggcaacctgccggtagtgcgcgcgatgcccaacaccccggccctgctcggcgcaggtgtgaccggcctgttcgccacaccgtcggtggacacgcagcagcacgcacaggccgagaaggtgctggccagcgcaggccgcaccgtgtggatcgacagcgaggcgctgatggattcagtgactgccgtatccggcagtggcccggcctatgtgttcctgctggccgaagcgatggaagcggcgggtattgcccagggcctgccagccgacgccgcgcgcacgctggtggtgcagaccctgctgggtgcctcgcgcatgcttgatgaagccggtgagagcccggccgagcttcgccgccgcgtgacctcgccgaatggcaccacccaggccgcgatcgagagcttccaggccggtggcttcgaggccctggtggacaccgcactgcgtgccgcacaggtgcgtgggcaggaactgtctgcggcgaatgattga

SEQ ID NO: 108766 - DNA, 486 bp, Glycine max
  Peptide Sequence Number=SeqID_225544
atggcctctaggatatgcaagagtatcggttcaagacccacaactgaatatgatacaaggagatttcactccttagatgcatggaaccagtacacggataatgtattggggagaaacatcttgccagagaggaaggtggagctctaccacactgagtttgatgattttaagactgaattggagaggcgtaatctccataaatgcctcaccaatttggttgatgggagcatagatgtggctttggtgaaagagttctatgcaaacctatacaactctaagggtcattcaccaaagcaagccagggtcagaggccatctagtgaagatcgacgctgacagcctcaacacattcctagagacactgtggctgccttcagatcctagggagattgaggctgccctatgcataccaggccaagggttcatcttgaatgctgagggccatcctaggaggatcatgaggaaggacttgacgaatttagcctag

SEQ ID NO: 108767 - DNA, 462 bp, Glycine max
  Peptide Sequence Number=SeqID_225545
agttctctgccttgctctgttttgcttggctgtgatagcttgtgctgtttgtatgttgttttgcttggatgttgtggaagcttgggaggattgatgggggcccggggatggtgggtttatgcgcgcattgtggatgtggaaaacttgttgtgcaccatcgcccgaccgccacctagtaccacatgtgatggggtgaaacttcctgcttttattgttgaccacagagtggtacctggagatatgttgcgggggtcaggagaccttggggacgtcaggcgagctcctggcagtcaacagataaaaggaacaaagaccacaaagcaaggaggcttgtggtggctggccagctgtgaattttgtgtaatatgtggtttgtggcctctggtaatcgattaccaagggcttgaaaacgaagtcaggaaacttagggagcctctggtaatcgattaccagcctgtgtaa

SEQ ID NO: 108768 - DNA, 243 bp, Glycine max
  Peptide Sequence Number=SeqID_225546
atgaggggcatcgtgcatgaacctcaagtgaacctaggggcaaatcagaagttctcacccaataggttcccagctacaagatttcctacatctaatgtccaatcttttgaattcgggatgaccggccctctcgatgagtcaatctcttgctttcttataagggtggacccttgggtactagtaccctcacccttagagggctgcacgccctcgccttcagaggactacatgtcctcaccttaa

SEQ ID NO: 108769 - DNA, 361 bp, Glycine max
  Peptide Sequence Number=SeqID_225547
atgccacaatacgttcctccaccaatccagcagcaacaacagcaacagcctcagaaacaacaaacagttgaggctcctccgcaaccttcccttgaagaacttgtgaggcaaatgactatgcaaaacatgcagtttcaacaagagaccagagcctccattcagagcttaactaatcagatgggacaattggctacatacttgccttctcaatctgtccagaatccaataaatgtgacagctatttcattgaggtcgggaaagcagtgtcaaggacctcaaatagtcgcagcttcctcgttcgcaaatgaacctgcccaaccttactctactccagaaaaagatgatgacaaaaatttaaaaa

SEQ ID NO: 108770 - DNA, 507 bp, Glycine max
  Peptide Sequence Number=SeqID_225548
atgaccgcactgggtcgcgtgggcctgccagatgacatcggtccgatgattgccagcctgctgggtccggacaaccgctgggtcaccggtcagcgcattgaagtctccggcacctttgatgccgctgagcgtcaacagattgccagagatttgacacagttaggacttgattgcgaggcgctgccagactcccctctggtgcgtagtacggtatggacctactttgccgaatactcttctgatgccgtttttatgggagacaaacccgcatggttgccggttgtgtcccttcagatatatgtcatcaaaggtggcctggatgaggaagcaaagaagaagctgatcgagggagcaactgcaattctggatcgtcgtccgtcaggcacctctgtcgcgcctgtttatgtggtgatacaggaaatcgaagaagcaaactgggggatattcggtcagcaggccgatctcgcagcgcttcgcgccagcgatgacaatgctccggcgatttga

SEQ ID NO: 108771 - DNA, 573 bp, Glycine max
  Peptide Sequence Number=SeqID_225549
atgtctcttgatttccatcctaagaagactgaagttttctgcttctgtgatggtgaaaatgaaatttggtattggaatattaattcagccacctgcacccgtgtaactaagggagctagtgcacaagtgaggtttcagcctagactagggcgtttcctggcagcagcttctgataaaggagtgtcaattttttatgttgaatctgacacacaaatatacaccctccagggacatcctgaaccggtgagctatatttgctgggatgggaatggtgatgccttggcatctgtgagtccaaatttggtgaaggtttggagtttgacctcaggaggagaatggattcatgagttcagctccactgggagccaattgcattcctgtgtttttcatccaagttattcaactttgttggtgattggaggaagttcgtccttagagttatggaagatgaccgataacaaaagcttggcagtttctgcacatgaaaatgtaatttctgctttggctcagtccactgtcactggaatggttgcctctgcaagttatgacaactatgtaaagctgtggaaataa

SEQ ID NO: 108772 - DNA, 555 bp, Glycine max
  Peptide Sequence Number=SeqID_225550
atgtctgccagtgatcatgctattctacgtgatagagtgcatcaacccaccaagaagagcttattggagttatcatcacaagacgttgtgttggcacaaaataagtttctttctaagcaacttgagatcttaacagaaacaattgaacaaatgcaggaagctagttacatgggaaatcaacaaaagcaaggatacaaccaaggaggattctcaggtttccagcaaggacaatggagatcacaccctggtaatcaattcaataaggaccagggtggaccttccaataggccgcctcaacaagggcctaatattttccagaggactaccaaactggaagaaactctggctcaattcatgcaagtgggtcaactagccaagcagttagctgggaagtcatcccagagctttgggaaaaatactaagaagaatcccaaagaagagtgtaaagttgttgtaacaagaagcaggaagcttgtagcggctgaggatgaggatgttgttgctttgaaggagcaagctgctttgaaggacaccactattaaaaagaagaatgag

SEQ ID NO: 108773 - DNA, 222 bp, Glycine max
  Peptide Sequence Number=SeqID_225551
atgggctcaaaaatctaccctaaggttcatgagaaccctatggccttctttagtagctctagcccaagcctcttagaatcttctatccaatacccttggggggtaggattgcatcataaatccttgtgctttgttggtgcccaaaataggtattgtgaggcaccaaatccctatgataggtgttatgatgaatgtgttgagtggtgcaacctttttttgtaa

SEQ ID NO: 108774 - DNA, 1206 bp, Glycine max
  Peptide Sequence Number=SeqID_225552
atgcgggaccttggccgtttctattcggacggcgtgcgcattcagctgcgcgagatcgtgatgaacaacccctcgctcatcggcacgacacaggtcgttccggttctggcgggcgcggacatcgattccgccttcaaggggcagatcgatctttcggtgccggaggcgaatcgcaaggtttcggaccgtcaggtgggatggatgaggacgctttcggaagaaggcgtgatgaaggagtccttcaatacgggcctcttcaccttcggcgcatccagccgtccggaaacctccggtctcggcgtggcattggttggttcgctctacatgatgctcatcgttctcggcctttccctgccgattggtgttgctgcttcgatctatctggaagagttcgccaagaagaaccgctttaccgacatgatcgaggtgaacatcaacaatctggcggcggtcccgtccatcgtgttcggcctgctcgggcttgcggtgttcatcaacttcttcggcctgccgcgctccgcctcgctggtcggcggtctggtactgacattgatgacgcttcccaccatcatcatcgcgacccgcgccgcccttcgcgccgtgccgccgtcgatccgctccgcggcccttggtcttggcgcgtcgaaaacacagatggtgttccaccacgtcctgccgcttgccgcacccggcatcctgacgggaacgatcatcggccttgcccatgcgcttggtgaaaccgcaccgcttcttctcatcggcatggtggctttcgtcgccgacgtgccgtccacgccaatggatccagcgacggcattgcctcaatcattctgcgccgccgcttcgagcgccgctggtaaacgggagtcgaaagctatgaacctgatgactgaacgatctctcgagaaagccgtaggagaaaagatgaacgccaacgccaattccataaagatgcgcggcgacaaggtttgcgtattttatggcgagaagcaggcgctgttcgacgtcgatctggaaatccaggaaaagatggtcacggcgctgatcggcccttcgggttgcggcaagtctaccttcctgcgttcgcttaaccgcatgaacgatacgatcgaaggctgcaaggtcggtggcaagatcacgctcgacaatgaagacatctacgatccgaagatcgatgtcgtcgaactgcgcgcccgtgtcggcatg

SEQ ID NO: 108775 - DNA, 355 bp, Glycine max
  Peptide Sequence Number=SeqID_225553
gatcagtcccatcagtctaggaagaccctttaggaaaactgctagaactaagatagatgtttatgcaggcacactgtccatggaggctattgctaaggtgaacccgatgcccccttctgatatcaaccaaatgaatcatccaacctcaaatatggatgttaataactgcgctcccatactcattgaaagccaacaacctcaagctaatcatgcgcatgtctctcaacccacgggggagacacatggaatgccccaccacaatctagccgacttcgagccttgcctcggatatgccactgaagggaaaggctcagggccattgaaggaggtgaagattatgcccttgctaacctag

SEQ ID NO: 108776 - DNA, 482 bp, Glycine max
  Peptide Sequence Number=SeqID_225554
atggaaggtaaaggaaatttaaagcaagctagagacagtttcctatgtgaggcttggatgaccctttggagttcccaagtagctcttcacttagtctacatgatttacactaagttattacacacaaatatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 108777 - DNA, 345 bp, Glycine max
  Peptide Sequence Number=SeqID_225555
atggataagaggctcgtgggattacacgagggttggtggggcctatatttctgggagcgaactccagtcgaatatgaagcgcctggatacaagttatgccttggaatggaagagaattccgaatcagctttgtctacgaacaaggaagctataagtaatgcaactaggaatctcatggagagttcgatcctggctcaggatgaacgctggcggcatgccttacacatgcaagtcggacgggaagtggtgtttccagtggcggacggctggaaacggctgctaataccccgtaggctgaggagcaaaaggaggaatccgcccgaggaggggctcgcgtctgattag

SEQ ID NO: 108778 - DNA, 216 bp, Glycine max
  Peptide Sequence Number=SeqID_225556
atggagcaaccaaagtctcagcttgagtgcctttttgactacctagatcaatatcaccatgttgctaagagacacataggattttcttcttgcacccaacatcttcatacacccgacagtgagaggaaaaataaaaaatacacttcaattaacctacactttcacttatacgaattgacaatccgtgtgagctatacggattggcaatctgcatag

SEQ ID NO: 108779 - DNA, 111 bp, Glycine max
  Peptide Sequence Number=SeqID_225557
atgagtatctctcacacatggaaccccaagactactcgatcatcttcacctgagtatgccacaattccaacagttcctagaggacaaagctcgacagttacaagttggtaa

SEQ ID NO: 108780 - DNA, 1098 bp, Glycine max
  Peptide Sequence Number=SeqID_225558
atgaagcttcctccgggtttaaatgtagataatcctaatctagtttgtcgtcttcagcgttcgttatatggtcttaaacaagcaagtcgtcaatggtttacacgactctcatctttcctcctctctcaaggattttctcaatcttctgcagatcactcccttttcttatgcactaacaactcttctgatatcacagttattctcgtatacgttgacgatattatcttgacaggcaacaatctcgacactatcattcacattaccaagctgcttgatcagacctttagcattaaagaccttggcattctcaaatatttccttggactcgaagttgctcgctcgacacatggtatacacctgtgccaacacaaatatgcactggacatcctatcagactctggaatgcttgggtcacgacctggatctacccccatggagtattccacacgattaaatgctacaatgggtaccccattatcagaatcttgtgcctcttcctacagacgtctcgttggccgtctcatatatctcacaaacactcgccccgacattgcttatgccctctccgggtctggtcttttcttcgcagctaaaggaagtttcactctcaaggctttcagcgattccgactgggcgggatgtcgcgatactcgccgttccgttactgggttctccatctacttaggagattctcttatatcttggagatcaaagaagcaaaccacggtttctcgaagctcctctgaagcggaatatagagcattggcctccaccacttgtgaactgcagtggctcagctttcttcttcgagattttcgagttcagctatctcaacctgcagcactgtactgtgacaaccaatccgccattcaaatagcctcaaatccagtctttcacgagcgtaccaaacacatcgagatcgattgccacattgtaagagacaaggtcaatcaaggcttgctgaaactacttcctatctcatcctcgatgcaactcgccgacatattcaccaaacctctccctcctgcttcgtttcaaagtctctataccaagctgggaatgatgaacatccattcccagcttgcggggggctcttag

SEQ ID NO: 108781 - DNA, 543 bp, Glycine max
  Peptide Sequence Number=SeqID_225559
atgtttgtcctagaaaatggtgtgaagaacaagggggaagacccaaggcttcaagcaatctctcaagccatcagagtggtgcctcactttcccaaacaaggaataatgtttcaagacataacaacattgttgttggatcacaacgcgtttaaagacgcggttgacatttttgttgatcgttacagagacatggatatttctgttgttgccggagttgaagccaggggattcatttttggttcctcaattgcgttaggcattggtgcaaagtttgctcctttatgcaaacctggaaagctaccaggtgaagtaatttcagaaaaatatgttctagaatatggaactgattgcttggagatgcatgttggtgctgtccaacaaaatgaacgggtcataattatcgatgatttggtggctacaggtggaactatgtcagcagcaattagacttctagaacgtgctgatgctgaagtagtggagtgtgcttgtgtgattggtctgtctgatcttaagactggaagtccaagttctttacctaaataa

SEQ ID NO: 108782 - DNA, 585 bp, Glycine max
  Peptide Sequence Number=SeqID_225560
atgaaatctacaactactcttctttggaaacaacaccctaatagatttggagaagtaacaaatgatgtaatccagttgtatgctcaagttatgccttgttcagatcccataattaaatctttgatggttcaagctgagttttcagatgttgtaaagctcggacagattaagaccgatgatgctttagtgactactttggttgaaaggtggagacctgaatcacacgcttttcatcttcttgttggtgaatgcacaatcaccttgaaagatgtttctcttcaactgggtttacgcatagatggaaaactagttattggctcaacaggtgttgttcacctaaagaatgcactagtgggatcaacacctaaactaaaatggttaaaagaaaacatgttgactctcctaaacagtttatcccacatccctaataatggaaggatgtacaatgttgttatagtcgtgggcatgatatcgcatgtcattcattcaaccaaggatcgagtgtcagccgtcatatccacttgcaacaagatggagggacagggggctacgatttttttggaatcccacgcagtgatgttatag

SEQ ID NO: 108783 - DNA, 4008 bp, Glycine max
  Peptide Sequence Number=SeqID_225561
atggctgacgctacacgatcgaagacaagcatggagcgttgggaagacgcgtttgcaaagctttctgcatccatgacgtcaaagttcgacgaacttctcagtcgtatgaaccaactagaaacctcccacgccaacaatcaggctccgctggcgttcgtgaactccgctgcaatggccacagcaaacacaacttatcgattgaagttggaggttccaagatttaacggcacggatccggaaggatggatattcaaggtaactcagttctttgaataccacgcgacaccggagcacgataggttaacgatagcatcgttttatatggagggcccagccctggcctggtttcaatggatgtatcgaagtggccaactctcctcgtggtcagcctttcttcacgccatccatgcacgattttcgtcctcggcatatgaagatcccacgggagttttgtgtaagctcacacagcaaaccaccgtgtcgccgttcctctcggaatttgaaactcttgctaacagagtcataggcctcccaacgccgtttatcttgagctgtttcatatcaggacttaatcctgcaattcgaagggacattcaggtgatgcaactgcattcactagctcaggcaatttctttcgcgcgcctccatgaagagaagcttctggatagtcgccgtcataccagtaaacctccttcctcctcaactccgggaacgagtgtcacgcgtacgtcttcttccttgaccttatctcccacaggttcgtcactccttccttctccaagcaaacctcgtgcctcatctattcccttcaagagactaactccgtcggaactcgccctgcgccgggaacaaggcctatgctttaactgcgatgaaaaatactcaaggggacataagtgtgcttcatccctattcttatttgtcacggaagatgatgatgataatcttccggtgcaaattagcctacatgctttgtctggtcacggtgcacctgagacattacgcctcacgggattcatttgtgagcatcgcgtccagattctaatcgatgggggcagcacccataatttcctacaacaggaattggtcgcattgctgcagctgcaaccacaagagacctccaccttgcgggtcactgtgggtaatggtgaggaattgcggtgcactcaagtatgccctaatctcgccatgaaaatacaaaaacatgaatttccggttgacttgcatgtattgcccatacggggagccaacgttgtgctgggagtacagtggatcaaagctttaggcccagtccttattgattacacaacacttacgatgaaattcatctacgatggccaattaattgagttagtgggagatcgcgactcatcttttcagatgatatcaccttcccagttacgcaggttggtggacacagctccagtcaatgtaaaaccttaccgttaccctcacttccaaaaacaagagatagaaacccaagtcgccgcaatgctccgacaaggccatatccagcacaactcaagtccgttctcatctccggttctattagttaagaagcgcgatggatcatggcgcttctgtgtagactatagggctctcaatgcaataacagtgagggatcgcttccctattccgacagtggatgagcttctcgacgagctcggaggcgtgattctgatgagagaatccgatatcagcaaaacagcatttcgcacccatcatgggcattacgaatttcgtgtaatgccctttggtctttgcaatgctccttcaacgtttcaagcgatgatgaacaggttgtttcagcctcacttacgaaggtatatcatcgtcttcttcgatgatatactgatatacagtcgcagcttggaggagcatatcaatcacttggaaatcgcgtttcaggtattacactatggccagtttactcttaagctcaccaagtgttcgtttgcacagaagaaaatagagtacttaggccatatcgtcaccggtaatggggtccaacctgtacctgagaaggtacaagccattcaggattggcctcaaccacgatccacacgagctctgcgaggtttccttggattggtgggattttattgcaggtttatcaaaggatactcgatgataactcacccactttcacagctattgaccaaggcggagctggtttggtcgtcggaagccgacagcgcattccaaaggctcaaacaagtggtcacgacggcgccagtactcgcccttccagacttctccaaaccctttactatagaaactgatgcttcgggcttgggaatgggcgcggtgctttcgcaggaaggacatcctatctccttcttcagtaagcaattttgcccccgattactgcaagcttccacctatgtcagggagctcgctactatcaccgccgcagttaagaaatggtggcagtacttgttaggccactctttcatcatattgacggatcacaagagtttgaaggagctaatgaatcaggctgttcaaactccagaacaacataaatatctagcacgactactgggttttgattatgtaatccaatatcgagcagggaagagcaatatcgttgcagacacattgtcacggtcaacacctgcctcattattcattatcacagtccctcacttcgtcttcctcgacgagctgcgaagggagttgcaggcaaatccagcgttcatagaattaaggaggaaagtaaccgctgaacctcacgcatatcctgatcactcactagctcaggacctcatcctttatcggggtcgtatatggttaccccaggactgctctttcatcgaggtcctactctcagagttccatcagtcccccttaggagggcatatgggattccgcaagaccctaaaccgcatatcggagaacttcacatggagtacgagcactcgagacacgcgtgacttcgtctccaattgtttagactgccaactagtgaagtacgaaacagcgaaacctcgaggccttctatgtcctctttcggtgccatcgcagccatgggaagacctttcgatggattttatcgtaggacttccggcgtatcgaggtcacacatgtatcctggtcattgtagaccgcttttctaagggagtgcacttaggaatgcttccttcccatcacacatcacagatggtggctcagtcattcatggaaatggtgggcaaattacatgggatgccttgcagcatcacctttgatcgtgatccgcttttcctgagcaagttctggcagtccctgttctctttaagtggaaccaaactccgaatgagttctgcctatcatcctcaaatggatgggcagactgaagttgcaaaccgtgtggtggaacagtatttacgagcatttgtgcaccggaaacctagctcgtgggggcgctttctgttgtgggcagagtggtcgtataacacgtccatccactcatctacagggatgacacctttcgaggtcacattcggccgcaaacccctgagtttccctcaatatctggctggcacttccacggtagcagcagtggatgatttacttagccaaagggacgacacgtttaatctccttcgccggaaattacagaaggcgcaaactcgcacgaaggacatagcagatggtcatcgcaggaaccatgcgtttcaggtaaatgaatggatcttggtcaagttgaggccttatcgtcagaccacagtagccggaacgggtcagtctaaactctcgaggcgtttttatgggcccttcaagattgttgagagactgggtcccgtagcgtacaagctggaactaccggagcattctcgcattcatccggggctcacacgcatggttctagtacaatggcaaggcttgcatcccgatgaaatgtcgtgggaagagtgggaaggtctcaaggaacgacatcaccttgaggacaaggtgctatttgaagaccacgggaataccctcgtggaggtacagcagcaagaagaacgtggaaaatcattctag

SEQ ID NO: 108784 - DNA, 498 bp, Glycine max
  Peptide Sequence Number=SeqID_225562
atgaaactggccaaatacaggctaaaggcccaagtggagaaggacaaaggcctaagtggagaaggacaaagcccccgagtggagaaggatgaaggctcaaagtttctctctgggttccttgttgaaccaattatcagacttatcaaggtaatccttgtggcgtctaccctgacttatcttccttcaccggaagtggcgtctacccagacttatcttccttcactgggcgtctaccctgacttatcttccttcactggaagtggcgtcatccaaaccattgtagcctgtatcaaacgatccgctcctactcagtttctatcctatccttccttcattggaagtggcgtctaccctgacttatcttccttcactggaagtggcgtcatccaaatctctgtaacctgtatcaaacgatccgctcctactcagcaactcagaatttcaggatacgaggcccaaaagaaggagcaacattcctgggcacttgaaggactatga

SEQ ID NO: 108785 - DNA, 257 bp, Glycine max
  Peptide Sequence Number=SeqID_225563
gcggtcaaccaccggggcaggtgcaaatacatgagtgtctctaccagttcagcctcagtcagcaagggcagggtttcgctccttttgcatgccctactctagagctgtttggggttgaggtcgcatggcccggagattggctcgaggcccaggcaggggaggagcccgcaggatcccccggtgcggcagaggaggcccgtatggatgaagaaatgacgaacttgcttggtttcttgggaggaagcagagccacgtga

SEQ ID NO: 108786 - DNA, 318 bp, Glycine max
  Peptide Sequence Number=SeqID_225564
atgttttcgaacccgcgacttttccctcatgttgatgatcctcttcttcgagaagcatcgtccaaactcgcagaactgcacctgtcaactaagggagtagtcgtcgcccatcacatgacgaaggtgcttgtcggcgcagatggcctaggccataccttgcgccgttcattgaatgttgtgatcgggtgtggtggttcacttgcacaggtttatatggaagacgattatgtgaggaagatgtcagatgaagtggatatggaggttgacatggataatgaagttagaatagatgaagatattcataaagattatggataa

SEQ ID NO: 108787 - DNA, 261 bp, Glycine max
  Peptide Sequence Number=SeqID_225565
atggtgagagagacattagatttttcaggatattgtctaggtgttgatattaggtatgaagcattagtggaactgtcaagaagggagagagaagcaggaataaagccagaccctgagattgatgcattcatgaaggttatagcattgttaggtcaaaaaaccaatttggtaacagattatgtactcaagatccttggattggatatttgtgtcgacattgtggttggagatgagatgagaagaggcatctctggtggatag

SEQ ID NO: 108788 - DNA, 483 bp, Glycine max
  Peptide Sequence Number=SeqID_225566
atgcggtggctcaccaccacacccacgtcgtgtccccgcaccagtggtaccccgccgtggtgtaggagatcgacgccccggtctacactatacatcgtgcggcgctttgacaacccgcgatattacaaatacttcgtcatcaagagttgccacgtcatcctcggcaacagcgatgtcaggcccttccacgagatccacgtgttctccggcctcctcgccgccatcagcaccgagtgccttgacgacgagtgccacatcatcggtttaagcatgattggcggcgaccacccctctccaactaccgcttcgtcaccaccctccacccctgctccgccgctggcaccgtcatcgtcgacgtccccgccggcaacaccaccgaggacatgcacgtcttcatcgacaccatcctccgctgcaacctccggattatccttttcaaatgctcttttgaattttaaattaattaacgaaagtcttaattaa

SEQ ID NO: 108789 - DNA, 1504 bp, Glycine max
  Peptide Sequence Number=SeqID_225567
atggaacctgaaagcccagctttgttgcttattttgtttgcaaccctactttggttcttagccacaaccctttccagaggcaaatctccaccaccctctcccaccaccattcccaaagcatatcctgtcatcggttcggtgttctccatcgccgccaacaaccgccgccgcatccactggatctccgacatcctccacgcctccccctcctccaccttcgtcctccaccgcgccttcggctcccgccaggtcttcacggcgaaccccaccgttgtccagcacattctcaagaccaacttccctgtgtaccccaagggcctgactctgaatcgggcccttggagacttcctcggccagggtatcttcaactcagatggcgctggatggaaagttcagcgccaaatttccagccacgagttcaacactcgcgctctccgcaagttcgtcgaaaccgtggtcgacgccgaactctccggccgcctcctccccctcctcgccgccgccgccaaaaacaaaaccgtcatccccgaccttcaggacatcctccaacgcttcacgtttgacaacatctgcaagatcgcgttcggcttcgacccggagtatctcctcccctccctcccgttaacccccttcgccaccgccttcgacgacgccaccagaatcagcagcgagaggttcaacgccgccttccctctcttctggaaaatcaaaagcctcctcaacctcggctccgagaagcgcctcaaggaagcgatctccgaggtaagaggcttagcaaggagaatcatcgtagaaaagaagaaagagtttcaagagaaagaaactctggacaccttggatctgttatcacggtttttgtgctctggccactccgacgaagagttcgttatggatattatcataagcttcattttagcggggagggacactacctccgcggcgctaacgtggttcttctggctgatttccaagcacccgaaagtggaggaggaggtggttaaggaggttatggagaaagacgcggcatacacgcacgtgtatgatgaggtgaaggacatggtatacacgcacgcggcgttgtgcgagagcatgaggctgtacccgccggtgccggtggatacgaaggaggcaggggaagacgacgttttgccggatgggacagaggtgaagagagggtggagagtggcgtatcatatttacgcgatggggcggtcggagaagatatggggggcggattggggcgagtttaggccagagaggtggctgagtagggacgaggtggaagggaggtggaaattcgagggggtggatgcttttacttatccggtttttcaggctggaccaagggtgtgtttgggaagggaaatggcgtttttgcagatgaaaagacttgtggccgggattatcaagagcttcaaggtgctgtcggaggtggccgaacccgagttcgctgcgtatctcacttctttcatggttggtggcttccctgtcaggattcagaacc

SEQ ID NO: 108790 - DNA, 2576 bp, Glycine max
  Peptide Sequence Number=SeqID_225568
caactgtggtggagatggcatcaggtggaaaggaaacttcatttgtcaaagcaaggagaatgaaagggttcatttcccttcttacatctgcagcttgtgagtggcttttgatatttctgctgctactcaatgccttgctatcatatatgctcaccaagtttgcgagttattgccaactgcaaatgccttgcttgttgtgttctaggcttgatcaaatcttatgccgtgaaaggccggagttctatgtgaacctgttttgcagcagtcacaaatcagaaatatcatctctgattttgtgtcatattcatggtaagctggcagatgggcataggatgtgtgatgattgtcttttgtccgtcactgcaaagaccaagtgcaatgcaaaaacgcacaaattgttggtgggtaaatttgggctggttcttggtggttctggtttcaaaagtccatcactaagtagagatttgtttgctggctctaagggtgcaagactatgtacaagacaatgtacttgttgtggtaagctttggaagtcagatcagaactccccaagatctatccaactaaaatcacctgggagagcttttcttaagccaaatattccttttccatgtgcaccgaggcaaagccgtttaaatcaccgggataacttgaagaaaatgagggataaatttcctggatcagagggaaaaagcagttttcagccactatctcatattgggtacactgagctgagacttaattctgattctgagtccgaatttctattttctgatgatgatgatgttagtagtgtgtttcatgagaacattgaagccagcaatgaccctaaagctcaagttacatctgcaccttcctcaaactgtattccgagtgctttgaatccggaaaatctgaatgatagttctgccaaatccatgcctttgccttcagatcaatgtgtggagcctaatgtcagcgaacatcaagatgtgaatgccaattctgcagaagaaattaatttgcagcaagaaaagcaagagacattcagttctgacctggctgagctcatttcaataaacgaggtttcaccatcacctattgttatgaatgttcctgatagagaatcagaagatagtaagattacttctccttctcaggattctcgtcctactcctctatctgagcttatgactttgaacgacacacatgcacatgctgaagcatcatcagaaaaatatgttgcacaagcaagtgatactggaatggtatctgaaaagaaaggggaagttttagagaagattggtacagaggaaaaagcatcaactgagactcatctggaggtatgtaattctgctcctataaatcctaaggaagttgataatgtcaaggaagaactggagcaatcaccatcagacaaatcttctcctaatgggtctaatatatcatcatatgttcccataaatcatattcactcgccacctgggacagatgctgaggcttctagttctaacggagttcaggtacttcaaaagtcatcctcagtggaatctggtattgattctctggatgaaagcaatattgatgaaattgaaggagattctaatgatgatagactgaggagacaaattgagtattacaagaaatgcatggattctttacagaaggaactggaggcagaaagaaacgcttctgctgttgctacaaatgaagcaatgtctatgattacaaggttacaggaggagaaggcagcactgcagatggaggctcttcaatatttaagaatgatggaggagcaagcagaatatgataatgatgaattggagaaagttaatgatctactcacagaaaaggaaaaagagatacaagatttggaagccgagctggaatattatagatcaaacttgggggatgatgaacctatggtccataatatgcataaggaaagtcgggatttgaaaggagaagatgtcacagtgcaaaacactggtgtgcataacatcacaaataccgcaagcagttcaaagaatgctgaggtatccaaagttggtgaggaagatgtgaccagtggaaccacatttttggaatttgaggaggaaaaggaatacatttctcaatgtttgaaaaacttggaagagaaggttcatcaaatctctttgcatgcgcctaatgatagatctgagaaacttgaagtcagtgaattgaatcaacaaggagcttctaatggtgaagggcatcaattagatggtcatgaagatactggattgtccacagagaaaagcattaatacattgaatggaaatcatattgataaagatggatcagctgctgaagatgttgatgcttgttctcttagtgcagaaaacaatcattccaaatctcctgaactacaaatctgcacgcctagaagagaagttgagttggttgctctagaaaatgaaatatcagaccttaatgaacggttggaagcacttgaatttgatcatgatcttctggagcacctaacaaattctcttcaaaatggcaatgatggaaaacaatttattcaagacatagctcatcgattgcatgagcttcggaaaattgcaataagatga

SEQ ID NO: 108791 - DNA, 1521 bp, Glycine max
  Peptide Sequence Number=SeqID_225569
atgcctctctcagtcccagccagagcgagaatccaccatctccatggaccctcctttttcccttccatttccaaaccaaaacaaaaacccatttggccaacccttttgcctctgaatcgcgcattcgggtgcagaagcctcgaaatcgccgtccctagcccctcctcctcgctcccttccaacgttggaccgaatagttggaaacacgtggacgttgccactctgagcaacctctgcgtcgacatcgtcctcaatgtcccgcagttgccccctccctcccctcttcaacgcaaggctttcatggaccgcttggcccaatctccccctgacaaggttgagttagcagaagccctcaccaaagttgggtcgctttctcatggtgtgaaaaattgggaagctggtgggaactgcaatatggctatagcagctgcaaggttaggactcaactgcatatcaattggtcatgtgggtaatgaaatctatgggaagtttctgtcagatgtgcttcgtgatgagggcattggtttggttgggatgattactaatgacgatatcgtcaacagctctagtggtagtgcctcttgtgaaactcttttatgttgggttcttgttgatcctttacaaagacatggccctaactatgttttctcaattagtcgggctgatttttgcgaggagcctatattgcattggatgagtaaattgtccagtgaagttaaaatggctattaaaaattcaaaggtcttgttctgtaatggatatggatttgatgagctctctcctggtgcactactctcagcaatggaatatgctgttgaagttggcacatcaatcttctttgatcctggaccacgtggaaagagtctctccactgggaccccagatgaacaaagagctcttaaccagttactgagaatgagtgatgttcttcttctaacttctgaggaggctgaggaattaaccggcataaacgatccaatattagcagggcaggagtttctcaaaagagggattcgcacaaaatgggtgattgtaaaaatgggttctaagggttcaattcttataacagcatcgagtgtagcttgtgcacctgcattcaaggcattatcttctcattctaatttcttcattgctttcgtgaatgttattgacactgttggatgtggagacagttttgttgctgctattgtctatggttttatacataatatgccactggttaatacattggcaattgcaaatgcagtgggtgctgcaacagccatgggctgtggtgctggtaggaatgtagcaacactggagaatgtagtacatatattaagatcatcaaacctcagcgaagatgatgaattttggattgaaatacttgaaaagaatgtggttgctcaggaaataacatacctgtcaaatgttatgaacggaaacaaaaaccgtctcaaccttgtctcatttgacaaggttgcctctgagctcttgcctaagcttgaacttccacaaacagtggggaatgcgccaacttga

SEQ ID NO: 108792 - DNA, 624 bp, Glycine max
  Peptide Sequence Number=SeqID_225570
atggtggtcataatgtcaaagcaatatgacttatatattaagcttagttttgcggctaatgcttccagcttccattacaggttacttgtggagaaggatgccccaattgtttggagaggtcccatggtatcaaatgctcttgaaaaaatgacaaggggagttgactggggtaaccttgacattctagtgatggatatgcctcctggcactggtgacgtccagatagctatgtctcaaaatcttcaattatcaggtgcactgattgtttcaactcctcaagatgttgcattaatggatgccaggaggggagtaaagatgttcaataaagttgatgttccgattttgggaattgttgagaacatgagctgctttaagtgtccgcattgtggtgaaccttcatacatatttggtaaaggagggactcaaaggacagcctccgaaatgggattagaacttttaggcaagataccactggaagtggagatcagagaagcttgtgatcaggggcaccccatagtgttggctgcacctgattcagtagtttccagagcatacggcgaggtagctgaaaagcttgctcagaaactcaaggaacagcagttccaaccggagataatactatga

SEQ ID NO: 108793 - DNA, 360 bp, Glycine max
  Peptide Sequence Number=SeqID_225571
atggtgattcttgcaaagaagccttctgcagaagtggttgtaactcagactgtctcagaccatccaaatgaatctattcatgtacttcatgttggaaagatgaggatgaagctctgtaaaggaaatacaacaattgccaaagaatactattctagttcaatgcagctttgtggagttcgaggaggtgggaatgctgcagcacaggcagtcttttggcaaccgaagcaaggtctttcttttgtattagcttttgagtcagagcgagaaaggaatgcagctatcatgcttgcaaggagatttgcatttgactgtaatattattcttgctggacctgatcacaaagctccattagaaacataa

SEQ ID NO: 108794 - DNA, 312 bp, Glycine max
  Peptide Sequence Number=SeqID_225572
atggatgaacttatacatagggctatgaaagtggagcaacaattgaagaggaaacaaacctacaagaagacttcatacacttattcatcttggaaggataaagacacttccaagaaggagggttcttcttcacaacatcttgaatggaagtcttcaagagagagatttcttcagaggcaaaaactttttgttttaatcgagtacatagttgtcgtaatcgattacaagaagttgtctgaagcttgtagagttaagtctcatattggtttaatcgattgtggtaatactttaatcgattacactgttgtttaa

SEQ ID NO: 108795 - DNA, 978 bp, Glycine max
  Peptide Sequence Number=SeqID_225573
atgtcctcacctttagagtactacacgtcctcacgttcagaaggctgcacaccctcgcctttagaggacttcaagtcctcaccttcagaggagtacacgtccccgccttcagagggctacacgtactcgccttcagagggctgcacgccctcgcttgtcctcaccttcagaggaccacatgtcctcacctttagaggactacgctacctcaccttcagagggctgcaggcttccgcgttcagaggactacatgtcctcaccgtcagaggactagacacccccggcttcagaggggtacacccccgcgccttcagaggacttcgagtcctcgccattagggggctgcataccctcgcccgtcctcaccttcagagaactacatgtcctcaccatgggctacacaccctcgccttcagaggactagatttcctctccttcagacgacaacacgtcctcgccttcagagggctacacgccctcgcctttagaggactatacatcctcgccattagagggctacacgtcctcactttcagaggactacacgtcctcgacttcagagggctacatgtcctcactttcagaggactacacgtcctcccctttagagggcaacacatcctccaattcagaggactagacctccactccttcagaggactacacgtcctcgccttcagagggctacacgccatcgccttcagagaactacacatcctcaccttcagaggactagacgcccccgccttcagcgggctacacccccgtgcccgtcctcaccttcagaggactacatgtcatcacattcagatgactacacatcctcaccttcagaggactacacgccctcgccttcagaggactacacatcctccccttcaggggtctaaacctcctccccttaagaggactacacatcctcgccttcagaggactacacgtccacgccttcagaggactacacgtcctacactttaa

SEQ ID NO: 108796 - DNA, 267 bp, Glycine max
  Peptide Sequence Number=SeqID_225574
atgaagaggacgtgtattcctctgaagctgagggtgtgcagccctctgaaggagagggcgcgtagctctctaaaggtgaggacgtgtagtcctctaaaggcgagggcgtgtagccctctgaaggagaagacatgtagtcctctgaaggtgaggacgtgtagtcctctgaaggcgagggtgtgtagccgtctgaaggtaaggacctatagtcctctcaaggtgaggacgtgtagccctctgatggcgaggacgtgtagtcctcttaag

SEQ ID NO: 108797 - DNA, 207 bp, Glycine max
  Peptide Sequence Number=SeqID_225575
atggataataactttcttaagaacatctccagcgcagagaaggtgccgcgatggagacgcaaccatggccgaaggcatcgccaccagatgcacgattatcagtatcggtgctacgatagagacacagtcatggctgaaggcgttggcgtaaaacgcaagtgggaaggaacagtgcagcagtggctgcaatggcaaggagcggcatag

SEQ ID NO: 108798 - DNA, 501 bp, Glycine max
  Peptide Sequence Number=SeqID_225576
atgggaataggaaagtgtgaacaaagtgagaataggaatggaatgggaatgggaaaagaagagatggaaaaaaatgggcaggacacgtggagaatgggaaagggtgcatggaaaagtgaatttcaaattctcaaaagcaagtttctcaagcgacatcttcacggcgatgctcttctccaccaaagaccaccgccgcctgattttctccgccgacgacacgtggcggtttctggcagagaaaggaaacaaattctatcgtgcgagaggtgcaagcaaccgcgggttcttgaagagggatcttggaacagcaagcaaggggactcgaggttaagcatggagattaccgatctacgtgatttttgcgagatcgacgaccctggaggcaagatcaattgctccttgttgaaaaggcgcgaagaggaagattgggcaaagaaaaatagtggccgcataggggaggcggtcgtggtggttgggggagcaggaaaagaggaaacgtga

SEQ ID NO: 108799 - DNA, 525 bp, Glycine max
  Peptide Sequence Number=SeqID_225577
atgggctacgtgagagtacgtgagctcagttggaggtgggcaacaggggatggtgggtttatgcgcgcattgtggatgtggaaaacttgttgtgcaccatcgcccgatcgccacctagtaccacatgtgatggagtggtacctggagatatgtcgcgggggtcaggagaccttggggacgtcaggtggggtgctattgcccaaaaccaagcttgaccaatcccgacccaacccgggcatagtcggtcagcttgaaaacgaagtcaggaaactaagggagcctctgagggatgggtcactggtaatcgattaccagatcgtgatggcggcgcagctaatccatgatcgagtagagatggagtgcctagagggagcctgggagaccctcgaaggcaacacgaggtgccgatttcggggcaccattcgattcgcggctacttctttggtgcatccagatgaacctgcacggacgcttcagcgcacggtggagtggacagccttttggattagttttgtatacttttga

SEQ ID NO: 108800 - DNA, 657 bp, Glycine max
  Peptide Sequence Number=SeqID_225578
atggaggcactcgagtctggggcagtgatgatagtaatgatgtcagcagtagcagtatcaataaagatattaatggtggtagcaatattggtggtggcaaccaatggcggtgatgttggtggcggtggtggtgacaatgacgaaggtgatattaatggtggcggtgatggtaacagtgacagtggtggggtggtggcggtggttgccacgatgttagtggtggttacagtgacagtgagggaagtggtattgttggtagtggtggtggtaactataacgacaatgatagtggcaatgacattgatggtaatggtggtggtagcaataccaataatgatagcgatgatggtgctagggacagtggtgttgttggttgcaccaagtggttgtggtggctgtgatcatattggtggtggtgataatgatggtgacggtggtggcgacactaatggtggtggtgttatgacaattagttatagcaataacaatgatggcgatggcaatggtggtggtagtggcaataatgaaagtggtattggtggtggcgacggtaatggcaatgacaatggcgatggtagtggtggtggtggtggcagcagtagtggtgatggttgttgcgatgatgatggcaaaaaaaagtatcattatcaaatgtga

SEQ ID NO: 108801 - DNA, 276 bp, Glycine max
  Peptide Sequence Number=SeqID_225579
atggatagcactgatatgatcattatggagttaaatgcaaaagctagatatactctggcatatgcattatccaaaaataactttgaaggattcataaatgataaggtggccctcatgtccaaaaagttcaaacaaatcatgaataagaatgagaagtttcataactcctctaaaagaaaggacacaaggttcaagaagtactacaaagaggggggcaatgaaatcacctgctttgaatgcaaaaatcctagacacatgaaggctgagtatccctag

SEQ ID NO: 108802 - DNA, 174 bp, Glycine max
  Peptide Sequence Number=SeqID_225580
atggggaattcaagtataggcaacgatggtggacatgagtttggagcaagagatgatgttggaggatcattaggtgatgttgccgtggaggtggagttgagctggattaatgaatggtgctggaacaacatgtggaaactccaaagggatatcttcaatgatggaagaaaataa

SEQ ID NO: 108803 - DNA, 429 bp, Glycine max
  Peptide Sequence Number=SeqID_225581
atgaaattcaggaccagacaatttttcaagcaattgatcaataaaggagagggggaaatggtcctttcaggtgacttcattgagtttcttgtaatcaatacatatctgtcactcgatggtctttctttacgctatgagatctttccactcattttccatggcaatggtgccccctttcttagggaaacattgtaccagacttatgcattcactgtcacagatggggtagatgatgtctacattgaacaacttcagtatctctcccttcacaatgttcatcatgttggggttgagtctcctctgagccaatgttcctcatttcctgctaatgagaatgggaaggcagacaatcagatatactttgtaacattggcaggactcttcacagtgtttatgagcctcacaaacttctttagatggactacatga

SEQ ID NO: 108804 - DNA, 606 bp, Glycine max
  Peptide Sequence Number=SeqID_225582
atgacacatcacagagcgagagaccaaactgttggaggctctgtagaagaagaagtcagccctaatggatgctctgcagcatgtgattctaaagggttaaggtttgaggaagaggaatgggggctggaggaatggcgactagctatgttcttccatatatgcatcaagttaatgacgaggcttagagactcaaagatccatgttcatcttcatgataatcccatatataagttgggcccggtccatgttggggtcagaggtgtgggaggtgagagcaaggttgaagtaggagaggacgctgcatgtctgagccacagtagtcatagccttcatcaagatcttccatggggccccctcggcgttcaaaatgaaatggcctccgggcaagcagagcttggcctcaatggcctagtggtcagagtatgtgtgcaggaactaggagaagtgtctcctctagagctcctccaagaactcatcaaaatacgtgtaggccaactccaaactcctctctggatgaatgttttggagatgaatgttgtcttaatatttgtgcaagctaccatagacatgaacctagtggaatcccaacctagttccacttgctaa

SEQ ID NO: 108805 - DNA, 838 bp, Glycine max
  Peptide Sequence Number=SeqID_225583
atggcagaacaagctaaacaggtattttatgttcaagacccttgtgatgaaaggtggtcagtggttctacacgggaaaacaattggtgtcaatgttgaagatgatgattcatacattgataattacgttagtcctttgtccacacaaatgtctcctaacatcatcggagaagaagaaactgatgacattcattctaatttgactttgaaatgggcacttgcaaccgccaaggatgatgtcgatgacactgtttgcgaaaaacacccttcgtgggagtttcttgaaaagaagttgatggacgagaagaaaaataaacaactggaggaagctgctcaatccaaaagcactgataccgtgattgatccttcatttcccatcagacgacacgtgaagtggaagatggcccgcaccaagaaaactgattcgttggaggagcaagcctcacagggttcctttgtcgcccatggacgccaggatgacctcccacagttcttcatccatggctcccgaaaacctggagaagctgacacaaaaaatcagggaccaactggagaaggactcgcattgcctcctgagccagaggttggtccttcagttgctcatgtcagcacaaaggagagttgtgttgatccctcagggaacgatccagacacggatgacttagagaaatgcaggttatacgtcgaagaaaatactccccgcctggttgccttaggaagactttatgaggggttgacaacaattcatagcatccttttgcgccatgatcaagtcaaggttggtgttgaggaagttagagatgcagatgctcccattcctatacccactaaaaagttca

SEQ ID NO: 108806 - DNA, 237 bp, Glycine max
  Peptide Sequence Number=SeqID_225584
atgaagcttacctcgacaccaacaacgacagtggcaacgagactggctgcgagtgggagtgagaaagaaaagttgcgacgtggagaggaacacctatgcggaggcgcgacactcggagttgtgatgaagatgataacatgggcgacaccaaagctgcggcagagacgaagatatgctatagacatgagtgaattagggtgtggagccaataatattttaaaaaatcgaattcactaa

SEQ ID NO: 108807 - DNA, 1728 bp, Glycine max
  Peptide Sequence Number=SeqID_225585
atgatgtcctcaccagctaatttgaacacggggggagaagagaagaaattagaaatagagaaagtggtagagagtcaggtagaggtagcagataccgagtcaaagagaattcagccatggaaagagcaaataacagtgagaggattggtggtgagcacggtgcttggaatcatatacagcataatagccatgaagctcaatctctcagctggaatcgttcctaactttaatgtctctgctgcccttcttgctttcttgtttgtccgaagctggaacaaagtgctccacaaggctggttttatctccaaacccttcacccgccaagaaaacaccatcatacagacttgtgttgtctcatgctatagcattgctgttcatggaggatttgcttcttatcttttgggattaaacaggaagacgtatgagttgtctggagttgggactgagggtaacaatccaaatactgttagagatcctggatttgcttggatgactaccttcctttttgtggtttgctttgttggtctcttcatcttgattccactcagaaagatcatgatagttgacctgaagttgacgtttcctagtggcttggcaacagctgttctcatcaatggtttccacacgcagggggacaaaatggccaagaagcaagttggtgggttcttgaagtatttttccatcagtttcatgtggggttttttcaagtggttcttctcagggacacaggattgcggattcgctcagtttcctacctttggattgcaagcttggaagcaaacattctattttgattttaacatgacttatgtgggagcagggatgatttgcccccaccttgtaaatttgtctttgctccttggagccattctctcctttggagtgatatggccgctcattgatcgtcgcaagggagattggttccctaccaatttagatgagagcaacatgaaagctttgtacggctacaaggtctttctaacagttgctctcatcctcggtgatggcttatacaactttgtcaagattttagtttcctcaatccttagcgtacatgaaaaaattaagaaccgtaaaaatgcttcaagtgcggatcaacagagagataacgctgaagagcttaaacaaaaagaagttttcctgagggacaacatttcgatgtggatcggaaccggcggatacatagttttgtcggtgatttccataattgtaatccctttaatgtttcctcagctgaagtggttctacgtggtggtcgcttacatcttagccccgtccctggcattctgtaacgcttacggaacgggtctcaccgacatgaacatggcatacaattacggcaaagtggcactctttgttgttgcagctatgagcgggagagacaacggcgtagtggcaggtctcgtagggtgtggtctggttaaatctgttgtctctgtggcttgcactctgatgcacgatttcaaaactgcatattacacctgcacttctcctaaagcaatgttcatatgccaattaatcggcactgcgttgggctgcgtaatagctcccctcagcttctttctgttctacaaggcattcgatgtggggaacccgcatggggaattcaaggccccctatgcgctaatttacagaaacatggcggttttaggcgtcgaaggtttctccgcactgccccagcattgcttgcagctctgttacgggttctttgctttcgtggggtggtga

SEQ ID NO: 108808 - DNA, 417 bp, Glycine max
  Peptide Sequence Number=SeqID_225586
atggtgagagacctctcccccaacgtgtttgggaaatggatgccgttgcccatggtgatggcgattccctttctggttggtgcctactttgccattgatatgtgccttgggagtttggtggtttacgtgtggcacaagcttaacactaagaaggcagaggccatgattccagcaactgcctctggactcatttgtggagaaggcctgtgggctcttcccgcttccattcttgctcttgccaaagtacacttcatacataaccaaaatgctataaatattccaagtgtctggccattgggcttaggaacattgtattattgcttactacaactttgtaggaaaagtcagttcctgttaattgatctctcggaagggaatttcttcttcacaggagtcataattaattcgagttattag

SEQ ID NO: 108809 - DNA, 498 bp, Glycine max
  Peptide Sequence Number=SeqID_225587
atgtctcttgctacattatttggaaagttacaggaacacgaaatgaaatggttgagattaaatcaacatgaagaaaatgataagaagaaaaagggaattgttcttaaagattcatcttcaatccaagaaaaaagtgataaggaagacttaattgaattagatgaagatgacgattttagcctttttgtaaaaaggttcaacaagttccttagaatcagaggaaatcaaaggagacaaaattttaaacctaaaagaaggacagaagattcatcctctactccaaaatgctatgaatgcaatcaacctagacatccaagggttgattgtttgatcttcaagaaaagaatgaagaagtctgaaaagaaaattattagtgaaaagaaggcaaagaggacctacatcacatgggatgacaatgatttggaatcatccgaagattcagaaaatgaagtaataaatctgagtctaatggccaagagttatgaaagcgatgaagag

SEQ ID NO: 108810 - DNA, 144 bp, Glycine max
  Peptide Sequence Number=SeqID_225588
atgggagataatgatttacattggtggaccacgagctaccacataaagaaacttgagactcaagtttatgggtcttctcctcacttatatggtgctccacatttccactttttcccgatgtgggacttcacctcacacttgtaa

SEQ ID NO: 108811 - DNA, 369 bp, Glycine max
  Peptide Sequence Number=SeqID_225589
atgcggagacaccttacagttatttgcacctcgtcattcggagaccccaagtccgatgacacgcatagaccaatgtggtcatctacaccctccccggagatgtcagcgtctttcgaccgagactatttagtctcaccttttgctatccaacgacccaagagtccgtctcaccctcgtcatccagagatggcaagtccgatgacacgcaaagacatctcatggttatccgcaccctcatcatccggagacggcaagtccgatgacacgcagagaccaatcatggtcatctgcacccctttgtcgaagatctcggagtctttcgacagagattactttagtctcacctttgctatccggagacggctatag

SEQ ID NO: 108812 - DNA, 1323 bp, Glycine max
  Peptide Sequence Number=SeqID_225590
atggcgtgtgaggaagtggctcattcgagacctctgttcctcacgatctacactattgtcttcgttggcgtcgtcttttcctcactctacgtcttctccgccattcgctacccctccaccaacgcttctacttggtccctttcaaatgaggatgttcgtcttacagaacaaacacttaacgtttctcagtcgggaaatgcgcatgttgtgccttctgttcctccggaggcacgaaatgtgaagacaaggcctattttgaatattcctccgcgcaataaaaagatgccatctttgaatactttcagattgaccgaagaattggttcagcaaagggtgaaagataacattataattgtgacctttggtaactatgcatttatggactttattctgacttgggttgaacagttgaatgatctgggagtttctaattatcttgttggtgcaatggataccaagttattggaggcgctttattggaaagggataccagtttttgacatgggcagccatatgagtacagatgatgttggctgggggtctccaacatttcataaaatggggagagaaaaagttattctgatcaacttgatactgcctttcggttacgagctgttgatgtgtgacactgacatggtttggttgaagaacccacttccatatcttgctagttatcccaaagcagatgttttaacatccagtgatcaagttgttccaacagtggttgatgatagtctggaaatttggcaagaagttggtgctgcttacaacattggaattttccattggagacctactgagtctgcgaaaaaattagcaaaggaatggaaggaactgcttctagctgatgataagatatgggatcagaatggttttaatgatattgtacatagacaattaggaccgtcagttgatgaggacagtggacttgtttatgcttatgatggaaatctaaagctgggaattttgccttcaagtatcttctgtagtggacatacatattttgtccaggctatgtatcagcaactcagattggagccatatgcagtgcacacaacatttcaatatgcaggcactgaaggaaagcgccaccgactgcgagaagccatggttttccgtgatccaccagaatactataatcctcctgggggcttcttgtcatttaagccttctattccaaaaagcttgttgctaagtgggaagcataccattgaatcacattttacacttgttaattaccaaatgaaacagattagaacagcacttgcaattgcttcccttttgaacagaacactggtgagaactatttttctgggatcataa

SEQ ID NO: 108813 - DNA, 213 bp, Glycine max
  Peptide Sequence Number=SeqID_225591
atggcagtggtgcaggagtggcaagcttccatggctaagcttattgtttctactgtagtggataaggttatcatcatattgacaacaatgctcggagtcagccacaagcagagaaacttgtatcgacaaaacatgacagcaagaaagacaatgtttcacttagcagtgcgtgcttaccttctccattttgttggttgcacgatatttgcatag

SEQ ID NO: 108814 - DNA, 516 bp, Glycine max
  Peptide Sequence Number=SeqID_225592
atgagtacccaatcatcattcttctctgatgcgggcccatcaaatatgatggcaagaacacgatttacagcagcatttcgtgttcagaagaacatcattgaagttccattgagttaccatagtcaatggaggccatattacccaacttatgttttatttgactacaatggaaccaagcattttattagggtgcacaaatgtggcactcgatgcttttttgctgatgggctgaaagagtttagaagaacccacgacattaatgacagtgtcattatccgattttttgcagcctctaaagatacttctttggaagtcgacatcatgggacctatccttagacagacatgtcaaaggtcggttgttacaaccagaaggcacatctttaccgctgatgtcacccaagacatgatcgaacataccaaccctttggttcttccagcaacaactttaaattttttgtttggatcaaaaaaaattgttcctgttcagcttccaaatggcacacgaaaccaatga

SEQ ID NO: 108815 - DNA, 1002 bp, Glycine max
  Peptide Sequence Number=SeqID_225593
atggaggttaagattcagaaaacgttgtctatgtgcaagaatttgatgaaggaggtaaagacatggggttgtttgaagcagacagggctgagtttaagatatatgatggagtttggttccaaccccactcccaagaatttactcatctctgctcagttccttcacaaagagcttcccattagaattgcaaggagagccattgagcttcacactctccctcatggcttgtctcacaggcctcctgtcttgaagaatatgaatgacgagaaagaattcactgaactgattaagtccatcaaggtgagacacaacaatgtggtacctacaatggccttgggtgttcagcaattgaagaatgtttttgaggaccctgatgagattgatgagtttcttgatcgcatttacatgtcaagaattggaatccgtatgctcatcggacagcatgttgagttgcacaatcccaatcctcctcccaattgtgtaggttatatacatacaaatatgtctcctgtgaatgtggcaaggaatgctagtgaggatgcacgttctatgtgttatggtgaatatggaagtgctgcagatgttcgaatttacggggatcctgattttacttttccgtatgttccagctcacttgcatcttatgttttttgagttggttaagaactcactgcgtgctgtccaagaccattttatggactctgacgaagttgctcctcccattagaataataatagcagatggaatagaggatgttaccataaaggtctcagatgagggaggtggaataccaaggagtggtcttccaaaaatatttacatatctctacagtacagccagaaatgcatcgtgggatgaaaatgaaccttctgatcttggaacaaccgataatataagtgtaaaaatggctggaaatggttatggacttcctatttgccgcttgtatgctaggtattttggtggcgatcttcaagtaatctctatggaaggatatggtgagtaa

SEQ ID NO: 108816 - DNA, 1829 bp, Glycine max
  Peptide Sequence Number=SeqID_225594
gtgaaatgagtagttgttgggttcctccaccttgggcatgttcaagcatggccgaagtgaagcaacagcattccctcctcctccgtttgggactctccacgaacaaccacgccatgtctcgcatcttcaccttctgctccctctccaagcacggagacatcaactacgccctcaaactcttcaccactcttcccaacccagacaccttcctctataacactctcttcaaagccttcttctccctctcccaaaccccttccctttccctcctcttctactcccacatgttacaacattgcgtcacgcccaacgctttcaccttcccctctctcataagggcatgtaaacttgaggaagaagcaaaacagcttcatgcacacgttcttaaattcgggtttggaggggacacctacgctctcaacaacttgattcacgtgtatttcgcttttggttccttggatgatgctaggagagtgttttgtaccatgtctgatcctaatgtcgtatcttggactagtcttgtttccgggtactctcagtggggactcgttgacgaggcttttcgcgtttttgagctcatgccttgcaagaagaattctgtttcttggaacgccatgattgcttgttttgtcaagggaaaccgatttcgcgaggcgtttgctttgtttcgaaggatgagggtggagaagaagatggagttggataggtttgtggctgccacaatgctctctgcttgcacgggagtgggagctctagagcaagggatgtggatacataaatatgttgagaaaactgggattgtcttggattcaaaacttgccacaactattatcgatatgtattgcaagtgtggttgtttggacaaggcgtttcatgtgttttgtgggttgaaagtaaaaagagtttcttcatggaattgcatgatcggggggtttgcaatgcatggcaaaggagaggatgctattaggctttttaaggagatggaggaagaagcaatggttgcgcctgacagcatcacttttgtgaacgttctcacagcttgtgctcattcaggtttggttgaggaagggtggtattactttcgttacatggttgatgttcatggcattgatcccaccaaggagcattatggttgcatggttgatttgcttgctagagctggaaggctagaggaagcgaaaaaggtcatagatgagatgcctatgagtcctgatgctgctgtcttgggtgcccttcttggagcttgtagaattcatgggaatttggaattgggggaggaggttggtaatagagtgattgaactagatcctgaaaatagtggacgttatgtgatactaggtaatatgtatgctagttgtggaaaatgggaacaagttgctggtgtgaggaaattgatggatgataggggagtgaagaaggaaccaggattttcaatgattgaaatggagggtgtagtgaatgaatttgttgccggggggagggatcatcccctggctgaggctatatatgccaagatttatgagatgttggaatcaattagggtggttggttttgttcctgatactgatggtgtgttgcatgatcttgttgaggaggaaagggagaatcccctgttctaccatagtgaaaaacttgcaattgcttatggtttgttgaagaccaaacgaggagagacccttcgtgtcaccaagaatctgagggtttgtaaagattgtcaccaagcaagtaaaatgatctccaaggtttatgattgtgatataataataagggataggagccgtttccaccattttagtaatggagagtgttcttgtaaagactactggtaa

SEQ ID NO: 108817 - DNA, 165 bp, Glycine max
  Peptide Sequence Number=SeqID_225595
atggatgatcaagaaggtccatggcctagggaagtgacctccattgcactgaggaggggtgcttttctaagggcaaaggttcttgcgaatcccccaaacgagacaaatggagatatgcgtcagtccctgcaaacaatgtatcaagagcttcagaattctcagtag

SEQ ID NO: 108818 - DNA, 1176 bp, Glycine max
  Peptide Sequence Number=SeqID_225596
atgatgaacaaaactcttctcctcacttatttctacttgttcatctacattttgctttcttctggagtcattttgtacaacaagtgggttttgtctccaaagtactttaactttccgcttcccatatcactcaccatgattcacatgggcttttctggggcagtggcattttttcttgtccgggtctttaaggttgtcactcctgttaaaatgacatttgaaatatatgctacttgcgtgataccaataagtgccttctttgcatcaagtctttggtttggtaacacagcttatttgcatatttctgtggcttttatccagatgctcaaagctctgatgcctgtggcaacattcctcgtggctgttatgtgtggcactgacaaagcaaggtgtgatgtgttcttcaacatgttgatggtcagtgttggagttgtcatttcctcctacggagaaattcattttaatgtagtcggtacagtttatcaggtcactggcatctttgctgaagctttaagactggtcttaacacaagtccttttacagaagaagggcttgagtttaaatcctattacaagcttatattacatagctccatgcagttttgtgtttctctctgtgccctggtacctgctggaaaagcctgttatggaagtttcacagattcagttcaatttttggatcttcttttccaatgctctatgtgctctagccttgaatttttccattttcttagtaattggtagaactggggccgtaaccatacgggttgctggagtgctcaaggactggatattaatagccctttcgactgttatatttccagagtctacaataactgggctgaatataattggctatgctattgcactatgtggagttgtgatgtacaattacataaaggttaaggatgtccgagcctctcaatcaccaaatgaaattattccagatggaatcacaaagtttatttcatcgagttcgattgacatacaggactggaaattcgagaagaggtcatctgatttttatgtgcctgataatgttagtaacaatgggggaagtggtggaggcaatggttctctttctgatatgaacattgatgaagaagcaccgctaatttcttcaagggtgtctcatattggacgtatgcagctagccaaccatgcaacaggaaaatga

SEQ ID NO: 108819 - DNA, 264 bp, Glycine max
  Peptide Sequence Number=SeqID_225597
atgggaatgaacgtaaacttcattacatactcaactgaaattgagccaaaatgccgacaaactcagtctgacatcatgaatgttcctcgggatttgggacgcccaatgaaaaccaatataaactcatgcctgcttcagctacatcaacatattgatgcacgtatacagcaaaaatatgcactacaacctgatattctggaagaagcttcaattttggttgaaaagtacaatgttagcttcaaattgcccaagttcatgtactag

SEQ ID NO: 108820 - DNA, 2986 bp, Glycine max
  Peptide Sequence Number=SeqID_225598
atgttgaaagaactccctgaggaagagtttggccccggaatagatattagagagtactcaatacttgataatcccatcctcccctcagaggtgaagaagtcatggcttgatgttcagctctgtaaggatggaacccaagattgttttgcatcaaataacaccactgttgggggagtactcaaatttccaaggcatagcaatgaagaaagggaaagggaagatagattcagaaaacgtgttaaacggtacccaggtatatggtgctgcgtgctggatcacactcctggccacatttattacgatatgtactgggatgagaaacctgaatggaagccaatccctcctcaaacttccgctgatgatcatccaccatgcgtcattcagctgtttgacgaaatgccacaaagatatatacatgggagagagatccattttgagcttgttgattacatcaaattgtgcctcaaaaaacccaaaattgtgactgccactgttgcccattgtgcagccttaaagataggtgctctagctcacctccccacttcaacatctctactcactatttattccaaggctggagactttacctcttcaaagggtttgtttgatgagattcagaatagagatgcgattgcttggaatgctattgttgcagcatctcttgaaaataagtgttataggatagcaatggacttctttgataaaatgatcaaggcccaaactgggtttgattctactactctattgcttattgtatcagcttccttacacatgaaaaactttgatcaaggacgcgcaattcattgtgtgagtataaaatctggaatgcttgtggatatcagtttaggtaatgctcttgttgacatgtatgccaagtgtggtgatctaagctcttctgagtgcctatatgaagagattgaatgtaaagatgcagtttcatggaattcaattatgagaggcagtctttacaaccgtcatccagaaaaagcattgtgttacttcaaaagaatgagtttttctgaagaaacagcagacaatgtcagtctatgttgtgccatttccgcgtcttcaagtttgggagagctgtcttttggtcagtccgttcacggtctgggaatcaagctaggctacaagtcacatgtttcagttgccaactctctcatttcattatattcacaatgtgaagacatcaaggctgctgaaacactattcagagaaatagcacttaaagatattgtttcctggaatgcaatgatggaaggatttgcttcaaatggaaagattaaggaagtgtttgatcttctggttcaaatgcaaaaagtagggtttttccagcctgatatagtgacattaattaccctacttccactttgtgcagaactgatgctctccagagaaggaagaactatccatggatatgcaattcgaagacagatgatatctgatcatgttatgttactgaacagtctgataggcatgtattcaaagtgcaacctagtggagaaagctgagctcttgttcaattctactgcagagaaagacacagtctcatggaatgcaatgatatctggctattcccataacaggtattctgaagaagctcaaaatttgttcacagagatgctacgttggggtccaaattgcagctcatcaactgtttttgctattctttcatcctgcaactcccttaatattaatagtatccacttcggaaaatcagttcactgctggcagttgaaatctggatttttgaaccacattcttttaataaatattctcatgcacatgtatatcaattgtggggacctgacagccagtttctcaattttgcacgagaattctgctttagcagatatagcttcatggaacacactaattgtggggtgtgttcgatgtgaccattttagagaggctctagagactttcaacttgatgagacaggaacctcctctaaactatgactctataacccttgttagtgccttgtctgcctgtgcaaacctggaactattcaacctagggaagtctcttcacggccttacagttaagtctcctttgggatcagatactcgggttcagaactcgttaattaccatgtatgacagatgcagggacatcaatagtgccaaagtagtgtttaaattcttctcaactcccaatctgtgctcatggaattgcatgatctcagcattatctcataatagagaaagtagagaggcactggaactatttctcaatcttcagttcgaaccaaatgagatcaccattattggtgttctctcagcttgcactcaaattggtgtcctaagacatggaaaacaagttcatgcccatgtgttcaggacttgcattcaagacaattctttcatatcagcagctcttatagatttgtatagcaactgtggaagattagacactgccctccaagtattcagacatgccaaggagaagtcagaatcagcttggaattcaatgatttctgcatatggataccatggaaagggtgagaaagcaatcaaactctttcatgaaatgtgtgagtcaggagcaagggtgagcaaaagcacttttgttagccttttatcagcatgcagccattctggacttgtgaaccaaggtctttggttttatgagtgtatgttggagagatatggagtacaacctgagactgagcatcaagtttatgtggttgacatgctaggaagatcaggtagactagatgaggcttatgagtttgctaaggggtgtgacagctcaggtgtgtggggagctctcctaagtgcatgcaactatcatggagaactcaagttggggaaaaaaattgctcaatatctctttcaacttgaacctcaaaatgttggacattacatatctttgtcaaatatgtatgttgctgcaggaagctggaaagatgctaccgagttgagacaatctatccaggacttgggtttaagaaaaaccgcaggttatagccttgtagatgttg

SEQ ID NO: 108821 - DNA, 585 bp, Glycine max
  Peptide Sequence Number=SeqID_225599
atggccaagtccaaaaccttcatgcttagtattttgcgcattgccctcgccctcctcttctcctcattcgcagcagcagaagaagaacctcgtttcgatcgaaacttgtctccgaaatctctgggtctccgaaaggagaagctcacccaccttcgcttctacatgcacgacgttatgagcgggccaaagcccacggcggtcaagatagccgaggcccagatggccaacacttcctcctcatttttcggactcctggacatggccgacgacccgttgaccgcggggcccgagcctgaatcgaaactggtgggaaagggccaaggaatgtttggctttgcggaccagaacgagttagggcttgtgatgctcttcaacttcgcgttcacggaaggcaaatataatggcagtaccctaagcatgttggggcggaacatggtgctcaccgccgtgagggaaatgccgattgttggcgggagcggggttttccggtttgcacgtggctatgctcaggccaagactcacactcttgatgccaagacgggggatgctgttgtagagttcaacgtttacgtgttccattattag

SEQ ID NO: 108822 - DNA, 231 bp, Glycine max
  Peptide Sequence Number=SeqID_225600
atggcagcactctcagcttgttgggggcggaacatggtgctctccgccgtgagggaaatgccaattgtcggcgggagcggggctttccggtttgcacgtggctatgctcaggccaagacttactcgtttgatgtccagacaggggatgctgctgtggagtacaactacgttgattcctccatttttccgcggattaaacagttcaggctaaaaagcttgcatcttagatga

SEQ ID NO: 108823 - DNA, 285 bp, Glycine max
  Peptide Sequence Number=SeqID_225601
atgagtcatgcagtagcagtaggagcacttgctgttccatctccaactcccatcccttttgtattaccttctctctcttctcttctcttctcttctttccctttctatttgaattccactgctccagtggaattggaacatggtcatggtcatggggtgaagctcattcaagatgggtataagtggcgcatcgttttggcttacgatggaacccaatacgcagttgctttgaagaatctcaaacattgtatctatcgttttagagtgatctcagttattaactga

SEQ ID NO: 108824 - DNA, 483 bp, Glycine max
  Peptide Sequence Number=SeqID_225602
atggcggatcgattgacgcgtattgccatcgtcagcaacgtcaggtgcaagcccaaaaagttccgtcaagagtgcaagaagagttgccccgtcgtcacaaccgagaggctgtgtattgaggttacttccgtgtccaagattgctttcatttccgaggaattgtgcactggatgcggtatttgcgttaagagttgtggtggcaggttgccggttccgaggcctgggcaggtgcttgggttggttgggacaaatgggattgggaagtccactgctcttaaagttttggccgggaaattgaagccgaatttgggtcgattcactaatccccctgattggcaggaaattttgacctattttcgaggatctgaactgcagaattactttactcggattctagaagatgatttgaaggtgatgtccgcacccttgttcaatatgtatgcatgccgtgatgtcttagtgatttggactctgacactgtaa

SEQ ID NO: 108825 - DNA, 1479 bp, Glycine max
  Peptide Sequence Number=SeqID_225603
atggcggtgattcatgatggttatcttttagatctttttcgcgccaaaatctgtattttttatcttcccatccatttaaattcacttctctttgggaagaaattctctttaccgggcatcacacatctcttcttcgtgggaacgaaaatgtggaggcaagtggaagccacaaaccaagatgagtcgatcggaagaaggaggaacatcaatcccgttcatgtcgccttcattgttgataagtacctctgcgacaatcatttctcaaacacgcggtgcatctttcgcaacgaggcatcttctctctttgctacttcgtcaatcaaccagttgccgaagactttggaggagatgctggatgagtatatatttttgaagaaacaaaatgcgatcctgggtcaagaaaggatcatggtgatggaagagaaaaacaggattcaaatactgttgcaaggcatgcagaatgccctgaacacttacaatgcttttcagaggccaccctcactgaatgtcgcggcgatgaatgcaaattttgcagtagttcctcaaccgagagtttataacaaaactccccaaggtgtttctactattacaagtattgctgctgccatgcaaaacacatctaatacacagttgcttactagacctgtcaacaccaatgtggacactggaaacttctcaacacccatgattagtgtgtctgacaagaagagaaaagatactgaagcagtaaatgggcctatagttgcaaagaaacctcgtggtagaccacctggcaggaaaaatcaagtccaaggtgaaaacacatcaccacaatcaagtaatgctgtcaacaaccaagtagtttctcggccatcttcttctgcaactcaatcatcatctgggaactgtgcaaccagcggatcactggttcaaggatccaatgttgtcaaaggctcattcaatcaccctccactttttgttccagacaattccccaattccaaagacacctacaacacaatcctctcagagtgatacatatgtgtcccctactaaaatttatcctgctgcatcttgcaatggagaggctagtcctacttgttgcactatgaatccaaccaacaaagttatggttggccctgaaacacaaatggcttataaagagaacagtcattgcaattctcctatcgaagtagatacaggaaaatcaagtaagatggatgacgtaaggagcaaactgaactttgatgcctctaatatgcctgagagcttggacaaatcattgtctaatgaggtttatacatctgagtctgacaaggaagttgacatatctgacattgatttttcaaacttgatggattgctgcccattcctaggaatcacttccgaagatttttcttaccatccagttccaactcattccaaggataatgcttcaacgtcttctcatgaatgcaatgctaatcatttgacttaccatcaaactgaaaacaatcactga

SEQ ID NO: 108826 - DNA, 2247 bp, Glycine max
  Peptide Sequence Number=SeqID_225604
atggctacgaggaaagttatagctatatgtcaatcaggaggtgagtttgtaactgataaggatggatcattgtcatacagtgggggagatgcctatgcaatagacattgatcagcagacaagtttgagtgattttaagtcggagatagcagaaatgttcaactgcaatgtaagtacgatgattatcaagtacttccttcctggcaacaagaaaacacttattacagtgtcaaaagacaaggatttgcaacgcatggtcaatttcctcggggatgctaacacggttgatgtgtttgttatgtcagaggaaggagctgctcgaaataacaattccaacatgcctggtagtaggtcaagcaggacaactgtgtcagaagccgctgtacctgttgttgctcctatgaatgtcattgttgatgctgtccaatgcatggatcaggtagaggtagtagatgtagctaatgaagtccctgcacgttctatttgttctgggggcaatgatgacaatcatcgtaaagctgcacagcagtgggaaaataccatcacgggtgtggaccaaaggttcaatagttttagtgaatttcgagaagctttgcataaatactctattgctcatgggtttgcttacaaatataagaaaaatgatagtcatcgtgtcactgtcaaatgtaaatctcaaggctgtccttggagagtatatgcatcaaagttgtcaaccactcagttgatttgcattaagaaaatgcactgcaatcatacttgtgaaggatctgtcgttaaagctggataccgagcaactaggggttgggtgggaagtattataaaagagaagttgaaagattcacccaattacaagccaaaggatattgctgatgacataaaacgggagtatgggattcagttaaattattctcaagcatggcgtgcaaaagaaattgctagagagcagcttcaaggctcctacaaagaggcatatactcagttaccattgttctgtgagaagataaaagaaaccaatccagggagttttgcaacattcacaactaaagaggactcaagtttccatcgtctctttgtagcatttcatgcctcaatatctggtttccagcttggctgtcgccctctcattttccttgacagaactcctttaaactcaaagtaccaaggggagttattggctgcaatttctgtggatggaaatgatggcatttttcctgtagcctttgcagttgtagacaccgagactgaagacaactggcactggtttctgcaggaactgaaattagcgacatcaacatctgagcagatcacatttgttgcagattttcagaatggcttaaaaaaatcattgtcggatgtatttgaaaaatgctaccacagctattgtttacgccaccttgctgagaaattgaacaaggacttgaagggacaattttctcatgaggccagacgtttcatggttaatgatttttatgctgctgcttatgcgcccaaattggagacttttgaacgtagtattgagaatattaaaggtatttctcctgaagcctatgattgggtcatacaaagtgagccagaacactgggcaaatgcattctttaatggagcaaggtacaatcttctttcatcaaattttggacagcaattctacagttgggtgtcagaggcacatgaattgccaattactcaaatgattgatgcattacgaggtaagatgatggaaacaatttatacacgacaggtagaatctaatcaatggatgacaaagttgacaccatccaaggaggaattgctccaaaaggaaagattagttgctcattcacttcaagtattgttctcacaaggtagcacatttgaggtccgtggagaatctgtggatattgtcgatattgataattgggattgtagctgcaagggatggcaacttactggtgtgccctgttgtcatgccattgctgtctttgaatgtgttggtaggagcccatatgattattgttcgagatacttcacagttgagaattatcgattaacatatgcagaatctattcaccctgtaccaaatgttgacaaaccaccagtccaaggtgaatctactgctttagttatggtaatccctccaccaactaagcgccctccaggtcggccaaaaatgaagcaagttgaatcaatagacataattaaacgtcagcttcagtgcagtaagtgcaagggacttggccacaataggaagacatgcaaactttcatag

SEQ ID NO: 108827 - DNA, 303 bp, Glycine max
  Peptide Sequence Number=SeqID_225605
atggagttggccggaactgaagctggacatatacccagatgttatgttatggatatgtctaaagacttcattcccatgtctgtgttttctgacacaccacaagccctaacagtccttaaatggttaatcaaacatgcacttactgtatccgtggccctaactgcttccttttctaccctttccccatatacgtctaatcaccagaggtctatcagagagatagatgggaatgtcaactatgagaagctcaagttttgcatgcacagtgtgagagtatcaatcagtaaaaaaatgagacgctga

SEQ ID NO: 108828 - DNA, 183 bp, Glycine max
  Peptide Sequence Number=SeqID_225606
atggcaatcaaggaaaaaaaagctccaactaaaccaacggatatgaagagaacaagaagagaccatggaaagatagaagagattgtgttcgagctatttgaacgacaaccaaattggagtttaagaaaactcatacaagaaaccaaccaacctgaagtaggtctctacaagcacaccatatga

SEQ ID NO: 108829 - DNA, 489 bp, Glycine max
  Peptide Sequence Number=SeqID_225607
atggatccattccaacggcactttgcttaccatagtgtgtataaactcaatagcgctgttatgagagaagctgcaacatattttgttggcaagcatgatttctctgcctttgccaatgcatcccacaatgatcgggtaccagatccagtgaagcatgtattccgattcgatttgaaagaaatgggagctcttttgcaactagaagttgaaggctcaggttttttatataggcaagtccgaaacatggtggctttgttgcttcagattggtagggaagctatccctcctgacattgtaccacatattctggcgagtcgagatcgcaaagagcttgcaaaatactccttgcctgcccctccacatggtctttgtcttgtttctatcaactataatgaaagtcacctattgcctccgccggagtccccccctgcaaacagttttggtagacatcagaccataaggaaatgcaaggttccattctttttgtaa

SEQ ID NO: 108830 - DNA, 414 bp, Glycine max
  Peptide Sequence Number=SeqID_225608
atgactctttcggacgacgaggacgagaatctggctcaatttctggaatcagaagtcctctcggaggtatctgacaaggaagaggaaaatgtggaggaaccgaaagcaaagagagcgcgcttagaagaggatgagattactaagcaaaaacaaagttctgattcattatctgcgccgaagaacattgttgtcaacaacggggtggtgcccagaaggattgagactggttatttcagtcaaattccaccggagcttttccatcacatccttaaatttctgtcctccgaggaccttgtttcttgttccttagtttgtaggttcttgaattatgctgcatcagatgaggcattatggcgtcgcttgagtgccagtcccatatctgctgggtatgagagacggaactcccccgtttga

SEQ ID NO: 108831 - DNA, 1397 bp, Glycine max
  Peptide Sequence Number=SeqID_225609
atggtggtccccttgcttgtaggaattgatggtcatgcttcattagatggtccaattgaggaagttgccagatcagaagcaagagacgctgaagacttgctacaagacttgggcattccgagcccttcttcatccagaaattcgcctcgtggaatattctgcagccgtacattgaatttgcggtccattagtgccattggatatgacatggactataccttgatccattataatgtgatggcttgggaagggagggcttatgactactgtatggaaaaccttaagaatatgggtttccctgttgatggacttgcctttgatcctgacctggtaattagaggccttgtcatagacaaagagaaaggcaatttggttaaagctgatcgatttggttacataaaaagagctatgcatggcaccaaaatgttatctactcgagctgttagtgagatgtatgggagagaactggtggacctgcgaaaggagagtcgatgggagtttctcaatacactgttttctgtgtctgaagctgtggcctacatgcagatggttgacagattggatgatgaaactataccagcagatcttgctcttgattataaagggctatataaggctgttggaaaagctctcttctgggcacatgttgaaggtcgtcttaagagtgagatcatgtctaagcctgaactatttgtggagcctgatccagaattacctttggcacttttggatcagaaggaggctggcaagaaacttctgctaattaccaactcagattatctttacacagacaaaatgatgcagcattcttttaatagattccttcccaacgatatgggttggcgagatctatttgacattgtaatagtctcagcaagaaaaccagagttcttccaaacgtcacatcccatgtatgaagtggtcacaggcgagggccttatgcgtccatgcttcaaagctcaaactggtggtttgtactcggggggaagtgcacaaatggttgaaaattccctagatattcatggagatgaaatattgtatgttggcgaccatatttacactgatgtcagtcaatcaaaagtccatctgcgatggcgaacagcattgatttgtcgagaactggaagaagagtacgatgccttgattggtagccgcagttatagagaatcattggtggagcttattaatcaaaaggagattgtaggggatctctttaatcaacttcggctggctctgcagaggcgaagcaaagaccgtcctgctcaaaccctagcagcaactaacttgaatgatgaagacctcactgatagcatgcaaaagctacttattgttatgcaaagactggatgagaaaattgctccaatgctggaggcagatggggagctcttcaattcaag

SEQ ID NO: 108832 - DNA, 282 bp, Glycine max
  Peptide Sequence Number=SeqID_225610
atggcagagaatattgacttgtatggagattctgacatcaagcaagattcaaagagcaaggtcaaagatgaatctgccaaaacggtacccttatacaagcttttctcatttgctgatcctttggatcatttgttgatgtttgtgggggctgttggtgctattgggaatggaatctccatgcccttaatgactttgatatttggaaatatgatcaatgcatttggagcaaccgaaaactccaacgaagttgttgatgaagtttctaaggtagttcctcactaa

SEQ ID NO: 108833 - DNA, 342 bp, Glycine max
  Peptide Sequence Number=SeqID_225611
atggcaccagctagggttttcggggcaatcgccggcagagcgttcatggcggcggcggcgaagagcgcggcgaagaagaaacccgctccgtccagcggagccgctgcgaaagccgctgtgaagaagacggccgcgcccaggaccaccaactccggcatacagaaggtggttccggtgtcttccgagctcggagacttcctcggcgctcctcaagtgtcccgaaccgaagccgtcaagaaagtctgggcctacatcaagctgcagaatcttcagaatgaggctattcgtttggttttgtgcttctctgtctgcaatgttgaacgctatctctgtttcatataa

SEQ ID NO: 108834 - DNA, 523 bp, Glycine max
  Peptide Sequence Number=SeqID_225612
atggcctgggagcaagggtaccaaaaggtttgggtggagagtgattacaaagtggctatcaacctcgtgacctctgataatgctaatcatcatatgcggcctcttatcagtatagctagaactcatgcacgaaatgcttacatgggcttagttcctccttttgataaaaaaaaccttgtgtttgataacacattggttactgccttattggtggatgtggatccaacaacagtgataaagggttgcgaagcaaccttggactatcttggactgttaaacacaaacaatgaccaagccttccatgttgcttcatcacacgatgggctttacaatggatggggtataagaactgatggaataaaatgggtgaaagaaagaaagaaaagaaatggtggaaagggagaagagaattccccaaggaagagttctcaggctctaggtagtagtgagaatgctctgagactcgtcgtgctcagcacgagctatgcgctaagcgaggaatctgggctgagccttgttgctg

SEQ ID NO: 108835 - DNA, 1980 bp, Glycine max
  Peptide Sequence Number=SeqID_225613
atgccacagaactgcatagcaccaaaaccagaattctgcaatagtcataactctgtggaaggtcccccagagatgactgagccacataactcaactgtcctttcctatcccatgcaagccaatgaacaacaacaacaacctttcccaaaactcattatgtaccccataactctgaagtttgaggagttggtttacaaagttaaactagagcagaaaggagggtgctggggaagtacatggacttgcaaggagaagaccatactgaatggaatcactggtgtggtgtgtccaggagaaatactagctatgttggggccatcaggcagtggcaaaaccacacttctcacagcactcggaggccggctcaacggcaaactatccggtaagatcacgtacaacggccaacctttctccggtgccatgaagagaagaacaggttttgtggctcaggatgatgtgctataccctcacctaaccgtcaccgaaactctagtgttcactgcactcctaaggcttccaaacaccttgaaacgagacgaaaaagttcagcatgttgagagagtgatcactgagctaggattgactcgttgcaggagcagcatgataggaggaccactttttagaggaatatcaggtggagagaaaaagagagtgagcataggccaagaaatgctcatcaacccaagcctcttgctgctagatgagcctacttcaggcttggattccaccacagcacaaaggatccttaacacgatcaaacgcctagctagcggcggtagaaccgttgtcacaactattcaccaaccctctagtaggctctactacatgtttgataaggtggtgttgctctctgaaggctgccccatctattatggtcctgcttcaactgccttggactatttctcatctgttggcttttccacatgtgtgactgtcaatccagctgatctcttgcttgatcttgccaacgggattgccccagactccaagcatgcaactgaacaaagtgagggactggaacaggagagaaagcaggttagagaatctctcatctctgcttatgagaagaatatagctacaaggctgaaagctgaggtttgcagcctggaagctaacaactacaatatcacaaaagatgcttgtgcaagaaattcgataaagccagatcaatggtgcacgagctggtggcatcagttcaaagtactattacaaaggggagtgagggagcgaaggtatgaagccttcaacaggctgagaatattccaagttgtaagtgtcgcttttctaggtggactattgtggtggcatactccagagtcacacattgatgatcgggttgccttgctctttttcttttctgttttctggggattctaccctctctacaatgcagttttcacattccctcaagagaggagaatgctgatcaaggaacggtcttcgggaatgtaccgcctttcttcctactttctggctagaacaataggagacttgcctctggagcttgcactaccaactgcatttgtcttcataatctattggatgggagggcttaaacctgatcctatgacttttatcctttcacttcttgtggttctttacagtgttgttgtctctcaaagccttggtttagcttttggtgctattttgatggaggttaaacaggcaactactctagcttctgtgacaacccttgtgtttctcattgctggagggtactatatacaacagattcctccattcatagtgtggctcaagtacttgagctatagctactactgttacaagctgcttttaggtgtccagtacaatgaaaatgactattatgaatgctcaaaggaggagctgtgcaaagttgcagactttcctcctatcaaatcaatgggcttgaatcatttgtgggttgatgtgtgcattatggccatgatgttggtgggttatcgacttgttgcttatttagcactgcatagagttaggtag

SEQ ID NO: 108836 - DNA, 192 bp, Glycine max
  Peptide Sequence Number=SeqID_225614
atgccaagaccagacaaacccaattggcctacgatgcattcgcgctcagcgccacacctcgcgcttagcgcgttcagatcgtgcgctgggcgcgccatgcacgctgggcctgtgcttctgttggatcgggcgctgggcgctgggcgcctagctgggcttagcgcgcgtaacggttttcaccttcgtgcttaa

SEQ ID NO: 108837 - DNA, 198 bp, Glycine max
  Peptide Sequence Number=SeqID_225615
atgaggattggggacttcccccgtgatttaaggagaatggtggagcaagaagaaagggaggtaaagccgcaccgagaagagacagaggtagtgaatttaggcattggtgaagaaaaaaaagaggtcaaggtcggcacttgtatgttcatgaatgtccaagataagataattataagcaattgggctgagccagattga

SEQ ID NO: 108838 - DNA, 309 bp, Glycine max
  Peptide Sequence Number=SeqID_225616
atggcggaattgtgcctagtacccaacatcatcattccttcgaaattcaaggtactagactttgacaaatacagggggactacttgccccaagaaccacctgaagatgtactgccagaagatgggggcgtacgcaaaggatgagaaactcttgatgcatttctttcaagagagtttggctggggcagctatcacttggtacactaatctggaatcttcccagatccattcttggaaagatgtaatggctgccttcatcaggcaataccaatacaacttcgacatggctctagatagaacgcagttgtag

SEQ ID NO: 108839 - DNA, 179 bp, Glycine max
  Peptide Sequence Number=SeqID_225617
gggttatggctaccattgcgttatcaagtagatatgggagcaagttagcatatgacaccggaatttggggctttgtggttgatttagggatggcctttgtggataactgggtggtgggtaaggaggtgatccacttcgatcctttcactggcgaagaccaaatccgcaaacctttgagg

SEQ ID NO: 108840 - DNA, 1161 bp, Glycine max
  Peptide Sequence Number=SeqID_225618
atgggcatagatgcagcacttttaatgtgtctaagagatattaggcataatcaatttgaagactccctaattggaacagtcgaaaccagcctaggacaagtgagtctgatggacagaaacattcttgactctctgttcttaaacatccactttcatggccttgacatgaaagaaggatcaatcccagcagccttaatttataggattcagtacaaggtcatgaatacttgtgcatctagagtcctgttaaaacctcaaaaaggagaaacaactttgtttatcactgatatgacaaaggctaacgtttctctcccgagaaaaataaaatgggatgaagtaactcttcccgaaagatgggttatggataaggcaacaccgtctattccccgacccgctccaaccatagagcatattaagcaagataactccggaaagacactacttctagcatacctagaacaacatacaaccaagaacaagaggacgaccaaaagtcgatccaatccccaacatactcttctatggaaccttatgatgttatctgacaactttagcattgataaggaaacccttaggaaagatttttattctccggagaatgaacctcaaaggagatggtttttccaactttacaagggtacaaacagaaaacaaatccaagacaagttctacgaatttgttgaaagagtcaagattaatgtccttttctttgattggtttcatgcttatgccatcagaaatgatatagattacccttggaaacaagacatcataggtgatccaacaacaaatgtcataacaaattggcaagttaaggatggtgagttaatccaatcggaattacctcccgcaacacaatatcaactaccaaataacaaagacagtaacaataaacctgtcatggcaattccattcaagacaaaagatgtcaacgaggaagtaacctctaaggacatcaagagcctaatggaacaggcaaattataccaataaatatttacaagctttaggagaaaccataaaaactaaggtagttcctaaacaaaaatcaattgaggaagcttcgccaagtatccccattgaaaacctttattcaaacctttcaaagttagtgagaaggctaaacgaaaaattagggaacttagaaaaactaaatccttaa

SEQ ID NO: 108841 - DNA, 186 bp, Glycine max
  Peptide Sequence Number=SeqID_225619
atggatcggtcaaccgcagcaggggaagagaacagatgggaaataataagctcgattaaggagaggaagaataagaagagcaagctagacgtgcagaagactgaggatccttgggaagtaggaggagttgcttgtttatcaatgaacagtgaccataaagtgattcccgatgaggagaagcactga

SEQ ID NO: 108842 - DNA, 240 bp, Glycine max
  misc_feature (154)..(154): n is a, c, g, or t
  Peptide Sequence Number=SeqID_225620
atggaagagaattccgaatcagcttgttttacgaacaaggaagctataagtaaggcaactaggaatctcatggagagttcgatcctggctcaggatgaacgctggcggcatgccttacacatgcaagtcggacgggaagtggtgtttccagtgncggacggctggaaacggctgctaataccccgtaggctgaggagcaaaaggaggaatccgcccgaggaggggctcgcgtctgattag

SEQ ID NO: 108843 - DNA, 318 bp, Glycine max
  Peptide Sequence Number=SeqID_225621
ttctacggagtgcccatcgcccccaacaaggtcatcaggccccctattaactgggctttcatcaagaagtactgcaccccccaggcaggtgcagggcgagacaccacagtagcctgggaatggccggtagcgagcaatagacgcaccgctgccacctccagagcccatcagctcatctacaaaggtttgagcattgcctacgacccgtggcagaccatcaggcgaccaagtccaaagccaaaggtaagcaaaagtactaggtccgtgaccgacaagtcatcacgtgtccagctcaagatgttaaagaagcgctactag

SEQ ID NO: 108844 - DNA, 462 bp, Glycine max
  Peptide Sequence Number=SeqID_225622
atggcttctgcttcctcatccacacccttcttgggaatcagacaagaaaatcaaaatccagatgcggaggtgatagcactatctcccaagaccctaatggcaacaaacaggtttttatgtgaagtgtgcaataaagggttccaaagagagcaaaacctacagctgcacagaagaggacacaacttgccttggaagctaaagcaaaagaccaacaaagagccaaagagaaaggtttatctgtgtcccgagcccacatgtgttcaccatgacccttcaagagcccttggagacctcactggcattaagaaacactactctcgcaaacatggtgagaagaagtggaagtgtgataagtgctccaagaaatatgctgttcaatcagattggaaggcacactccaaaacctgtggcactagagagtatagatgtgactgtggcaccctcttctccaggtttgtgtaa

SEQ ID NO: 108845 - DNA, 447 bp, Glycine max
  Peptide Sequence Number=SeqID_225623
atgactttgaaaatgttgggcaagtgtaccaagtattggcatgagtgttatgagattctcgctgttggagccattcttaacccacggttgaagtttggagcaattcggtttgcttatactaagattgatctttctacttgtgaaaagatgattattgctttaaggaaaaagattgaaaaattgtttgacgaatgtgtgaaagtaaaatcaagtgagtcaaatgcttcaacttctcaacaaatttctcctccaccacaacaagtttcttatatggatgatgaacaagtgattgatgcattaggtcttgcttgtgtggcttctatggaggctggatctttgagcttcaatgaggaagaaggaacttcaccaccaagaattgccttggataagaagcttgaagagaatgctttaatggaggaaaagaaacagagaagggggggagcatga

SEQ ID NO: 108846 - DNA, 1069 bp, Glycine max
  Peptide Sequence Number=SeqID_225624
gcgtgacagtttcatcactcatagggcattttgtgatgctctagcacatgagagtgcaagacacccttcaagcgtgaatcatttgggaactcatcatctgtatggcacaaaccacatgagcctaggccttggtgctcaacttcagaaccaccaaatctcagccactaacagcatattgagccttggaagcgaaccaaagtttgagcacttgatctcaccaaatctgcaccactcatcatcatcatcatttggagtgcaatcaccccagtcatcatcgttcttcatgactgatccaaaccatgcatttcaagacctccaatctcagaaccaaggacacttattctcaaacaagcaacttcatggtctcatgcaactccctgatcttcaaggaaacaccaataacaactccactacttctgcttcatcattgtctgcttcagctaataacaccaatctcttcaacctaagcttcttccctaacaccaacaccagtggcagcataatcaatgatcaattcagcaacataagtggaggtaacaataaccaaggaacagcaacactctacagcactaatagccccgtgagtaataaccatgttggtaactcaagcttgtcttcactctttggaaactcatcagtgcaacaagataacatgtcccctcacatgtcagccactgcattgcttcagaaagctgcacaaatgagttcaaccacaaccaccaataatgagttaggcatgagatcaagcatagagaatgagcacagtagccatctacgtggtttgttgaactctcttgccaacggaaacaaccttggccagtatcacaacgtggtggaggagcctaagaagatgtcacaaaacaatcttggtttgtgctttggagggtctgataagttgaccttggactttttgggtgttgggggaatggtgaggaatatgaacaatggtggagggttttcacaaagagagcaacaacaacaacactccatgggaattactatgagccccttggatcctaaattggaatcagcacaagcaaaccaacactatggaacctcaacactctaa

SEQ ID NO: 108847 - DNA, 2130 bp, Glycine max
  Peptide Sequence Number=SeqID_225625
atggtggctgaggcttgcttggatggagatacgatttcaaatgagacgacaggatcaacgagtgatcatccaccagttcaaggtcctgaaaatacccaagaaatggatggcaggcagcaggattccaagaagaacaaagtgaaggactcttgggattgtcttctgatggttgttggggcaataagtgctgttggtaatggaatctctatgcctttaatgactatacttattggagatgcgattgatgctttcggaggaaatgttgacaataaacaagcagttgttcatcaagtttataaggcatctctgaagtttgcatccataggcgcaggtgcctttttggcagcattcttgcaggtgtcttgttgggtgatcactggggagagacaaactgccagaataagaggcttatacctcaaagcaatcttgaggcaagatatcagcttctttgacaaggaaactgtggagaggttgttggaaggatgtcagttgatatctcaggtaggaaaattcatacagtatgtggcatgtttttttggaggtatagccatagcattcatcaagggttggcttctaagccttgttcttctatcttctctcccgcttcttgtcctctctggttccgtaatgagctttgcttttgcaaagatggcatcccgaggacaaacagcttattctgaagcagctactgtagtggagcgaacaattggttcaattcgaaccgttgcatcatttacgggtgagaagcaagctagagctcaatacgacgaatacttaactaaagcttacagagtaggagtgcaagagggtgtggctgtatggttcggagggaagatggtactagagaaaggttatacaggaggacaagtgattagtgtattttttgcagttttgactggttccatgtcactggggcaggcatctccaagcttaactgcatttgctgcaggacaagccgctgcctttaaaacgtttgaaacaataaagagacgaccagatattgatgcttatgagccttatggtcaacagccatatgatattcccggcgatatagaacttagagaggtttgctttagttatccttcaagacctgatgaactgatattcaatggattttcaatttcgataccaagtggcactacagcagctttggtagggcaaagtgggagtgggaaatcaacagttattagttttattgagagattttatgatcaacaagctggtgaagttctcattgacggaatcaatctcagagaatttcaattgaaatggatcagacaaaaaatcagccttgtcagccaggaaccagttctctttgcttatagcattaaagagaatatagcctatggtaaggatggggcaacacatgaagaaatcagagctgcagctgaccttgctaatgctgctaagttcattgatatatttcccaatggacttgacacgatggttggcgagcatggaactcagctctctggaggtcaaaaacaaagaatatctatagcaagagcaattctgaaggacccaagaattctgctccttgatgaagctacaagtgctcttgatgcagaatcagagagagtggtgcaagagatactagacagaattatgataaaccgaacaactgtcattgtagcccactgcctaagcacaataaggaatgctgatgtcattgcagttattcatcaaggaacagcacacatgctgagctcactaaagatcctgatgcagcttttagccagctcattagattgcaagaaattaaaagggaatcagaacagcatgttggaaatgacaggctggccagaaaactttgtagattctgaacgacaattgagccaacggctttctttccctgaatctttaagtcggggatcatctggaagaagaaacggctgccaacactcgttcgaaatatcaaatgccatgcctacctcaccagatctctttgaaacatcagaaggagggcctgaaattcttccttcagtagcatcacataaacctcaagaagtctcacttctctgcgttacttatcttaacaagcctgaaatcccagtgttactcttggggactgtagcagcagcagcaactgggcaatactacccaccgtggggcttcttctctcccacatga

SEQ ID NO: 108848 - DNA, 183 bp, Glycine max
  Peptide Sequence Number=SeqID_225626
atggcggtatcattggcgtggcaacacgtggatgaagcaaccaggatgaatggcgagacagctgccacttggatgccgccagtcgaagtagcgagacatccatggaagcctccagtcgtagcagcgagacccgtgacatggacactgtctcgccagttccaatgtcgacacagggcattttga

SEQ ID NO: 108849 - DNA, 258 bp, Glycine max
  Peptide Sequence Number=SeqID_225627
atgaatacggggacttaccggtacaatgacctaaggcgcacagtagataaacttcctcgaggtcacgacaggcgcgagctccactacacgacaggcgtgagctccactgcacggaatggatgttggcgagggaccgcgagtccattttccaacacgctggagtggaaaggtttggagaatgcaacacaacatagaaaaggaggaacttttggaagtgtagaagcattacatggaacagatgcatgtccagatacgtga

SEQ ID NO: 108850 - DNA, 1263 bp, Glycine max
  Peptide Sequence Number=SeqID_225628
atgaagcaaaaaacgccatcttcaccgaccactgcaagaagtgtcttgaagaagcaaggtcacaagtccctgcagagtcctcctccaccaccaccaccaccacgcctcagagcttcttctaaggctccaaagtcaccgccagaggttgtaaacagggaatccatttcatcaacgagagctgagtcagtgcctccagacttgaagaacgtttcaagggctaaaaggggtgtcgtggtgaacaagcctaagttgaatgaagaggttttggggtctcaaaaagctgaagagggtaagattgttattgttgctaggccacggcgaagggttggggattttggttcgaggaagagtgaagatgatgactctcatggaaagaagaagaaggagttgttgcaggagaagcttgaggtgagtgagaatttgatcaagagtttgcaatctgaggtgctggcattgagggaggaattggatagagttaagagcttgaatgtggagcttgagtctcagaacacaaagctcactcagaatcttgctgctgctgaagctaagatatcaaatgttggcattggcaacaatggaaagaaggagccaattggagaacaccggagtcccaaatttaaagatatacagaaactcattgctgaaaaattggaacggtctagagtaaaaaaggaaggtactcctgaaataatttttgctaaagcatcaatctcagctccaacaccaagttatgccgttcctgaaactataagtgtaggaagaaaatctccacccaatacatgcctgcagccacctccaccgccgccaccaccaattacaagtgtaggaagaaattctccatccaacacatgcctgccgccgccaccaccaccgccgccaccgccaattccaactccgcctttggcaagattagctaacacccaaaaggcccctaccattgttgaactatttcactccttaaagaataaggatgggaagatagactcaaaaggatcagtgaatcatcagagaccagtagttattagtgcacacagtagcattgttggagaaattcagaaccgttcagctcatcttctagcaataagggcagacattgaaacaaaaggagaattcattaatgaccttattaaaaaagtagtagatgcagccttcacggatattgaagaggtcctaaagtttgttgattggcttgatggcaaattatcatcattgtttatacactattatttctctcttttgataagggtacatgggaggaaataa

SEQ ID NO: 108851 - DNA, 558 bp, Glycine max
  Peptide Sequence Number=SeqID_225629
atgatagattcgggtatatatacagcttggttgcctaaagtagatgacgaagcaattcttaagacagacatggatggattaacgggggtggtccctaatataatgggtgtggttggtgatgtatgtagatgcttcgaggagaaaagtggtgcagaactcgctgcggatatatctgctgctgatgacagtatgacagaatacactaattgtttgacaaatggaattctagaggcatactcagggatcttagaaggatttaaagctggcaatctgtacaatccaatggaagagagaagaacattggaggaatctcacaaatggttgtggaaagaggaaaagaaaagaaggttgaatgttgatagagaaagagagagagggagagaaggaattgtagcaacggataacgaattggtggaaataataataaagaagggtgagggttacttacgtagacaaagtgagtgctccaagaaagagagaggaatggactgtgacggaggtgcagcggaggacggaggtgacggcaagcagagaactaaagatgcgaggctgcaatga

SEQ ID NO: 108852 - DNA, 369 bp, Glycine max
  Peptide Sequence Number=SeqID_225630
atgttagaacaggagatttcttcctacaaggatgaccctgacattccatgcggagctgccttaaaaaagatggccagcctattagacaagtctgagcggagcatacagaggctaatcaagctacggagttcagtcacacattcatatcaaatgtacaacattccaacagcatggatgcttgattctggaataatgagcaagacgagtaacataccatcgatgcagataaagcaggcttccatgactctggtcaagacgtacatgaaaagagtgacaatggagcttgaatccattcggaattcagacagagaatccattcaagattctcttctgcttcagggcgtgcattttgcatatagggctcatcag

SEQ ID NO: 108853 - DNA, 477 bp, Glycine max
  Peptide Sequence Number=SeqID_225631
atgagtactaaaggttgcttccctgcaggatgcaagtttcttatatttgcacaccatcagccaatgatcgattcaatacacgagtttcttcttaagaaaaaagtgggttgcatacgaattgatggaagtacacctgctgcatccaggcaacaattggttactgactttcaggaaaaagattctatcaaggcagcagtgctatctattaaagctggaggcgttgggttaactttaactgctgccagcacagtaatcttttcagaattgtcttggactcctggtgacctaattcaggccgaagaccgtgctcatagaattggccagatgttagacggccatgagaacgccttggaggtctcagctagtctgccggtgaatagcccttcaaagcagaaaactctagaccagtttgttagaagatgtgataacacggatgggttggaatatgagcccaaccccaaacgtccccgaaactga

SEQ ID NO: 108854 - DNA, 1009 bp, Glycine max
  Peptide Sequence Number=SeqID_225632
tcgttgctctccgccaacggattgtcgctggcggccttcgcgccgacgccgttgtggctgcccgagaccgcgtcgggctggacgctgtattgcctggatggctacctggtggcgcgccagcccgacggacgcggcgcgctgtatgcgcgggaaatgaccgatgacgacacgccgtcgacactggcgcggacgttggggccggacgccgccgcttgcgccgccggcgcccgccagtggatcggcgccgtgccggcgcagtggcgtggcgatgcgcccgacccggtgttgccggaggcggcctgcggcgtgatggccgatatcccctggagcatcgcggccgccgccgacggccatgcggcggccggcgcatggggctggggcagggcgaccgcgctggccatggctgcggccgcggtatggatggccggcctggcattgcaggcaacccggttggaacatggcgcgcaggccctgcgccagcaacaggcgcaggcgttgcgccaggtgtttccgtcgatcaccacggtggtcgatccgctggcgcaggcgcgccggcaattggccgcgcgccgcgccggcacgggcgatgactggcgcgaactcggggtcctgttgcgggcggcgcgcgaacacatggccttcgccgcgggcgacgtgctggcctggcgctacgaggcgggcggcctggagctggacatgccgcccgcggcccgtcccgggacgccggatgcgcccgccgacggcaagccggcggctacgcccggctgggtccaggcggcgcgccaggcgggcttggcggtccaggccaccgcgaccggcctggcaagcccgtggcgtggcggcctggacgcgcctgtcgcacagcgaaaaacgcctgctggcgctttgtgcctgcgtcgtcggcgcggcgctgtgctggctggcggtgatcgaaccgtcgctggcgcgcatcgagcgcagccggcaagcgctgcggcagctggaagcgggcgcgcgcgaactcgatgcc

SEQ ID NO: 108855 - DNA, 294 bp, Glycine max
  Peptide Sequence Number=SeqID_225633
atgtggataataataggattaggaggtgcaaaggtagataacttagatcccttagtgcaacgtgccattgttgcagcgtctgcagttccagatcttcaagatcgataccacaagatccctagttttattgaatcaaagctattgccatttcagcgagaaggtgttaggtttatattgcagcatggaggacgtgttctcttagcagatgaaatgggacttgggaaaactttgcaggcaattcactgcctaaaattaaatcatttccacacgttatctgtgcatcatgatgcatag

SEQ ID NO: 108856 - DNA, 696 bp, Glycine max
  Peptide Sequence Number=SeqID_225634
atgaataagagtggggccattgctgtagcttcttgtgttcaggactcgtggcctgttctcataattgcaccatcttcgttacgcttgcaatgggcttctatgattcaacaatggctgaatattccttcatcagatatacttattgtcttgtctcaaaatggtggatcaaatagaggaggtttcaatatagtatcttcaagtgccaaaagcagcattcatctggatggactattcaacattatctcatacgatttggtgccaaagctacagaatatgcttatgacatgtaactttaaggttgtgattgctgatgagtcacattttctgaaaaatgctcaggcaaagaggacaactgcttctcttccagtcataaagaaagctcaatatgcattattgcttagtggaacacctgctttatcacgaccaattgaactattcaagcagctggaagctttgtatcctgatgtatataggaacgttcatgaatatggtaaccggtactgcaagggtggattttttggagtttatcaaggtgcaagtaaccatgaagagttgcacaacttgatcaaggcaacagtgatgattcgcaggcttaaaaaggacgttctttctcaacttcctgtaaagcgcaggcaacaagtcttcctagacttggctggcaaggacatgaagcaaattaatgctttatttcgagag

SEQ ID NO: 108857 - DNA, 960 bp, Glycine max
  Peptide Sequence Number=SeqID_225635
atggagggcaaaattgcattgaaaaaattgctggaagttcaggaaaaggcatacgttaatgatacagatgcaatcaactggactgaggaaccgtccattaaaaatactagaattatgcagctaggatctagtcttctcagtttgagtctgaataacttggagcctccccaaaatcatgagcaacagaacctgaatcaaaaggacagccagcagaataacatggagaaaccagcgttaccctcctgcaggcagttcttaaatactggtcagtgggtaatattacaagaagcaaaaatcgtagaagagcaagcatttgaggcttcttgcaagaaagctagagtgtccatgggtgatgggtgtcaatggagaaaatatggacaaaagatatcaaagggcaatccttgtcctcgggcctattatcgctgcaacatgggaactgcatgtccagttcgcaagcaggttcaaaggtgtgctgaagatgagagtgttgtcatcacaacctatgaggggaatcataatcattcactcccaccagcagccaggtccatggcgtgcacaacatcagcagcactgaaaatgttcctttctggctcaaccactagttcacatggaagcacttattcttattcaaattcagacctcttctctccactatgcacttctacctactatccatctgcagcaccatcatgtccaactataactttggacttaacccaaacctctaagaacaacatgaaattcccaagtgctatttcttcaaaccatttgcaaccttttccactttcattgcatggtcaacctcaacaatctgagggaatattaccttcagagaaaaaccttgccttggtggatgttgtcagtgctgccataaccaacgatccttctcttaaggcagcattagaagcagctgtttcctcaatcattggagactctcagaaatcactgccaactttgtag

SEQ ID NO: 108858 - DNA, 504 bp, Glycine max
  Peptide Sequence Number=SeqID_225636
atggacaaagtaattccagggaaaatgcttctattaattagcacaatattgatcaaaactcactttttgcacttcaaatattcaccagatctggtttcgtggcgaagtgttgagcttcatgtgcgacgaggtgcgcgtgttggtggcaaatttgggagcttcggcgcttcaaaacgacgtcatcctcagagattccatcatccactcagatatgaaagtgatgacgactacattaccccccatgactggtactccatcctgcgcctccttccagatgacaccgacaactgcgatctcacacgacaacatcctgtgttcacggtggctgccggagtcatgaggagtggcgttgtcagcgagaacccagattttgttattggttttgagggttggtctgatctgggtttgagatttggttttttgatttgcgtggtgaatgctcatgatgggtgtggtttgaagaagaggatgaataaaaacaacataaagatactggctttttga

SEQ ID NO: 108859 - DNA, 489 bp, Glycine max
  Peptide Sequence Number=SeqID_225637
atggaggtggaggatgactgggatttgagcgcagaggacctcgattctctcgaaagagacgctttccagaaaattgctcaactacgcaaccctactcctcctccttcttctccgcatcaacgccaccattctgcatctgcaacaaccaacaacctcccaccaaaaccccttcccaattcgcgttcccaaactgttgatgcgttctctcaaggagcaagagcattgcccacgacattgaaatcagggacaaacaatgacaatcaggctaaagagctgccaaagttttcggtcaaattttttcttcattccagtggaaatgttgcagcaaagtttcaatatgaccaggtagtaattgctgcttttcgaagaatccctagatcttcttggaatgcaaaggaacggttatggatattcccactatcttccttgtcagaagcagaaaaggttattggagaaatacctggttataatgttcagttaggaaattga

SEQ ID NO: 108860 - DNA, 564 bp, Glycine max
  Peptide Sequence Number=SeqID_225638
atgtcttcagtcattgcatgccttcaaaaaggtgacaatgaccttcatccacatttcgaagacgacaatgtcttcagtcattgcataccttcaaaaaggcgacaatgtcatcattttcattttgaagacgacaatgtctttagtccttgcatgccttcaaaaggcgataatgaccatcatttgcatttcaaagacgacaatgtcttcagtcattgcatgctttcaaaaggcgacaatgaccttcatctacattttgaagacgacaatgtcttcagtcattgcacgccttcaaaaggcgacaatgtcatcatttgcatttcgaagacaacaatgtcttcagtcattgcatgccttcaaaaggcgacaatgaccatcatttgcatttcgaagatgacaatgtcttcagtcattgcatgccttcaaaagacaacaattaccttcatccacatttcgaagacgacaatgtcttcagtcattgcatgccttcaaaaggcggcaatgacctacatttacatgtcgaagacgacaatgtcttcagtcattgcatgccttcaaaggcgataa

SEQ ID NO: 108861 - DNA, 422 bp, Glycine max
  Peptide Sequence Number=SeqID_225639
gggttgtcttctgacagcctcacttttgagcgtctgagcccgatcattaacttgcctacatcaggaagaacctattggaatcctaatgatctgacagtttctatccgaggggctaggagggcgaggcgagaccagctaagcttccctccacatctacagctcctactccagcatccacttcagcagccccttcagtcccagctcagattgattctcagcactttgatgccatgcttcagagcattcatcagggacatatcattttacttcagagtttatagggaagatgaaggtcccacagcccaggtaccccagcatgtagaggatgcatcatctgaggccatcattctagagccattcattatagaggaggaggcaggtgagacacgggttagacaggaagctgctgctactcctgagag

SEQ ID NO: 108862 - DNA, 303 bp, Glycine max
  Peptide Sequence Number=SeqID_225640
atgtcgcgggggtcaggagaccttggggacgtcaggtggggtgctattgcccaaaaccaagcttggccaatcccgacccaacccgggcatagtcagtcagtgagaacctgtgacatacctaagcaggcgagctcctggcagtcaaccaataaaagaacaaagtgcacgaaggcactggtaatcgattaccagttgtgtgtaatcgattacatagtgttacctgctactggtaatcgattaccatttatgtgtaatcgattactcagtgtagcttttagattccactgtgcaaaggctgtgtaa

SEQ ID NO: 108863 - DNA, 291 bp, Glycine max
  Peptide Sequence Number=SeqID_225641
atggtgcctcatgaatccttctatgctcgtgccatcggtgcccggaagaccccttatcctcatgacgtgtccaaaaaaagggaacgagatgtttattacttgagcaagaagttcacgacgtgcgagatgaactactatttgctagaaatgacgtgttatgctttggtatgggtggctcatcgtttgaggcagtacatgctgaattacattacttggttggtatccaaaatagaccccgtcaagtacatctttgtaaagcccactctcactgaacggattgctcggtggtag

SEQ ID NO: 108864 - DNA, 201 bp, Glycine max
  Peptide Sequence Number=SeqID_225642
atgaaagctggctacactggttttcaatgggaagagtctgagaaactacttagtattgagggaatggagcaatggcaggttcatctgagagatctacatcatcaaaaggttgtggagaaattgaagagagtgcacagttttttatttttaaatcacaagttagacaagatcatatcgatgcaagtgaacagtgtgagctag

SEQ ID NO: 108865 - DNA, 207 bp, Glycine max
  Peptide Sequence Number=SeqID_225643
atgccgtcgcagttgctccctcaactctctccgccaaagctctatgtggaggtcttagaaagtggagaacagataggcttaaagcactttagaccaattaaaccattgggatcaggagatacgtactggcagccaactaaggttctcaaggaagatgccgtgagcagaggtagtgatcgcattggagtaccttcattgccaaggtag

SEQ ID NO: 108866 - DNA, 228 bp, Glycine max
  Peptide Sequence Number=SeqID_225644
atggaagaagctcgaagtcgcagagggtacgttccagtgcttgtgggcacagggaaagaaggcatggatgagaagatttgggtaaccatcaaagcaattcagcatctcaccattgttgagttactggagcagtctgcaaaggagtatggataccaaaatggcttgctcaaaatctcatgtgatgctgacaaattcaaggtcatacttcacaacatatgcaagaaatag

SEQ ID NO: 108867 - DNA, 469 bp, Glycine max
  Peptide Sequence Number=SeqID_225645
gccacttgtccaatactttctccttctccattccgctgcaatcagatctcaagaagcaaaggaatccattgatgaagaagatccaaggcctacaagctccacatggagctacatcacttaccgttttatactacataccggccgtcgaacaagcaacctagttcctctggacttggaaattgaagctaccttaagaaggaacagagctgagaggagaaggaagttattgcaagataggacaatagcttccattctagaagaagaagctcaatcttctgactctacatcatccgatccactatcatcaagggaatccgctatatacttactagaagcctctgtcatggctgatgaacaccagcaaagggttacccttgaggattattctagtagctcagtgccgcaattctttacaagtatttgtgcgtctgaagtcaagctcacaacatcaactatcttcattctttga

SEQ ID NO: 108868 - DNA, 574 bp, Glycine max
  Peptide Sequence Number=SeqID_225646
atgaatggaaacgaaacgggttgggacagcgttaacgatcttattcactaccatgagcgcggaaatggtctgacgataaataacaaaccgtcttatgacataaatcaggcggggttgcagatcgcgcgcggcgataaaacctggaatggcgttcacgtcacgggaaaagaggcgacggtgacctattccttcccggattgggattataacgaactgaacctgggccaccgctccccggaacgtgatacggggctgagcgcgttcacgcaacagcaacaagaacaggcgaagctgtctttgcaatcctgggccgatgttgccaacatcaaatttgtcgaagttgccgcaggccaaccctccaatattacctttggcaattatgaggggacaggacaagcgtatgccttgaaaccgttctcatataatggcaatgattacagggggttcaattctgatgggcaaagttggtacaacattaagaatcactccgaaaatttgcatcctgagctaggtaattacggccgcttaaccattacccatgaagttggccacactctcgggttagatcacccgg

SEQ ID NO: 108869 - DNA, 980 bp, Glycine max
  Peptide Sequence Number=SeqID_225647
aggactacacgtccctcgccttcagagggctacacgccctcaccatcagagggctactcgccctcgcctataaggggcaacacgccctcgcctatagagggctacacgtcctcaccttcagagggctacactccctcacctttagagggctaaacgccctcgccttcagaggaatgcaccccctcacgttcagaggactacatgtcctcgccttcagaaggatgcatgtcctcgcctttagagtgctgcacaccctcgccttcagaggactacacgtcctcgccttcagagggcaacacgccctcgcctttagagggctacacgccctcgcctttagaggactacacgccctcaccttcagaggacaacacgtcgtcgcattcagatggctgcacgctctcgccttcagaggactacacgtcctggccttcagagggctgcacgcccttgccttcagaggcctgcactccctcgccttcagggggctacacgtcctcgccttcagagcgctacacatcttcgccttcagaggactacacgtcctcgccttcagagcgctgcacgccctcgccttcaaaggactacacgccctcgccttcagagagcttaccctcaccttcagagggctatgcgccctcgccttcagagggctatgcgccctcgccttcagaggactacacgccattgcttttaaagggctacacgccctcgcctttagagggctcaacgccctcaccttcagagagctacacgtcctcgccttcacctcttggatactagtactctcaccttcagagggctacgcgccctcgcctttagaaggctacgcgtcctcaacttcagaggtgtgcacgcccttgcctctagaaggctgggcacccttgcctttagaagactacacatcctcacattcagagggctgcacgccctcgccttcagaggactacacgccctcaccttcagatggctacacgtcatag

SEQ ID NO: 108870 - DNA, 333 bp, Glycine max
  Peptide Sequence Number=SeqID_225648
atgcagaccgagagatcagaatcatcaggaactgagcacaatgagcatgatgatgacgatgagtcggaatcaaaacgtaggaaagttaagagccttggttcaagcataatgcaaagtgcatcggtgttggcacgagctcttaggagttgcgaggagaagaaggagaaacggcatcgtgaaatgatcgagctggagcaaaggcggattcagatggaggaagctcggaacgaggttcaccggcaaggcatcgccacccttgtcgcggccgtcaccaacctttccggtgccattcagtctctcattaataattctgaacgccatggccaaagataa

SEQ ID NO: 108871 - DNA, 660 bp, Glycine max
  Peptide Sequence Number=SeqID_225649
atgggttacaaaagagagaccacatcaaacgaggtcggaatggctccaaatggcaggggtagatgtgtgaggaagggatgttgccagaggtggaagcttgccggcaaaggcatcgtgatgtgccagagaacggtgacgcgcaagtgctgtttggcaagagtgttgctggactgttcacgacgtcatgaccaccatcgtgtagatcggtggatggcaatgctgatggtggggtcaacagccggagtggtggtcggagcagtgacagtggctggaaaaagaaacttcggaaatcaaaaagggcacttcaaggggatgctttttcacaaagtaattaagcactacgtgattcaggctggggataaccaaggacaaggagctactgaagactggaacttgagaggaaagcaacatacaattactagtatgaaacatgaagcattcatgcttggaacttccaagggcaaacaccacaacaagggatttgatcttttcattacaactgcaccaataccagatctaaatgagaaaattattgtgtttgggcaagtcatcaagggagaggatgttgtccaggaaattgaagaagtggatacagatgaacattacaagcctaaagtatctatcgggatacttgatgtgactcttaaacaaaaggtctga

SEQ ID NO: 108872 - DNA, 255 bp, Glycine max
  Peptide Sequence Number=SeqID_225650
atgacaaaccacgacaagtgtcctaccacctgtacacgaaagcacacgtgcatgaccttgctgattgacacgtgtcttcaaggcaccttgaagagtctctatatatatggcttcacaatgccaccgtcaacaagcaacgaagcacgacgtgagagagattgtgaagtagaaatcggtgcaagaaattctccactttatctaaaaaaattcgttggtgcctcaacaggttcatcaatggccaaacttaccacccta

SEQ ID NO: 108873 - DNA, 357 bp, Glycine max
  Peptide Sequence Number=SeqID_225651
atgaatgagagaaagaatcctcaccgtccctttttgccgtatgagcagctggtgtatctgactttcctctacgctataaatacatccactgctactccatgccaaaaccaaccaacactcacagcaagagctccccaattaagagggtacattttgcttagagttcaagcatgtttctcaagcagcaaagatgattactactataattacgatgatagtagcagaaggcattttgcaagtgacgaagatagagggcgttgggttgctgagcctggtattgacgggaaagcatctgctttcatcgctagattttatgcctcacgagtcagtgattctgagcaccaaattgcatcttga

SEQ ID NO: 108874 - DNA, 521 bp, Glycine max
  Peptide Sequence Number=SeqID_225652
ctgtgattctggagttggattttgcacaactcatgagaggcagagagggcccagagtttgaacagtgtgagagtgatgggagtgaggtacagctctgcccagcttcctcctctcatgtttcatgctttgaggatgctaatgtgacagaccttgacatgcaatatgtcagtggaagaggtttctacagacctttgatggttggttttactcttattaatggcgctgctgctaaaggagctgcactctttatttgggttgatggtgaatgtggtcgaactaatactgaagtcatcgttgctccacagggagcagggttatatttcagagggcaacgcatttggcaagctgctatggaagatttaatgtcaaaagggatgcgctatgccaaacaggctcttctatctggatgttctgctggaggtttagctactattatacattgtgatgaatttcgggaattgtttactagaaccacaagagtaaaatgcttaagtgatgctggattattccttgattcgtaa

SEQ ID NO: 108875 - DNA, 624 bp, Glycine max
  Peptide Sequence Number=SeqID_225653
atggcagttaagaggctgtcacaagttacttgtatgttggaaaacatctttgatgccttaacaacaacaactcaaattaatagatgcatctttttgtggcagggagtgcaaaggagtcttccaaggagttgtaccagtcgcctcaatccaattttgtgctattttcctcagcacttaattgccggtgtcaggacaccattatttcttctcaatgcagcttatgatacttggcagattcaagccagtcttgctccaccatctgctgactaccattggaactggtatgaatgcagaaaaaattatgcacgttgcagtgcaccacagatacagtatcttcaaggttttcgaaatcagatgcttagatctacaagagccttctcacggtcttataaaaatgggttattcataaattcatgtttcgcccattgccaatcagaaagacaggatacatggtttgctcatgattcccctcgtattggaaataggttaagaacttgggatttgatcgacatgtttaaagtgagggaaatttgtaaggttccttctcactcttctaatgattgtctaaacatacaagcaggggatcgcggagtcggttgggaactggtattttggccgagttag

SEQ ID NO: 108876 - DNA, 453 bp, Glycine max
  Peptide Sequence Number=SeqID_225654
atgggggattacgttccacctattcctttaaacatggactgtaatccaccaattttccaaccagatgaattcctgagtaatgattttggaactgattgtggcacaccagcatcaacttgtgaatatacgcatagcctacaaaatgaagtgggtaactttactccaccaagtttcaatttgatgtttagccaagatgttgaagagaataatccatcattgcatgatataccatatcaacgcccacatcgaaatctaggacataataggagatgtcctccgtgtggaacggggacaccattatggagattaagtataattcgacatgccttattgatgcaatcctaccccgcaagggcattggatagaaaactccaagtagattgggccagagatgcaagagaaggccctagggttcttatgagccttagggtagatttcgggcccatgggctaa

SEQ ID NO: 108877 - DNA, 5472 bp, Glycine max
  Peptide Sequence Number=SeqID_225655
atgaagcaatcggaagcaacgtcgttggcggcgaggaagcgtgggaagtggggatacatatggccgatgtggacgtcgctgttgctccacctcctcgccattctcctcttcaccaccggctttctcctcacccgaaccgagcttccttaccacagccactgctccgacgtgtcccactctccttgcttctcttccaacaacaacggatcttgctggaccaaacccgccactaatcgtctcctcatcatcgttctcgatgctctcaggtttgattttgttgctcccagtaccttctttgcagttggttatgctatgttttatgtgacagaatcgaaaccatggatggataaactgcgagttttgaagaatgcggcgtctacgcggcctttgtccgctaggattttcaaagccattgctgatccgcctaccacaagtttgcagcgtttgaagggattgacaactggtggacttccgacttttgtggatgttggaaatagctttggtgcacctgcaattgtggaagataacttcataaaccagttggttcaaaacgggaagaaagttgttatgatgggggatgatacatggacacagttatttcctcatcattttgaaagatcatatccatacccttcttttaatgtcaaagatcttcatacggttgacaatggatgcatagagcacctattaccatccctatacgaagaagattgggatgttcttatagcacattttcttggagtggatcatgcaggacatatatttggtgttgactccaccccaatgatagaaaagttggagcaatacaataccattttagagtctggacctgggagctcacatgaaaatactatgcttgtggtcatgggtgaccatggacaaaccctaaatggtgatcatggcggtgggagtgctgaagaggtggaaactgccatttttgcaatgagttttaagaagcctctttcttctgtgccctcagaatttgattcttgttcttgtcaactagatctggaactcgccactcgtcgcgacaagggcctctgttaccattgcgaagaaaaatggtcacagggccatcgctgcaagcctcgtcttcagatgttcatcgtagaagacgacgaggacttccccgatgagattccgcctttggaaatgccctcaaccccctctaccacttcgaccacgccccaaatcccacagcttagccttcatgccctcgcagggatgccggttccagagactttccgcgcgtatggcaccatcaaccaccatcgtgtagtggtcctcatcgatggagagagcacacacaatttccttcaggaccgtatcgccaagttcctgtctctcccctcatctacgaccccacctatgcaagtaatggtgggtaatggcaccaccatgacctgtgacaggcactaccgccaggtccctctccacatgcaagcccattactatacaagccgatattccactccagcccacaccggcctcagcccaacaacttcgccgcctgttccacaccgagagcgtctcggccctattccaacttgccatcgtcaccaaacccactccgacaacccatccacccctgttatcgacccaaacccaccaccaccaccacctgccctcacctctctattaacacggttcgcaacaatcttccgtgaaccaaccactctccctccctcatgccccatcacccaccatatccatcttcaacctaattcatccttgataaacgtccgcccataccgttacccgcattcccaaaaggccgagctggagaaacaggtggtggccatgctttcaactggccttatccgcctaagccagagccccttctcctcacccgtcctattggtgaagaagaaggacgacacctggagatgctgcgtggactatcgagctctcaactctgtcacggtccgcgacaagtttcctatgcccaccatcgatgaacttctcgatgagcttggccgtgcttgcactatgaatctgcgttatgcctttcggtttgtgcaatgcaccctctaccttccaggcgaccatgaacgagctcctcaggccttttctccgcaagccctgaccaacggagagttttatcttcgtcgttctaaatgcctttttgctcgccgccaactacaatacttgggtcatattgtgtccaccgatggcgtcgcccccgacccggaaaagattcagaccatggtcaactggcctcgtccattgtccaccacggaattgcacgggtttttgggcctcactggggatgggaagaatgtttgtatcagcaccatgcagcagcttgactttgcagtaacagtatcagcattgcttggcatacctttcccttacggaagcattggtcacatcaatcctgaattatatgcattaggagctgatagttggaattcggatgcctctcaaaagctatcagaatcagatatctggatgcagaattatgctaatgcactgtgcataaattcttggcaggtgaagagatatgtagatgcttactcaacttcatcagcggttggattttcccatgatgacttatcacgaatagcaagtgtttatgctcaagtggagaatcattggtcacattccacaaaaaagcttttgcttgatagacaaaatgacagtgatacattagtgcctgcacttaagagacaaattgatgcatacttcaagtttctaacaacagtctctgagttagctcggtctaaatggactgaatttgatttgaacatgatgggaactggcattggaatcatcactttgtgccgatttgcaattgaagttgggctgtccaagcaggctgccacatctgctttcatgaaagactatacctcatggatcatcaacatagcctcaggtttacctgtatgggactatgcagctgaagttataccaatggtagttctgattctgctggcagcttggctttacaaggccaccagtggcagcttgtttgattggccatggaagtatgtcatactgggcactatcttgagttatatgctaataattgtgcattggatcacagacagtgatagatttggtggcacattgatgtctcaaaacattggaagaacttatatacctagaatcatttatgctattgctttgggacagttgttattattgacatttggccaattatttaagaatagcagtttagattgcaagacaattttagttgcaaaaacaatggccatattatctgcgtggagttcaactgtcattcttctttcaggaaaacagggtcccatggttgcttttgcatccatagttggaggtgctctttctttttgtgctcttatgttgtataaattggctatatcctgctgcatgattcttcaaatacacctctgtcatggctttacttatgctgctaatatttgtagattagcaatgggttattttattatgaagtttgttaacgtagaaggtggtaaggatgaacctcatagaagtttttctattatgcaatggagcctctttgctacatgtctctttttctgcagtggtcactggtgtgcatttgatggtctccgctatggtgctgcatttatagggtttgaagaatttgtgcttgttcgccaagcaatcctccttgctatcgatacatttggtttttctatcatccttccagtatttggactcccacttcttgtagcaaccaagtaccaggctaatcttggaaagcattttattttcacacaattatctcaagatttgaaagctgaggctaacgcgggagatactgagttccaagcagtgaagattccgagacaaggaggatatagagccacatatttcatctttgcaatgatgttgctggataacattggctttgtggccaacatggtaagcttggttttatatttcatgaacgtcatgcattttgactactctggttctgcaaccaccacaacaaactggttgggtactactttcttgctgacgatcgttggagggttcatctccgatacttatatgaatcgcctcaacacttgcatcctctttggcataatccagttgttgggatactccctacttgtgattcaatcccacgacaaaacacttcagcctgatccatgtttaaaatcaacatgtgtgcatggcactaaagctttgctgttgtacgcttcaatatacttgctagcacttggtggtggtggaatcagaggctgtgtacctgctctcggagctgatcaatttgatgaaaacaaaccaaaagaaggtgtacaactagccagtttcttcaattggtttttgtttagcattacaattggggccagcttaggagtcacctttgtagtttatgtgagcacggaatcccaatggtacaaaggttttatcatatctatgtcatgttctgctactggtctcattttcattgccttgggaaagagattctatcgtgccagggtgccgggagagagtccattgttaagtgttttacaggtgctggtggtcacagtaaagaattggagggtgaaagtacccttggattctgatgagttgtatgaaatacaaagtcatgaatctaatttaaagaaaaaactcatccctcacactaaccaattcagggttctagacaaagctgctgttctacctgaaggaattgaggcaaggagatggaaagtctgcacagtgacacaagtggaggaagtgaagattctcacaaggatgatgcctattcttctaagtaccatcatcatgaatacatctttagcccaattgcaaaccttctccatccaacaaggaaccttaatgaacacatacattggcaaactgaacataccagcagcttccattcccataattccattagtattcatgacccttttgataccggtttacgaatttgctttcgtaccacttgtccggagaatcaccggccaccccaatggaataacagaactacaaagagttggggttggccttgttttgtcagcaatctcaatggtcatagcaggggcgatagaggtgaaaagaaagcacgaattcaatgatcataatcagcaccgtatcagcctcttttggctctctttccactatgcaatctttgggatagctgacatgttcacattggtggggttgctggagtttttctacaaagaagctcctcaaggcatgcgttcactttccacttccttttcctttctttccttgtccattggttactacttgagcacagcttttgttgagctcatcaacttggtgactggtaagattgccaagagcaagaaagggtggctagagggacgtgacttgaaccgaaaccatgttgaattattctactggtttttggctatactcagcataattaactttgtcatttatctgatgtgtgcaaaatggtacaaataccaaagtgttgtaccatttgatacgggaatgttgctcaaagatccacctcctcgtaatgatgaaaacgtctactctactagctttgtgtccacg

SEQ ID NO: 108878 - DNA, 438 bp, Glycine max
  Peptide Sequence Number=SeqID_225656
atgggtttcaagcatttgctgcttgtgacgtctgtgtgtgcttggtttgtatccttggctgttacaacttcttctggtgatggggtaacgagagttagtctaaaaaggaggagtttagacattaacagtcttaattctgcaaggatcaagggggttgttaatcatttaaaagcagatggagtgtatctgaagaattatcttgatgcacagtattttggcgaaattggtattgggtcacctccacaaagcttcagagttgtgtttgacactggtagctcgaatctgtgggtcccttccgccaaatgcgtcttgtctattgcttgctattttcattccaagtatagatcgaagctatctaacacctatacgaaaataggaacaccttgcaagatcccttatggccatggacacgttccctggcttcatcagccaagataa

SEQ ID NO: 108879 - DNA, 330 bp, Glycine max
  Peptide Sequence Number=SeqID_225657
atggcaaataactccacaaatggtggtgttggtgatgtagctccatgtggagattgcaggccttggatcttcttaatcaatagagtcctttacttcttgaagatcaatggcaatataatggagaaggaggaaaggttattggagacgctacttcaaggagaagatgagtcaagaacaagttcatcaccacaggaagccatggataaaagcttcaagatatggttcaacccactactccaagatcaagtccaatattctccactaagtgcgcttaggtgtcatgaggcatgtaaagcatggacaaagtgtgactatatgatgtggcaatga

SEQ ID NO: 108880 - DNA, 726 bp, Glycine max
  Peptide Sequence Number=SeqID_225658
atgagtgaacaagggagcatgcttagtgctgtgattgttattggtgaacaagggctcgtgactcaaaagattttctccctttggctaaaccaagacccagtggcaaagctagggggtgagattgtctttggtgggattgactggaggcactttaagggtgaacacacttatgttccacttactcaaaaggattattggcagattgaggtgggagatattcaaatagcaaacaatccaacagacctgacttacaatataaaacttgagtttccagggctatgtgagggtggttgtgctgctattattgactcagggacctctttgattgccggtccaacaaaaattgtgactcaaattaaccatgccattggagcagaaggatatcttaagcaaaagaatacaaaggaaaaaatattaaaatatgtggatgagctgtgtgagaagcttcccaatcctgtgggacaaacatttatagactgcaatgatatagcaaacatgccacaaattacattcaccattggaaacaaatcatttcccctgtctccagaacagtatatgctaagaattgaagaaggttgcaacactgtatgctatggtggttttgttcctctagatgtgccagctccacaaggtcccctctgggttcttggagatcttttcttgggggcttatcacacagtgtttgattatggcaatctccgtattggatttgctgaagctgcgtag

SEQ ID NO: 108881 - DNA, 873 bp, Glycine max
  Peptide Sequence Number=SeqID_225659
atggaagtgagaattgggcaaagggtgtctcgcggaatgctccctctcctcgctctccacaccgtcagcgagtattaccgctccgaccacaaacctccgttcaccgccgccctcatcgccgccaacaccctcatctacctccgcccctccttcctcgatcccctcattccccccattgaacaagtctggttcaacccccacctcatcctcaagaacaaggacttgaaacgcttcttgttgtcgccgttttaccatatcggagaaccgcacctggtttacaacatgctatcccttctctggaaggggtttcagttggaaacctcaatgggaagcgtcgatttcgcttccatagtcgcttccttgctcgttctctcccagggcgtaaccctaatgttatccaaatcactgcttctgttcttcgactacgagagatcctactacagcgaatactccgtcggattctccggcgtcctcttcgccatgaaagtcgttctcaactcccaatcggagaactacacctccgtctacggaattatcgttccgtcccgttacgctgcgtgggctgaattggttctcgctcagcttctcgtgccgggcgtgtcagggattgttgatgctgtgaagtggccttttaagttcttgcggcggaggcggggacggatcaccggaaggggaacagttggaagtaacagggcgtggagatgccagacgtgtacctatgacaacaacaatggttccctgagagtgtgtgagatgtgtgggacgattagggttgtcaatggagtgtcctcttttcagaggagctcccgttctgatgggcttcctttggatgagttgcgccgccggagaatcgacaggtttggaggcaggtga

SEQ ID NO: 108882 - DNA, 186 bp, Glycine max
  Peptide Sequence Number=SeqID_225660
atggagatgaaaggctccatacgcgggacgtcgggatgtatgcgatttataggcgttcagaatccagacgatgtcaaatccagagaggttgagccgcagagacaaagtttgatcaatagacaatggctaatgcctaatttgcctaccattatacacggccctgtaggccaaaaactcacattctaa

SEQ ID NO: 108883 - DNA, 105 bp, Glycine max
  Peptide Sequence Number=SeqID_225661
atggttcaactaggggctggtcgaagtggaaacatgggtaggtactttggaggaatgaatgttggtagtttgagacaaggaggaagtggagaatttttcaagtga

SEQ ID NO: 108884 - DNA, 420 bp, Glycine max
  Peptide Sequence Number=SeqID_225662
atgaagggctatggaaatggatactacatgaaggttgggcaggagaggctttcagctctttgtccgatgcagaagtttgttgacttggattcattagccttgatttcacaaactttcttggacattgattttgtgtcaaggatactggatagtatcatgaagctttgcttgcaattttgctggaatattgagaaccaagataattgttcaaatacttctgaactggagcatataattgaggaattcaacaagaaatcaagttccttgtccactatactatgcaatagcaggcttgctggaagtcagcgggcaccctttttgagacgttttctcttgcggttaaatttgaattccatttttgagaggaatgcagaaggataccagtaccactaccccatcaaccacaagtggtcagattag

SEQ ID NO: 108885 - DNA, 144 bp, Glycine max
  Peptide Sequence Number=SeqID_225663
atggattcaaaaatacgcacactgagcatgctaagatcacggtttcagtcattgcctggtgcattcaacacatgcttggttccttctgataagaagcaaaaaggaagattctctttctcaaagaaatttgctgaggctgcttag

SEQ ID NO: 108886 - DNA, 402 bp, Glycine max
  Peptide Sequence Number=SeqID_225664
atgtctaagctgttaggcaacatttgcttcaggtttaaatttgacgatgaacgagtatcaaaagaagatccaaagagggctttagaagaacagtatggtggtgaagaagagttacctcgtataaatcctggcttcaaccactctccttttaaatttacaaaacactcgaatgcatatatgcttgtctatgtacgtgagagtgacaaggataaaataatttgtaatgtggatgagaaggacattgctgaacaccttagaatgagattaaagaaagaacaagatgaaaaggagctgaagaggaaggagaaggctgaggctcacttgtacaccaccataaaggttacaactctatctttcttttacttctctgttatttttggccccgttaaatactttgtatga

SEQ ID NO: 108887 - DNA, 306 bp, Glycine max
  Peptide Sequence Number=SeqID_225665
atggttctggtcaatgatcctttggttgctcctgtttccttttccttagaccttacaatcgtcacaagcttgaatttaggtctcatgagtgtgtttttcttggatctgtttttgtcttcctctaagtctgattcacatcctaataaccccatctctttcattccctctacccgtattgttcctcaacctattgcttctctttccccctctagcatttctgttgctagtcctacttctattaatcctactacaactgattcaaattccatccctagtccttctgtccatgctgagtcctactattga

SEQ ID NO: 108888 - DNA, 1197 bp, Glycine max
  Peptide Sequence Number=SeqID_225666
atggctgcgaaaggggagagtgggttcagctgttcaagaagagaagaacgaaaacattcacaacatcagttcaatgcacgtgagagtgactggggtttcattaatttcatgccacttgctgaattgtatgatcctgctagaggttatcttgtgaatgatacatgtgttgttgaggctgacatttctgtgcgtaaagatatggattggtcatatgattcaaaaaaggaaactggttatgttggactgaaaaaccaaggagctacatgttatatgaattctctgcttcaaacattgtaccacatttcttatttccgaaaggctgtgtaccatatgcccacgactgaaaatgatatgccatcagggagcatccctctggcattacaaagtttgttttacaaattgcagtatagtgacactagtgtggcaacaaaagagttaacaaagtcttttggatgggatacatatgattcgttcatgcagcatgatgtccaagagcttaatagggttctttgtgaaaagctagaaggaaaaatgaagggaactattgtggaaggcactatacagcaattgtttgaaggacaccatatgaactatattgaatgcatcaatgtggattataaatcaacaagaaaagaatcattttatgatcttcagcttgatgtcaaaggctgtaaggatgtgtatgcttcttttgataagtatgtggaagtggaacgacttgagggtgataacaagtatcatgctgagaactatggtttacaggatgctaggaagggtgtgttgttcattgatttccctcctgttcttcagcttcagttaaaacggtttgagtatgattttacgcgagacactatggtaaagatcaatgaccgctatgagttccccttgcaactagatcttgatagggataatggcaaatatctatctcctgaagcagacagaagtattcgcaatttttatacacttcacaggtttggaggtacagaggataaggctttgaaattgataaacaactatttccagagatacagtgagggcattgttattcagtgttgtcaaatggcggccatggcggaaaggcgtggtggatttttgaaaaaacgccaccgaatagcggtggcatggcgggttgcgaatggcggcgccatggcggtcatgacggttatggcggcatggcggaaaatagcggatttttag

SEQ ID NO: 108889 - DNA, 1063 bp, Glycine max
  Peptide Sequence Number=SeqID_225667
atggcagagtctgtgggtgtggctgggttcggtgtttcaggctcattctctcttactaggcccacaatcttttctcgatcttccaataatatctctctctttcgctctcaatctcatttccctgctgctgcattcggttccttgacacgttccaacccacacgtgcacgccgctgtcacttccgactccaaggccgctacttcgcttgacctaactcaacccgatctcgataatagcggcggcggtgccaacggtaacggaggcggcggtggaggtggaggtggaggtggaggtggaggagaaggaggaggtgataatagcaagggcgaggaaggatctgacggtgacaagaggaaaatggctctgttaatgtctcagaaattcactctagcttatgctgcactcgtcggagtgggtggtgtaatgggttatctcaagagtggcagcaacaagtcacttttggctgggggtttgtctgcatcactgctgtattatgtttatactgagctacctggaagccctgttttcgcatcatctgttggccttggcatatctgctgcacttcttggggtgatgggttctcgtttcaagaaatcaggaaaggtctttccagcaggtgttgtgtcacttgtgtccctcataatgactggtggccgattactgtctatcccaacaaaacctaacccagatgatgctcctgcctctgctcgttggctcgtctccctcaatttctggggagtcttgaatactatctcatctgatttgggtggagctccctttgggaatgtggtatcatatagtgatggactacctaacgaaagcactggaatcccatacttttacttgacaactctagacccgacagcaagaaatgcactgcaagatgataaagcttcattcacggtcagtgaataccctcttgggacctgtggcaggagagacccaatgaaccctacttgttccaaaatttctctaactggaaagctgaaattggttgatgaaaagtccaaggaagccgaatttgctcgaaatgccttgttttccaagcatccagagatgaaag

SEQ ID NO: 108890 - DNA, 2253 bp, Glycine max
  Peptide Sequence Number=SeqID_225668
atgcagggaggaatactacttgggccatctgcaattggacgaaatgagaagtttctgagcacggttttcccaaagaaaagcataacggttcttgacacactaggcaacgttggtcttttgtttttcttgtttctagttggtcttgagcttgacatgcgtgctattcgccgtactggtcacaaggccttagccattgccctttgtgggatcactgtgccttttgttcttggcattggcacttcttttgctcttagagccaccgtgtccaaaggtgctgagccagtttcatttcttgtcttcatgggtgttgcactctcaatcactgcctttcctgtcctcgctaggatcctagctgagcttaaactcctcaccactgatgttggtcgcatagcaatgtcagctgcagctgtgaatgatgttgcagcttggattcttcttgctcttgccatagccatttctggttctaacggatcaccctttgttcctctttgggtcttgctctctggtgttgcttttgttatctttgctgtctttgccattaggccattgcttgtagctatggctaaccgttcccctgagggtgagccagtgaaggaggtgtacatatgcatcacattgacactggttttggcttgtagttttgtcactgatactattggaatccatgccctctttggggcttttgtgattggtaccattatgcccaaagagggttcattttctgtagtgatgattgagaagatagaagacctggtgtctggccttttcctgccactgttttttgtgtctagtggcttgaagactaatgtggcaactattagtggaggactttcttgggcaatgttggtgcttgttatattcaatgcttgctttggcaagattgttggcacaatagttgtgtcgttaacgtgcaaggtgccttctcaagaagccgtggcacttggatttctcatgaacacaaagggcttggtagaactcatagttctcaacattgggaaggaccgtaaggtgttgaatgaccaagcatttgccatttgtgttctcatggcattgtttaccaccttcatcaccaccccaatagtgatggctgtatataaaccagctcgcagaggagcaccctacaagcacagaacaattcagcgcagagatcctgacactgagctccgaatgctagcttgcttccacaccacccgcaacattcccacgttaatcaatctcatagagtcttcccgcggaattcgaaagagaggaaagctttgcatctatgccatgcacttgatggaactctcagagcgatcttcagcaatcacaatggttcacaaggcacgcaagaatggcatgcccttctggaacaagaaaccggatgacaaagatcaaatgatcattgcttttcaggcttatgagaaactaagaagtgtcaatgtgcgccccatgacagccatctctgctctcaatagcatccatgaggatatttgtactagtgctcaccaaaaacgtgcagccatgattatcctcccattccacaaacaccaacgtgtggatggatcaatggagtcactaggacattcactccatgtgatgaatcagcttgtgctaagccatgctccttgctcagtgggaattttggttgatcgaggtcttggagggacaagccaagtccaagctagtgatgtgtcttataaggttgttgtacccttctttggaggacgtgatgatcgtgaagcactttgttatggtatgagaatggctgagcacccggggattttgctcaatgtggttaagtttgtgcccccacctggggcatcattggcctttggtgctaaattggttgggatgtcatcgaacaaggacaagaaagcaatggaagtggttggtggcagttattatgatgataaacaacaagatgatcaattgtggagtgagtttttaagtgcatgcaacaacaaccaagagtcaatgaagtatgagcaaaaactggtggcaagcaaaggtgatattgaggcagcattgaaggaaatgaataggagcaatctaatattggttggtagaatgccatcagtaggacctttggttagcagaagtgattgtccagaacttggacctgttggaagctacatggcttcttcagatttctccactgttacatcagttatggtaattcagcaatataatccttcaactgacattcatccactagtgatggaggaatttgattacccagataagctagagccaaacgcaccaaggagttaa

SEQ ID NO: 108891 - DNA, 195 bp, Glycine max
  Peptide Sequence Number=SeqID_225669
atggaagaagatcacaagaagactctcaagtttttagatgttacaaatgcaaccaactttgtcacatcaaagctaattgtccttcaaaggaagaatggcctgagaaaagtgataagaaaagatggctcagaaaaggaaatcaaccttctaaccaagaattatgagagtgaagagaacatttctcaagaaggttga

SEQ ID NO: 108892 - DNA, 327 bp, Glycine max
  Peptide Sequence Number=SeqID_225670
atgtcaaaccataaaagcactgagtcagcactgaagaacctcgaggtccaggtgggacaactcgccaagcaaatagcggacaagtcatccaacaattttgtggcaaatacaaaacagaatcctaaggaggaatgcaaagttgtgatgacaaggagtaaaaggtttgtggaggctgaggatgaggatagtgttgtgcataaaaaggaaactactgacaagaaaggtactaattgcaagaaaaatgaggaaaacatcataatggaaggaaactgcagtgctgtgatccaaaagatccttccacccaagcataaagatcctgggagttaa

SEQ ID NO: 108893 - DNA, 225 bp, Glycine max
  Peptide Sequence Number=SeqID_225671
atggcagatttcaaaaactccttctatgcactctctcactccaaaaatttacgcattttgcatatgtgctttctctttgcgttatctacttctaatcccaaagcattaacaatccaagcgttctctgaagaaatagctaagtgcacttaccgtgctaagcgagttcatcctttgaggatgaacactcatcctcttggtgaactacctgtgactaagcgaggctga

SEQ ID NO: 108894 - DNA, 378 bp, Glycine max
  Peptide Sequence Number=SeqID_225672
atgaccactcttacccagatatggatggcgttgctacttagcaagattctgccaagcgaccacaactccgatctccccctgctgaagtggatcgcaccaacaagacacccagtggacccggagaagtccaacagggccctagggtttccaactctgattgcaggcctctgtcagttctatgaagtgctcgttgcccccagcaaggtcatcaggccccctattaacaaggccttcatcgagaagtactgcacccccaggctggcacagggcgaggctccacaacagcctggggatggccagcagcaggcaacagacgcactgccaccacttctagagtccacctcagctcatctacaaaggctggagcgtggcctatga

SEQ ID NO: 108895 - DNA, 285 bp, Glycine max
  Peptide Sequence Number=SeqID_225673
atggccaattctcattattctaaaactttgcatcttccatgcaaatccttctctatggctattctccttgtttacttgcttcttgttggttcttgcactgcaataaggacaggcgcaaccatgcggttgaatgaaggctcagaacttctccggcggaagcagcaacaaccgcgatttccttacaaaggtcttgttttcaacttcttacccaaaggggtgccaattccaccttcaggcccttcaaagaggcacaactcagtggtggcttccacacctaagaattga

SEQ ID NO: 108896 - DNA, 186 bp, Glycine max
  Peptide Sequence Number=SeqID_225674
atgaagccatcaaaggctccaacgcaaaagtctctctcctcctccaatgcttcttcccgcaagttcgtttcaacgcttcacattcacattgtggacctgttacaagaacaggttttccgtaagggaaaaaatagtttacagaatggccattccgaaaggaaaagtcctacggatattctggtgtag

SEQ ID NO: 108897 - DNA, 246 bp, Glycine max
  Peptide Sequence Number=SeqID_225675
atggcttctaatattcaaactctgcttgtgcttgttctggcaacattgggaacatttatgatcccttccaatgcacagcttactcctaatttctataagaaagtttgtccccaggcattgccaatcataaggtctgtcgttcaccgagcaattattcgtgaacgacgcattggagcctccttgctgcgtttgcatttccatgactgctttgttaatacacaacttggtactaatattgtggtctag

SEQ ID NO: 108898 - DNA, 912 bp, Glycine max
  Peptide Sequence Number=SeqID_225676
atgaaagtgaaaataatagaaagagaagagaagttgatgtcaacagcagaagctcctcctccgttccaagaagcagcgcgatgcgttgtgtgcaattgcagtttcaacaccttcagaagaaggcatcactgtcgatcctgtgggagaacattgtgcaatgaacattcatcagatcaaatggctttaccacaatttggcatttactcaaatgtccgagtatgtgctgattgtttcaacaactcacgattcaatgcattcaaagagcttgggagactgcacaggtctgggaaggatgaaccacagacttcttcagatggagtaaacagtgtgacagatacaatttctaaattagatatcaacacaaatgttgattcaaaatccataccaactgcagagaataagcttgtgttgggcattaaagagtgtaaatgtggaatgccactttgcatttgtgaagctccaaccccttcctctgatgcactcccccagcagaaacccaatccagttattgcagctccatcaaatcctaaatctaagaagacagatactgttccgaaaaatagaagctccagttcaactagcaaatttagttctatgtttaacgttggtcatgtaactaatggtacctcagacaggccccagattgattatgaagttactggagagggtttaagagaagcaataaaaaatggtgacattgctgctgttaagaaacttcttaatgagggtgtggatgcaaattacagggacaagcaaggactgtctttattacatttgtgcccccaatactaccactgtctaaaggttctccgttaccagaacaaaaatttccggcttctgtataattgtgacagagatggagttcaattcatctttctgaaatggcagactaagtatgcagacctttattag

SEQ ID NO: 108899 - DNA, 186 bp, Glycine max
  Peptide Sequence Number=SeqID_225677
atggctggtgtgaaccccgaggcaggagggtggaaggcttatccttctgttatggagactgctcttgatagtggtgatggaaggagtcatcataacatgagtgatgatgggtcggtgatgcatttctctgctacaagcttttatggggatttagttcatgaaaagaagacagacatccatgtctga

SEQ ID NO: 108900 - DNA, 1440 bp, Glycine max
  Peptide Sequence Number=SeqID_225678
atgaagagcaccaaggcaattagtcatgccatatttgttatctttatactctctgtgagtgcaagatgttgtggacaagaagaccttgataatgatatattagctcctatggagaaagcagagcaggaagctctatactccaccattcaaggctttgttggtgattcctggaatggctcagatctctatccagatccttgtggttggactccaattcagggggtctcttgtgatctgtttgatggattttggtatgttactgccttgaacattggaccggtccatgacaattctctgagttgtgctcaagaattggaatttagacgagagttatttgagctcaagcacctaaaagctctatccttcttcaattgctttcaatcacaagacatgtttccagctaccatccccactggaaactggcagaaactggctggcagcttagaatcactggagtttagatcaaacccgggtctcattggaaacatcccctcaagttttagtgccctcaagaaccttcaatcactagtaatactagaaaatagtgtaacaggtgaaataccatcaagcattggcaatctcatcaagttgaagaagcttgttcttgctggaaactatcttactgggagtattccagatgtttttgatgggctaaatgagttattgatctttgacttaagtagcaattcattgtctggctctttgcctttgacacttgggagcttaacttcagcattgaagcttgatgtgagctacaaccaccttgaagggaatcttctaaatgcatttgctaatcttaagtatctgacccttatggaccttaggaataataggttcactggtgggttgaccttatctttgcaagagatgtcctccttagaggaattagttttgtccaacaatccattgggtggagacatcagattcctaaagtgggaaaacctcaacaatttggccattttggaactatccaacatgggattgacaggggaaattcctgagtctttatcagaattaaagttgttaagatttttgggacttagtgacaacaatctcacagggaacctgtcaccaaagctggaaactctgccttgtctcaatgcactttaccttagtggaaacaatctcacaggagagattaacttctctaaggacttttttggaaaaatggggaggcgttttggtgcttggaacaacccaaacctttgctaccaaattggactaatgtcatcaagccatgttccatttggggtaaagccatgccagaaagaggtcaatttgttagaatctgattcaaaaactgagctgatcaatggggatatgaatgagactttccatttcatagcctctaagggattttctagctgtgctactgatggcttctggtggacttttctggaaaaaatattgatgatgggcttatttctaagtcttatataa

SEQ ID NO: 108901 - DNA, 342 bp, Glycine max
  Peptide Sequence Number=SeqID_225679
atgatgacaattgatgttgatagtgttggcaatcatggtggtggtggtgatatggtgataacattggtggtagttattgcaacaacgttgttgttgttggtggcagtgacaagtggtattgatggtgacggtagtaatgtcggtgatgttgaggacgaaggtggtaattgtgatgataatattgatagtgataatgacagtgttagtagcggtgcgatggtaagctataacaaaagtgatataggtagtggtggtagtgataatgatattgatggtagcaatagtggtaatggcagtaatagtaacggtaataatagcaagaagtgtcataatcaaatataa

SEQ ID NO: 108902 - DNA, 1071 bp, Glycine max
  Peptide Sequence Number=SeqID_225680
atggcttatttagttggttatgatccttgttcccacttgagcaaggccttttctcagtacccttctctttctttttctgatcgtggtagctacctgtctttcccatttctccgtaatcttgtttatgctaatgtttttggggttagcagaagcattggttttggtactagaggttgtagctttgacactagtggtagctgcagtggtaatagtgataggatctttgtgagggcaaagacaaggtcccgtggctttgcatcgaatcgccgccagccgatgttggctgatttggagcaaaggaattctgttaggagtgatgagagtgatgctactttggttaaggttgataatggatctataaatggaagtcctgctaagcctccttgtttcagtgatcatcgattatcccagaaacttgtggttgctgttgatgttgatgaggtattaggaaactttgtgtcagctctcaacaagttcattgcagatcgatattcatcaaattattcagtttctgagtatcacgtgtatgagttctgcaagatatggaattgttcacgtgatgaagctgatatccgtgttcacgagttttttaagacaccatatttcaagtcagggatccatcctcttccaggtgctcagatggctcttcagaagttatcaagattttgtagcctatcagttgtaacgtatgcttttggtattgaactttcatcaacctgtaaaggaatcttatcacggcagaatgcaatcaaggaccgcacaattgagtggatagagaagaattatccaggactgtttcgtgagattcacttcggtaaccactttgctcttgatggtgtgtcaagaccaaagtcagaaatttgtaggtctttaaaagccaaggttcttattgatgataacccacgatatgccatagagtgtgctgatgttggaattagagtcttactttttgattatgaaaactcatatccttggtgcaagaacgagtctgttgatcagcatcctctggtgaccaaagttaagaactgggaagaagtggaacaacaattagtgtctctgatagcttcttag

SEQ ID NO: 108903 - DNA, 1488 bp, Glycine max
  Peptide Sequence Number=SeqID_225681
atgggactccaacattttactacgtgcgttttgttagctctttgcattctaagccaaggtttggcaaagggtgctcatggctttgcttgcaactggggaacgcgtttaacacatccccttccacctcaaataaccgtgaaactcatgaaggacaatggattcaagcaagtgaagctctttgaggctgatcccgcagcactcaaggctttaggaaattctggcattcaggtcatggttggcataccaaatgacctcttagcaacccttgcttccaatgtcgatgctgccattgcatgggtcaaccaaaacgtgtcctcttacatatccaaaaatggggttgatataaggtatgttgctgtggggaatgaggcttttctcaaaacatataatggccggtttgttaattcaacctttccagccatccaaaacatccaagcagcccttataaaagcaggattaggcaggcaagtgaaggtgacaacccctctaaatgctgatgtctaccaaagtgacagtagtcttccatcaggtggaaacttcaggcctgacattcatgaccaaatgatctccataataaagttcctaagccaaaatggtgggcctctaaccttcaacatctacccattcctcagccttgatgctgatccccacttcccaaaagagtttgccttctttgatggctcagctgctcccgttgttgatggctccataacctacaccaatgtgtttgatgcaaactatgacaccctcatctcagcccttgagaagaatggttttggccaaatgcctgtcatcattggagaggttggatggccaacagatggaacagccaatgccaacatcaagaatgctcgaaggttcaaccaaggcctaattgaccgcattgtgaaaagacaaggaagccccaaaagaccttccccaccagatatctacttgtttggatttatagatgaggatgccaagagcattgagcctggcccttttgagaggcattggggtgtcttcaactttgatggatccattaaataccctttgaatttgggtggtggaaagcaactagttggtgcaaaaggggtgaggtatttgccaaagcaatggtgtgtgatgtcaactcaagcaaatgttgaccctaatgctttagctgagagcatgagcaaagcatgcacatatgctgattgcacaagcctctctccagggtcatcttgcagtggattagacacaagaggcaatgcttcatatgcattcaacatgtactatcaggccatgaatcagcaaaaaggtgcatgcaatttcaatggtctctctgtcatcactaacataaacccttcaccacctcaaagctcttgtcaatttaagatcatgatcgatctggggaagcatgaaaagaagtccacctcttcttctgttgcaccagagaggaaactacactcaatggtcatgctggtgtcaagcttcatttttactgtcatgttattgctttgtgtttag

SEQ ID NO: 108904 - DNA, 5406 bp, Glycine max
  Peptide Sequence Number=SeqID_225682
atggccggaggtgccgccgggggtttcgtcactcgagcgttcgattctattctcaaggagtgttcttctgtcaagaagtttcccgaacttcagaaagctattcagaattacacagatataacgaaacaggcgagccagaaaaagcagagtgaggtcaatcaaggtgcaccttcagctgaatctgggagcacgaatgaaactgaaggtggagcggcaactaggacagaagcagatcagttccagaaggctgagcatgcttcagatgacaggcctaagattggaaacattaatgttgttttggctagtgctgggaatactcttgaaggagctgatgcagagcttgttttaaatcctcttcgtcttgcgtttgagactaagaacttgaaaatccttgaatctgctttggattgtcttcataaacttattgcgtatgaccatttggagggagatcctgggttagagggtggtaaaaatgtcccattgtttacagacattctaaacatggtttgcagttgtgttgacaattcatcacctgacagtactattctccaagtgctgaaggttcttcttactgctgtggcttctactaaattcagagtacatggcgaacctttactgggagttatcagagtatgctacaatattgctctgaatagcaagagtcctataaaccaagcaacgtcgaaggcaatgttgacacagatgatcagcatcactttcaggagaatggaaactgatccagtggggcatctaaatttcttagtcgaagcgtcatctgcttccagtgggcatacaatttcaaaggcagcttcagcagagaatttaaactcaaaatctgatgaatcttcaacgggagactcaaatgaaaaagaaatgactttgggtgatgcacttagtcaagccaaggatgcatctccaacatctcttgaggaacttcagaatcttgctggaggtgctgatataaagggcttagaagcggtactggacaaggcagtgcatactgaagatggtaaaaagataacacgtgggattgatttggagagcatgagtatagtacaacgtgatgctttgttggtattccgcactctttgcaagatgggtatgaaggaagataatgatgaagttacaacgaagacgaggatattgtcgcttgagcttcttcagggtttgttggagggagtcagccactcatttacaaagaacttccattttattgattcagtgaaggcatatctttcatatgcattgttacgagcttcagtttcacaatcccctgtcatatttcagtatgcaactggaatatttttggtgctgttattgcgattcagggagagtctcaaaggtgaaataggcatcttctttccattgattgttcttagaccactggatggattagaatttcctgtcaaccaaaaacttagtgttcttcggatgttagagaaagtatgtaaggatccacagatgcttgttgacatctttgtgaattatgattgtgatcttgaggcaccaaacttgtttgaacgaatggttactactctgtccaaaatagctcaaggaactcaaaataccgatccaaattcagctgctctttctcaaacagcttcagttaaaggctcatcacttcaaggtcttgtgagtgtgcttaaatcactagttgattgggagcaatcacatagggagttggaaaagttaaagaataatcagcaagaagggatttcagctggagattcttctgaaataagatctagggaagatgtaaccagtgactttgagaaggctaaggctcataaatccacattggaggcagccattgctgaggctacaattggtgactatttaggtcaacatgaagaatttccccttgctgtgatgcatgcttatgtagattccatgaaattttctggatttaaatttgatactgcaatcagggagtttcttaaagggttccgacttcctggagaagctcaaaagatagaccgaatcatggaaaagtttgcagagagaagtgtcttggtgcttgttgtctatggcagatactgtgcagacaatcctggcctttttaaaaatgcagatacagcttatgttctagcttatgctgttattatgttaaatactgatgctcataacccaatggtgtggcccaagatgtccaagtcggattttgttcgcatgaatgccagggatgatctggatgagtgtgctcctaaagagctactagaagagatctatgattccattgtcaaagaggagattaaaatgaaagatgacacatctttaattggaaaaagcagcagacagaagccagagggtgaagaaggacgccttgtcagtattcttaacctggcactcccaaaaaggaagtcatccggagatgccaagtctgaaagtgaggccatcattaagaaaacacaagctatattcaggaataaaggggtgaaaagaggagttttctacactgcccagcagattgaacttgtaaggcccatggttgaagccgttggatggcctttgcttgctactttttctgtaactatggaggaaggtgataataagcctcgtgttgttttgttgatggagggatttaaagctggcatacatattacgtttgtgcttggaatggataccatgcgatatgcatttctaacatctcttgtcaggtttactttcttgcatgcccccaaggaaatgcgcagtaaaaatgtggaagctttgcgtacactgttggttctatgtgactcagacatgaacgctcttcaagatacatggaatgcagttctggaatgtgtttctcgcctcgaatttataacatcaactccttcaatttctgtcactgttatgcatgggtcaaaccaaatctccaaggatgctgttgttcaatctctgaaagaattagctgcaaaacctgcagaacaagttttcatgaatagtgttaaactacctagtgattcagttgtggaattcttcactgctctctgtggtgtatcagctgaagagctaaaacaaactccagctcgtgtcttcagcttgcagaagcttgttgaaattagttattacaatatggctcgaatacgaatggtctgggctagaatctggtctgtcctagcaaatcactttatatcagcagggagtcatcatgatgagaaaattgctatgtatgccatagattctctaagacaacttagtatgaagtatttggagcgtgctgaactggccaatttctctttccaaaatgatattcttaaaccatttgttgttcttatgcggaatagtcaaagtgaatccaaaaggaggctaattgttgactgcattgtccagcttctgcagatgatgaattggaatcaattgtcgagagtgcatttgaaaatgttgagcaggtctaagtctactattgcatttgtggtgtatctaacacatggacattttacagtcatcttagaacactttgatcaagtagtgggagactgtttcatggattgcgtgaattgtctgatcaggtttgccaacaataaaacttcacatcgtattagcttgaaggctattgcactcctgcggatctgtgaggaccgtctggcagagggtcttattcctggaggtactttaatgcctattgatgctactttggatgcaactttcgatgtaacggagcattattggttcccaatgctggctggtttatctgatctaacatcagatcaaaggcaagaggtcagaagttgtgcacttgaagtcttgtttgatttactgaatgaaagaggtagcaagttctccacagcattttgggagagtatattccatcgcgttctgtttccaatttttgatcatgtgagacatgctgggaaagagggctttatttctcctgatgatgattggtttcgtgaaacaagcatacattcacttcagcttctatgcaaccttttcaacacattctataagattactcatgaggaatcttgtttccaggaggtttgttttatgttgcctccactactgggtctgttgttagattgtgccaaaaagacagatcaaacagtggtctcaatatctcttggtgctttggtgcatctcattgaagttggtggacaccaattcagtgaaagtgactgggacacactacttaaaagcataagagatgcttcgtatactacacaacctctagaactgcttaatgtgttaagttttgaaaacctgaggaaccatggaagcattattagtgattctgaaggcaacgcaggtgacagtgggaccacaaggtctattgacaatgaggtaattggtgaccgtcaacttgatgtcaatagtaatgggaaattgtctccactggcatcctcaaatacaaatgctgatggagtggaagattctatatcacagacaaatgtagatcagtctgaaggccttccatctccatcaggaagaactcccaaagctgcagatggagaaggtttccagcggagccaaaccttaggtcaacggattatgggaaatatggaaaatctcttccttcgaaatctcacaaaatctaaaagccatatatctgatgcttctcaatcatcttctccaattaaggttgctgatgctgtagagcctgataccaagaatgaggagagtcctttgctggtaactgtcaggggaaagtgcattacacagttattgcttcttggtgcaattgatggtattcaggtcttggaaaaatgtctgtatgaggaagtacctcttcacactgtatgtgaggaaaagagggagaataagaaatactggacaaaattaaaatcccaacagaaggtttctataatggacattttgctgtctttgttggagtttgctgcttcatataactcatccaccaatcttagaactcgtatgcaccaaattcctgatgaaaggactttaaggttcactaaactattcttggacaggccaccaataaatcttcttcgccaggaattagctggtactggcatatatctggacatcttacaaaaagcaacttatggttttgaaacaaaaaaagaaaaaagtccagagtctgttggatttcaagatgtggactctacagaagttaatggcttgagtattactcaagattctgattcagaagtgaaatttgaaaggttagctgaggagaaactggtgtctttctgtgaacaggtgctcagggaggcatccgacctccagtcaattactggagaaaccactaacatggatattcatcgtgtcttggaactgcgcgctcccatcattgttaagatttttacactacccgtgaaccagattatgccacctcacctgtttagaaactgttttaagcttctattgttgatgaaaagccttaacatggtgtggcacttgcttgcttgtagattgcataaactgatagtggatcacggatcacctttaatctcaaaataa

SEQ ID NO: 108905 - DNA, 2163 bp, Glycine max
  Peptide Sequence Number=SeqID_225683
atggatgaagagttgggacaattggaatctgtgaataaatgggaaagaagggcacctttgaccccatcacactgtgctcgattactccatggtgggacaggtgtttctaggatcattgtgcagccttccactaagcgaattcaccatgatgctctctatgaagaagttggtgctgaaatatcacaagacttgtcacaatgtggtctcatccttggcattaagcaaccaaagctggagatgatattaccagatagagcttatgccttcttctcacatacacataaagcacagaaagaaaacatgcctttgctggataagattctagctgagagggcatcgttatatgactatgaattaattgttggggacaatgggaaaagattacttgcatttggaaaatttgctggtagagctggaatgattgactttttgcgcggattaggacaacggtttttaagtcttggatattcaacacctttcttgtcacttggatcatcttacatgtatccttccctggctgctgctaaggctgctgtgatttctgttggtgaagaaattgcgacccagggattgccattggggatttgtcccctggtttttgtatttactggttcaggaaatgtttgttctggtgcacaagagatatttaagcttcttcctcatacctttgtagatccatctaaactacgcgatctacatagaacggacaaagatcaaccaaggcatgcttcaaaaagagttttccaagtttatggttgtgttgtgactgcccaagacatggttgaacccaaagatcacgtgatagtgtttgacaaagcagactactattcacatcctgagcattacaatcccactttccatgaaaaaatagcaccatatgcatctgttattgtcaattgcatgtattgggagaaaagatttcctcaattgctgagctataagcagatgcaagacttaatgagccaggggtgcccccttgttggaatagcagacataacgtgtgatatagggggttcaattgagtttgttaaccgtgctacatcaattgattcaccctttttcagatatgatcccttaacaaattcctaccatgatgatatggaggggaatggtgtgatatgcttagctgttgacattcttccaacagaatttgcaaaggaggcttcccaacattttggaaacatactttcccaatttgtcataaatttggcttctgctacagacattacaaagttgcctgctcacttaaggagagcttgcatagccaataaaggagtgctaacctccttatatgattatatcccacgcatgcggagttctgattcagaggaagtatcagaaaacgcagaaaattctctatctaacaaaaggaagtacaatatatcggtgtctctgagtggtcacttatttgatcagtttctgataaatgaggccttagatattattgaagctgcaggaggctccttccacttagtcaactgccatgtcggtcagagcgttgaagctgtatcattctctgaacttgaagttggtgcagatgacagggctgttctggatcaaatcattgattctttaactgctattgctaatccaactgaaaatgatagattttcaaatcaagattcaagtaaaatttcacttaagcttggtaaagtcgaagagaatggcatagagaaggagtctgatcccagaaagaaggctgcggttttaattcttggtgctggtcgggtctgtcaaccagctgccgaaatgctttcatcatttggaaggccatcatcgagccaatggtataaaacattgttggaagatgattttgaatgtcaaattgatatagaaatcattgtgggatctctgtacctgaaggatgcagagcagactgtagagggcattccaaatgtaaccggagttcagcttgatgtgatggatcatgccaatttgtgtaagtacattgcacaggttaacgttgttataagtttgctgcccccaagttgtcatattatcgtagcgaatgcttgcattgagctgaaaaaacatcttgtcactgctagctatgttgatagctccatgtcaatgctaaatgataaggctaaggatgctggcataacaattctgggagagatgggcttggacccaggaattggtagagagttatttgataattag

SEQ ID NO: 108906 - DNA, 1551 bp, Glycine max
  Peptide Sequence Number=SeqID_225684
atggctattccttcactagtaaaccagcctctagcattcagcttctccttcctcctctttcttgctctctgcaccccattggctgctaacaacaccgatttcggaggttcagcctgcctcaaggtttcccccacccacttcgccggctcagtcaccgaagtcataactgctatacgacaagtcgcttccatcctctcacgcttcagccctcccttcgccaacttccgcctcgccaccgccctcgccgactgccttgacttgctcgacctctcctccgacgtcctctcctgggccctctccgcctctcagaaccccaaagggaagcataacagtacggggaatctgagttcggatttgaggacatggctaagtgcggcgcttgcgcatccagagacgtgcatggagggattggaagggacaaatagcattgtgaagggtttggtctcagccggaatcggccaagtggtgtcgctggtggagcagcttcttgcgcaggtggtgcccgtacaggatcaatttgacgacgccagcagcaaggggcaatttcctttgtgggttaagcccaaggaaaagaagctgctgcaatcaattggaatgacagctgctgatgttactgtagcgttagatgggagtgggaactatgctaagatcatggacgcggtgcttgcggcaccggattacagcatgaagcgttttgtgattttggtaaagaagggtgtttatgttgagaacgtggagatcaagaggaagaagtggaatattatgatggttggagaggggatggattccaccattatctccggtaaccggagtgtcgtcgacggttggaccacattccggtcagctacattcgctgtgagtggcagaggattcatagcaagagacatatcctttcagaacaccgcagggcccgagaagcaccaagcagtggcactaagatcagacactgacctctcagtgttcttccgatgtgggattttcggttaccaagacagtctctacacccacacaatgcgccaattcttcagagaatgcacaatcactggaacggttgattacatctttggtgacgccactgcagtgttccaaaactgcttcctacgggtcaagaaagggttgccaaaccaaaagaacacaatcacagcacacggtagaaaagacccaaatgaaccaaccggtttctcgttccaattctgcaacataaccgcagattctgaccttgtaccttgggttagcagcactcaaagttacctggggagaccctggaagagttactcacgaacagttttcatgcaatcgtacatgagtgaggtgataaggggagaagggtggttggagtggaatgggaactttgcattggagacattgtactatggtgagtacatgaacaccggggcaggtgctggacttgctaaccgtgtcaagtggccagggtaccatccattcaatgattccaaccaggctagtaacttcacagtggctcagtttattgaggggaatctatggttgccttcaactggagtaacgtacactgcgggactcatactttag

SEQ ID NO: 108907 - DNA, 255 bp, Glycine max
  Peptide Sequence Number=SeqID_225685
atggataacaaacctacacctaatgtcactgtggctaaagatggcagcggagatttcaaaaccatctctgaatgtttaaatgccgtcccgcaaaaatatgaaggacggtatgtgatttttgttaaagaaggagtatacgatgagacagtgacagtaacaaagaaaatgcaaaatataaccatgtatggtgatggatcccaaaagagcatcatcactggcagcaaaaactacagggacggtgttagggcatcctaa

SEQ ID NO: 108908 - DNA, 1563 bp, Glycine max
  Peptide Sequence Number=SeqID_225686
atggctattccatctcctaaaattttcctcctcttaacattcttcttctcacattctatagctgtgaagtcctccaatgtttccacaaccccaacattgcatgcaaccttcccatttcctgaagttagcagcttcaattcatctaagctttcaatctcaataaacataaatccaaacatcatcaacacccttcttcagtccctccaagcagcaatatctgaagccacaaaactatctgatctattaaacaacgctggacataacatcatagagaacaaaataggagcagtccaagactgtagagaacttcaacaatccaccttagcttccttaaaaagatcactatcaggaatccgttcccaagactccagaaaactagttgatgcaagaacctacctcagtgcagcactcaccaacaaggacacgtgtctagagagcttagattctgcttctggtacccttaagccagttctagtgaattctgtgatcaactcttacaaagatgtcagtgactctctctcaatgctccccaagcctgagaggaaggcttccaaaggacacaagaaccggcgtttgttgtggttgtcaacgaaaaatcgccgtctcttgcaaagcaatgatggaggagagcttgttgtggctgcagatggaactgggaactttagcaccatcactgaggctatcaactttgctccgaataacagtgttggtaggacagtaatctatgtcaaagaagggacgtacgaggaaaatgttgaaatcccaagctataagaccaatattgttctgcttggcgatggaaaggatgtcacatttattactggcaacagaagtgtcattgatggctggaccactttcagatctgcaactctagcggtctctggtgagggctttctggcacgtgatatagcttttgagaacaaggcagggccagagaagcatcaagcagtggccttgagagtgaatgcagacttcactgctttctacaggtgtgctatgtatggttaccaagacactctctatgtccactcctttagacaattctatagggagtgtgaaatttttggaaccatagattacatatttgggaatgcagcagtggttttacaagcatccaacattatcacaaggatgccaatgcttggtcaattcactgtcatcactgcacagtccagagattcccctgatgaggacactggcatttcaatccaaaactgttcaattctagccaccacagatttgtactccaattctggtagtgtcaagagctaccttggaaggccatggagggtctattctcgtactgttttccttgagtcctacattgatcaatttattgacccaatggggtggaaagagtggtctggtgatcaaggcttggacactttgtattacggagagtatgctaattatgggcctggttcagggactgataaccgagtcaattgggctgggttccatgtaatggattatgacagtgcctacaacttcacagtttcggagtttattattggtgatgcttggcttgggtctacttcattcccttatgatgatgggatttaa

SEQ ID NO: 108909 - DNA, 210 bp, Glycine max
  Peptide Sequence Number=SeqID_225687
atgacatatacagctaaaaaagggtcagagggtgcaaagagggtcaatcggacaagcccaaaaatctcttatgacttctgggtggcaagctggcttgccggaccaggtcaaattgacccattaattttaaaaggaaaaattagaccaggccgaatggagttgctattggtcctactacagttgctaattacactactcacgagggagtga

SEQ ID NO: 108910 - DNA, 531 bp, Glycine max
  Peptide Sequence Number=SeqID_225688
atggcatcaaggaaagctcttaaccaatggttggttatgccaatcttgctgatgaattgctttgttttgctgggtcaatgtgcaaggccactgaacacagaagaaggagaggatttgtccctgctagcaaagacatcagatctaaaagtgcttgctgagattgcactgaatctgagcacaacatatgctgcagacactttgtcctatgttcacgagctgcagtctaattcttctgctgccaatggctccaacaacaacatttacgcgtcgcgttgcttaagtgactatgcagaggaatactcagaagccatagagaacttgaaggactcaaaagaagcacttgctaatggagattgtgaccaagtggatacgttggtttctgctgctatgtctgatgctgagacatgtgaggatggcttcaaggacatgcaaagtggggacagtgattccacatctcctcttactgagaggaatcgttacttctctgaactttgtagtaatgctcttgccattacaaaactactagtttaa

SEQ ID NO: 108911 - DNA, 672 bp, Glycine max
  Peptide Sequence Number=SeqID_225689
atgggattcagaaacaccgcaggccctgatgggcaccaagcagtggctgcaagagtgcaggcagatcgtgcggtgtttgctaactgtcggtttgagggataccaagacactctatacacccaagcccacagacaattctacaggagctgcatcattgcaggcacgattgacttcatatttggcgcagctgtggtgttccagaactggatgttccagaactgcatcatggtagttaggaagccactggacaaccagcagaacatggtgactactcaagggagggtggacaagcaacaagccacaggaattgtgctgcagaagtgcacaatcaaatctgatgactcactggttccagtgaaggacacgatcaggagctaccttgggaggccatggaaggagttctcgagaaccgttgttatggaatcggaaataggcgacttcattcacccagatggctggacggcttgggcgggaaactttgctctcaagacattgtactatgctgagtatgccaacacaggacctggtgccagcaccaatgctaggatcaagtggcctggttaccgagtcattaacaaggatgaggctacccagttcactgtgggctctttcatgaaaggcacatggatccagaacacaggcgtgccctctacacaaggcttgtacaattaa

SEQ ID NO: 108912 - DNA, 426 bp, Glycine max
  Peptide Sequence Number=SeqID_225690
atggaacgtattccgtgtttcattatgcagcgccctaaagcctcagtgttattccaggtgtcagattacatacaaggtttaaagcaaaaactggaagaattgaaccagttaacagtggcaacggcacgaaaaatcgttgactatgatccaatgcctaagcttgaagttgaaacacaagaagagggttttgtgatcaaggtgctgagtgaaagcagttgccaggggttgctggtgtttatattggaagcctttgaagagctggggcttgatgtgctccaagctagggtttcttgtgcgcacagcttcagtttagaagctctcggaaacaaagagaacaatgaagatactcgcccattggatgcacaactagttgagcaagtagtgtctcaagctattcaaaactggagggaagtttcacagatataa

SEQ ID NO: 108913 - DNA, 306 bp, Glycine max
  Peptide Sequence Number=SeqID_225691
atgaagactgcatgcagtaagcatgagatcatcatccagacagatccaaagaactgtgagtacgtgatcatcagtgacagtggtgctcaaagaaaaacagaggattttgatgttgaggatgcagaaacttttgaactaccagctgacgaagagagagaaaagcttgctgaaccagtgattgtatgtctccacgtcaaaagaaaagagttgctgcagaaaaaactgcttccagcttcagagggcattgatcaatgctggctccatcttcccaggattatttccaagaatgtgagtcttgaaatgtaa

SEQ ID NO: 108914 - DNA, 318 bp, Glycine max
  Peptide Sequence Number=SeqID_225692
agatctttcttgatcggtgctgttgtggtttcctcctttggttaccgcaaagagcgtgatggctctttggtaaaaaatggtgctcaaccaaatgatgatgaaagacacttaccggttgaaggagactcttctctccttcagagtattttggacaggtttgatggacttcaaacctatgttggtgagaggtttgactccttggaacgtcaagtggacacacgattcgaggagatgaactcaaggattgcaaaggttgaagaagatgtcaccatcattcgtgactgccttgatttacctccaccaccaccatcagtttag

SEQ ID NO: 108915 - DNA, 2394 bp, Glycine max
  Peptide Sequence Number=SeqID_225693
atgggaagttttgggaagatggttgcctgctttcgttatgcttcaattcaccttcattctgtttatcttcccccacccaaactggaattcaactatgatagtcaggactggctacaaaaagaagcaaatgagctgcataacaaggctgaaatactgtttagtgaagtgtgcaatgtgctgcatcaaatttcagagaaggtttcaggtcctgtgttgcaggagggtggaaatagggtgtcagattttaggaatctagttgctgaacttaaagggatgctgctgtatgagaaagaagaatttgaggactcattacaaagattgctgcataaagagggcaaagttggtcagcctgtgattgatattctagagctcaataagttgtgcaggcatatccatatccattcttatgtttgggaccagcgcttgatatatgcatccaatctaagtaaaattattcttcaagaaaacttgaagagcttaaatcatagagagaagttgcttggttctagggaaaaggttatcgaagcagatgttgccactaggccagcaagaggccatagcagttgtgattcctttcttttgggaacaaaacctgatggaaacctaaatttagaaaacactagccaccttagccaccctgtggtcaaaagtgaggacaagggcaaagacacaaatcatgataaggttgatctttctctttctggtggtgccaatatcaatgataaatctgattctgtggagtttggaggggctgtacggagggctttgtccgagggggaatctccttttgtggctaatttatctgatacccttgatgctgcatggacaggtgaaggtcatccgacaaatttatcactcaaagaaaatggttgtctacctcctgatgcagcagctgtggctgttcattcacctgtggcaaatatagttacatcaaaatcaaattctgatatttatagtgctaatataggtgggattgaggcaggatgcactaattactctaaattgctttccaaaggacttgatactaaatggaaaggaataccttttgcaaatgtctttggttcattcaacaaaacttcttccttcaatactgagaagcttgttgagtacaacccagttcacattttatcatttcgagagctggagcgccagacaggtgctagattgcttcttccagccagcactaatgataccatagtgcctgtctacgatgatgaacccactagtgttatagcgtatgtgcttgtgtcaatggattatcatatgcagatgttagaatatgatagacctaaagagagtggagacagttcaatttcattgccactctttgattcaacaagtctactttctctcaactcttttgatgagacaattactaatacctacagaagtcttggctcttttgatgagaatgtgttacccacttctgggtctcggagtttgccggctggggatccattctcatacacaaaggatttgcatgcaagggtttcttttactgatgatggctcccttggaaaagtgaaatatactgtaacttgctactatgcaaaaagatttgaggctttaagaagaacttgttgcccttctgagttagattttgtgcggtcccttagtcgttgtaagaagtggggagctcagggaggaaagagcaatgttttctttgcaaaaaccctggacgatagatttatcatcaaacaggttacaaaaacagagcttgagtcgtttactaagtttgcaccagcttattttaagtatttatctgagtcaatcagtacaggaagtccaacttgtcttgcgaagatcttggggatttatcaggtaacatcaaagcacctcaaaggagggaaggaaacaaagatggatgttttggttatggaaaatcttctttacaggcgtaacattagacggctttatgatctcaaaggttcttctcgttcacggtacaatccagatacaagtgggagcaataaagtgctgctggatcagaatctcattgaagctatgccaacctctccaatatttgttgggaacaaggcaaaacggttgctcgagagggctgtgtggaatgatactgccttccttgcatcaatatatgtgatggactactcattgctggttggcgtggatgaggaaaagcatgagttggttttaggtatcattgattttatgaggcagtatacatgggacaaacaccttgaaacttgggtgaagacctcaggcatccttggtggacccaagaacacttctccaactgtgatatcaccacagcagtacaagaaacggtttaggaaagccatgagcttatattttcttatggtgccagatcaatggtcccctccagagttacaccccagtgggtcccaatctgacatttgtgacgaaaatgcgtga

SEQ ID NO: 108916 - DNA, 222 bp, Glycine max
  Peptide Sequence Number=SeqID_225694
atgggtgtatatgcctcaagggttttaagtaaggaagatttggaagtgtatgctgaagagctcgttcagcgtgcaagattcgctaagcgaggcgacccgctcagcacgaaagagagcatgttcaatgcgaagaaaaaccctagaaagcacgaaatcagagagagccgcactcggcgcgcagccaactcgtccaagaaagtttttgtcgcttctcgcgcttag

SEQ ID NO: 108917 - DNA, 1137 bp, Glycine max
  Peptide Sequence Number=SeqID_225695
atggtggaacatgctaatcagggatctaagtctcctgaattctggccactgcttttgggtttaactgggaatcttgcatctagccaattttcctccccctcctttgaccatgaagttcgtatatctactaagcaaggtggtcaaggtgctaaaggtttggcttggcaccatgccaagtgtctcatcgatctgtcaccatcaattgaagtggataagttatctggatggaacaatctctcatcttctgatcaatcagctgtcattgacttcgctaaaaagggtggtagtgatacaaaaattgagactgaggagggtaaagaatccacaccacaacaaacttccaaaggtggcataaaacgggggaaggatgttgatagtgagcggaaatcaaaagttgctaaggccaagggagatgtgtctgtgggcagcgcaatgtcagtgaaatcaggggaagcatgtgatctggagaagaaaatggagacccaaagcaaagaactctgggatttgaaggacgatctcaaaaagcacgttacaacaacagagttgcgtgaaatgttggaagccagtggtcaagattcaacaggatcagaacttgatttacgtgaccgctgtgctgatggaatgatgtttggagcacttgatctttgcccaatatgttctggctttctgcgttactctggaggaatgtaccggtgccatggatacatttccgagtggagtaaatgttcttactctacctgtgaaccaaaacgtattgaagggaagtggaaaatcccaaaagaaacaaataatcagtaccttaaaaagtggttcaaatctcaaaaagggaagaaaccagttaggatattgcctcttccatcaccaaggaaatctgctgaaagtcaaatgattgctagtcagcatcaatcatcaaatagtggaaatttacgagatttgaaagttgctatctgtggattacctaatgactctattgcggaatggaaatgcaaaattgatggcatatgtgggatgtttcatgcaaaagtaaataaagatactaactgcttggtggttggtggatcactcaattatgaagctgagatgcggaaggcaaggtatgatgcactcaaattgtcaatctcaactttatttgattaa

SEQ ID NO: 108918 - DNA, 684 bp, Glycine max
  Peptide Sequence Number=SeqID_225696
atggttatggattcgtggaacgacgtcgctttagtgtcctcggagatggagaagttcctgtgcgagttgttgctggattcctcccagccaatttctgagcgcttcagagcattcttctctctccgcaacctcaaaggcgcctccactcgcaacgctcttattctcgccacaagggattcgtcgaatttgttggcgcacgaagctgcatttgcgttgggtcatatgcaggaattggaagccatccctgctttggcctcagttctcaatgatctttctttgcatcacattgttcgccatgaggcagctgaggctctgggtgctattggttcagatggtaatgttcctctcctgaaaaatagtttggattcagatccggccgaggaggttcgagaaacatgtgaattggctcttgaacgaattcagaatttaaaagatgctggtaatactgatgtgttgctgcgaatgatgtatctacttttatgtctgttgatccagctgcaccagcgacccctggttcttctgttgataaaccaagacaagtgcttattgatgaagaaacaagggatgtatgagcgctatgcagctctttttgcacttcgtaatgacggtggaaatgatgctgttgctgctattattgattccttgggctcaaaaagtgctctactgtgccatgaggttcgataa

SEQ ID NO: 108919 - DNA, 852 bp, Glycine max
  Peptide Sequence Number=SeqID_225697
atgaaccttgtcactctccttctgcctctgatcaatccccttctcctccttctcctccttccaatgtctgtatgcagaaatttaggctatatgagactcgatcgctttgaaagtgggttgtctcttgcttctcatcatgctttagatccttggatgtatgtattatcatccctgaacttttacatgataggaagggacaagagcaggacatattggaaagtactaaagattgaccgtcttgatccttccgagctaaatttgcgtgaagattccaccacatatacagaaagtgaatgttctgatcttttgagacggatacatgagggtaacaagtccacaggtggactaaaatttgttacaacttgttatggaattgtagggttcatcaaatttttggggccttactacatgctgcttatcacaaaaagaaggcaaattggtgcaatctgtggtcatacagtatatgctgtctcaaagagcgagatgattccattgccaaattcttcagttcggtctaacatcaattctaaaaatgaaaacaggtacaagaggctcctatgcatggttgaccttacaaaggatttctttttcagctactcataccacattatgcgtagtcttcaaaggaacatgtgtgatgatgagacaggccatattctttatgagaccatgtttgtttggaacgaattcttaactcgaggaattcggaatcacctccagaatactatttggacagttgcactagtgtatggattttttaaacaggtgaagacaggaaatgcttatgatatccagacgggagttcacacttacgctcattgcaagacgatcacgtcattatgctggcactag

SEQ ID NO: 108920 - DNA, 177 bp, Glycine max
  Peptide Sequence Number=SeqID_225698
atggacacgcgagcagtgactaagaagggacgcaagaaattgaacccgcgtgcatgggtttgccgatgttgggttgattggtcggtggtgattgcttttggctcaattgttttgtggggatttgcctatgatcaggcatttgccaccgccaccaccaccaaggtgatggtgacgtga

SEQ ID NO: 108921 - DNA, 1536 bp, Glycine max
  Peptide Sequence Number=SeqID_225699
atggcatcctctgatggtagagttacgtattcttcattatctaagctagaaaaggagaatacccattttggctacgatgatataaatcatcatgttgaatctgtgtggtctgagcttatgcctggtaccccgtgtggccaattagtcccaacgttgtctaacaaagagacattgtatcagtttccctctgaggatgatgacttgtttgatggaggttatgaatcaggtgatgatgctcgtggtattgtaccctctaacaggccgcctgaggtgaacttgaagaatgtgctttctgggatctttgctattttgtctggacggaccaaggctccgagtgttactgcaaaccagcagctcccaagttcaaatgtgtcattttttgactctggaaagaatggggatgttttccttgactcttcggtgtacacgccaagtgctccgccactttgtctgccaaatggaattgattatagttcttacaaagaggtcttggaagctgaaccccctgagtggctccctgatagttctactactgtttgtatgcaatgtagtgctccttttactgcgattacccgtggtagacatcattgcaggttttgtggggggattttctgtcgaacatgtacaaaggggcggtgtttaatgcctgttgggttcagggaaagaaatccccaaagggtttgtgatgcctgctatgatcggcttgatcctttacagggcgttctgatcaacaccataagcaatgccgtacagggggctaagcatgatgtcacggactggacttgtgctagaggatggattaatcttcctattggtttatctatggagcatgagatttataaagcatctaatacattaagaaactactgtcaggtggccaaatccaatcctgagaagtccattcctttaactgttcttaaaagtgccaagggcctagcaattttaacagttgctaaagctggtgcactagtctcttacaaactgggtactggcttggttgttgctcgaagatcagacggatcatggtctgcaccgtcagcaatattctccctgggtttaggatggggtgctcagattggtggtgaacttatggattttatagttgttcttcgtgatatgaaagctgtgaagacattctgcagccgtatgcatttttctctgggtgctggttgtagtgctgcagcagggcctgttgggagagtgcttgaggcagatattcgtgctggtgacagaggctctggcatgtgttacacttacagttgcagtaaagctctcaggggtggtgctatgataggtacttggatgatgtttgaaagtatagctaacgacatggaatgttgccaaactgtaggtgcatttgtgggagtgtctttggaaggaaatatagttgcaaccaggatggatgccaatttgtgcttttatggtgatccttacctcaccacatctgacattctactgggaatggtggacagaccaaaggctgctcaacccttgtatggcagtcttcaagaactatattcctgtctacgattctaa

SEQ ID NO: 108922 - DNA, 627 bp, Glycine max
  Peptide Sequence Number=SeqID_225700
atgactggttctggttctccttgtggagcctgcaagttcttgagaaggaaatgtgtgagaggttgtgtttttgcaccttacttttgtcatgaacagggttccactcattttgcagccattcataaggtctttggtgcaagcaatgtctcaaagcaccttgctcacctccctgtgagtgaccgttgtgaagctgcagtcacaatctcttatgaagctcaagctagacttcaggatccaatttatggctgtgttgctcatatttttgcactccaacaacaggtggtgagtttacaagcacagctagtttatctcagggaacaagcaagtcagatctatctcaatggctctgccactgaaaaccctaatgagaaataccttggaaaacctactactttccctcaagatctacaaagttggttccagatggaaaattccaacttggcttcacaatttctccctaacttgtccaccaatccttcaacacagtattatgggaatactaatactctcgtggaaccaaaccctattggaaattatgaaaattcaggaaccgtagaagaaagtatctcattttctagctttaaagagagttgtaactctatgtcctatgacatgcaaaggcagtga

SEQ ID NO: 108923 - DNA, 599 bp, Glycine max
  Peptide Sequence Number=SeqID_225701
atgcctggtgtcatttcatatctcgagtcgtgtccagatgtgactgacctcaagatagcagcgtatccaccatgtccgcacgcactggtgtcgcgatggacttgtactcatggacaaaacgtattgacactaccatccgatctggttcagtttttgaaatgttctgatggattgcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 108924 - DNA, 321 bp, Glycine max
  Peptide Sequence Number=SeqID_225702
atgactgctccagctactcaaacagtaattaccgttggacagacgctctacatcaacaatataaacgaccgtatccggaaaaaggaactaagagagtcgctgtactatttgttttcacaacatggtcgagtactggatattgttgctctcaaaaccatgaaaatgagaggtcaggcatttgttgtgtttgatactgcaccagctgccactgttgccatgagagaactgcagggattcccattgtatgacaagaacatggtaagactagagttttgcagatcgtcatgttgcattgatatttcaactggatttggttgttaa

SEQ ID NO: 108925 - DNA, 306 bp, Glycine max
  Peptide Sequence Number=SeqID_225703
atgccgatctccccctacggaagggtcatgcccacaagacacccagtggacccggaggagcccaacagggccctggggtttccagctctagtttcgggcctctgtcagtcctacagggtgcccgtccccccagcaaggtcatgccatcgtgacatagggatcgcgcccgcaagacacccagtggacccggagaagtctaacggggtcttagggtttccagctctggttacgggccgctgccagtcctatagggtgctcgtcccccccaacaagatcatcaggccccttttaatagggctttcatag

SEQ ID NO: 108926 - DNA, 849 bp, Glycine max
  Peptide Sequence Number=SeqID_225704
atgctcatatcaaacaacattgagagactaaatcatgtatggtctgaaacatgggagttcctaattgatggtatctttcatcaacagagaaggataagaaacatactagatttacagttggaaacagaagagttacaaaacttggcattgcttgagattgaagagatattacaatccaacaaaaacattaaaggattatccaaccatgccttttccaacacatttggtgttgtcacattttggtactgggaagacctttatatggaagacattagcatttgcattctattcaaaagtccaacctacctcacattgacaaatgcacaagaaatcaagagcttttcccaatggctgataaatgttggagatgagaaactaggcaaaggtgatgatgaacgttatgagatagaattttcacctaatattttaataacaaacttcattgatcctattgaagcaattgtaaggcgtatctacccaaatatccagaagaagtataaagatgaggaatttctcaaatctagagctgcaacaaatgaggtggtataccaaattaatgactatatattaaacatcatcccaggtgaagagaaagaatatttcagttgtgactcaattgacatgacagatgttgcaacaactgaatgttatgaagcagttgtcgcaacctgcccttcggcgggagggcgacgcgagactcgcgggaggcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaaggtattag

SEQ ID NO: 108927 - DNA, 1671 bp, Glycine max
  Peptide Sequence Number=SeqID_225705
ggatcaaacgattgtgggccctctagtcaaatagtcagatgtctttcttttcctgaagagaacaaatcagctaatggtaaacgtacgccagagcgacgagaggcagtgggcaggcaggcaatgctgaagaatttattggcttctcctgatccatccatactggttggtgaaatccgaaagcttgaggatcggcagctccagctctgtgaggatgcaaatcgagctcttgaagttctgcaccaggattttgcaactcacaaacttgggaatcaagaaactgctgaaaccatgtcgaaagtactatctgaaataaaagacttagtagctgccagctctactccagaagaaattgtggcagcagataaggccgacctaatggaaaagatcacacagttgaaaaatcaagggaacaccattgcatctttagaaaggaagctggagaatgttcaaaaatctatagacaagcttgtgtctgcttttaatgcagaggagactccagaaaacaagacgacccctctgagaaggaagaaaattcttcctttcacattaagcaacagtcccaacatgcagcatataatacgtgctccttgctcgcctctctcctcttcgcgtaaagcaatggaacatgacattgagaacagggcaccggaaaacaacattggcatctctggcagtgattcttttgctaagtttcataaagatactccacgaaaggatgataaaagttgtgattctattttatcacgggcaggaagcccagctacaaggaaatcaaaatcagtgaatgtgatgaagattcaaaagatgttcaagaatgctgcggaggagaacattcggagcttcagagtttatgttaccgagttaaaagagctagtggcaaaactgcattaccagaagcagctactggtttgccaggttttggaactggaagcaaacaagtcattaaatgaagaaaaggatacacctgatcggtctcccttgccatggcatatactatttgatcagcagagaaagcaaattatcatgttatggcatttatgccacatatctcttgtgcaccggacacagttttttcttctgttaggaggagacccttctgatcagatatatatggaagttgaacttagaagattgactcggttagaacagcacctggcagagcttgggaatgctagtcctgcacttctaggtgatgagcctgcaggctctgtttcagcaaggtatgctcgtgtctttgaaagacatgtgtcttttttgacaattcctgctagtcctgcacttctaggtgtctttgataattccttaaatcaagtgtctttgataaagctcgtgtatttgaaaaacagcattagagctctgaagcaagaaagggaacatcttgctaggaaggtgaacactaaacttacagcagaggagagggaactgctttatgcaaaatgggaagttcctccagttggaaaacaaaggagactgcaatttgtaaataaattgtggaccgacccttataacatgcaacatgtgcaagaaagtgctgaaattgtagcaaagctcattgatttcagtgtatctgatgaaaacagcaaggatatgattgaattaaacttttcaagcccttttaataagaaaacatgggcgggctggaactttatatcaaatcttctaaatttgtaa

SEQ ID NO: 108928 - DNA, 1059 bp, Glycine max
  Peptide Sequence Number=SeqID_225706
atggcattagtgagaatgaatcctgcgctggcgcatttctccctggcgatgtcactgaaaattctgtcatggcttccggtgaaagcacttttgcgattcaggtgcgtttgcaagtcttggaagtctcttatgcttgatctctctttcgtgaaactgcaccttcaaagatcatactgcagagacacccccgtcctattcacgttattaaactccaactccaaggaagaacaatgctccctacactactactgctccatgcaacgtttactcgataacccattatccgccattgatgacggtgacctcccattcaatcagaatctctgggactactttgcaaaaaggccatgccgattttggaacccggccacaaggctaaggtccaaaaaatcaccatgcattatgtgctatattcatacgttgattggctttggctacaatgattcaagcgacacttacaaggtggtggccgtggttaagaaatcacgggcaattacggaattgagagtttgctgtttgggtgataattgttggagaaagattgcaacttggactgattttctccgtgcaattcatactaaggggctgtttatgagtaacactcttaactgggtaggaagactttacactacccatcagaatgcaatcttttcctttgatataaggaaagagacatacagatatttgtcactgcctgttgatgttgatgtcctgtctgatgacacagtgattggagttttaggaggttgtctgtgtctttctcatgattacaagagaactcgtctcgctatttggcaaatgaaggaatttggagttgagaaatctaggactccgttgaagaaggttagttatgagcatcttcaaatttctacatcttcgtcttggatggccatgcatgcaaatggcgatgtcaggttggtggcaagcaaatcagagtttggacttgttctgtataaccggagagagaatagagtaaagcctaatgggatgttctccaaaacagttattttggagtccactcaatacgttgaaagcttggttttgccttatcgaatttga

SEQ ID NO: 108929 - DNA, 786 bp, Glycine max
  Peptide Sequence Number=SeqID_225707
atgaatcgtggtcgctatgatgatgcagtagttgttctcccttgcgagctccaagtggaaattccgccatggcttccggagaaaacacttttgcggttgaggtgcgtttgcaagttttggaaaaccctagttttcgatcctattttcgtgaaactgcatgttgaaggatcacgcagagacaccaccccacgctactgctccatgcaacgtttactcgatgaccacccatcactcatggatgaagttggtggccacggattcgatcagaagtgccacaacatggttggggttaagatcccaaaaataggtacttgggaagcgaagatgggctttggctatgatgattcaagcaacacttacaaggtggtggcagcggttcaatactcctccatgcaattgaaaactgaaccgagagtttactgcatgggtgacaattgttggagaaacgttgcaagttggacaagttttccccgtatagttcaaggaaggagacacagatatttgccgctaccggttgctcttgatataccctttggtgacctcctagaaatggttaatcatgaggctcttcgaaaatctgtttctccgcattggacgtccatgcatgctgcaaagggcgatgtaaagttggtggtggcaaacattcaagagttggaacttgttctgtgtaatattggaggagtaaagcttaatggaatagttttcttggagaccatactagctgatgatctattccctacaccttctgtaacgatgttcaacatgcaattgtgcaccatatattga

SEQ ID NO: 108930 - DNA, 1705 bp, Glycine max
  Peptide Sequence Number=SeqID_225708
gtatttgaggcgtggtgttaatgagaaaggaagagtagcaaatgatgttgagacagaacaaatagtctttgaggatgttgctgaaggtcttcccatccaaataagctctatcatccagaaccgtggttcaatccctcttttctggtcacaggaaacttcaaaactaaatattaaaccagatattatattgtcaaaaaaggatcagaattatcaagccactagacttcactttgaaaaccttgtcaaaagatatgggaatcccataattattttgaatttaataaagacccatgagaagaagcctcgcgagtccatacttcgtcaagagtttgctaatgccatagatttcattaataaagatttatccgaggagaacaggcttagcaaagctacaaatgtcttgcagcttcttggcaaagtggctgcatatgcattgacattaacaagttttttctattgccaaacgacaccaaccttgagaccagaagaaagtctgaaatggcaaagtacagacagtgttgatgagggaaccttttcacctactagacatgccaatgatgataatggggatgctaataatttagagaggaaaccaagtgaaggaaacaatgatgccaatgaaaatcattctgtcaaaccacccatgttgcagaggggggtgctcaggaccaactgcatagactgcttggatcgcactaatgttgcacaatatgcatatgggttggctgctcttggccaccagctccatgctctgggagttattgaccacccaaaaattgatcttgatgaccctgtagcagatgatttgatggggttttatgagcggatgggtgatacactcgcacatcagtatggtggttctgctgctcacaacaagattttctctgagaggaggggccagtggagagctgcaacacagtctcaggagttttttaggactcttcaacgctattatagcaatgcatacatggatgctatgaaacaggatgcaatcaatgtattcctggggcattttcagccacaacagggtaagcctgctctatgggagttgggttcagatcagctctatgatgcaggaagacatggagatgacgatgctaggtcatttttcaaaagatccttctcagatggaaacattcttaatgaaagttctacaccgatgtcagccccaaaggccaagcatgaaaaattcccaagccaaggcggcttaccagatcgatcagaagaaggaagcaagggactctgtgagtcatcaccagaaatatctactactgagagtgacatctcattttcaaggtacactccctcaatgcctcggagacagctctttggagatatgcaaagagagcgctgccttgaaagtgaacatatttactattctgatcacggggattccttcagctgctccaactttgttgacctggattggctatcttcttcaggaaattcatgtgaagaagagccatttgagaggtcatcaattaccaactctccaattgctggagtttcttcagaaaatgttgtcaatggaataatggtaggtgaggcaactgcctccactagtgattggggggcctccagcctaaagggaagggaacaaactgaatccgagttatcctacggtgatgcacggtccaacacaccagaggaatttccagatacttttgtaaactgggtgacttatggacagacactttgccattga

SEQ ID NO: 108931 - DNA, 1341 bp, Glycine max
  Peptide Sequence Number=SeqID_225709
atgacgggaacacctgtggcggtggctgcggcaacgccgaggtctaagatacagaggaatgcttcaggtacgccgggtggccccaaagttcgggaggagaaaattcgagtcacggttcggatgaggccgctcaatacaaaggagcaagctatgtacgatctaattgcttgggattgtttggatgaacacactattgtgttcaagaatccaaaccaagagaggcctacaacaccatacaccttcgataaagtttttgcacctacgtgctcaactcataaggtttatgaagaaggggctaaagatgttgctttatcagcactttctggaatcaatgcaacaatatttgcgtatgggcagactagcagtggtaagacattcacgatgagaggcgtcactgaaagtgctattaaagacatctacgactacattaagaatacaccagaaagggattttattctgagaatctctgctctggaaatctataatgagactgtcatagaccttctgaaacgtgaatctggtcctcttcggctcttggatgatcctgagaaagggactattgtggaaaagctgaatgaagaagtagctgaagatcgtcaacatcttaggcgcttaattggcatctgcgaagctcaaaggcaagtgggagaaactgctttaaatgataaaagctcaagatcacatcaaataatcaggctgactgtagaaagcagccttcgtgaaagttcaggtcacgtaaagtcttacatagcaagtttgaattttgtggatcttgctggaagtgaacgcatctctcaaacaaatacatgtggagcaagaatgaaggaaggcagccacatcaaccgaagtttgttgacacttgcatcagtcatcaggaagctaaggttcaaatctttgaaacagtcgctctacttacagggggataagactgcttacatctatcctttcaatatctcactaggaagaagcctcatgcaccaggctactctttttgttcaaactgaaaatggcggaaaatgtggtcacataccatatagagactcaaaattgacacgaatattgcagtcttcattaggagggaatgctcgaacagcgattatctgtaccataagtccttccttaagtcatgtggagcaaacaagaaatacactagcatttgctaccagtgcaaaggaagtcattaatactgcccgagttaatatggtcgtttcaaataagacactagttagacagttgcaaaaggaagttgcgaggcttgaaggggagttacgaagccctgacctttctgtgaattcatgtctaaggtcattgctagctgaaaaggagttgacaattcagcag

SEQ ID NO: 108932 - DNA, 288 bp, Glycine max
  Peptide Sequence Number=SeqID_225710
atgacaaaacctaggtttcaatgcacaagttgctcctcttttctgcttctagggctcttttccccaaataggcctgtggctgctctggaattctgtgccctggccgtctgtaaaagctgtcataaaggtggctctgaaaccgcgacgctgcacttagcgccaccctcgcgcttagcacggctgtgcttagcggttgtcgcaacctacccttcggcaggagggcgacgcgagggctcacgggtgcgtcttccatgggagaaagatgcacggagtcgccaccaacgttaa

SEQ ID NO: 108933 - DNA, 228 bp, Glycine max
  Peptide Sequence Number=SeqID_225711
atgaaatgcaaaaattttccaggaaaagttggtgaagttgctttcaaaattgatattagtaaggcttttgataagatgaatgacatcttttttggatgtgatcaagtcaagaaagtttgggaaactgctggcctctggaatacagtccacacgaacatgcaaggagcacaatcaacaaaggctctcatctccaaacgtatagatgctcttctagatgatcttaaatga

SEQ ID NO: 108934 - DNA, 291 bp, Glycine max
  Peptide Sequence Number=SeqID_225712
atgcataacaaacattctatcctctgtcgttgtgacgctgacaccgaaaaagaggaggatggagaggttggaagtaacgacatcggtgaggccgaggcaaaggctcatgatgaggaggtagttgaaggggaggtaaatgcggattgggtggaggaaggagtgggtgaggagatcggggagggagaagataaggtaggtgtaggccattcaggtgatgttgaggtcctggtgcaagagatcaacgaggatattggatatgttgagttaaggagtgatactaggatggagtag

SEQ ID NO: 108935 - DNA, 320 bp, Glycine max
  Peptide Sequence Number=SeqID_225713
atggctcacgccactcaggccgcagcaaattgcggtaacacacccagccagctcagcgtccatgccagcacattcagcacgccgaaaagcagtaccaggccaatcgccagtggcgtacgcggccgatcggcaaagcgctgttgcgcacgccgcgccagcagcgccggaataatcaccgcccacagcgtggcaaacagaccggcaaaaccgatggcggcgacgaagccatgcggccaccatagcgaagcgagcagcggcggcaaaaatgtcaggcaagcggtttgtagccgcgcgcgcggggaatgcccccagccgaggcg

SEQ ID NO: 108936 - DNA, 897 bp, Glycine max
  Peptide Sequence Number=SeqID_225714
atgcgtatttttataacgggtgcgacgggctttatcggctcacgcgttgtatcggccctgctggctcgcggccatcaggtgaccggtcttgtacgttcagaagaagcagctcagcagttaaacgataagggcgcgacagcccagcgcggtacgctggaagatccccatgcgtggattgccggcattgaccaatgtgatgcggtgatccacaccgctttcgatcatgatttcagccgttttgtcgaaaattgcgaaaaagaccgccgcgttattcgcgcgattggctctgtattgcagggcagtcagcgtccgctgctcatcacatctggtaccggaatgggtgatgacggcagcggccagcccgctcttgagcagaatttcaacccggcacaccctaacccacgcgtcgcctcggaactggaaggtactaagctccttgaatcgggaatcgatctgcgtgtggtgcgtctacctcaggttcacaacaccgaacgtcagggattaatcagctattacatcgctcttgccagggagaaaggcgcggcagcttatatcggcggaggtgaaaacgcctggtgcgcggcacacgttgatgacgtcgcggggctgtacgtaaaagtgcttgagcaaggcgaacgcggcaaacgatatcatgcggtagcagaggaaagcattgcctcacggctgattgctgaaaccgtggcagcagggctgggtattcctgccgtttcgctgaaacccgatcaggccgcggagcatttcggctggttcgccgctttcgccaggctggatctgcgtgccagcggtgcctggacgcgtcagcagctcaactggcagcccaaaggaccgggtcttatcgctgatttaagcagagcgaattattcaacccagtcgtag

SEQ ID NO: 108937 - DNA, 3657 bp, Glycine max
  Peptide Sequence Number=SeqID_225715
atggcagtggagctgggactcttgaagggctgtcatcctcttctgacagatatagatgttaccgtaaatccttctaaaggatcagttgttgtagaagaagtaaggtcaaataaggatgctaaagttggcacactgttggatcttactcggtcgggtgcatttaatgggtactcagttgatcccactgaagatttgcttggagaaaatcagaatgacactggcctcctatttagttcccaacaaggtctaaaacagaactttgagcaggatgatatgagcttacagaggaatgttgtctcggttgatagtgaacttggtcaagttctacaaacagcacaagtggtaataaatatgctagatgttaccatgccgggtactctaacagaagagaggaagaaaaaggtgttaactgctgtgggtcaaggagagacactcatcaaagctttagaggatgctgttccagaagatgtccgtggaaagttaacagatgcagtgactggaattttgcatgcaaggggctctaagttgaagatagataggattcttaatatttctcaggctcctgaatccttatcagggcaaaagaaccaagaaaaattcagagtatctggtgcagaagttatggttgaagaacagccctctgtgaatcagatgaaaaagactagtagtcctatagatggctctgataatgctccagatagcattgacaaacttgctgaagaaacagaaacagaagttattcccatagagaaatcaccaaattctacaaatttagcccagtctcaagaatcaaatgatgaagttggttcttctggttctttaaggaaggaaactgacgaatctaatgataataatgacacaaatgaggaatcaaagggaaaagctgttcctgatgttggtcatagcaagaacggattggaaacaggttctaaaccatactctcctggccatcctgatggagcaggtggctttgaatcagcagctgtgggtgagcagaaaagccaaaacagtggaatagctcaaacagacccaaaggaggaaaacactatcctgaaggatgaacagaaaagtcaggatttttctggcgatcatagtaaaaatacttcaactgatgcaaaagaaggaccctcttcaccttctatgtcctctgagcaccaaacaatagaaagggaaggtaatgataatgagaaaaaagataataagaatacgcatcatgtttcacaccagaccaactctaataatttagcttctagtgcccctgccttcagtgtttctcaagcattggatgccttggcagggatggatgattccacccaagtggctgttaatagtgtttttggtgtgatagaaaatatgatatctcagcttgaacagagctcagagaatgaagacttcaaggatggaaaagatgttgaacagaagatagaagaaaaacaaaaaactaattgccaaagaaaggattccaacacatctgctgatccttcagtagatgatcaccataatgatatgtacttgaataatggttcttgtcatacagaggaacaagcagctcaaagtcttggtgaaattaatgggaatggtatattcaatgctaaaagttgtaactctaatgatcacctagttcagaaggaaaatagtacaaatactcaactgattgacaaaagatttctcattggtaaatgggatggacacagacacatggatagggtgccagagttcatagctggtggttcatacgggacccctccttacaatgaaaatttccataaatatcttgtttcaaagattcctatcaaaccacttgatttagatacaacaactgcattattgcttgactatttcccagaagaaggtcaatggaaactttttgaacaaccacaaaacatggaaattgcttcttctcatactgaaactagtgaagaggctgggcccaaggtgaaggctccctcatctgcaaaatcttctaatgcagagcaatatattgaaccactatatgtaatattggatactgaaaagcaacaagaacctgtcaaagagttcattacaacagacacagaaaacagaatgactgacataagtgatgacaggtcagatgaattgatgcaatttgtgaaacacagagtgttacattctttgaagatggaagttggtcgcaagctgaatgctgctgaaatgatagaaatgaagtcaaagcttgctgaagatatggaacacgtggcaaatgcaatttcacaagctgttgtacatagcaaggtgcaacaactatatactgaaagtcaaggtcataatgttgagggtgctatagaaaaggtaggtactcttgaaggggagcatgtcattagtgtaatttcttcatctattcagcaaacagactgccttagaaaagtggttcctgttggtgttattgttgggtccatcttagcttccttgaggaaatattttaatgtcactacacttcaagatgatcacagaagatctctgatccatgatgatgaggaaaaacctagtacaaagaattatggcaatgaaggtgtaacggatatagatcaagtacctgacgagaaaactagtttggaccatcctattcagacagagacagtagaaagtgcatcaaaagatactggcaaaaataatgtcatggttggcactgttacagctgctcttggggcttctgctttattcatgcaacagaaggatccccaacaagaaaatgaaactgctgaaagctcatccacatctttgaaaatgaaaaatcgccataaaaaagagccagaacggcttcaggaggaggcctctgagaagaaccagaataacatagtcacaagccttgctgaaaaagccatgtcagttgctggtccagttgtacctactaaagaagatggtgaagtggatcaagaaagactggttgcaatgctagctgatttaggacatagaggtggcttgttgagactagttggaaagattgctttgctatggggtggtatacgtggtgcaataagtttgacgggcaggcttatctcattcttacgtatttctggacgccctttgtttcagaggatttttgggtttgctggcatgacccttgttctatggtctcctgttgctattccattgcttccaacaattgttcagagctggacaacaaaaacttcttccaaaatagctgagttcgcttgcattgttggcctgtacactgcaatagtgatacttgttatgttatggggggaaagaatccgtggatatgaaaatgcatttcgacagtatgggctggacttgacatcaccacaaaagctatttttgatagtgttcgaaagacatacagggaacccgtcaattcctgtgctatttgagttcttgaaaggcttggttggtggggtcatcttcattttttcaatccatgctgtgaatgcattacttggttgtgcaagtttctcttggcctcatattccaacttctttagatgccataacttggctaaaagtgtatggacatatggatctggtagttgttcaaggaactgtgatggcaagtgctattgcagtggtggaagaattgctttttaggtcatggttgccccaggaaattgaagttgatcttggatatcatcagggaattatcatttcagggctggcattttctttcttgcagagcttataa

SEQ ID NO: 108938 - DNA, 1536 bp, Glycine max
  Peptide Sequence Number=SeqID_225716
atgatggtgctggcgctaacttcctttgcacccgcggccaaaccctttcgatttcgaccccgctcgttctggcgccggaggctcaaaatcaataactctctgccactgccttcacccgctcccttcgagaatctcttccacagcttaataacgcacttcccttccgtgaattcactcaatttgattactcccgctctcggcttcgcttccggcgtcgctctctcctcctcctcctcctcctcctcgcgctccaataactattcctccgtctccgacatcggcgagtggctcctgttcgcgagtccgacgccgtttaaccgcttcgtgctactgcggtgcccttcgatatcgttggaggggggagaggacccgagtgcgaggctggttagggaggagaggcactacgtgagaggagggaggattcaggttcggagggggagggagagggagagggaattggaggagctcggttatcagagggtgtgtgtgagtgctgctgatggaggcgttgtttctttggattggcctgataacttgcacttggaagaggagcgtggattggacactactctcttgctcgttcccggcacgccgcaggggagcatgaacgccaatgtgaggttgtttgtggtggaagctctcaatagggggttcttccctgttgtcatgaaccccagaggatgcgctgcttcgcctctcaccactccccggttatttacagctgctgacagcgatgatatctgcacagctataacgtatatcaacaatgcaagaccatggacaaccttgatgggtgttggctggggatatggtgcaaatatgctgacaaaataccttgcagaggttggggaaagaacgccattgacagctgtcacatgtatagacaatcctttcgatttagatgaagctacaaggtcctctccttatcacattgttactgatcagaaactcactgatggactgatagatattctacaaaccaataaggcactattccaaggcaaaaccaaaggttttgatgtggaaaaagccctgatggcaaagtctgtacgtgattttgaagaagcaatatctatggtacacatgccactatctcagttaaatccccacttgattaatcacatcctgtattgttggattgaaattcaaatccgactttatgcgagcaagactatcttgcttggatcaccgctacctcactccctatccgattcttctcctcaggatattctatcggcttattctccgacaatagatattcggagtatcccctatgagtggatattagttacaaaggaactagtcttaggacacttgaagaggcagaataacaagcagaagcaggcaaaaggctcaaagccaggctttaggaaagattcactacgtatcactatgaatattcaatgcttcgctgacataatattcatttgtctaaaacgaaccgctactcgaatcctaaatggcgagaagggatcgaagaagaagttccatttccttttcatctcattagatcctattcccaacatcgagttgtag

SEQ ID NO: 108939 - DNA, 1014 bp, Glycine max
  Peptide Sequence Number=SeqID_225717
atggggacattgctacaaatcgtaccaataaattctggaagccaggacatgtcttcaaagttcaatttatccccaaacttgtcagactattgtttccaagccattattatgggcaattcttctactggtcagattacagctaggacctcaactacttttgcagtcaacaacaatgctgaaccaatagtttttattactgaaatggtgcaacagatgactattttcatccttcttaactttggtacttcaaggatgcacggagtctgtcccgggattgaatcttgtttagtgaagcgaagaagggtattttacttactccttagaagattggattcgagtgtcacactagctgccgttaagcagttaagtaggaaggataggtctattgttgttgtagtagaagctaaaggttgtcaacttacgttctgttccagcttgaaagtgaagacgaagccagccgccggggttggcaggctacttgaatggacatctgagatggcatcaagccgagcacaaaacagatctgggctgctagtaaggagggcaatgaagccttctagcataagtgatgccttcccaagcactcactgtgatgaagagttacgtacagactacacagaggcaactaatggtcgtgtacccaaggaagggagagtgctcttagttaggttagttgagtgggggactacgctgttcatagagaagtgccaaaacaaaggaaaggggaaggcaaagtactccaactgggaagaagacggatacaaggatagcaactacaactcgatgttgggaataggatctaatgagatgaaaaggaaatggaacttcttcttcgatcccttctcgccatttaggattcgagtagcgaataagccgatagaatatcctgaggagaagaatcggatagggagtgaggctggaagtgctgcggaaggagcagctcgaactcatttcggaggctgtgtcccggctgtcacactcggtgacaggcagggaagactagaaaaaaagtag

SEQ ID NO: 108940 - DNA, 537 bp, Glycine max
  Peptide Sequence Number=SeqID_225718
atgaagttagaagcagtaggaggagggtgtaagtaccacccaaataacaagcaactaccgggtgtttgtccctcatgcttaagagacaaactcttgaagctctatgacaacagcaatccaacttatcctctcccttgtcctcctcctcctcctccaccttatttgtttcgtggccaccgccgccatagttctctcgtaatggattctgcttcttccatggttagcttcaattatgggttggagaagagcaactccattgcctttgcttcaagaagccaagccatagatagggaagtcaatgggagcaacaggggaactgtgcaatttaacaattaccatgtgatggcaacccttattcccattgctccacaagtgttctacttgtcatttttaatatctactgtgatcacggtgtacataaacgagcaaaacatgagatctgtaaatgatgtacaatggagaggtatgctaattgctaagcgggtagtgaaattagattatgaatcaaaacagaacaaatatctgaatgctgtataa

SEQ ID NO: 108941 - DNA, 315 bp, Glycine max
  Peptide Sequence Number=SeqID_225719
atggggtggctatatgatgcgtatgatggcccatttggtacaagactgaggtgctgtattccaactcaatgggtgcaaggaggggtgctcagtgaccaagagagtcacaacctacatacatggagtagctggaagaatgtcaaggggccaaaaatgtcaagggtactagtaagacataggagattgaagatattaagaactgcatgtgtgagaatgccaaagggtccttcaagtattttgagccaaagattttcaagagctatatacctagaacactgtcaatgtgagtactacttgtttaagatctttggttga

SEQ ID NO: 108942 - DNA, 1485 bp, Glycine max
  Peptide Sequence Number=SeqID_225720
atgaaattcttgtcagaaactaactttaaggaatggaggcaagtggtgacagaaattaaccgtttcacgaaagttgacaagggctttagtttcaggcccatgcgttattgtgccacatttgatactcatcgagcttctcttccttatgtggctcgttttcatgcaaagagggttttgaaatttcaagatgcactgttgacaagctatcatcgaaatgaggtcaagtttgctgagcttacattggacatctatagaatgatacaatgtttagaatgggagcctagtggagtattctaccaaaaacatacagttaaacctaaggagaatggtgacataattgatcattcaggagcttccgggataatagacatgaatcttactgcagatatgaccgatccaactgtacctcctaatcctagaaaggcttccctgtaccgtccatctgtgacacatgtgatagcagttttggctactatttgtgaggagctgccaccagactgtgttgtgctagtatatctttcagcctcagggaaggctggtcttaataatgtctctcaggtggagaattttagcggttcatccaaatattcaagacacaaagtcctctctcagacttcccaaggacagaattctgaaccttccgaaactcaaaataatggcaagagagaactgagctattatgacaattatctgtggtttggtcccaagggaaatagtggttcaaataatctctaccctggtgatcttatccccttcactaggaaacctcttttcctgattattgacagtgataacagccatgcattcaaggcagaaaaccttgccttgttgaatttcttccaacaatttgaatatgaatgtagaactttctcagaggacaaagttgaatgggtggaaagaaagaaccgttgccaacaattcatgtttacttacaaaaagaatggcaaatacagcatccttctgggttataatgattttgtggttttacatggggctgaaaggggtgaaacggctgctctatttctttcacctttaagaccgattttcaagaatccctctgatgtaaattcaaataatggaagccaatttaccttttttttgactgctcctttgtcagcattttgccaaatgattggtctctcccccaacgagtctgatacagatgtctacaatgaagcagagaacataatcgctaatgctttgactgagtgggaaataattctttgctcatcaactaccatggatttagtatgggcgcaggttataagtgatccatttctaaggcggcttattctaagattcatattctgccgatccgtgatatcttttttctgcccacctgaggaaagtgaactgtacctgccactttgtttaccccatctaccgtcttctgttgcaccaacgtctgaagctgtgcgttctgctgttgtgcaacttgccatgcactttgacgttgctgactcctttcactttactgaaacataa

SEQ ID NO: 108943 - DNA, 288 bp, Glycine max
  Peptide Sequence Number=SeqID_225721
atgccaaagcacataaaaaataagcctaaggttgttaaaatcacttttctaagacattttattgatgcatgcttttgtttgtttaggctatgtcagatcaaattgagcaaatgggggtcacactataaactcaatagaagatctaacatatttagtttgatcaatgatattccatgtgtttttgaagttgtgactaacatgaaaccacttaaggacaagccaacaacgaatagtggaagcaagtctaggggaagtgccaagcaacactcttttaaatgcacttattag

SEQ ID NO: 108944 - DNA, 249 bp, Glycine max
  Peptide Sequence Number=SeqID_225722
atgaagacaacaacaaagaatttacttgataatggttgtcatcatcaaaaggggaagaatgtgaatcatgaacgttttgatgatgccaaagttttgatgatgccagaaagaatttacatgataatggttgtcatcatcaaaaatggggagaattctcaaacaaattattttcaacaacccaaggcattggtaatcgattaccagaggcagattgcaaatggacttttcaaaaaggattttgcaatttga

SEQ ID NO: 108945 - DNA, 417 bp, Glycine max
  Peptide Sequence Number=SeqID_225723
atgtggaccaccacgggtacatataatgaatccgaaaagcttggtttgagcaaaataggggagatgcttgccgcccagctcgcccaggcgagcagggttgcttcctccagaagcaacagccttctggaggaatcttctgcagggcccaagtgggcctggttgctatttgcacccccatttttactaattacgaaaacttacgaatttcgtaacgatacttgttttctttccgtaatgttacggaaccttgcggattacataatcatcccctttttgacttacggaatgttacggaacctcactaattatgcaacgatgcttccatttgatttccggggtgtcacggaaccttacggattgtgcatcaataatttcttttgttttccggcatgtcccggaatttcacaaattgcctaa

SEQ ID NO: 108946 - DNA, 558 bp, Glycine max
  Peptide Sequence Number=SeqID_225724
atgccgatctccccctacgaaagtatcggctggtctgtgccattccgacatagggatcgtgcccacaagacacccagtggacccagaggagcccaacagggccctggggtttccagctctggttgtgggcctctgtcagtcctacagggctcccgtccccccagcaaggatcacacccgcaagacacccagtggacctgaagaagcccatcagggccctggggtttccagctctgggatcgcgcccgcaagacacccagtggacccgaagaagtccaatagggtcctagggtttctagctctgattatggacctctgtcagttctacggagtgcccgtcgcccctagcaagggatcgcacccgcaagacacccagtggacccgaagaagtccaacaggttctacgaagttcccgtcgcccccagcaagttcatcaggccccctattaaccgggctttcatcaagaagtactgcgcccccaggcaggcgcaaggcgaaacaccacagcagcctggggatggccggcagcgggcaacaaatgcactatcgccacctttag

SEQ ID NO: 108947 - DNA, 717 bp, Glycine max
  Peptide Sequence Number=SeqID_225725
atggtggtcctggcggcaaaacagcatgcgcaaggggtcccgatgatggttgggataggcgcgatggcgacggatatgattctacgtcttgctgaggatgctcagcaggcgggggcgaatgctgtgctgctaccagtgctgaactatcagcctctgacggatgatgaggtgtttacactgttccagacggttaaccgccatgtgtcggtacctatttgtatctatgataacccgcgcaccacccacagagccttttctgatgcgcttgttgagcgtattgcttcgttatccaatatcgcatcaatcaagatccccggtttgccggccgaccaggctggcgtcagagtggcgacgcttcgtcagcgattgccgcagcgagtgagtattggcgtcagcggcgacgcttttgccgcagcagggttaaacggcggctgtaatctgtggtattccgtttgcgccggtctgttcccgcaaattgcccaaaatattaccgcagcagcgttgagcggcgagcggcagcaggcatcggcactaagcgaacggctggagccattatgggcattgttcagacagcacggtagtctcaaagtgattgccgctgccgcctctattcttgaactagccgaagtagagtgtttaccgcgaccgttggccccgctctccgcggaggccattaacgatgtcaaatcggtcatggataagctggatctacgctga

SEQ ID NO: 108948 - DNA, 420 bp, Glycine max
  Peptide Sequence Number=SeqID_225726
atggggtcctatggtggtcacagctcgaccggagagggtgatgacaggtggatgcattttgtggagcacgtactacctgcgagtgagctttgtctagtgcctaggcaggtatctacggattacatggagtggtttttccgcatatctcacccattcatgataccgacacaggcaggtgaccagccgatagatggaccagccgcagaccctgaggagtacatacagccgtccaacccccaggatgattacgacggatatgaggtgattacacaaaggttggagcgtgtgctcaaccttagaatggttactgtgggcacagagtattatgagattatgcaggactgtctgacgatcgctagagggggagccaatgctgatggaagtgtcagggctcgtcagagacgccgcacggaacattga

SEQ ID NO: 108949 - DNA, 312 bp, Glycine max
  Peptide Sequence Number=SeqID_225727
caagcattcgctaagcgcaatattcagtggctaagcgcgaggaagaatccagaagaagatgagctatcaagttcgctaagcacatcgctccaggaggtttccggactatggaaagctaaatcctctgttggatcttcccttgggaactggtctgattctaaagtacttggtagtatgggactaagttgttgtgctatcacgagggatcgagggatctatggacgaggcttgttcaagactaggctaggctatcatgaggaatcggggtctagcagtccaggagacaacataggaacgcatgagcattgttaa

SEQ ID NO: 108950 - DNA, 190 bp, Glycine max
  Peptide Sequence Number=SeqID_225728
atggcggcggcttgcagtggtgctgtgtgtcgtccaatggaagaaacgaaaggaagaagatggagtaaggtctcttgcttcctattgaagctatttatggttctacccggtggtgtagatagtgctgttagcccttgctttgtggcgtcgagccctgactcgatggggcgtgttgcgagtcccacatcgg

SEQ ID NO: 108951 - DNA, 1116 bp, Glycine max
  Peptide Sequence Number=SeqID_225729
atggtgaaggggaaggtggtgttgattcggaagtatgtgcttcaaaccatatccaatgccaaggagcttgttggcaatggcttcaacctaattggctcatcagtcgaatatgatattactaaatctgtgtttttcaacttgattagccgcaccaagtcatccaaggataattattcaaaagatggaaaggaggcctgtttagagaataatgcttcggtgttacgaagcttgggagggaaagaggaggaattcgacatttattttgaatgggatgctactgagatgggaattccaggagcattttacgtaaaaaaccatatgaaagatgagttcttccttgtgagtatgactcttgaatatccacttccaacatgtgaccgccacaaggacaaaaacagtatcattcactttctttgtaactcatgggttcacaatcatggatgctacaaaacgcatcatcgcattttctttgacaataatccatatctccctggtaatcaaacaccagaggcattacgaaagtatagagaagaagagttggataatttaagaggagatggaacaggagaacgcaaggaatgggataggatctatgattatgatgtctataatgatttgggctatctagatagtgatgaaaaggatgatcacccaatccttggaggcaccctctatccctaccctcgtagggttagaactggcagaaaactcctcaatgacaaaaatattaatggtggtaaatacgagaaacctgcagacaatgttatttatgtgccaagggatgaaaatttcagtctggagaagacaacagatttccttgaatttggaaagaaatctttatctggaaaagtggaacccttgctcctatctttatatttaaagctcacaccgaacgagtttaatggctttgaagaagtgcagagactgtatgatcaagaaggtggcataaagctgcctatatcgaccactatgggtactgaaaatgtccttaagtttccaacacctcatgtaatccaagctagcacatttgcatggatgactgacgaagaatttgcaagagagatgattgccggtgtaaacccaaatgtaattcgccttctaaaagaaaaagattaa

SEQ ID NO: 108952 - DNA, 279 bp, Glycine max
  Peptide Sequence Number=SeqID_225730
atgacgagtgacatagaggaggtaaaggaacagatgaaggccgacatggaggccatgaaagagcaaatgaccacaatgatggaagccatgatgagaatgagaaaaatcatggaggccagggaggtccttcaactccatacccttggagatgccactaaggggcaagcattttgtgacgtacccctgctaaacactttgaggaggcctcaatattgcccacaaccccaacccttacattttgcgatcggaggagggcctcctgctatggtggaaaggtag

SEQ ID NO: 108953 - DNA, 987 bp, Glycine max
  Peptide Sequence Number=SeqID_225731
atgaaacaatttacaacacagattgaaggtgatgttgcagctctaggatggtgggacttgtttattaacttcggcattgcacagtgctttgcgtttcttgtttgtacaaagtggcacaatccaactattcatggaggctgtcatattacagaaccatgctcatcgtcaaataccataagatacctagactttaggacaggaggcttagttgtttacacagatgaagatagacagcaaaatgggttctgcaatctacaggatatcggtgggcatattatgaaaattccattcattggtttccaaatacttctttttatgcatttagagggaacaccatccagtgcaaagaatctgccccactgggtcattttttccccactttttttgttgcaaggagctggggttttatttgcagcttatagattaatagagaagatagttcttctactctactgtggagatattcctgaaagatactcagccatagcatcaaaatcccgtgagtgctttgggttctttcgacgtgggtcaaggttgcttggttggtggtcaatagatgaaggaagtagagaggaagaagctagacttttttgtgctgggagtcctgggtataatactttcacccctgatacggtgaagaaaatgcctagggcagatctggttgaggaggttatttttgttcattgtttgtacttgaatgactgtcaagtgtatcaggatctaacactcttcaaattgaatggtaaatgtatcaggagaagatcttatgcagaatttgcttcgaggagcagattaatgtggtcctacttccctgcaggcatcacattctttgcagcacttgctgcgaaaaatgtaaaaggtgccctgtctgtcgtggaccaattgaagaaaggatgccagtatatgatgtgtagactgagttcaatgaagatgtataggtatcttactgaccatacagcttgtgattttagacgaggcaagcactga

SEQ ID NO: 108954 - DNA, 1266 bp, Glycine max
  Peptide Sequence Number=SeqID_225732
atgtctctggaacatgtggtaaagttatatggaaaagcaatccttccagagcttgtccaagttgtcaccatcttttatgtttcagagtatatttcacaggaacattttttctgcatagatatagatattgcaattgtgcatgtagcccaagaatggcctggactacctttaggtgttaaatttgatccatctgatcaagagataatatggcacttgcttgcaaaagttggtgctggaaattcaaaacctcaccctttcattgatgaatttattacttctcttgaagtggatgatgggatttgttatactcatccccaacatttaccaggtgtcaagcaagatggaagtgcttctcaccttttccatcgagcaatcaaggcttataatactggcagtcgaaagcgtcgaaagatatgtggtcaggattttggtgatgtccgctggcacaagactggaaggactaaacctgtcatcttgaatggggttcagaaaggctgtaaaaagattatggtcctgtatataagcccagtgagaggaggaaaacctgagaaaactaattgggttatgcatcaatatcatctaggaacagaagaggatgaaaaggatggagagtatgttatctctaaagtgttttaccagcagcagcaagtcaaatttggtgaaaagggtgaccaggatattcctgaaaccactgaagcaactacagttaaagtggatccagtcactcccaaatctgtgactcctgaacctcctcgtattgaaaatcgatggtcaaatctagacctaggacaagaatcacatcacattcctcagcatcctcagacggattgtttagaggatcttcaggctgattgtgaagatcttgcaaaagatgatctattgatagtagaaactgaaaataatgaagggatagataatatagaaaacaatgctgaggaagactcaaaatggtgggatagtgagtcacagaatctgttgagctcacaacaacttgttgaagcattgttcttgtgtgatgatctccttcaaagccagtctcccaagagggatggggaaaatgagcacaaaaaacgatctagtctttctgtttatgctaatctaggaccagagcatctgaagaaagatatcgtagagtgtcaaaatcttgtccttgacactgcaaatgtagtgcctgagacaccaccttcagaatttcaactaagtcagctggatttcagttcacaggatagctttgtttcctggtgtgccagcaaagcatttgactaa

SEQ ID NO: 108955 - DNA, 150 bp, Glycine max
  Peptide Sequence Number=SeqID_225733
atgggtagtcctagcatgggaggctcaaagagaaggctctcaagcagagggcttggaggagcccttagggagcgaagggcaaggctttacataattagaagctttcctttgatttctcctttcatttctttctttgctgtggctggttga

SEQ ID NO: 108956 - DNA, 171 bp, Glycine max
  Peptide Sequence Number=SeqID_225734
atggaacggtatgagataattaaagatattgggtcagggaactttggtgtggcaaagctggtcaaggaaaaatggagtggtgaattgtatgctatcaagttcattgagagaggcttcaaggttccattttcaaactccatattgatgaacacgtgcaaagagagattataa

SEQ ID NO: 108957 - DNA, 1560 bp, Glycine max
  Peptide Sequence Number=SeqID_225735
ccccaacgccactccttcttcgtgctcgcgacctcctccactcacgatgcgtaccacgcgaacctcaacatcgccgccctctcacgcgccgggaaagccgacgccgcgcgcaaactgttcgacgaaatgcccataaaagacgtcgtcacgtggaactccatgctctccgcctactggcaaaacggccttctccaacactccaaagcactcttccactccatgccactccgcaacgtcgtttcctggaactccatcatcgccgcctgcgtccaaaacgacgacctccacgacggggtggagggagggattgggcgcgcgagggcgctgttcgaagcgatgcctcgaaggaacgcggtgtcgctggttgtgatgattaatggtttggtggagaatggattgtgcgaggaatcgtgggacgtgtttgtgagaatgccgcagaagaatgatgttgcgaggaccgctatgattactgggttttgtaaagaagggaagatggaagacgcgaggactttgtttcaagagatcgcgcttctagttattgtctttggtgtttggttccttgtatatgattctccagagtctgaattgaaattgaatgacatttttgagtttgtgggtatccttacatatgatctagaccttcgggatgacaatgaagattgtccggagaatagtaaccatcagcatgctgccatgattgagccgattaaatcttggttagctaaagattggcaagttaatctttcccatgtttggcgtgaatgtaatcatgttgctgatagattagcagctaagggtcatgagcttcccttggagctaaagtccaacttggtcaaaggcatcctaagacatctcacggctgttcttggcgacgatgatgtagctaggttacgcccaaaatgggagaggggaagaggcactgaatttgtttcacagatgatcaggaccgcaaatgtggtggaattgttgatttctgagtttactatctgtgtgttgtcatgctgggaagatcgtgaaagcatgaatctattcagtttgatggttcataattatggtattccaccaaggtctgaacactatgcttgcttagttgaggtgttgagtcgagcaggtcagttgcagagagcttgcaaaataatcaatgacatgccattcaaggcagattccagcatctggggtgctgtgcttgcagcctgtagtgttcatttaaacgtggaattgggggaactggcagctagaataattttgaatttggatccttttaatccggatgcctatgttatgctgtctaatatatatgctgctgctggcaattggaagcatgcccatagaatcagggttctgatgaaagagaaaggagttaagaaacaaacagcttacagttggttgcagattggaaacaaaacccattgtttcgttggaggggatccatcacatcctaatattaatgatattcatgttgctttaaggagaataacattacatatgaaggtaaaagggagctgggaaggtctaagggatgacaacattggtaaattgatgtcgtccatatttagctag

SEQ ID NO: 108958 - DNA, 132 bp, Glycine max
  Peptide Sequence Number=SeqID_225736
atggaagctcagcaccacgacttaaaatctgtgacttcgtcatctgttttgcactcccagccaaaatctactgtaggaacccctgcctatattgcaccagaggttttgtcaagaagagaatatgatggcaag

SEQ ID NO: 108959 - DNA, 471 bp, Glycine max
  Peptide Sequence Number=SeqID_225737
atgacgtcaaattcatttttccatccacctgagtttggagttcctcgcggtcggggtgacgggcaccgggccggtgagattgttgtaggacaggtcgaggagtttcaaggtggtctggttgaaggaaggaagcgtgccggagaagttgttggagttgagacggagcgcgatgaggcggtggaggaggagggagagagtgaggaggcggtggaggaggaggagggagggagggaaggagccggagaagctgttgtggtcgaggaagagggacttgagggagttgttgcggaggctgaggactcggagctggtccagacttgtgagagtgtgcggcgggaatgggcctcgcaggcccatggactgggccacgaagctgaccactctgccctgcgcgcacttcacgccctgccactcgcagtagtcgtaccgctcgttgagggagtagaggagcttgttgtcttggtccgctag

SEQ ID NO: 108960 - DNA, 2112 bp, Glycine max
  misc_feature (491)..(491): n is a, c, g, or t
  Peptide Sequence Number=SeqID_225738
atgcatcatcatcccaaaacgacaacaacagcaacaaaactccgccctctgttcctatgcttcttcttgaccctcgcctcttccgcgcccccaatgctcccctccgacgcggtttcgttgttgtcgtttaagcgtctagcggaccaagacaacaagctcctctactccctcaacgagcggtacgactactgcgagtggcagggcgtgaagtgcgcgcagggcagagtggtcagcttcgtggcccagtccatgggcctgcgaggcccattcccgccgcacactctcacaagtctggaccagctccgagtcctcagcctccgcaacaactccctcttcgggcccatccccgatctaagcccactcgtcaacctcaagtccctcttcctcgaccacaacagcttctccggctccttccctccctccctcctcctcctccaccgcctcctcactctctccctctcccacaaccgcttctccggtcccctccccgngaaacgtcaccctcctccaccgcctcatcgcgctccgtctcaactccaacaacttctccggcacgcttccttccttcaaccagaccaccttgaaactcctcgacctgtcctacaacaatctcaccggcccggtgcccgtcaccccgactctcgccaaattaaatgcacaatcgttttcagtggaatctcggtatcatgcgaatccgggttatacaagctggttaagtcactccaaacgcattatgtttggtttacccgcgaggaactccaaactcagaatgcgtttggagtggccagacccgattgtataactcggatttacatgataccgagatttcacttattctctcttttgggtaaccccggtctctgcggggagattgttcacaaagagtgcgaccctcgttcacatttcttcggccccgccacgtcatcttctaccacccccttgagccagagtgaacagtctcaaggtattttggttgttccttcttcttccaccaaaacaaagcatcatataaaaacaggacttgttgttgggtttgtcgttgcggttgttcttgtaactgctttcactctcacagtggtttctttggtgagaaagaaacaaaatggtaaagcttttagagcgaaaggtgtggttttggagagtcctgaggtggaagggggtggtgtggtggttgcggtggaaggtgagagagaggtgaagatgaggaagatggaggaggcgcacaggagcgggaagctggtgttctgctgcggggaggtgcagagttacacgctggagatgctgatgagggcttctgcggagtttctggggagggggaacgtggggaccacctacaaggcggtgatggattcgcggctgattgtgacggtgaagaggttggacggagagaaaagcgcggcagcggggagtgacggggaagtgtttgagaggcatatggaggttgtggggaggctgagacaccccaatttggtgcctttgagggcttattttcaggccaagggagagaggcttgttatttatgattatcagcccaatggcagcctcttcaacctcgttcacggttcaagatcagcgagggcaaaaccattgcattggacatcatgcttgaaaatagcagaagatgtagcacaaggacttgcttacatccatcaagtttcatccttaatccatggcaacctaaaatcctctaatgtccttcttggggtggactttgaagcttgtatcacggactattgcttggccttgtttgcagattcttcgttctccgaagaccctgattcagcggcttacaaagcaccggaggctcgcagctctagccacaagtgcactgctaagtctgatgtgtatgcttttggggttcttctgatagagcttttgacgggcaaacacccttcccaacacccttttcttgcgccagcggatttgcaagattgggttagagcgatgagggacgatgacggcagcgaagacaaccggctggagatgctcacggaggttgccagtatttgcagtgcaacctcgccagagcagaggccggtgatgtggcaagtgcttaagatgatacaaggaattaaggacagtgctacaatggaggatactgcacttacttga

SEQ ID NO: 108961 - DNA, 171 bp, Glycine max
  Peptide Sequence Number=SeqID_225739
atgacggtggcaacgagtggtttatcggtggcaatggatgcaaacggcaacgacggaggtgcggcaagaagaagaaaacgaaggagaaagaaggaggcggatgtgaatctcagcggaccattccggaacactttgttttactgcaatgatccaataatgacttatctgtaa

SEQ ID NO: 108962 - DNA, 1089 bp, Glycine max
  Peptide Sequence Number=SeqID_225740
atgatgggtcacgttgaaagtggagctacatgtttggttgcactttcactcgcactccaccttgtatcagcaacgaccacctcttcttccttggacgttggcgccgttagagtcgtgagggttcggagggacggcgcgggagactttaggacggtgacggacgccgttaacagcattccgtcggggaacaagcggcgagtggtggtgtggatcggaaggggcgtgtatcgcgagaagatcaccgtagacaggtcgaaacctttcgttacgttttatggagaaaggaatgggaatgacaacgacaacgacagcagagacatcatgcccatcataacgtacgacgccacggcgttgcggtatgggacagtggacagcgccaccgtcgctgtcgacgccgactacttcgtggctgtcaatgtggcatttgtggaaactgaaattagagaattggagaatatgcaattacggtacaactcgtctcctaggccagaagaaaacagtgttggtgcacaagcattagccatgaggatatcaggggacaaggctgcattcttcaactgcaagttcattggatttcaggacactttatgcgatgataaaggcagacactttttcaaggactgctacatccaaggcacctacgatttcatctttggaaatggaaaatccatctacttgagaagtaccatagaatcggtggcaaatggtttgagtgttatcacagcacaaggtagggaaagcatggcagaagacactggattcactttcctgcactgcaacataacggggagtggtaacgggaacacttacctagggcgtgcctggaagaagagccctagggtggtatttgcttacacttacatgggctccctcatcaatacccagggatggttcaacaaccaagttgctcatgccaaatccaacaaccagacaatctactatggagaatataggtgcatgggaccaggagctgtttcctctggccgcgtaaaatttcggaagatactgtctaaggaagaagcaaagcccttcttgagcatggcttatattcatggaggaacgtgggtagttccacctcccaagctgtga

SEQ ID NO: 108963 - DNA, 384 bp, Glycine max
  Peptide Sequence Number=SeqID_225741
atggctcctaaactaaccttggagattgcaaaacaagttatcgcaaacatagcgggagtaatcggggtcattgtggccgtcgtagacgccgacaaaggtgccgaaggtgccaaaggcgccgaactcgatctagctttggtcctcgatgacctggttggcctggatgatggccatggagaaattgtcggctgtaaacttttcgatgtcgcggaaccagaggaggtcgtccttgcattctcttccagcgacgacgttaccggcgtcgtcaccgtgcccaaacggcttaaaacggcgcacgataaggctcatcaatgcatggagcatcccacatctctcaaaaaccctaaccctaggccccagcaccggaacctcttttcccaatag

SEQ ID NO: 108964 - DNA, 246 bp, Glycine max
  Peptide Sequence Number=SeqID_225742
atggatgcctttgtgtcgagttttaagattggagatattggatatgataatgacattaaccttttccatgggactctccagtctttagctaaaatggccaacaagtttgtgtttcaacagcattcttttactaagttatacaagggagccatgatagaaaagcataatttcctttcaacaatgactactaacaacactactgaggaaggaagtgaacaagaacaaacgcaacactttgcagactag

SEQ ID NO: 108965 - DNA, 1455 bp, Glycine max
  Peptide Sequence Number=SeqID_225743
atggcaaaccgtgccgaaaaccatcccatattggtttcaaaaatcggcatcctaggagctggagtaagcggcatagcagctgcaaaacagctatcacaccacaaccctattgtttttgaggcctcagattccattggtggagtttggagtcattgctcctataactccactaagcttcagtctcatcgtcgtgattatgaattcactgattttccttggcctcaaagagacaatcctgattttcctacccatttggagatactcaattatttgcactcttatgctaagcactttgatgtgctcaagaacataaggttcaactccaaggtggtggaaatccgctacacaggcaaccgggaagttacctgctctggaagcctacttcccggtttgcctgtgtgggaagttgctgtgcagaccaatcactcagacaccattcagttggttgtggtttgcgttggaaaatatggggacatagcgaggattccaacgtttccacagaagaaaggggcagaggtattcaagggaaaggtgatgcatacgctagattactgtaaacttgaccaggaagctgctactcaacttctcaaagggaaaaaggttgtggtcgtaggtttcaaaaagtcaggtcttgatttagccatggaatgtgcccaggcaaaccaaggacctgaaggacaaccttgcaccatggttgtaaggactttgcattggacagttccccattactggatttggggattgccttttttcttgttcttctcaacaagatcttcccagtttatccacgaaagaccaaaccagggcttactcagaacccttctatgcctcatgtgttccccactgctattacagaggcgtggaatttcaaagtttattgagtcctaccttctatggaaacttccattggagaagtatgggttaaaaccagaacacccctttgtggaagattatgcatcttgtcaaatggccatcatgccagaaaatttcttctccgaggctgaaaagggccaaattgtctttaagaaggcatcaaagtggtggttctggaatggagggattgaatttgaagacaacactaagctgaatgctgatgtagttgttctcgcaactggttttgatggaaagaaaaagctcaaaaccattttacctgagccttttagtagcctgttggagtacccttctggtattatgcctttatacaggggaactatccatccattgattccaaacatggcctttgtgggttacgttgagagtgtctcaaatcttcactcgtcagagctacgctccatgtggctttctggactggtagatgacaaattcaagctcccaagtgttgagagcatgctttcacatacacataaggagatagaagtgatgaaaaggaagaagaactggatatccgaggtatttggaccctatagtattgaagaatatgccaaggaagattga

SEQ ID NO: 108966 - DNA, 306 bp, Glycine max
  Peptide Sequence Number=SeqID_225744
atggctagtgctgtcagtaaggtttccggcgacctgaagtcgtcgagtttcgatcgtgtcagagaagcaccgccgccgcctcctgattcctcccttcttttggctaccagacctcccaggcatctgtctctttctctttctgcttcgttcctaaccttaccttatatcacttcattacaagcggtgtcatactggacatgctcaaagctttgtgcattttgttttgttgctggagcggttttcggttactcgctcaggggacgagttaagcgctgggcttccaagatgctcaagaagctcagctga

SEQ ID NO: 108967 - DNA, 273 bp, Glycine max
  Peptide Sequence Number=SeqID_225745
atgttgcttgaaattaattttatgttttttgaaataccgttttccacttacaagagggtcgaatcatttgtgcaggacgtagaacaatacaataaattggaagatccaactgatgaggaaaatgacatgttggatctagcttttgggcttactgaaacatcacgtctgggttgccaagtgattgctaaacccgaacttgatggaattcgtttagctattcctgctgccactcggaacttcgctgttgatggttatgtgccgaaaccacactga

SEQ ID NO: 108968 - DNA, 225 bp, Glycine max
  Peptide Sequence Number=SeqID_225746
atgtttccagagtgcttgaaaaggttgttcagcagaagccagaaggtgaaggggagggtggtgttgatgcgtaagaatgtgcttgacttcaacaacttaacgagtgtggtagggattgttggcactagcaaaagcctaattggctcagcagttgatggtgttacttccttaatgggcaaatctgtgtgtatccagttgattagtgctaccaaggctgatggttag

SEQ ID NO: 108969 - DNA, 1317 bp, Glycine max
  Peptide Sequence Number=SeqID_225747
atgccatatttgaggaagataaacgagctagattctgcaaaggcttatgccacgaggacattcttgttcttgaaagatgatggaactttgaagccacttgctattgaattaagcaagccgcatcaatgtgtatatgtcctgccacatccaccacatatgcgtccatctccatttctacattattattttccgagccaagtggtgttgcctgcagacaaaggtgatgatggtacaatttggctattggccaaggcttatgttgttgtaaatgacaccaactatcatcagctcataagccactggttgcatactcatgcagtgatggagccattttccatagcaacacacagacaactcagtgtgcttcaccctatttataaacttcttcatcctcactttcgtgacaccatcaatatcaatgcacttgctaggcaatcgctgattaatgcaggcagcattatagagcaaacatttttgcccgggaagtactctatggagatgtcttcagctgtatacaagaattgggttttcactgaccaagcattaccaactgatctcatcaagagaggattggcagttaaggatcacacttccccacatggccttcgccttatgataaaggactatccttatgctgttgatggattagaaatatgggatgctattaagacatgggtccaagagtatgtcaacttgtattactctaatgataaggcagttgaagaagatactgaactgcaagcatggtggaaggaagttgtggagaagggtcacggtgacttaaaagataacgaatggcctaaaatgaagacatgtcaagagcttatagactcttgcactataattatatggattggttcagctctacatgcagctgttaattttggacagtacccttatggaggctatatcctaaaccgtccaactcaaagcagaagattgctcccagaaccaaaaaccaaagagtatgatgagatggtcaagaatcctcaagaggcttttttgagaacaattacaccaaagttccagacagttattgatcttacagtgatggagatattgtcaagccattcctctgatgagatctaccttggacagagggacactccaaattggacctctgatcagaatgcaaaagatgtatttgaaacatttacaaaaacacttgcagagattgagaaaaaaatctcagaaaggaacaacaaccaagagcttaaaaaccgaactgggccagccaaatttccctacactgtgcttcttcctaccagtgaaccagggttgacttttaggggaatccctaatagtgtctctatctaa

SEQ ID NO: 108970 - DNA, 1326 bp, Glycine max
  Peptide Sequence Number=SeqID_225748
atgacatatgttccaagtgaaacacctggtccattagtgacatatagagaagcagaattgcaggctctaagaggaaatggaacagggaagcgcaaggaatgggacagagtttatgattatgatgtttacaatgatttgggcaatcctgacagtggtgaaaactttgctcgtccagttcttggaggatctctcactcatccctaccctcgtaggggaagaaccggtagaaaaccaacaaagaaagattccaaaagcgagaaaccgggacatgtttatgttccaagagatgaaatttttggtcacttgaagtcatctgacttccttagttatgggataaaatctttatctcgaagtttcttacctgcaatcaaatcaatatttgatttaaaattcacaccgaatgagtttggtagctttgaagaagtacgtgaactctgtgaaggtggaattaagctgcctacagatatacttagcaaaattagccccttaccagtgctcaaggaaatcttccgcactgatggtgaagataatctcctcaagttttcaatacctcatttaattcaagttaataaatctgcatggatgactgacgatgaatttgcaagagagatgattgctggtgtaaacccttgcgtgattcgccttctacaagagtttccaccacagagcaagctagatccgtcagtctacggtgatcaaacgagtaaactgactgaagaacacttgaagattaaccttgaaggactaacagcaattgaaggtcagagactattcatattagatcaccatgacgtatttatgccatttttgacgaggctaaacgaatcaaaatcaacaaaggtttatgctaccaggacaatccttttcttgaaagatgatggaaccttaaagccattggccattgaattaagtttgccacattcaggtggacaacaccttggtgccgatagtaaagtcatcttgcctgcaaaccaaggcgttgaaagtacaatttggctattggctaaggcttatgttgttgttaatgattcctgctatcatcagctcataagccattggctgaatactcatgctgtgattgagccatttgtcatagcaacaaacaggaatctcagtgttcttcaccctgtttataagcttctatttcctcactatcgtgacacaatgaatatcaatgcacttgctcgacaatcactaattaatgctgatggcattatagagcaatcctttttgggtggcaagtattctatggagatttcttcagaagcttacaaagcttgggtgttccctgaccaagcattaccagctgatcttatcaagaggtaa

SEQ ID NO: 108971 - DNA, 2372 bp, Glycine max
  Peptide Sequence Number=SeqID_225749
caaagggaaatgggaaagttggaaacgaaacctttttggagaagcatcttccgacgctaccaaccttgggagatagaagggatgcatacgatattcatttcgaatgggatgctaactttggaattccaggagcattttacatcagaaactacacctatgatgagttcttccttgtcagtgtcactcttgaggacattccaaatcatggaaccattcacttcgtctgtaactcatgggtttacaactttaaagactacgacaaaaaggatcgtattttctttgccaataagacatatcttccaagtgcaacaccgggtccattagttaagtatagagaagaagagttgaagattttaagaggagatggaacgggagagcgcaaggaacatgaaaggatctatgattatgatgtctacaatgatttgggtaatccagatgaagatgtaaagcttgctcgtccagttcttggaggctccagcacctatccttatcctcgtagggttagaactggtagaaaagccaccaagaaagatcctaaaagcgagagaccagcaagcgagctttacatgccaagagatgaaaaattcggtcacttgaagtcatcagatttcctcacatatggaataaaatcattatctcaaaagctcttaccttcgctcgaaaacgtttttgattcagacctcacatggaatgagtttgatagctttgaagaagtaagagacctgtatgaaggtggaattaaggttccaacaggtgttcttagcgacattagccccataccaatcttcaaggaaatctttcgcactgatggtgaaagtgtccttcaatttccaccacctcatgtagtccaagttactaaatctgcatggatgaccgatgacgaatttgcaagagagatgattgcaggtgtaaacccaaatgtaattcgtcttcttaaagagttccccccacaaagcaagctggatccctctctctatggtgatcaatctagtacaataacaaaagaacatttggagattaacatggatggggtaacagtagaagaggcacttaatggtcagagattattcatattagattatcaagacgcattcatgccatatttgacaaggataaacgcactaccttctgcaaaggcttatgccacaaggacaatcctgctcttgaaagatgatgggactttgaagccacttgctatcgaattgagcaagccacatccaagtggagataatttgggtgccgagagcaaagtggtcttgcctgcagaccaaggtgttgaaagcacaatttggctattggccaaggctcatgttattgtaaatgactcgggctatcatcaactcatgagccactggttaaatactcatgcagtgacagagcccttcatcatagcaacaaacaggcgtctcagtgtgcttcaccccatttataaacttctttatcctcactatcgtgacaccataaatatcaatggacttgctaggaatgccctaattaatgctggtggcgttatagaggaatcatttttgcctggacggtattctatcgagatgtcttcagctgtttacaagaattgggttttcactgaccaagcattaccggtcgatctcatcaagagaggaatggcagttgaggatccatcctctccccatggccttcgtcttgcggtagaggactacccatatgctgttgatggactagaaatatgggatgctattaagtcatgggtccaagagtatgtttccttgtattacccaacagatttggcaattcaacaagatactgaactccaagcatggtggaaggaagttgttgagaagggtcatggtgacttaaaagacaagccttggtggcctaaaatgcagactcgtcaagagcttattcaatcatgttctactatcatatggattgcttcagctctccatgcagctgttaattttggacaatacccttatggtggttttatcctaaaccgtccaactcttagcagaagatggattccagaaccaggaaccaaagaatatgatgagatggtggagagtccccaaacggcttatttgagaaccattacaccgaagcgccaaaccattattgatcttacggtgatagagatattgtcaaggcatgcttctgatgagatctaccttggggagagagacaatcctaattggacatctgattcaaaggcattagaagcattcaaaaagtttggaagcaagctggcagaaattgagggaaaaatcacagcgagaaacaaggattcaaataagaaaaatcgctatggaccagttcagctgccatacacattgctccttcctacaagtgaggaagggttgactttcagaggaattcccaacagtatctctatctaa

SEQ ID NO: 108972 - DNA, 270 bp, Glycine max
  Peptide Sequence Number=SeqID_225750
atgaaaagaaagaaaaggaaaggaaaagaaggattcccaatcgaagatcaaaagaaagtaaaaagaaaaggatcgaaagaaaaacagaataattcccgaccaatacaggaaaccaggaaagagaacagaagatcttctgaccagataaattttcggcaggccgttctcgactggcgatatcccgccccacataaacaaagaggaaaagaccaacacacccaacttcctctccaaaaacactacccacgagaaaatcatattgatccgtga

SEQ ID NO: 108973 - DNA, 504 bp, Glycine max
  Peptide Sequence Number=SeqID_225751
atggacagggcaaggttggtttacgaacttgtcacatggatggatatggatgtgggctcattcatttcaggtcagatctggcagatggcccagtccaactcctttaggctcggattttcggcgcttatcactgctttatgcatcgctcggggagttgttccagactcattgtcctttgagtcccagagccctgtcattaatttggcatatatccgaaagaactgctggaacccggatgatcccacgatcacctttccagggacccgcaaaactagggctcagggaccctcagacgcttctgctccttcttcttcagctccaccagctcccgcaccaacaccctctggcacctccatgcagacaccagatgtgatagtgttgatgctgcagagcctccaccatagcttatgccaggtgatgcagagtatacacgacttggctcagcatcaacccattatgagcatggaggcctttatggcccaggtggcctggccaggagtctag

SEQ ID NO: 108974 - DNA, 186 bp, Glycine max
  Peptide Sequence Number=SeqID_225752
atggatattgaagaggatgctgaaatcccactgattttaggttgtccctatgttaaccaccaattgtgtggtggatatggggaaaggttaattaggcaagtttgtgaagtgctgattttcatccgctcgctaagccaatcttctggcttagcaagccatccgctgagcgcaacactcctcggctga

SEQ ID NO: 108975 - DNA, 507 bp, Glycine max
  Peptide Sequence Number=SeqID_225753
atggcctctagaaagagaaaggcaactgcctcccgaccccaggagccctatgacacaaccaggtttatttctgagggtgcctgggaacgatatgagcagaatgttcactcccgaaacatccttctggagaggaacattaacttgtacatcactaagtacgacgagtttcgtcaggagcttgagaggtgcatgtggcctaaagccttgactaggcaacctgatggtcacattgatgtggtcctggtcaaggagttttatgcaaatttatatgatccagaggataaatcccttaggcaggttcgagtacgggggaagctgataaaatttgatggggattcgctcaacactttcctggagaccccatggttttggagccaggggagcgctacactgcatacaccaggttctacagcacgcacccaaatcctcaggagcttgcatccaagctctgtattccagggcgcagtttcgttcttaatgctgaaggagcaccctagaagctcctga

SEQ ID NO: 108976 - DNA, 264 bp, Glycine max
  Peptide Sequence Number=SeqID_225754
atggcacgcagcgtgttcgctccgtgcccctatttaagggacctacaagggagagaactaactaggtatttagcaataaccccccaaggtagtcatatctctcttgacgtggagtcgccaactgtcgcaacctacccttcagcgggagggcgacgcgtgactcacgggatgcgtgttccacgaaaggaatacgcgcggagtcgccaccaacgtttatttgaggaaaacgtcggaaaaaccggaaaagacgcgatctacgaactt

SEQ ID NO: 108977 - DNA, 579 bp, Glycine max
  Peptide Sequence Number=SeqID_225755
atgggtagtatcatgaataatgggtgggaatggaagctcatttggaggaggcctctctttgatgctgaggtagcaatggcagacacttttttaggagagatttcacagcagcaagtggattctcataaggaagatacctggatttggaaatctgacccctctggggattactcaacaaaatcaggactcatccgagacagactgccgacaaagaataatcttactaggagacaggtgacggtagaggacatgttgtgccctttcttcagaaatagagaggaggaggctgctcatctattcttcacctgcagcaatatcctccctctatggtgggagacaatgtcctgggttaacttatcaacagcaatgccacaaagcccaagggatcactacctgcagcatggacatagtgttgctggaacgaaaaagtctacaagatggaagtgcaggtggattgccttagcattcacaatctggcaacacagaaataagatagtcttccaaaatgctacttttgatggaggcaaactgatggatgatgcggttctcctaatctggtcatggatcaaaacaatgtag

SEQ ID NO: 108978 - DNA, 249 bp, Glycine max
  Peptide Sequence Number=SeqID_225756
atgacaaggcaactttgtgggttactcattgtcgcaacctacccttcggcgggagggcgaccgagggctaacgggtgcgtcttccatgggaggaaaatgcacggagtcgccaccaacgtttattcgaggaaaacgtcgaaaaaaccggaaaaggtgtggtctacgaactttaagtgtgaaaggttccggagttgtatttacgcatggggaagggtgtttctcttgctcctacgtattcctcaattgtga

SEQ ID NO: 108979 - DNA, 150 bp, Glycine max
  Peptide Sequence Number=SeqID_225757
atggctaacattgcattattgagtagatatgggaggtggtgtttagcatcagatgtgcaacaggcaggttttgtggctgatttaggggtggcctttgtggatgattgggcattctttgctgatagggtgatgggtaatgagaagggctga

SEQ ID NO: 108980 - DNA, 297 bp, Glycine max
  Peptide Sequence Number=SeqID_225758
atgaaagattgcagaaatacaagtagtggggatgtctcctccacctctaggacctcccaatcactcacaaactcatctcaagctctgaggacggcttcctcttccagctctggtggctttgttcgtgctcatgcgcttagcgcacttcagaaccgcttagcgcgtattagtgaatttcggcttagcgcgacttttctcgctcagcggattgaccgaagcggtgcacttagcgggatggcccttcgctcagggaacaagcacaactcatccttcttccagattcttcctcgcgcttag

SEQ ID NO: 108981 - DNA, 372 bp, Glycine max
  Peptide Sequence Number=SeqID_225759
atgttggaccgttttcatgtaagttcaccccatcatgcttctcgtgaaactccatgcccgaaatgtgattaccaaacaaagactgaagccaaggctagaggaggaacttgcaccactgcatcttctgatccaaccgaagccgtcctttgccgcgcttcctttcttctcaagaaaggatttggtggctaccatttgttcaagatcaactgtgaggactttgcaatgtactgcaaaacaggcttgcttgtagtcacagacatcagtgtagggcaaagtggacaagcaacatctctcttggctgctgttggtactgtagtttcttcaccatttgtgtttatgagcactagcttgtgtggtttggctttggtttga

SEQ ID NO: 108982 - DNA, 360 bp, Glycine max
  Peptide Sequence Number=SeqID_225760
atgtcacgaaaccttatggattacgtaatcatcccttctttggcttccgggatgttacagaactttacggattgcgcattaacacttccttttgactttcggcatgtcacagaacttcacgaattgcctaatgatgggtgccaagcgcagaatgaccataatttgtctctgcgtgtcctcggacacgatcgagcctgggtggcaaggcgcagaatgaccataatttgtttctgcgtgcggacacgatcgcctctggatggcgaaaaggtgtggggaatgaccataatttgtctccgcccaccactcgacttactgtctctgaatgaaaaagggcgcagaatgaccataatttgtctctga

SEQ ID NO: 108983 - DNA, 883 bp, Glycine max
  Peptide Sequence Number=SeqID_225761
atgccacaaggaaaaatcccattaggttttaccaaaataaagggtgaccgaatgcaaatactgacttcgcgacaacaccggttagtgaaattgctgttgcaacaggcggcgccgcagccgattggtcagctggcgttacagctcggtgtctccggaaagaccattcagcgcgacctgcagtggctggagagctggctcagcaactgggcgctgacgctggagaaaacccctggccgcggtgtgcggctgcgggttaaggatatgcagcagcgtttgcagctggagcagcagctgaacggcgacgaggccggcgacgcgctcagtcataacagccggcggataaaaatcgcctcccagctactgagcgatgcgccgcgtgccacgtcaatcagcaagctgtccgagcgctactttatcagccacgcctcgattgtgaacgacctgaaagtaatcgaagagtggctgcagccgctgggattaacgctgcagcgcggcccgggtggcacgcacattgagggccatgagcaggcgctgcgccaggcgatggtgtcgctgatcaacgatgtgatgcagcaacaggtcgccggcacgccactgctgccgcggctcgatcccggcagccagcaggcgctggtgcactattttggcgaagaggatgtggcctttgtgcagacgctgctgcaacagatggagcagcagctgagttatccgctgggcgatgcctggtatctcaatctgtgcacgcacatcctgatcatgatgcaccgcatggcgcagggcaacgcgctggcgctggacattctcaccaccgcgcacgatctggatcagtcgattctcaccattgcccggcagatggtagtgcgcattgagcagcgcatcggct

SEQ ID NO: 108984 - DNA, 216 bp, Glycine max
  Peptide Sequence Number=SeqID_225762
atggagttttcaaagctaaatatcatccgaagggagacttcttgggttcctttgtgggtcacaaccccaactactcatggtgtagcattcacacttcacagactttggtcaaaagaggcacaagacagagattgggtgatgggaattctgcaaaggtttggtcccatccatggtttagaaatcctggcaattctttattgcttctcttgtgattga

SEQ ID NO: 108985 - DNA, 339 bp, Glycine max
  Peptide Sequence Number=SeqID_225763
atgatatcaaaaagtgcaaagatagatacgagttcacaagggctaaaaggtgactggataagagatggagaagctaataccaaaattttccatgccaatgcaaattccggaaagaaaaggagttttatttctaagctctttaatgaaaatggtgttgctatttctaatcagcaggatatttgtcttctagcaaagaaatacttagaaaccttgtatgctcacagtgatgtaaatattgaagtcgaaaaatgggagttcaaggaagctgtctttcatgtgcattctgataaatcaccgtgttcggatggatttaatcctgctttctacaaaagattttga

SEQ ID NO: 108986 - DNA, 274 bp, Glycine max
  Peptide Sequence Number=SeqID_225764
atggaaccggaagaaaccgccgccgccgccgccgacggaagcggcgacgaggggctgctcgggctagacagcggcagcggcggcggtggaagggacagagtgaagggtccatggtcgccggaagaggacgtcattctgagccgtctggtgagcaagttcggcgcgagaaattggagcctcatcgcgcgcgggatcagcggaagatccggcaagtcgtgccggctccggtggtgcaaccagctcgatcccgcagtcaagcgcaaacccttcaccg

SEQ ID NO: 108987 - DNA, 417 bp, Glycine max
  Peptide Sequence Number=SeqID_225765
atgcggtttgttggaagggacaaaaatactactttcagtgtggacgttgtgggacctctacaccaaagggcagtcctaaccataaggcaccatatttttaccattgatgtctctgaagatatgattcaacaaaattatcaactggttctgccaccagaggcttcaatttatttaattgcatcaaaaaaatatatggttgtggatcgtggtagtggtaggcatcagaaatggatgattaccatgaacaatggcctgtcatgtgttgctgatgtgtggattcattatttagatgagtgtcatttgaaggctggagatgaggtcatctttttctacaacattgaccaacatctatgggaggtcctttataggaagcaggttacatgggatgacacaaaggatgaagctgactccccttga

SEQ ID NO: 108988 - DNA, 189 bp, Glycine max
  Peptide Sequence Number=SeqID_225766
atgaagggattaacaacatcgctgtaccagacacatatagatgcactaatgattgctgactgttcaccagattacatggactggttctttgggatatcgcatccattcatcacacccacacaggtagttgatcagcccaaacatccacctgtcccacagcatgaggcatacatggagccagatatctag

SEQ ID NO: 108989 - DNA, 156 bp, Glycine max
  Peptide Sequence Number=SeqID_225767
atgaaggattctttgaagcaaagctggtacattgatagcggttgctctaaacacatgacgggagatgcatcaaagtttactcatatttctcctaagaatagtggacatatgacctatggagacaacaacaaagataaaaccccaaatcatgcttaa

SEQ ID NO: 108990 - DNA, 420 bp, Glycine max
  Peptide Sequence Number=SeqID_225768
atgggtgccaagtacctcgaagtggtcaaacgagggtcgcatcccaacaacggatggtccccgaacgaaattaggtgcacagcggaaattaaaagagtagggaagaaggagacaaacacacaagagtttttatactggttcagcaacaacccgtgcctacatccagtccccaagcgacctgcgatccttgagatttcttttcaaccttgtaaaaatccttttacaagcaaagatccacaagggatgtaccctcccttgtcctctttgaacaacctagtggatgtaccctccactagaactgatccacaagagatgtaccctctcttgttctcagtcaacaacccaagtagatgtaccctctacttgtaccacaaaggatgtaccctccaatgtgttaagacaaagttctcaggcggttaa

SEQ ID NO: 108991 - DNA, 162 bp, Glycine max
  Peptide Sequence Number=SeqID_225769
atggaaaatgttgaaggtctatgtattttgaaaatgagggttcgggagtcttttacgcacagggaagtcgaaactcgctttaaacaaagaaaaagatcatcgatgatcgaagaaggatatgaagattcacaaagaataaaggggacccctaagggtccataa

SEQ ID NO: 108992 - DNA, 207 bp, Glycine max
  Peptide Sequence Number=SeqID_225770
atggaagatgcacccttggcccatccgagaggcctctacgcacccctcgccagagggcaggttgtgacacctatgaaagcgaggactttgagtcctatgaaagtgaggactttgagtcctatgaaagcaagaactttgagtcctatacaggataaaagtaggctccaaggtagacatctcgttttgaactctgcatccaactcttaa

SEQ ID NO: 108993 - DNA, 450 bp, Glycine max
  Peptide Sequence Number=SeqID_225771
gccctacttttgtcgaccaccccaccttttgttaccgtgacccaagagtccggtggcatgcggagacacccgatggtaactcgcacacaccctttgctatccagcgacccgagagtccgatagcatgtggagacaccttacggttatccgcacctcatcattcggagaccccaagtccgattgacaagcagagaccaatgtgttcatctgcaccctttccggagatgtcagcatcttccggtagatactattttagtctcacaccgctttctcaagtactaggtggcaggcggagatacccaagtggttatccgtacaaaatgatttctgttaatcctgacccgagaagtcaggtggcaggcaaagatacccaagtggttatccgggcaagcgagcttgttgacacgcagagactaacatcgtcttctgcacctttgtcatccagagacg

SEQ ID NO: 108994 - DNA, 510 bp, Glycine max
  Peptide Sequence Number=SeqID_225772
atgggaggcgcattcggccaccatgaccattgcggcaacgttacgcctttcgctgaggcaaattttatcggtgaccctcaagcggcagacaaggttatcacggcaaattggccaactaccattgtaggattagacgttacgcatcagactgtcatgagcagcagatacatcgatcatctgcgcagccgttcagaacgctacggaaagttcatttatgacatcactcaattctacaccgattttcaccggcgggaggcgggtatcgacggtttctatgtacacgattcttcggctattgcctatgccatttctcccgagctttttacgaccattaaggggaaaatacgcgtggtgactgaaggaccggcgatcggccataccatgataaaaaaggatgatcgtcgctatcccatagatgaatggagtgattatccggcacaacgggtctgtgtcgacgtggactcagcgggcctgctcgaattgtatgccagtacactggcggcaggttga

SEQ ID NO: 108995 - DNA, 342 bp, Glycine max
  Peptide Sequence Number=SeqID_225773
atgtacgcgctctactcttctggaaaacttcccaccgccgtaatgtgtcataacgatctgatggccgttggtgttcagaacgcggccagtgaactcggaattaaaatccctaaggatatgtccgtgatgggatatgacgatattgaaactgccagaatggctaatccaccgctgactacggtaagaatcccacttgaaaatctggctactcaggcgattgatgagctgattaaaaagataaatgagcccggtattcctgctttgatttccgtcaacccagtactggttgttcggggttcggttgatgaaccgccgatggataaggcgcgcaagcctgaataa

SEQ ID NO: 108996 - DNA, 303 bp, Glycine max
  Peptide Sequence Number=SeqID_225774
atggtgaaaccatcgaagaagcacaagggttcttcaagtagaagccaacgacactccaagactcaggatactccaattccttactccatttcctcctcctcattgttctcatcagaagaacaacgtgcactggacgatgattggaagtttgatttttctgtgcatgatgcccaccgattggtttgcaccaaccaagcggaaatgaccggaaggctgcttgccggttcattggctcttgaaagccgcatccttcactatcttattgttcgtatcttattcccaagatcttcaaaccttgcacag

SEQ ID NO: 108997 - DNA, 879 bp, Glycine max
  Peptide Sequence Number=SeqID_225775
atgacgcttacaggacagctcccccctttaaatgcgttgcgcgccttcgcgatctcaggacgtaaagaaagctttcgtgctgcagccgatgaaatgtgtgtgaccccaggggccgtcgcccagcaggtcagagcactggaacagcatctcggcataacgttatttcatcgcctgccgcggggtttggccttgacgccttccggagcggcttatcttagggatgtaactcgagcattcgatattctgacagaatccacaagcaagctactggcccagccaaatacggtaacaatcagtgtcaccccaacttttgcggcaaaactcctgataccgcgcctggcagagttccatgctgagcttccggaaattgagttgcgaactgttgcgactgaggctttatccgatttcgagcgtgaccaggtggacattgctatacggttgacacacatgccattttcttccgagctggaaacaacgctattgttcaatcaagagctcgttgttgttgcgagcccccatctcgtacgaggtttgacactccccttaaatgtcatgcaacttcaaacgttgccgcttctccacgatatgcagaattactggcctttctttttgcaatcggaggagaagcaacccggatctgcatttaatctgacggctctggctctggatgccgcattggcaggacaaggagtggcagtagcatgcagagcttttgtgaatgcggatattgatgcgggccgattggtacaggtgatggatatcaccaaaacgctggcatccagttacttccttgtttgcaaacgtgcagcggcccaaaggcaaatcgtgcgttctgtgtgggagtggtgcgttaaaagattgtccctgccttttcaatag

SEQ ID NO: 108998 - DNA, 444 bp, Glycine max
  Peptide Sequence Number=SeqID_225776
atgtcagtagaaaaagttgcgcttattatcggtggcgggtccggcatgggggcagccattgccagaaaactggcgtgtgatgggtaccatattgcagtgctttcctcatcaggcaagggggaagctttagccaatgagttggggggcatcggcgtcaccggctcaaatcaatcgaatgatgatttacaacggcttgttgatatggcaatggcaaaatggggcagaattgatgcgttaatcaattctgccggtcacggtccgagcgctgctgttctcgatcttagcgatgaggaatggcaccaaggattggagatctatttcctgaacacggtccgcgcggcacgtttagtcacaccgataatggaggctcagggcgctggagccatcgttaatatttccaccgcttgggcatttgagccccttgatatgttcccaacctcaacg

SEQ ID NO: 108999 - DNA, 474 bp, Glycine max
  Peptide Sequence Number=SeqID_225777
atgccgaggaataagaaatactttcatggccctatgattaagtggatcaggggtagattagccttcaaagacaatataagagcagggagagaagtgggggaccaggtaaggttatcacttttcttgtcataccctgtttgggtatggcaaaagttattggttctattggaaaaacaacttgcctcacaggaaaatccaactcctttcttggcaaatgaatttgggggcatcaaatcacatgtgaagcaagaacaaattggcagaactctagtgaaagatagagacactagggtaggcatcaatttgggaggaaaaaggaatgtgtttgggctagagcatacttctaccatccactacactgcagccataccaggtgctgaggactacaatgattcaacaagaaggggagcaagtacaacaattgttgatccagggcttctagtttcaagtccaaacctagccctaatgtgttga

SEQ ID NO: 109000 - DNA, 222 bp, Glycine max
  Peptide Sequence Number=SeqID_225778
atgttgtttgccatgcttgacataatcacttccaatttgggagatcctatatgggccattagttctgacacattgaactctcttgtgggtctttctctcaatttctttttaatattgcctttcatcaactttgggtttgagtatgggtttgtagggcttgtttttggtgttgtggggtggtttagtacaggaactgcatccaacttggtaccaaattcataa

SEQ ID NO: 109001 - DNA, 246 bp, Glycine max
  Peptide Sequence Number=SeqID_225779
atggtcatgaagaaggctagtgcacatggccatgatattgggtttgctggcactgttcattttcctctttatcttggttttcttcacctggtaattgagacaaaccttgtcaatgctctctttgtacatggaaaaagatctaaagcttttgtgaagatacaaggttattggaagattcaatgtgtaaaaattgaatggaagcctctttggtttgtcaaggcagtagaaaagtttgattatgattaa

SEQ ID NO: 109002 - DNA, 530 bp, Glycine max
  Peptide Sequence Number=SeqID_225780
ctttcgctgttgcaattgctatggcttccaacagcatggtcccatgcagcacttcaccagcgatgataaagaaatatgaagtgtttgtgagcttcagaggtaaggacacacgcaacaattttactgatcatctttttggtgctctccaaaggaagggcattcttacctttagggatgacacaaagctgaagaaaggggagcgtatactctctagcctcatgcaagcaattgaggggtctcagatttttgttattgtgttctcaaagaactatgcttcttcaacatggtgcttgcgagaacttgaaaagattcttgattgtgttatagtccccggaaaacgtgttcttcctattttttatgatgttgatccatctgaggttcgaaaacaaacgggagattacgggaaagccttcaccaaacacgaagagagattcaaagatgatgtagagaagatggaggaagtgaaaagatggagaagagctctcacacaagtagccaatttctctggttgggatatgatgaataagtaa

SEQ ID NO: 109003 - DNA, 2919 bp, Glycine max
  Peptide Sequence Number=SeqID_225781
atgactgaacgcagctctgggactactaattgtgttgaggttcttttgggctcggttacaatttcattacggctctgtcccagttgtgttgcgctccacaaccaaagtattgtagccgcattaataggtgttgtggttcacgatttagaaccatttaacaggtcacaatatgatgagattgaaaaaattgttcaagagatactaagtaaattgggtcgcaatttttcaagtcttccaaatgatctagttgggatggaatctccggttgaagaactagaaaaacttttacttttggacccagttgaagatgttcgcattgtaggaatttttgggatgggtggaataggaaagacaactctcgcttctgttttatatcatagaatctctcatcagtatgatgcctgctgttttattgataatgtaagcaaagtttatagagattgcggtccaactggtgtggcaaagcagctgctccatcaaactctgaatgaagaaaaccttcagatatgcaatcttcataacgcagctaatttgatacaaagtaggctacgttatgtaaagacacttatagttcttgataatgttgatgaagtcaaacaacaagaaaaattagttttgaatcgtgaatggttaggtgcagggagtagaatcatcataatttctagagatatgcataacttaaaagagtatggagtgacttcagtctacaaagttcaactcttaaatggtgctgattctcttaaattgttttgtaaaaaggctttcaattgtgatgatattgtgggaggttacaaagagttgacatatgatgtgttaaaatatgctaatagcctaccactagcaatcaaagtactaggttcatttttgtgtggtcgaagtgtctcagagtggagaagtgccttagttagactgaaagagaatccaaacaaagatatcttggatgtgcttcaaataagttatgatgggctacaggaattggaaaagcaaatatttttagatattgcttgtttcttcagcgggtacgaggagttatatgtgaagaaagttctagattgttgtggatttcatgctgaaattggaataagagttctccttgataaatcactcatagacaattcacatggattcattgaaatgcatgatttgttgaaagttttgggcagaaaaattgttaaaggcaattcacccaatgagccacgaaagtggagcaggttgtggctccctaaggatttctatgatatgtcgaagacaacggaaactacaaacaatgaagccattgttttagacatgtccagagagatgggaatattgatgactattgaagctgaagcattgtccaaaatgagtaaccttaggttactcatactccatgatgtgaagtttatgggaaaccttgattgtctctccaataaactacaatttctccagtggtttaagtatcctttctccaatttaccatcaagttttcagccagacaaactggtagaattgatcttgcaacatagcaacatcaaaaaactatggaaaggcataaagtatctgccaaatttaagagctttggatctcagtgattccaagaatcttattaaggttccagactttagaggggtccctaatcttgagtggataattcttgaaggatgcacaaaacttgcatggatccatccatcggttggtcttttaagaaagcttgctttcctgaatttgaaaaactgcaaaaatctagtaagtcttcccaacaatattttgggtctaagttctctggaatatctaaatatctctggttgtccaaaaatatttagtaatcaactgttagagaacccaataaatgaggagtattccatgattcctaatatcagggaaactgccatgcaatcccagtcaacatcctcctccatcatcaagagattcatacctttccatttctcctactctagagggtctaaaaattcaggtggttgtttgttgccttccttgcctagcttctcttgtttgcatgaccttgatctaagtttctgcaatctaagtcaaatccctgatgctattggatccatcctttctttagaaaccttaaatttagggggaaacaaatttgttagcctccccagtaccatcaacaagctttccaaacttgtacatttaaacttggagcattgcaagcaattaagatatttgcctgagatgccaacacctactgccttgccagtaataagaggaatctattcttttgctcattacggaagaggattaattattttcaactgtcctaaaattgttgatattgaacgttgtcgtggcatggcattttcttggttgttacaaatcctgcaggtgagccaagagtcagctacccctattggttggattgatattattgttcctggaaatcaaataccaagatggttcaacaatcgatgtgttggtaattcaataagcctagacccgtctcccattatgcttgacaataactggattggcattgcttgcagcgtggtatttgtggtatttgatgatccaactagtttggataatgattggaaatcctctataagcattggttttgagacaaaatcttattcatcccggggttcaccgctctatattccaatacttcttgataggaatcttgtaacggttaaattgcatcacttgtggttactctatttgactaggggagaatttttttcctattttaaaatagaaaaaatgcttgatctttatggcatcaaaatgcatgccatggtcgacaactctcaaggtttgcacttggaggtgtgcagttgtggatatcagtgggtatttgaggaggatctgcaaaacttaaacccaacaataatgcgtagaggatacagcaacattccagttgatgatgattttgtgaacggcggttcaattctttcattagaagctggaagctag

SEQ ID NO: 109004 - DNA, 1299 bp, Glycine max
  Peptide Sequence Number=SeqID_225782
atggtgggaagaaatatggagaagtttctagacacaaacagaactctagacatttctctaagaccaatcaagaaaagtatcctccataaagcatttataaaaagacaagtcacttggagaaggaattgctggcatcattggaaaccaaagttaaaatggagaaaggaaaagatgttgcacaatgtcactatcgtaagaaatttggacatgtggaaaagaattgccccgataaaaacaagcatcaagcaaattccattgaagagcatgacaataagcaacatgttttctatgctacttgagattccaatgataggacaggtggaaatgggtatttggatagcggttgcagcaatcacacaaccacagtcaaagttcaattgggaaatggagtcatggtcaaaaggaaaagacactgtcgtggtggagacaaagaaaggtatgagattcatcaaagatgtcttactagttccaaatcttaaagaaaatctcttgagcattggccaaatgatggagaaaggctattcttttcacttcgaaggagatatgtgcactatttatgataaaaagaacaaaaggcaagaaattgccaaaaataacttggtctacttcttcaaagaaaaattagaggtcactggaatattcaagaagttcgaaactcttgttgagaaaaaaagcggaaaacatactaacataataggaagtggtcgacgcaaagaatataacttacacgagtttgataagttctgtgaagatgaaagcatcaagcaacaacttacaatcaaatactctctgcaacaaaatggcatgtctcaaaggaagaataagacaatcgcggagatggctagatcaatgctaaaagaaaaaggtttgcctaatacattttggacaaaagcaatttacattgcagtctacgtacacaacaaatgtccgactaaggcagttcaagacaagactcctattgaagcatggagcggacaaaattcatcggctaaacatctaagagtatatggatctatttgctacatacatcataagagacatgagctacaagacaagagtacaagagaaatcttcatgggatacaacatgcaatcaaaaggctatagggtctacgacttacaaacaaaaaacgcatcatcaatcgagatgttgaggttgatgaaaatatttcttggatggggaagcagaaaaagttcaagaagtggcagaagaagcaggtatgcttctgtctcctctacaacaagattcttcaccagagtctactccaagatgagtaaaatcattggtggacatatatga

SEQ ID NO: 109005 - DNA, 366 bp, Glycine max
  Peptide Sequence Number=SeqID_225783
atgaagacatttgttttgctctcaagatttatgggacattgtagaagaatgattcattgctcctacggacactttaactcttactgcaactcaaaaaaggagttgaaggagaataagcaaaaagattcaagggaattatatattttacaacaagcagtagacgacgtaatttttccaagaataatggatgccacaaatgttaaagatgcatggagtacactgcaggaggagtttcagggcagcaacaaggctagccagactaaggaaatcataatctgtgtgtcggtcatggtccaaaggtggatcgtgacaccaagtgtcgatggtcaaatggatatggttgagtggggattttgggtaacgtag

SEQ ID NO: 109006 - DNA, 648 bp, Glycine max
  Peptide Sequence Number=SeqID_225784
atgtcgtcccttgtgacgggctcgtggggtgctaataccttccttgtgcgtaaacaactcccgaaccctcattttcaaaatacgcagacctttgtcattttggtttttctgacgttttcctcatataaacgttggtggcgactccacaaattttccttcaatggaagacacacccttggcccatctgagaggccttttcacgcccttgccaaagggcaggttgcgacagttggcgactccactggggacctaactataatcattgttatcaaaaggaaagaacgcactttacggtgcccttatcgatcccgtcgaccagttagtgtattgggtgaagtagaggaggggaaagtagttggtggtgtacccctgccaaacactttggagggccctcagtttcgcccacaaccacaacccttgcattttgtagcgggaagaatccctccttctatagtggaaaggggaaagttagatcatataaaggtaaggctaagggccattgaaggaggcagagatcatgcttttgctgatatgacagagttatacctagtgcttgatgtcatcttccctccaaaatttagggttcccaatttcgataagtacaaagggactgcttgccccaagaatcaccaaaaattgtactattag

SEQ ID NO: 109007 - DNA, 525 bp, Glycine max
  Peptide Sequence Number=SeqID_225785
atggtagcaggaaatacaactatagaaaaacctagagatcaatgggatgaagatgaaagaagaagggttcaatataatttaaaagccaaaaatataatcattgttgcattaggcatggatgagtactttagagtttcaaactgtaaaaatgaaaaagaaatgtgggatacacattacaagaataaaggagaagattcctcatcaattccaaaatgctatgaatgtgatcaacttgggcacctaagagttgattgtcctatctttaaaagaagaatggaaaaatctgacaagaaaactttcaaagataagaaaggaaagaaagcatatatcacttgggaagataatgacatggattcatcaagtgattcagaaaacaaaattgtaaatctaagccttatggccaaagactatgaaagcgaatatgagatgatgacaaaggtgatgacaaaaagctcaaaggtcaatcaaaagaatgagttcaagatattcaagatagaatcaagaacacttcaagattcaagatga

SEQ ID NO: 109008 - DNA, 357 bp, Glycine max
  Peptide Sequence Number=SeqID_225786
atggtaacaggaaatatgcatcctcaattgaaagagaagttggtggctcaagaatatggtgatctcaaccaattagcctctaaagctaaccaaatagaacaatctatacatgagaaagagttgaagacaactaacaaaggacagagatcccatttaatcttgttagacaacattgataataagaatagtgaggcttttgaagaagtaaaatttgaaatcatgggtgctaaaaacttgagaggaaagtctcacttatgtccaactctgaagcctggaaaagacaaggcattgctaaagatgggaaggccgagtatgattttgacatattcaaggcaaatcagattttcgaccatctaa

SEQ ID NO: 109009 - DNA, 1419 bp, Glycine max
  Peptide Sequence Number=SeqID_225787
atggaatctgttaagccatcagcagtgacaccaagcaagagcaaattggctcgcacttttgccaaagttcttcacgttagagcagtgactggaattgcaccagttgatggactgaagaatgttaaagttgatgcggatctcagcaatgaagcaaatatgtgcaagagtgcaataaacatagaagatgaagagcttcaggaaagaaaggccacagaagctttgcttgcaaaaacttttgctagcatttcaacagttaaagcttcgtatgctcagctacagaatgctcagtctccttatgaccctgatggaattcaagttgctgatcaattgatagtctcagagttcaagaccttgtctgagctaaagcaatgttacttcaaaaaacaatttgatcctttaccagatagagcaattcttgcagctaaattaaaggagctgcaaagtgtcaacaaaacctttgagattacagggaagaagttagaatcgcaggcagggctcaaggactctgagattatatttctccaagaaaagctagaggaagctaatgtgcacaataagtcaattgagaagaggttaaatcaaagtggatcattatcagttcttgataatctccatatgtcaggactaagtcctagccattttgtcaccgttcttcgccacacagttaggtccattcggagctttgtgaaattgttagtaaatgaaatgagatctgctggttgggatattgatgcctcagtcaatgccattattgaacagaatgtggtttacttgaaagaagatcacaagtgttttgcaattgagtcctttgtgtgtagggagatgtttgattcattcaacttccctaacttctccctaccaaatgagtctctaccagataagaacaagaggcaacttttctttgggaggttcaatgagctaaaaccagtgaaagcaaaggactttcttgcagggaaaccaagatcaccctttgcaaaattctgcaggaacaagtacttgaggcttgttcatcccaagatggaggcatcgttctttggcaacctgaatcagagaacccttctgaatgctggagagtttcctgacacaaatttcttcacttcatttgctgagatggccaagagggtatggctcctgcactgcttggccttctcctttgagcctcaagcttcaatctttcaagtgggaaaagggtgttgtagattctctgatgtgtacatggagagtgtgaatgaaaatgatgaagcagcattgccagtggtggagtctgagccacaagttgctttcactgtggttccagggtttaggattggtaaaactgtgatacagtgccaagtttacctctcacagcaccaaagactgacccccgcatgcaataggttgttatattgtgttgaagtggaagccaatgttttgagttga

SEQ ID NO: 109010 - DNA, 282 bp, Glycine max
  Peptide Sequence Number=SeqID_225788
atgaatctaaaaggagagaaggttcaagcagctgatatctcactaagcgaggcatatgcacttagcgagtggcatccgctaagcgaggcatgcagctcgcttagcgtgctaggaaaccctagaagaggatcattcagagatgtgctggcccaatgcgccgcaagctcacccagtgagtcatttgtctcttctcgggctcagtgcgcccagctcgctaagccaaaattcacttactctcgcatagcgagccttcagaagctaaaacatccaagtagcctttaa

SEQ ID NO: 109011 - DNA, 639 bp, Glycine max
  Peptide Sequence Number=SeqID_225789
atggttcaaaaacaaggagagaatacattggggatgcctacatccttgatgacatgcccaatagcaacaacattcgccaatccttcaattggtaataattttgttgtggtatctgggcaattagctaaaatagtcaaacctatggtgcaaaatgaaatgcaacaaactaaagaattagaagtgagaatgatgaatgctagcaaaaattatgcttcttcaatgactagaaatcatgaagtgtcgaatcaggcgactcagccaaatatgattatgtcaggaatattcaacatggttcaaccgataagcaaccaagtggggttttaccctagacctttggtaggaaatacaagttatatgcctgtcaatgtgagtaatttgtttgtcgctacccctaagggcaaacaggatgcgaaaatacccaaaggggaaggcaaaatggtcattttaaggctttttttgaaccctgactcgcccagactagcctctggctcgcttgggccaccaaataacttcatggtgaaaggggttgagatggaggttcagaggttcagaggtgaaggattaggaaaaaacaagagaaaagaagaaggaagaagagaaaaagaagctaaatcgtcgccgaatcgcgactgcaattga

SEQ ID NO: 109012 - DNA, 630 bp, Glycine max
  Peptide Sequence Number=SeqID_225790
atgttggtcttgttgtctgaggcggttggttgcccaagatctattaatttcttatggtctagatctggtcttggatccagaatgagtctaaggactccagagagcaagaagaggggtcacaagaatctcaaagtgctgaaagacaaggcagagatggttgacctagataggcctagggcgacttctcctgtcgtgtttgctccttcctctccctcttgccaagcagttatggttaagcaaagcagtcgtgcccaggcggtttctcctctatctcgaggacatctcgtggaaccaatatgggatattcctcagaatagctttaagatgttagacgtgattctcacaatccgagattggaaatcgatccaagaggagggtttccccatgttctcgaaagcctttgaccatatggcattcatgggtgcccaaaatgccattttctctcggtttcttaatacaatccttcccaggatgttgatcatgaacctttcaagcatgaatttgagatgccaggttaaaaatgaggtgtggttggtgtatgacaagaccaagggcaaatgggtcgagggggctccaatttctactctagatgtcgaagatgacaacaatgtcgtcgttgtcgatgtttaa

SEQ ID NO: 109013 - DNA, 1635 bp, Glycine max
  Peptide Sequence Number=SeqID_225791
atgtccacttcgaaacccatatccccttttcgactcacctccctcctccgttccacgaaagacccctccctcgccctccagctcttcctcaaccctaaccctaaccctaatcctaaccctcgccccctgcgccactccctccgctcctacgatctcctcatcaccaaactcgcccgcgccaaaatgttcccccaaatggaacaaatcctccaccaactccaaaccctaacccaattccccgtccccgaacccctcctctgccgcgtcatcatttcctacgcacgcgcccgcctcccctcccgcgccctgcgcaccttcctctcaatcccctccttccgctgcacccccactctcaagtccttcaactccctcctccacgcgctcctactctgccgcgacttcccttccctcccgcgcctcctcccgcgcctccgccacttctccgcctccggccccgacgcctgcacctacaacatcctcatccgcgcttgctccctgaacaacaacgaccttgcacacgcacgcaaactgttcgacgaaatgctcacgctcggggttcgtccgactcaagtcacgttcggaactctgattaacatgctctgcaaagacccgcatttgaacttgcgggaggcgtttagtgtgaaggaggacatggagagggtttttaaattgaagcctaatgtttttgtgtacactaatttgatcaaagccgtttgcgaggttggggacttcgattgtgcgtttaggttgaaggatgagatggtgaggaacaatttgaggctggatgttgtggtgtacaacactttgacttccgcagtttttaaagcggggaagaagggtttagggtataggattttggaggagatgaagagtggcggggtgaagccggatgcggtgacgtgtaatgtgttgattggggagttttgtagggaggggaatttggtggaggcttatagggttttggatgatggggtggagggtgtgaagcctgatgtttttgggtacaatgtggttattggatggttgtgtaaagagggaaaatggagggaggcggatgatttgtttcgggacatgccaaggcggcagtgtgttcctgatgttgtgacctaccggacagtgtttgatgggctttgtcagtggatgcagtttgaggaagctgggttggttttggaggagatggtttttaaaggctatgttccgtgttcctcaagtttgaatgagtttgttggcaggttgtgccaggaaggggattttgagttgttggggaaggttttgagtggtttgggtggagggtttttttgcaatgagaatgtgtggaaaactgtggtttccttgatttggttccaccaaatgcacactcaacgtgagattctgttccaaaataccagaaaggagatatgctcattgaggccttctttgcttgacccccatcaaaaaggagtcattaagtctgctaccttagcttccaattctactacttgtggttgtggatgctcccaaacctggaggtatatggacttgcttgcttggcactcccatttccattgtaacaagctgaaaatacttggctggctaattaagttgatgatgcatggtgtaacatcaaaatggatgatggtgttcttaaaatgttaa

SEQ ID NO: 109014 - DNA, 313 bp, Glycine max
  Peptide Sequence Number=SeqID_225792
gcatgttgcacataggcggggatggggaaggtgtggatgtaggtattggggagaatcaacggaagatggagatggtgtggatgcagttggaggtggagatggtgtaagttcaacatcgggaggcctaactgggatagacacagaagacggggatggggtagataatgtcagactatctcgaggtggtaatagtctaactgcatatcatcttttcttcgtagttgtccctttcccactagagtcatgtgacgggagtcgaggagggtcaacactacttgatgacatatctatatatagaaaaataatattataa

SEQ ID NO: 109015 - DNA, 252 bp, Glycine max
  Peptide Sequence Number=SeqID_225793
atgccaaaagatagggggacttgtcttgatttcaggtattgtcatcatcaaaaagggggagattgtagacaaaggatcaagctgaaagttttgatgatcccaaaggattacatgaatcatatgcttctcaaagggatcaagctgaaagttttgatgatgccaaaggattacatgaatcatatgcttctcaaagatttactcaagacaaagcaattagagatattcaagatggataatcaagacagtctatag

SEQ ID NO: 109016 - DNA, 258 bp, Glycine max
  Peptide Sequence Number=SeqID_225794
atgaagagcaccaagggtcattttgaagaaattcagagtgtcactcgtctgggtgctttcaactcgcctaagctagcgagttgctctggcacgtcttggatcaaaaggataaaaaccatgcaacagctgaagaaggaagcaaaaacagaggaagaacaacgtgaggaagagagtgaaaaaagaaacagagaagttggagctgcagtgatcgacgtcgaagtgaccgtggattgcatccttcatcatttcatttgttga

SEQ ID NO: 109017 - DNA, 363 bp, Glycine max
  Peptide Sequence Number=SeqID_225795
atggcacgcagagaccaagtttggtcattctgcacccatgatccgcggagataccttacggttatctgcacccctttgctaggcagacacagttgtgtccgatggcacgcagagaccaagtttggtcattctgcacccatgatacgcggagataccttacggcagacacagttgtgtccgatggcacgcagagaccaagtttggtcattctgcacccatgatacgcggagataccttacggttatctgcacccctttgctaggcaaacacagttgtgtccgatggcacgcagagaccaagtttggtcattctgcacccatgatacgcggagataccttacggttatctgcacccctttgctag

SEQ ID NO: 109018 - DNA, 129 bp, Glycine max
  Peptide Sequence Number=SeqID_225796
atgacgagcagcgcaaagagagggaggttgcaacagagacgaaagcaggggcgaggcagcgatatttttgggttgatgatgagaggtagagtgacaaaaggagaaagggaccttattcattgtgattga

SEQ ID NO: 109019 - DNA, 273 bp, Glycine max
  Peptide Sequence Number=SeqID_225797
atggaacacgcatcccgcgagtcacgcgtcgccctcccgccgaagggtaggttgcgacaccttgagcgtgagaatgaaatggccccaaggaagcttgcctcaaagagatccaggaaggataaagcggctgaaggaaccagttccactcccgaatatgatagtcatcgttttaggagcgctgagcaccagcagcgctttgaggccatcaagggatggtcatttctccgggagcgacgtgtccagctcagggacgacaagtataccaatttctag

SEQ ID NO: 109020 - DNA, 282 bp, Glycine max
  Peptide Sequence Number=SeqID_225798
atggatttctttaacatattgagaaaacatagagacaatgaaaaaatattgagtctttggttcaacgatcaagctgctaaaatcatgaaaggagtctttgtgctttcttcaagaattgacaaaccattttgtaagtacgatggtttcactacacgaaagtgtgtagcgaaggtttacatcaatattgtggacttatcattggttgaaagtgtgaggattccatacatgaaaaatttacctccatattacattttggatgcatgtggttcggtgtgcatttga

SEQ ID NO: 109021 - DNA, 207 bp, Glycine max
  Peptide Sequence Number=SeqID_225799
atggaggcttcaatcccttcttctctctcacgtttgagaaccctatcagagcaattagagaaaaaaattgaggaatctcaggaacttgctagagatgccgctatcgctgtcgaaagacatgtgagcccgcttagagcattctcgcaaaacactgtgaccttgattggtctccctatgttcttacctagtgagagtgacctaacttga

SEQ ID NO: 109022 - DNA, 873 bp, Glycine max
  Peptide Sequence Number=SeqID_225800
atgtctcaacctccaggttttaaagactctaattcttcattggtctggagactgaatagggctttgtatggtctcaagcaagctcctagggaatggtttgagaggctgcagtttactcttattcagtttggttttgtagctagtaaacatgatccttctttgttcatctacgcagcctcagtttatcttttggtctatgtggatgacattattatctccggcagctccattcaattgattcaacagctcacctctcaacttaatgcaaagttttctctcaaacaacttggtcaacttgattattttgttgggattgaagtcaagactttatctgatagttctctattacttacacagagcaaatatattagagatctcttacagaaaactaatatgacacaggcacaagttatttcttcccctacgacttcaagctgcaagctcactacaacaggctcagatttgtttactgatcctaccatgtatcgttcagtggtaggtgccttgcagtacttgactataactagaccagtgataagctttgctgtaaacaaagtctgccaattcatgccaaatcctttggatactcattgggctgcagtgaaaataattctacggtatttaaaaggcatggttctttatggtcttcatttacgacctgcagctttgggtcaaccttactctattagagctctttgtgatgctgattggcatcagacactgatgatagatgttctacttctgaaagttgttgcaagatccagcacagaggccgagtacagaagtctagctgaaaccaccgcagaaatttcttggatcaagaccttgttaactgaattaggagtaccattcataactcctgtgatattgtga

SEQ ID NO: 109023 - DNA, 360 bp, Glycine max
  Peptide Sequence Number=SeqID_225801
atgaagattgatatcttttttgttcatgaaaatgtgctcaccaagcaattgattgttcatcgtattcctgctcttgatcaatgggcagatgcactcagcaaacctctctctccagccagatttgtttttcttcgaggcaaactcaatgggttaaaagatctcacttctctcaaggaactcgacctatctaataacaacatctcagtccttctgcccgagctgggtttgctggagccaagcctacaggcactgagacttgatgggaatcctctcagaagcattcgaagaactgtcttggatagaggaactaaagctgttctgcaatatttgaaggacaaattgccagagcaagagcaatag

SEQ ID NO: 109024 - DNA, 357 bp, Glycine max
  Peptide Sequence Number=SeqID_225802
atgaaagtgtatgatgatgccgtgatttatgcaaatgcaatgcatgaatatgatgcaggagtgatgcacccattaggatgctatgaagagatgcatgatgcgatcaaggaacaagccagagtaagtttgctatgtgcccccgaattgaggaacctaatggaaatgatccaaaagtctacttctagtgacaacaacaaagggtggtttcaagtaactttactggcttctagagatatcatcctcttagaggaaaactcagatgaggctacattgttatcaagtgtgttggagacccagcatgaccatagaccgacctccactccttatggctcacgtagacccgggtatagggcctaa

SEQ ID NO: 109025 - DNA, 549 bp, Glycine max
  Peptide Sequence Number=SeqID_225803
atgggtgccatcactagtcataccaacaaaatgaaaatgctgcagaggcagctaagtgttgtgatgacactcctttgttgtgttcattttcatgtccaatgttgtgatgaagttgaagatgcaatcagcagatctgacttcccagaagggttcctcttcggaacgagcacttcctcttaccagaaacaacaacagattgaaggagcaccttttgaagatggtaggggtttaagcaactgggatgtttttagtcatacaccaggaaagataaaaaatgacgagaatggtgacattgcagatgatcattatcatcgctacttggaagacattgagttgatgtcgtctcttggggtaaacgtatatcgattttctatttcatggacaaggattctaccaagtaagtatttaaatttacatactagttcacataatctttcaaaatttccgcataatttgatcttcatgaaccgtaacaggagggatatatggggacataaatccaaatgggataatgttctacaacaagattatagacaatctgctgcttag

SEQ ID NO: 109026 - DNA, 1701 bp, Glycine max
  Peptide Sequence Number=SeqID_225804
atggatcggttgctgaaagcggcgagagcctctggttctctcaacctctccaatcgatccctcactgaaattcccgacgaggtttaccggaatctggagggcctcggcggcggagacgacaagtggtgggaggcagtggagcttcagaagcttattctggctcacaatagcattgcatcgttgaaggaagatctgagaaatttgccttttcttgctgtgttgaatcttagccacaactctctttctcagcttccagctgctattggagagctgcctcagttgaagatgttggatgtttcattcaattcaatagttaacataccagaggagattggatcggctatgtcgcttgtgaagcttgattgttcaaataatcagctcacggaacttcctagctcgcttggaagatgcttagaattgtcagacttaaagatgttggttgagtggttgccttatgctgcttatctgacaaaagggggatcaaacaatcttattacaagtttgccagaagatttagcaaattgttccaaattgtctaaactagatatggaggggaacaagctaacagtgatatctgaaaatctcatttcatcatggaccatgcttactgaattcaatgcatcaaaaaatttgctgaatgggataccaaccagcattggaggcctttcacgtctaattcgtgtttacgttcatcaaaacagaatatcagcaatcccttcatcaatcattggttgtcattcacttacagagctttatttggggaataacaatatttctacattaccagtggagataggggccctttctcgccttgggactttagatcttcactctaaccagctgaaggactatccagtagaggcatgcaaattgagtcttttagtcttggatctttctaataattctttgagtgggttaccccctgaaatgggtaagacaattctcttcactgacattgaatctctaccttttgtttcttgtttaggcaagatgactacattgaggaaacttctgcttagtggaaatcctatgagaacttttcgaagctcattagtatctggacctacaccagcattactgaaatttctccgaagcagactttctgaagatgaagattctgaagcagtaaccacaacaaaagaggtgatcgcaatggctacccgattgtctatcacttcaaaggaactttctatggaagggctggggttgagtgctgtgccatcagaagtatgggaatcaggggaggtgataaaacttaatctttccagaaactccatccaggagttgccggttgaactttcttcttgtgtttccctccagacattgattttatctaagaatcaaattaaagagtggccaggttcaattcttaaatcactttcgagcctttcatgtttgaagctggataacaatcccctcaaacagatacctttggatggctttgaagtggtgcctaagcttcagatcctggatctaagtggtaatgcagcttcattactagatgtacctgcattttctagtttgccatacctgcaagagctttacctaaggagaatgaggctcagtgaagtcccatcagatatagtggggctgcaacagctacggatccttgacttgagtcagaattcccttcaatcaattccagtgtattgtaaagagacctgcagttattcaacttcagtctcagttagttttaactag

SEQ ID NO: 109027 - DNA, 345 bp, Glycine max
  Peptide Sequence Number=SeqID_225805
atgtctctcaacctatgggggagacatatgaaataccccaccacaatcaagccgacttcgaacctcacctcagatatgcaactgaggggaagaatccctcctgctatgggaaaattggatcatatagaggaaaggcttagggccattgaaggaagcagagattatgcctttgctaacatgcaacagttgtgcctagttcccgacgtcgtcatccctcctaagttcaaggtgccagactttgacaagtacaaggagactacttgtcctaagaaccatctgaagatgtattgtcggaggatgggggaatacgcaaaagatgaaaaactgttaatgcatttcttctag

SEQ ID NO: 109028 - DNA, 1308 bp, Glycine max
  Peptide Sequence Number=SeqID_225806
atggagcagtcgctgctgacccagcaggtggagctgggcgtggcctacatgccggtgaatcatcccagcctggcgacccggccgctgtacgagaaccgcatcgtggcggtgctgccggccggccatccgctggccgcgcgccgccaggtgaccgccgccgaactggcgcgcgagccgttgatcggctatagcgccgacattcccttcggcatgctggtgcacaagctgttcggcgccgaggacgcgcagcccgagccgcgcatcgaggtgcagcaggcgcacgtggcctgcgccctggtgcaggccggcgccggggtggcgctggtggacgagatcaccgtggccggcccgatctggtcgcaggtggtgaccgtgccgatcgccgataccgtcagcgcgccggtcaatgtgttccacctgcaattgcagccgttgtcgcgcttggcgcaggccttcatcgacgtgctgctggcgctcgaccagcccgtgccgattggttcctatgatgccctcgtccatccagcgcaaaacgccgctggagccgctaaacgcaatcgggaaaggaagggcgcagcaatgggaagaatcttgacgatgcaggatgtcgaagccgcggtcaggggcggttcggtgtttgcctgtggcgggggcggctgggccgagcatggccgcgaactgggatcgctggccgtgaccatcggccggcccgagttggtgtcgatggacgaagtgcccgatgacgcctggatcgccaccgccgccgccatcggcgcgccgggcggcctgaccgactggcagatgctgggcatcgactacgtcaaggcggccgagcgcctgcaggacgcgctgggcgagcgcctgtatggcctcatcatcggccagaacggcatgtccagcacgctcaacggctggctgccgtcggcggtgctgggcaccaaggtggtggacgcggtgggcgacatccgcgcccatcccaccggcgacatgggttcgctgggcctggccggcagccccgagccgatgatccagtgcgccgtgggcggcaaccgcgccaacaacgcctatatggaactaaccgtgcacggcgccaccggcaaggtgtcgccggtgttgcgcaaggccgccgacatggccggcggcttcatcgccagctgccgcaatccgatccgcgcctcgtatgtgcggcgccacgccgcgctgggcggcatcagccgcgcgctggcgctgggcgaagccatcctggcggcgcagcccaagggcggcagcgccgtgatcgacgccatctgcaaggccacgcagggcgagatc

SEQ ID NO: 109029 - DNA, 99 bp, Glycine max
  Peptide Sequence Number=SeqID_225807
atgcagttggcgaaagcgggcgatggcgcgcggcagcagcgactggcccaggctcgggctacaggacaggcgcaactggccttcgcggttctcggccag

SEQ ID NO: 109030 - DNA, 870 bp, Glycine max
  Peptide Sequence Number=SeqID_225808
atgcattaccctaagctgtatctaaatccagggattgagccatttgtgacaattcatcatcacgatttgccacaagaactggaagaaagatatggtggttggattagtctcctaatgcagagagattttgttcattttgctgaaatttgtttcaagagctttggagacagggttaagtactggactaccatcaatgagccagccctggttgcaaactatgcctatatgaaaggaatatatgcccctggtcactgttctccaccttttggaaattgtaatactggtaactctgatgttgagcctctcattgtcgtgcacaatatgttactggcacatgccaaggctgttgaattataccgcaagcattttcaggcaaagcaaggaggaaccattggcattgttgcacactccgtcatgtatgaaccacttagagatgaagaatgtgatagacaagctgtgaatagggccttggcatttctcataccctgggtcttagatcccctggtttttggtgagtacccagccgagatgcattctatccttgggagtcagttgccagtgttctctcttaaagagaaaagtctcctaaaaggcagcatagactttattggcatcaatcactatggatctctctatgttaaggactgctccctctctgcttgttctcttgaagcagatcatccaataacaggttttgtagaagtaactggaataagagatggcgttccaattggtgatcaggttcccttatgtcctttagctgctcttttcattctgttgtttactcaaatgtttgatacaggaataaacaggtttttcatggttctatgttgttccaaggggcatgcagaagcttgtagactacgttaa

SEQ ID NO: 109031 - DNA, 324 bp, Glycine max
  Peptide Sequence Number=SeqID_225809
atgagaggaatatatccccctggtcactgttccccaccttttggaaattgtaatactggtaactctgatgttgagcctctcattgccttgcacagtatgttactgtcacatgccaaggctgttgacttataccgcaagaattttcaggcaaagcaaggtggaaccattggcattgttccacattcccttatgtatgaaccacttagagatgaagaaagtgataggcaagctgcgagtagggccttgaacggattcccaaactttctgttcaatggttttctagtttcctcaacaacactagccacaccaacaaacaagacctga

SEQ ID NO: 109032 - DNA, 1320 bp, Glycine max
  Peptide Sequence Number=SeqID_225810
atgtcttgcctttcaaacctgcgtcgccgtcgtgtcgatacggtcgatacccttcctgcccacttcgtccagcgcctcttcgtagccggcgtcggcatagcgcagcacgccgctggcggtgtcgttggtcagcgacaacgacaggcgctgcgccgccgcgtcggtgccatcggccaccaccgtcacgccggcgctggtcatatagccgctgtagccgccgccgcccgagtgaatcgccaccaggtcggcgctggacgaacagttgatcatcgcgttcagcagcggccagtcggcgatggcgtcggagccgtcgcgcatgttctcggtcatgatgttcggatgcgccatggcgccggcgtccaggtggtcgcgggtgaaggccaccggcgcggccaggatgccggcgcgcaccatgcggttcacctccagcgccagttccgtgcgctcgccgtggccgagccaggcgatgcgcgcgggcaggccctcgaacggcaccgattcgcgcgccagccggatccagttggacacgatcaggttgtcggggaagcgccgcagcaggaaatcgtcgatcttgcggatgtcatcggggtcgttggacagcgcgatccagcggaacgggccgatggcgcgcgcgaacagcgggcgcaggaaggcctcggtaaacaccgggatctcgaaggcgcgctcgacgccgccctgcttcgcatgggtgcggatcaagttgccgttgtcgaacaccacggcgccgcgatccttgaaacccagcatcgcggtgacgtggcgcacgatcgagcggcggctggcgtccatcaggccggccatgtcgtcgcggcgcatgcgcgccacctgctccagcgtgtggccggccggcacgtagccgtagaccaggtcatgcgccgaggtctggtcggtgacgatgtcgggcacgatgccgcgcgccaggatctcgggatacacgtcggcggcattgccgagcaggcccaccgacagcggacggcgcgccgcctgcgcgtcgcggatcagcgccagcgcctcgtccagcgagtcggcacggcactccaggaagccggccttgatgcgtttctcgatgcgttccggatcgatctcgaccgtcaggatggcggcgttggccatgcggcccgccagcggctgggcgccgcccatgccgcccatgcccgcggtcaggatgaagcggccgcgcaggtcgttgtcgaaatggcgctcggcgatgcgcgagaagatctcgtaggtgccctggatcacgccctgcgagccgatgtactgccagtcgccggcggtcaggccgtcccagcagatcag

SEQ ID NO: 109033 - DNA, 1230 bp, Glycine max
  Peptide Sequence Number=SeqID_225811
atggcgtggaatcagcccggtaataacggacaggaccgcgacccgtgggggagcagcaataacaatggcggcaactctggcggtaacaacaaaggcggtcgtgatcaagggccacctgatttggacgatatcttccgcaaactgagcaagaaattgagcggtttcggcgggggcaaaggctccaacagcaatagcggcggcaccggcacctctggtccaggcttcagcggccgcattatcggtatcgcggcggtggccgtggtggtgatttgggccgccagcggcttctacaccatcaaggaagccgagcgcggcgtcgtgacgcgtttcggcaagttcagccacctggtgcagccgggcctgaactggaagccgaccttcatcgacgacgtgcgtccggtgaacgtggaatccgtgcgcgagctggctgcgtccggcgtgatgctgacctccgatgaaaacgtggtgcgcgtggaaatgaacgtgcagtaccgcgtgaccaacccggaagcgtacctgttcagcgtcgtcaatgccgacgacagcctgagccaggcgaccgacagcgccctgcgcggcgtgatcggcaaatactcgatggaccgcatcctgaccgaaggccgtaccgtggtgcgtaacgatacgcagcgcatgctggaagagaccatccgtccttacaacatgggcatcacgctgctggacgtcaacttccaggcggcgcgtccgccggaagaggtgaaggcatccttcgacgatgcgatcgccgcgcgtgagaacgagcagcaatacatccgtgaggcggaagcttacgccaacgaagttcagccgcgtgcgaacggccaggcgcagcgtctgctggaagactccaaggcttataaggaccgtaccgtcctggaagctcagggtgttggtgagcgacaaaggcaacaacctgatggtgctgccgctggatcagatgctgcgcggccaaggcgcggcgccggagagcggcaacaaggataccagcctgattcgcctcaatccgaatcctgcgccggctgccaacagcagcgccccgcgcaccagcggcgttattgtcctcgcggtgctggtggtgctgtacgcttcgctgttcgtggtgcaggaaggccagcgcggcatcgtactgcgcttcggcaaggttctgcgcgacggcgaaaacaagccgctggtgtatgcgccgggtctgcacctcaaaatcccgttcattga

SEQ ID NO: 109034 - DNA, 606 bp, Glycine max
  Peptide Sequence Number=SeqID_225812
atgcaaggccacactgaaactaactctatcatggcaccactctctcaaatcccaccttcttcttcttctcttcacctttcaaccgatgctgaaacgggtaacacaaccacccccagaaagcgtgttaagaaaatggaccacaccaattgcgagagcctcaacgtggaacgtgaaagaaggtcgaagatgactcaaatgttcactcagcttcaaaccactgtccctggtgtcttacctcaggctacaagggaagtgattataaacgagacaattaagtacattaaggagcttgagaagaagaagcaaaagctggaggagttgaaggagtcaatgaaaggagtagaagggtcgatattgcttgcatgtggtaacaacatgaattgctccgtcacggttactgtctctgctaatgttgcattctttggtattcaatccctgcctcgacccggtttggtcacggtaatcatgaaggtgttctgcaagcaccgagctgaggttttggccgcaaatgtctcagttaataatgggaaattcatattggcaatcactgcgacggtgcaaaatgttgtcgttgaaaatatcaaaagagaaataatgagtttgtag

SEQ ID NO: 109035 - DNA, 1029 bp, Glycine max
  Peptide Sequence Number=SeqID_225813
atggatcggcataattcattaactgaaattacaaaagagttgaccatgcgaaggcaatcaacctttgtcaagtctcatgcatcaaacccattgaacaaaaatagttccctcatttgggtgacatgctttttccgtcaatttgggcattctgtggttcttgcggattatcttacgcttcgcaaaggcttcatcatgaatcacaacctttcattcaaatatgattttcacagctacatgattcgatcaatggaagaggaattccaaaggatagttggtgtgagtggtccactctggggatttgttattgccttcatgcttttcaacattaaaggatctaatctatatttctggatagctatcattcctgtatctcttgtgctcttggtgggaacaaaactacagcatgttattgcaaccttggcattggagaatgctggaattacaaggttcttcccagaagcaaagttgaggcctcgtgatgaacttttctggtttaataagcctgaactattgctatcgttgatccatttcattctcttccagtggcagttcggatattattcctgctttattaggaatcaccttctcctttatataaggctaatattggggttagcaggacagtttctttgcagctacagcaccttgccactctatgcacttgttacacagatgggaacaaactacaaggcagcattaatcccacagaggataagagaaacaattcatggttggggcaaggcagctaggaggaagagaagacatggcatgttcactgatgactccaccattcacacagacacaagcactgtgttgtctattgaagaagatgatcaattaattgatacccctgaagtagaattacaaccagcaacagctgttacagctaccccttctcccattgctaatgaaacttcaagtagggctgttacacccctcctaagaccctctgcctcaatatcttcagtgcaatgcagttctaaagctgaagcaattccaagatgctcctctatgccaagtggaagataa

SEQ ID NO: 109036 - DNA, 860 bp, Glycine max
  Peptide Sequence Number=SeqID_225814
atgcttttgaagagaagtatggttccagtgtatccgcggaagctaatgatgaagatggatttagagatttagtgcgacatacaatgttcgaaaagggtcagagtaaacgcatatggggtgagctttacaaagtgatagattcttcagacgtggttgtccaggctgtagagtctatggttttagatgcaagggatccacaaggaacaagatgctatcatttagagaagcatttgaaggaaaattgtaagcacaaacacatggtgcttttattgaacaagtgtgatctagttcctgcttgggcaacaaaaggatggcttagagttttgtcaaaagaatttccaactctagcattccatgcaaacattaacaagtccttcggaaaaggttcacttctatcagttctgagacaatttgctcgattgaaacgtgataagcaagcaatatctgttggatttgttggatacccaaatgttgggaagtcatccgtaatcaacacattgcgtacaaagaatgtctgcaaggttgctccaattcctggggaaacaaaagtatggcagtatataaccctaacaaagaggatctttctgattgattgtccaggtgttgtctaccacaacaatgattctgaaacagatgttgtgttgaagggtgtggtgcgtgtaactaatttgaaagatgctgcagaccatataggtgaggttttgaaacgtgtgaagaaagagcatttggagagagcatataaaataaaagagtgggatgatgagaatgacttcttactgcagctttgcaaatcaactggcaaacttctgaagtcatttcatgatagtattgttgttgaggctaatgatcagctctactaa

SEQ ID NO: 109037 - DNA, 272 bp, Glycine max
  Peptide Sequence Number=SeqID_225815
atgacagccacgtgcggacctatattcaagttgcttcgaaaagatcaaggggttgtttggaccgaagattgtcaaaaggcttttgatagtatcaagaattatctgctagaacctccaattcttatacctccagttgaaggaaggcctctgattatgtacttgactgtgttagaagattctatgggctgtgtgctcggacaacaggatgagaccggaaggaaagagcatgccatctactacttgagcaagaagtttacagattgtgagtccag

SEQ ID NO: 109038 - DNA, 619 bp, Glycine max
  Peptide Sequence Number=SeqID_225816
actaggcatttatgagcccgttgaacataataaccctgcactctctcccaacttcgaatctcctgtctacgaggctgaagaggaggaggatgatgaaatcccagaggaacttgctcggttattagaatatgaaaagaaaaccattcggcctcatgaggaggtagtagaggtgattaacttgggaaccaaggaagataagaaggaagtcaagattggggcatcgcttgaggcaactgtcaaacgaagggtgattgaattactcaaagaatatgctgatgtgttcgcatggtcgtaccaggatatgcccggcttggatccccgtattgtggagcactgtttgcctttgaagcccgaatgctcaccggtcaagcagaaactgagaagaactcgccctgacatggctctcaagatcaaagaggaagtacaaaagcagatcgatgcaggtttccttgtcacatcagagtatcctcaatggttagccaacatagtgcctgttccaaagagggacggcaaggtcaggatgtgcgttgactaccgggatttgaacaaggctagtccgaaagatgactttcctctacctcacatcgatgtattggttgacagcgctgaagaggcatga

SEQ ID NO: 109039 - DNA, 390 bp, Glycine max
  Peptide Sequence Number=SeqID_225817
atggcagttgaagacagagaaaagacatctttcatcacgccttggggcaccttttgttacagggtaatgccttttgggttgataaatgcaggtgccacttaccaaagaggcatgaccactctctttcatgacatgatgcacaaagaaatagaagtgtacgtggatgatatgattgttaagtcaggcactgaagaagaacatatcgagtacttgctgaagatgtttcaacggctgagaaagtaccaacttcgactgaatcccaacaaatgtacctttggtgttagatctggaaaactcttgggcttcattgtcagtcagaaaggtattgaagtagatcctgacaaggtcaaggccattagagaaatgccgattccacaaacagagaaataa

SEQ ID NO: 109040 - DNA, 384 bp, Glycine max
  Peptide Sequence Number=SeqID_225818
atggctagaacacgaggtataggtcgtgccataggtagacttgtatgcagagatagacctgatgaccaggatgcagctgatgttcccgagaggcgtaggcctactgcctcagcccgtaggcaacgggttcatcagatgactgcgaatgcacatgacatgactgacgatgtacctgatgtggctgcggaggcacctgagatgcgtgcggacgtagagggtcttgatcatgctgagggatcagatgctgatgatgctgctgagggattccctggtgggccacgtgacccgtcagtgctgacatcatttgcggaccacgaacgtcctgatttgaagttagtgtcacatggggaggaaggtgacactaattgggaggccagtgcctga

SEQ ID NO: 109041 - DNA, 137 bp, Glycine max
  Peptide Sequence Number=SeqID_225819
gtacttggcacccatcgttaggcgattcgggaagtttcgtgacatgccgaaaatcaaaagaaagcatcgttgcacaattcgtggagttccgtgacatgccgaaaatcaaaagaaagcatcgttgcacaatttgtgag

SEQ ID NO: 109042 - DNA, 415 bp, Glycine max
  Peptide Sequence Number=SeqID_225820
gttggtggcgactccgcacacctttcctcctttgggaagcgcacccgtgagccccgccctcgctcgcccgcgaagggcacgttgcgacactgtcaagttagatgagctggaaaacgaggctgccactatattgtgtcagttggagatgtattttcctcattcgcgtttcgacatcatggttcacttaattattcatctagtaagggaaatcaaatgttgtggtcccatttatttgcggtggatgtacccggttgagcaatacatgaagatcttaaaagggtatacaaagaatctacaatgtcttgaagcacctattgttgaaaggaaaaacctattgggcttctcgagtgtcggcatgacgaaaaggtggaaggaaagggttatagaggattgcattgtatcactccaagtttag

SEQ ID NO: 109043 - DNA, 306 bp, Glycine max
  Peptide Sequence Number=SeqID_225821
atgttgaatatctttaatcttttggcatcatcaaaatcttcatacagcatatgcatctacatggatgacgcagctgaagaggtcttccaacatgttgaagaagctcgtgttgatgcccaggattttccagttattgtttggaaaggagagttatcctcccttggaaggaaggttcagaaatttgggaggcctgatgctgagattgaagggttagtcgttgccacaggattaagtcctttgatcgcttgttcattgcacactggcgaccggggactttgttggatcaagtggccttggaataattaa

SEQ ID NO: 109044 - DNA, 243 bp, Glycine max
  Peptide Sequence Number=SeqID_225822
atgaatagagtagcagttacaaatatgccaactgatccaccctctaactgcctacctctgaagactaagcttctcttatttatactactcattctaactattccgttaagatttacagctggcacagtttggggtgtatgcaatcacgcatttcatttgcactgtatcctgaaatgggtgaattctcagacatcacaagcgcattgccccatgtgccgtcgggagtggcagtttaaaggatga

SEQ ID NO: 109045 - DNA, 1026 bp, Glycine max
  Peptide Sequence Number=SeqID_225823
atgataggagaagttcgagcacttattatttttccaatcataccgtatggtattcttgcagtgttctacatgttctggatttctgctgctcttcatttgtttagctctggtcgggttgttcagaataattgcaactctaactgttgcgcatatgacctgttggaaaaaaaggtgatctgtgatcagtgttgtggatatagcattctttacacaccgcatattggagttgccatcctttttcacttttttagctgttattgggctacacagtttctcatagcttgctcatcaacagtgattgctggatctgttgcctcttactattgggcccatggtgaagcatctcctgaaattccttttctttcagtcttttcctccatgaagaggcttttgcgttacagtcttggttctgtggctcttggctctctgactgtatcatttgtagagtcaatccgctttctgcttgaatctattcgccggaaacttaaaggctctagccacgtgcctgatagctggattggcaaggctgctcaccaatcttctcaatgttttcgaaggtctattgagtggaccatcaaatcagtgaaccgaaatgcttacatcatgattgctataacgggtaaaagtttctttagagcttctgctattgcaacagaattgatcatgaataacatcctacggattgggcgtgttaacgttattggagatgttattttgttccttggaaaactatgtgtcagcctctcaagtgctgcttttgctttcctcatgttggacgcacacaagtacagatctgcacataacaagatctcatctccactattgcctgttgtggtttgctgggctcttggatatattgttgcaactcttttctttgcagttgtagagatgtcaattgacaccatcattctctcattctgccaagactctgaagagcatgggacagcacagtatgctccacctcttctcattgaaactcttggagaccaaaatgagatgcagagacttacacaaggaccccaatga

SEQ ID NO: 109046 - DNA, 336 bp, Glycine max
  Peptide Sequence Number=SeqID_225824
atgtgttgccgtggaaggaaattggctcctattactgatgcaaattggcaatcacttgtgcttgaatctgagtctccagtattggttgaattctgggctccatggtgtggtccctgccgtatgatacatccgataattgatgagctggcaaaggaatatgttggtaggcttaagtgctacaaactcaatactgatgaaagcccttcaaccgctactcggtacgggatccgaagtatcccaactgtcattattttcaagaatggtgagaagaaagatacagttattggagctgtgcccaagacaacattgacctcaagcatagaaaaattcttgtga

SEQ ID NO: 109047 - DNA, 720 bp, Glycine max
  Peptide Sequence Number=SeqID_225825
atgaggggtcctttgggtgcagtcataggaaggtacccttcaagtgatggaaccactcatttgggtggcatcataaggcacaacaaaaaatgcagagacatagccgttcttgtcatctttgttgcattctggattgccttgattgtcaactccagctttgctttcaaccgaggaaacccattgaggcttacttatgggctggactacaaaggaaacgtgtgtggacaaaagcatgcagttcaagatcttcgagaattggagctcagatactggctaagtcctaatcaggtttatcaaagtggattgaaggatagccaattcaagctggccaacgcccgcagtatatgcttattggactgccctataccttctgaagattcacttacttgggtgtgtgattatcctgaaggagatattcgcgtttcattgaatgattggattgatatgaactatgattattttgagttccttacgccagaaatgagaaactcttctcttcaacttcaaggcccttgttatcctgtcatatttcctagtgtaaatgtttactggagttgccaattcattgttaaagcatcgaatgtatccttaaagcattggcggcagatgggtggagttaacatcaatgaagacattgttattgacaagtccattcatgagtatatcaattctcattcagctgttttaaagggaaagcataacaccttatcagcatcttag

SEQ ID NO: 109048 - DNA, 237 bp, Glycine max
  Peptide Sequence Number=SeqID_225826
atgacttatgttggctggataggaaatgatgctatttcccccatcataggtgagcatgatccttacattcatgtatttgtaagggagcttactcatctacgagttgtcactgtccttatgacctttatcatgcttgttgccattcttacatcaattgctgttgttcggcgaatccttatggcaacttctgtccttaaggcaagcataactttattatatgcaattatgaaactatga

SEQ ID NO: 109049 - DNA, 1137 bp, Glycine max
  Peptide Sequence Number=SeqID_225827
atgtcgagagacgaaaacgcaaacggttctcagccggaaagcgacgacgacgacgaagctccggcacggagatattctaggaaatcgcgagaaaattcggatgtagattctgaacccgatagaaagcacatcaattcgcggagaggaacctccgattccgacgacggggataggcgccgccggagggagaggaaatcgcggcggcactactgcagcgagtcggattccggttccgggaaagcgcgagaagattctgatgtagactcggaaaccgatagaaagcaatgcaattcgaggagaaaatcgcagggaggacgctcggattccgacgacggcgacagaacgcaccggaggaagaggaaatcgcggcggcgccacagcagtgacttcggctcggaggagtccgagtcggagcggtccggttcggaatcggagagtgaggaggagcggaagcggcgggagaagaggagaaggagagagaaggaggatgagagggagtggaagcggagaaggagagagaaagagaggaagaggcgaaggagagagaaagagaaagaggaagaggagaggaggaagaaggagaagctgaagaaaaagaagaagaaggagaaggaggagagagggaagaagggagcggtgacgaattcttgggggaagtatggtgttattagagaaactgatatgtggaccaaacgaccagagttcactgcatggttggcagaagtaaagcaggtgaatctggagaatatgtccaattgggaagaaaaacagatgttcaaagaattcatggaggatcacaacacagctacctttccttccaaaaagtactacaatcttgatgcttactacaggcatcaaatggaaaaagagatgaaaaaaggttttaagaaagtccaggcaacagagcgcactgttttcaatgatgaagaacagcgcaggcaagaattgttgcaagctcgtgaaaagcacaaggaggagcaagtaatggcattgaagcactctatgcaaactggaatggcacaggcaatgaaagagcaaactcaacttagggaggagatggcttaccagtacaagcttggaaactttgaggctgctgctgctatccagagaaggttggatcccgatgctgccatatag

SEQ ID NO: 109050 - DNA, 297 bp, Glycine max
  Peptide Sequence Number=SeqID_225828
atgaaggttcttcagtcacggtcttcattctaccagaagaaccttctttttaagaaggttcttccggatgaacaatttgttctaccggaagaaccttcttccggaagctttccggaagaaggtttttccattagaacacaaattgttcttctagaagaaggttcttccggtagaacacaaattgttcttctggaaaattttcggaaaaaccttcttccggaagctttccggaagaaccttctttcggaagaagaaattatttttttaacgcaagggcaattttgcccattcacctaa

SEQ ID NO: 109051 - DNA, 330 bp, Glycine max
  Peptide Sequence Number=SeqID_225829
atggccaccgtgcaactccaatccctaacccttgttcgctcctccgcactcccttccgccaccttctcccctccgatcgccctctccggccgccggaactccgccgcgctgccgcgctacgcctgcctccgactccgacccgccgccgagacctgttttccgactcgcgccgccttgagaaccgctcctcgcggcggaggcgtcaagtgcgaggcaggagacaccgccgttgaaggaagtgtctgggttcaaacactattggcccaggcaaaatgtagtgccgtgtttggactttggaccaagtcaaacccacaccaacctggcccatga

SEQ ID NO: 109052 - DNA, 198 bp, Glycine max
  Peptide Sequence Number=SeqID_225830
atggaagagagcccatataacagcctggaaccaatagaaacagatgcaaaactgtatttcagattcagaagatacgcaccaaaagaactcccaggttgtgctcggcagaaggctcaggcgaagattctgaagcatataatgatcacaaacttagaccataggtgggaccatatgcttaatagggaagccttatggtga

SEQ ID NO: 109053 - DNA, 999 bp, Glycine max
  Peptide Sequence Number=SeqID_225831
atggcaccatttcccacttcccattattacttcagggccttcactttctccattttgttcctcaaaaccctagcttttgacccaattcctctgttttattatgctggctttggaaaagatctgaaatttacgcccaacgtggccctttttggtaatgcaaaggttctcaacgaagggtctgggattcatttctctggctctgggagttcaggagacactgggagagtcatgtacaagaaacccatcaagctttttcaagtctcattggaagatgggggtggcttggcttttgttatggctccaaagggttctgaaggtgatatgttttatcaaagttcttatgggttgaatagtagaaaatttgaagttgttggtgttgagtttagtgcctcaaagggtggtagaaaaggggtttcttctagttgtcatgtcaacatgaatattggtggttttgttgctaaaaaaagtaacacctctattggagaaaagttgcatgtttggattgactatgaagctagttcaaagcgcttagaagtgagactgagtcagcatggtaaatcgaggccatcttatccattgctgtggcaatcaattgacttgtcaaatgtgttgaaggagaaagaaatgttggtgggttttagttctgtgaaggggaatgactctcaagcatgctttctatattcatggagctttgttctgaggaatttcccacattcaatgcattcagagcccttggatccaaaggtctttgtcaaaaacactgaaagtccagtggttaaacaaaggagtgattgctttttgagagttcttgctgcaatgatatttggtactggatgtggagctttgacagcatttattgtgctttacttgtggaccatctttggcaacaataaacgtgctgtggtgccagaggaatctgttgtgcaacctgtagatgttgaatataggaaaaatgtcagaattgttgtagataaaaccatcgaagatggtaagaagtag

SEQ ID NO: 109054 - DNA, 4457 bp, Glycine max
  Peptide Sequence Number=SeqID_225832
atcactgtgcttccactgttccagactcaacccccaccaccaaactcagcctcaagcatttccctcttggtgatcatcacactggttcgtacacaggaggtgatagcattattgatgttggtgcttcttggaaccgcttctccttttacctctcaaaaaggaacacacgtgcaactcaaaccccaaaccttttcaaacttgaaggaactgtatcatttagaagcaccaacacattcaatgatggtggtggttcatattatgggggccaacgccgttaccgtaaaggttacgtaaccttcaagcttgaagggttttggcatgcgtcttcagggaaggcttgcatggttgggattgggagtggttattccaaaaaaggtaactctctcaatgtgaatgctgtttttaagctcaataatgtgttcaatgcaagcaacatcactagcttggttagtggaagcttggagagtttgagtcctcaaaaggatgagaactactttgaacccatttctgtgttgatgtttccaaaaggaaattacagttacaccttggattccatagaagttgccaacgagttctctcatgggagtgatgctgagcaaggattagcattgaatttaaattcattgagtttttgcaaacctcccctctcttgggggattaggagactccaattggagtactcacttgattgccgttcttctaagaattgcacttctataagtgggagttttggtaaacttccatctctaatgtctttgacaagcactggatgttctcttactactgagaaacataggttgagggttcaagtggaattttcagatattggttcttattggattaaccaaagttttgacccaaaagctatgttagtaggggaaggatggtgggatgagaagaacaacatgctgtgtgtagttgtttgccatgtcatgggcaactcatcatcattgtctggcactcatgttggtgattgctcaataagactaagattgagatttccctcaatttggtcaataaaaaacactattagcatagtggggcaaatttggagcaacaagaggccaaatgattcaggacatttcaagatggtaacatttagaaatgatgaggagagtggggtgggaggccatggcttaaagtatgagtatagccagctagaaaaggttaacaaatcatgccctaaacacaagcctaatgacaaggggaaaagatatcctgaggcctattctgatgacatgagatttgatatgtcaattagagagtccaataaaagggtagcatggggttattcagcacccttagctgttgatgatgaattttatgagtctggcatgtatgcatcttcttattctttctcaagtttctcaactgaagttcctgatggaaccctcaacatcaacgacaacaatggtagcttatttaacatgagctacaagattagcctctcagtgatatcatattcaaagataggggacaatacttctgtgtttaatttgtcctctgagagagtgaagatctctgcagaaggagtttatgatgccggagcaggaacgttgtgtatggtaggttgccgtgaccttctctcaaacacaaacactgagataccaatagctcattctgtggactgtgagattctactgaagtttcagttcccatcattggacacatatgatggaggctacattaagggaagtattgaaagcacgcgtcatgaatctgatcctctttacttcaagcgtttagacatatctgcagtggcatattatagggaagcagcaagaagaaatgtttggagaatggatgtggaagtgatgatggctctgatatctacaactctatcatgtgtttttgtggggttgcaactcaacaaggtgaagaaagaaccaaatttgctccccttcatctcccttattatgatgtcaattcttactttgggtttcatgataccccttgttctcaactttgaagctcttctcactcaaaatcccaacaacacaatgcgggtgtttagaaataatggatggcttgaggttaatgaaataagtgtgaggctgatcaccatggtggctttcttgttgcaatttcggcttctgtatctgacttggtcagcaaggaagagtggtgagagcaagaaagggctatggattgctgagaggaacagtgcttatgtcacttcactcttgtatgcagcagggttattgattgcatggttgttgaagttgaagaatggagataataaggattctgtgtatgtccctatgtaccagccttcaccttgggagaacatcaagtcttatggtggtttggttttggatggttttctcttgccacaaatcattttaaacctgtttttaaacatgagagacaatgttctttcattttctttttactttggaactacttttgtgagactcttgccacatgcctatgatctttacaggactcacagtgatgctgccctagatagtcgatcatactactatgctgatccaagtgaagatttttactccactgcttgggatattgccattccattgggaggtatcctatttgctatgattatttacttgcagcaacgttttggtagccattatattttgcctcataggttcaaagggtctaaggtatatgaaaaggtgcctgaaaaggtgcctgtggttactgaatcagaagctgaaaccggtaagtatcttaatttggatgctgtgtttaagcttgataatgtgttcgatgcaagcaatatcactagattggttagtggaagcttggagagcttgagttctgaaaaggaaattgccaatgagttctcttctgggagtgatgctatgaagggtggtttgtcattgaattcattgagtttttgttctcgtcccctctcaagggctattagaagactccccttagagttctctcctgagtgcaattcttcaaagaactgcactccttttagtgagagttctggtgagggatggtgggatgagaagaaaaacatattgtgtgtagtggcttgtcatatcataggcaacacttcatccttggccggcactcatgtgggtgattgctccataagactaagattgagattcccctcaacttggtcaatcaatagcactagtagcatagttgtccaaatttggagcaataagagtactaatgattcaggctacttcaacatgataaaattcagaaatgaagaggatggtagagtgggaattcaagctacaaagtatgagtatagcctactaaacagagttaagatgtcatgcctaaaacacaagcctgtgaagaacaaggggaaaagatatccagatgcctattcttctgacatgagatttgacatggcaattagagagtccaacaaaagagtagcctggggttattcatctcccttggctgttggtgatgagatctctacctttgatcagaatgtctcaagctccattgtagaagctcctgaggtagtactcaacagtggtggcttgtttaacattagctacaaaatcttactgtggtataattcaacctcaaatgacaagaattccctgcttaatcagtcctcttggtcagtgaggatttctgctgaaggaatttatgattccggagcaggaagcttgtgtatggtaggttgccgcgatattcacttgaattctctcaaaccaacagctcattctgtggattgtgagattgtagtgaagtttcagctcccaccattagatgcaaaaagtggaatcttcatcaagggaagcatcgaaagcacatgcaaaaagtcagattctctttacttcaaacctttggagttatcttcagctgcattttacactgaagcagcagaaaaagcagtttggagaatggatatggagaccatcatggttctgatatccaccactctagcatgtgtttttgtgggattgcagctgtatcatcacttcttgctcaaaatcctaacaacaaaaactgtgtttgcaaatgttgggtggcttgaagtgaatgaaatagccgtgaggctaatcaccatggctacttgtgtcactttacccttgtatgctgctggcttattggttgcattgctgttgaagttgaagaaagatggagatggggttccggtgattactccattgaaccaaaatcattcatcttgggagaacttaaaatcttatggtggtttggttttggatggctttctcttgccacagatcattctaaacctgactcataattatgctcgtgtagatagtgggtcatacttctatgcagatcctagtgcagatttttactccactgcttgggatattgtgattccattgggaggtatcttgtttgctatcattatctacttgcagcaacgttttggtgctcattgtattctgcctcaaaggttaaaaggatctaagttatatgaaaaggtgcctgtggttgcagaatcagaagctgaagtagagaccaccaacttgtaa

SEQ ID NO: 109055 - DNA, 855 bp, Glycine max
  Peptide Sequence Number=SeqID_225833
atggccgagttcacagaattgtttcccttgggcgaaccatttgatggtttgatgcacatgtatgtgtatgtcatcacatttgatcttccaaccttgttcattgttctattcatacccacagtgttattcttcatcttgtatcaagttctcaacggtttgttcttctggttaatggaaatgaggccaattgaacatgatattgaagagggtattacacatttagccaattatggggactctgtgccatctcaccatgttaccatattccatgcccttgtgcatagcaatttgcatgcttggacattggtgactgcatttgaaggagttttttacgagaaaagaggacaaagacttagagcttccaaaaaattgccccctttggtgaactatggaatgcatgccaccatattttcaacaatagttcttcttcttctattaaaaatctttgaaactatatccgacattcttcttgaaagacttgaggatgatgttgaagagggaacaataaggactttggtagttgaatcttttctgacttaccaagatgctttcaatgaaataagtgatggcagggaaagattacaaacatatatacaagcttctgagatgagaccaattcataaagggccatcaatcaaactgccacaactcgtaagttatggacaagatcaagatgatgagttgagatcattttgtagtagtgattgtgtcatatgtttggagagcttcatcaccggggaatcttgccaaattcttccaccttgcaatcacttatttcattcttactgcatagagcattggttgaaggacaatgccacttgcccggtttgtcgaaactgtttactagaaacataa

SEQ ID NO: 109056 - DNA, 186 bp, Glycine max
  Peptide Sequence Number=SeqID_225834
atgttccttatcaggcaacatcgtgttcgagtccaaatgctaagcatgtatttagatgtcgtctcgagtttcgaagcgtattacagagcaagagtatggtcaggacctgttcgaatcgaaaagagagaagagtctttggaaagggattcccaggttcaaggaagtatttacgaagtacaaggctag

SEQ ID NO: 109057 - DNA, 706 bp, Glycine max
  Peptide Sequence Number=SeqID_225835
atgaaatgttgtgttgaatcctcatcaacatcggtattggtgaatggctcacccactaaggagtttttggtggagaaaggatttagacaaggtccacttgtacctttcttatttcttatggtggcagagaggctaagcggccttgtaagagaggcggagaggaagaggctttttgaaggagcacaagtgaggagtggcaacttgaaggtttcaatcctccaattcgtggacgatgcactattttctgagaagttggataggctacccatggtcttgaactgcagaaggatggaagttccattcacatatcttggccttccgaaagtggttcttgtgcttgagagtttgtttaggaatttcttatggggaggggagggtgagaggaaaaggactctcttgggtaagtgggggtggaggcttttatcagaacaacaatcgttttgggtaaaggtgattaaggaaaagtacggtgtgtcttgtgggggtgttcatgagtgggaatggaacaaagggtctttggggtggaaggatataggaaagttggaggacatggcagtttacagaaaattcagaaggttgttcgatgtttcaaatgaaaaacaagcaactataaaggagatggggtgctgggaggggaatgtttatttgcatgggaggaagaacaaaatgacaattttgttacgttactcaattcctacaagcgcgg

SEQ ID NO: 109058 - DNA, 237 bp, Glycine max
  Peptide Sequence Number=SeqID_225836
atggaatcagtgaaaggcttggattcacagaagaacagcggcagagctcagagatacggtgaggttgatgatgaaaggagtaacaagttaataggaagatctgaaaatgtcgtctcgagtttcgaagcgtattacagagcaagagtatggtcaggacctgttcgaatcgaaaagagagaagagtctttggaaagggattcccaggttcaaggaagtatttacgaagtacaaggctag

SEQ ID NO: 109059 - DNA, 345 bp, Glycine max
  Peptide Sequence Number=SeqID_225837
atgcggcagatcccgagggatggagaatttgcctatccctatgaggcagtacttaattttgaggactttgttaaggggcatttctgcagtcgagctagcgatattctggtggcatgtaaggcatacatggaaggtgctcaagttgggtgtttggtcaaaggaggggttcaggatgttgacgagggagacagaagctgctcacagcgattcaaggattctttatccggatatatgaacatgcttgtcaaagagtttgctaaagttggagcaaaggacatcgagaaattgctgcctccagcaacaacaccagtagtgaacaagccatcaggtttaagtattgcctga

SEQ ID NO: 109060 - DNA, 681 bp, Glycine max
  Peptide Sequence Number=SeqID_225838
atgcagttacaagtgttattggtgctgctctccaatttgaattggaatttcacttcagagatatatgctccatctgtcaatgtgaaaaggagattgaagaatggctcctactccgttaaaccaaagcaactgttcccaggttgtgttttcttgagatgtgtgatgaacaaagaactacatgacttcataagagagtatgatggtgttggaggctttcttggttccaaggttggaaacacaaagagacagatcaatagaccgaagccagtgtctgctgaagatatggaggctatcttcagacaagcaaaagaagaacaagagaaaactgaccaagcttttgagcaagaagagaaaaaagcttccctagactctgggattcgcaatacagaattagaacccgatgatattttaaatgctattgttgattataagtctaaaaggggatctagaaaagcttctaaccaggtcaaagccacagatgcttcatctactcgaatcaattataaactccttgttccaggttccaccgttcgtgttctatctggaacattttcagggtttacaggcaccctcaagaagctgaatcgaaaaaccaaattggccactgtgcatttcactctatttgggaaagagaacatagcagacatagacgttaatgaaattgctatagagacaaactga

SEQ ID NO: 109061 - DNA, 438 bp, Glycine max
  Peptide Sequence Number=SeqID_225839
atggtaatggaaacagatatagataatcttccttatctccaagccatagtgaaggagacactgaggcttcaccctccatctccatttttattgagagagtcaactgggaattgcaccattgctggatatgacattccagcaaagactcaggttttcactaatgtgtgggttattgtcaggggacaacattatcaacttttgccttttgggagtggaagaaaagggtgtcctggagcttcactagcactaaaggttgctcacaccacccttgctactatgattcaatgctttgaattgaaggctgaagaaaaaggagggtattgtggttctgttgacatggaagagggaccttcatttattctttcaagagttgaacccctgatttgtgtcccaaaatcaagattcatgcaattccctttgtatcatgctaaatactag

SEQ ID NO: 109062 - DNA, 108 bp, Glycine max
  Peptide Sequence Number=SeqID_225840
atggagagaacgagaagagtcggagaggtgttgacgaagggatgtaatgtaataagcagaaacggaggtgcaaatagcactcccaaacaatgctatagcagaacataa

SEQ ID NO: 109063 - DNA, 312 bp, Glycine max
  Peptide Sequence Number=SeqID_225841
atggtgccaaaatacttgttccgctctccaggatactacttgtttgtgtggatgcgaaatctatcggcaagtacaccgggtcgtcaaataagggaagagtttacatcaattactcagcaagaatccccaactgagggtttagccttccatagcaagcaagctccttttacaataagaagaggaattaagagaaattacttgcttacaaaggagtggggatgtgatatgaatgacagcagaatggagaaggaagagagagaggagacgccatttcaaggagaagatgagtctagaagaagctcaccaccatag

SEQ ID NO: 109064 - DNA, 366 bp, Glycine max
  Peptide Sequence Number=SeqID_225842
atggctccgaagaagctctccacgaagaggtctagaaaggacgccactggagaaggcttcaatgctgccttggagtttgataatcaccagttccggagtgccgagcaccagcagcgcttcgaggccatcaagggatggttgttccactgggagaggcgtaattctatgccaacacctgacccactgaggagggggttcgggacatgcgctcgtgggaggaaccaggcagacggcttcgatgaggaggccatcgcccagatgctgtgcataccgaggcagtatttcgcccagaccgctgcggggaggcggcatgactaccctgacccagatatggatgacactgctgctcagcaacgtcttgcctag

SEQ ID NO: 109065 - DNA, 474 bp, Glycine max
  Peptide Sequence Number=SeqID_225843
atggcatatgacaaagaaatgttagcagaacaatacaacacggcataccaattgctcacagatgagcaaaaaactattgtcgataccattatgtctgtggttaacactcaatcagctgcagtttactttctctatggatatggtggaactggcaaaacatttgtttggacaaccttatcatctggtatacgctccaatggtggaattgtttgtacagttgcttcaagtggaattgcttcattactattgcctggtggtcggaccgcacattccaaatttgctataccagtccctgcaacagaaaattcaacatgcaatattcatcaaggcagtgagttagctgaattattaaaggttacaaaactaatagtctgggatgaagctccaatgtgtcacaaatttgcatttgaggcactagataaaagtcttaaagacatcatgcaaaacaatctgccttttggagggaaaattatg

SEQ ID NO: 109066 - DNA, 555 bp, Glycine max
  Peptide Sequence Number=SeqID_225844
atgcaacacatgcgggattttcttcctgcacctggcactagtgatgttattgcccgaacagcatttggaagtagttatgaagaaggaagaagaatatttcaacttcaaaaagagctagcagaacttaccatgaaagttatcatgaatgtttacatccctggatggagatttgtacgtactgctaccaataggagaatgaaggaaattgatagagatataaaagcttcacttacagacatgattaagaagagagagagagcactaaagacaggtgaagctactaaggaggacttgttaggtatacttttggagtcaaatcacaaggaaattcaagaacatggaaacaataagaatgttggaatgaatctcaatgatgtaatggaggaatgcaagttattctactttgcagggcaagagaccacttcagttttacttgtctggacaatggtgttgttaagtaggtaccctgattggcaagcacgtgcaagggaggaagttttacaagtctttggcaaacaagcaccgaattttgatgggctaagtcaccttaagatt

SEQ ID NO: 109067 - DNA, 1752 bp, Glycine max
  Peptide Sequence Number=SeqID_225845
atgactggagtgtcattgggtgtgcgcacagggagctatgggacgctgcagcaaaacggcaccgtttctcccaagcccatgcttgtgcgtagaccttcaaagacgctcctctacaaccccagagagaaagagaggggtttctttttcttttgccggctacttggaagaggcaaggtcgcaatgcttctcatgcttgcccttggcctctgtgttttcgtttttggttgctttactgtttacagaggtggaaacatcaatagtgaaattgaagatacgcgatcttatgccattactaggtatgaatttttaaaacctcgtggagtaatagaagacaagtcagaggatagtaattcttctagagtgttctcattgacaagtagacatagaagtacagctaggcctcctcctgctcctaattcactgtccttgtccaagccaacaagaaaaaagggatattttcctacttggggacatcgttgtgaccattttgcatttcctcctcctccaccagctgatagaagacgacctggaccacgcccatgccctgtgtgttatattccagtggagcaagctatagctagtatgccaagttccccatcagaatctcccatacttcgcactttgacatatgtgcatgatgaaaatccaattgaaagtgagccacatggtggctctgattttggtggatacccttctctggaagaaagggatgctgcttttaatatcaaagagaccatgaaagtgcactgtggatttgtcaaaggaagcagacctggtcgccagacaggatttgattttgatgaggcggatctcttagagttggatcaataccatgatgtcattgttgcatctgccatatttggaaactatgatgttatacagcagcccaggaacatcagttcagaagcaaagaaaaacattcctttctatatgtttattgatgaagaaacagaaatgtatatgaagaatgccagtattttgagtagcagcaggagagttggattatggagaatcatcattgtccgtaatattccttatgctgattctcggcgtaacggaaaggttccaaagcttcttttacacaggatcttccccaatgtccgatattcaatatggattgatgggaagcttgagcttgttgtggacccatatcaagttcttgaaaggttcttgtggcgccaaaatgctacttttgcaatttcaagacactatagacgctttgatgtatttgttgaggctgaggctaataaagctgctgggaaatatgaaaatgcttccattgatcatcaaattcaattttataaataccacgacggtttaactcattattccagggctaagcttcctataactagtgatgttcctgaaggttgtgttatcataagagaacacattccaattacaaatctctttacttgcttatggttcaatgaagttgatcgcttcacttccagggatcagttgagcttttccacagtaagagacaaaataatggcaaaaactgattggagtattaacatgtttatggattgtgaaagacgtaactttgtgatacaggcttaccatagagacatattggagcaaatgcctcctccagctgttgtaacccggcgtcctggtcaacctgcttcttataccagtaggcctcagatgaagagtcatcctaggcgtgggaaagtagacaagagatcaggttcaaagcgtcatcatagagtagtaggcactgttcttacgaaccacatgttgatttag

SEQ ID NO: 109068 - DNA, 315 bp, Glycine max
  Peptide Sequence Number=SeqID_225846
atgtgggtggcgggaaaacgtggaaacgacaacctcgtcggcggtgtcgcagttgcgttttggaatggattagggaggaggattggagatggtggatcgaggcgtagcgtgaatggagggaagagacaatggcaaatttttagaagaaggaggagaaggaaatgcagatgcacacacacagagatttttggaatgggccctctggcccaacagaatgtgcttccaaaaacaaaagtccaaagattgcttttgaatcatgtgaatggcccatttatccatgtgaaacaatgttttatttcgtataaagaggattga

SEQ ID NO: 109069 - DNA, 1662 bp, Glycine max
  Peptide Sequence Number=SeqID_225847
atggctaatcgctggacactggctcaggctcaggcgctatttgataaaccttttctcgagctgatgtttgaagcacagcaggtgcaccgccagcacttcgacccgcgtcaggtgcaggtcagcacgctgctgtcgatcaaaaccggcgcctgtccggaagactgtaaatactgtccgcagagcgcgcgttacaaaaccgggctggaaaccgagcgcctgatggaggtggaagcggtgctggaatcggcgcgcaaggccaaagcagccggctccagccgcttctgcatgggcgcggcgtggaaaaacccgcacgagcgcgacatgccgtatctggagcagatggtgcagggcgtgaaagccatgggcatggaaacctgcatgacgctgggcacgctcgaccacgatcaggcgcagcggctggccagcgccgggctcgatttttacaaccataacctcgacacctcgccggagttttacggcagcatcatcaccacccgtacttatcaggaacgtcttgatacgctggataaagtgcgcaacgccggcatcaaagtgtgctcgggcggcattgtcgggctgggcgaaacggtcaacgaccgcgccggattgctggtgcagctggccaacctgcccacgccgccggagagcgtgccgattaacatgctggtgaaagtcaaaggcacgccgctggcggataacgatgacgtcgagccgttcgactttatccgcaccattgccgtggcgcgcatcatgatgccaacctcgcacgtgcgcctgtcggccggtcgcgagcagatgagcgaacagacccaggcgatgtgcttcatggcgggtgccaactcgattttctacggctgcaagctgctgaccacgccgaacccggaagaggacaaagatctgatcctgttccgcaagctgggcctgaatccgcaccagaccgaggtgctggcgggggataacgagcaacagcagcagctggagcagcagattattaacgccgacaccgaccagttctacaacgcggcagcgcggcgggcggcagatgcgtttcgcgtacgcagggttgtcgaaaacggtgcaggccgttttctgacccgtgagaaccggcagttttgtaacttctccagcaacgattatctcgggctgagccagcatccggccatcatccgcgcctggcaacagggcgcggagcagtatggcgtgggcagcggcgggtccggacacgtcagcggatacaccaccgcgcaccaggcgctggaggagacgcttgccgactggctgggctacccgcgcgcgctgctgtttatctcgggtttcgcggccaatcaggccgtcattaccgcgctgatggggaagaatgaccgcattgtcgccgaccgcttaagccatgcctccctgctggaggcggcgaatttaagcccggcgcaactgcgccgctttgcgcataacgacgcgggacaactcgccgcgctgctgggtaaaccctgtgacgggcaacagctggtggtcacggaaggggtgttcagcatggatggcgacagcgcgccgcttgccgcgctgcatgacgcggcaaaacggcaaaacgcctggctgctggtggatgatgcccacggcattggcgtgatgggcgacgagggtcgcggtagcgcccatcagcagcag

SEQ ID NO: 109070 - DNA, 462 bp, Glycine max
  Peptide Sequence Number=SeqID_225848
atgttcacacaggacgacctccgctttgaccgccagcatatctggcatccttacacctcaatgcgcgatccgctgccgtgctacccggtggtggccgcgcacggctgcacgctgcagctggccgatggacgtgagctggtcgacggcatgtcgtcgtggtgggcagcgatccacggctataaccatccgcgcctcaatcaggcgttgcagcagcagatggcgcagatgtcacacgtgatgttcggcggcatcacccatccgccagccgtagagctgagccgccagctgatcgccatgacgcccgaggcgctggagtgcgtgttccttgccgattccggctcgatcgccgtcgaagtgtcgatgaaaatggcgctgcagtactggctgggtcgcggagagacgcggcagaaattcctcacgctgcagcgcggttatcacggcgatacgtttgccgccatgtcg

SEQ ID NO: 109071 - DNA, 381 bp, Glycine max
  Peptide Sequence Number=SeqID_225849
atggaggcagccaataagaatatcaagaagattatccagaagatgatcgtgtcatacaaggattggcacgaaatgctcccattcgcgttacacgaaggcaagcgtttggtcgccatgagccatgggcatttatatcataaacgagtgaagaacacttttgacaagaaggtacgcccgcgccggttcagcgaaggggacttggtgctgaagaaagtctcccaagctctgaaagccaacagaggaaagtgggccccgaactacgaagagcctttcgttgtaaaaagggctttctccggaggggccctgatgctcaccaacatggatggcgaggagctaccttcacccgtgaactccgatgttgtcaagcgatactacgcttaa

SEQ ID NO: 109072 - DNA, 453 bp, Glycine max
  Peptide Sequence Number=SeqID_225850
atatttccacagttatctttctccataatttcaggttactccaatgtgaatacatctcctattggacagggaacttatagcaatgtttatagagctcgtgatcttgaacaaagaaaggttgttgctttgaaaaaagtgagatttgataatcttgagcctgagagtgttcgcttcatggctagggaaattcacattctacgtaggcttgatcatccaaatgtcataaaactggaaggcttggttacatcaaggatgtcttgcagcttataccttgtttttgagtacatggagcatgacttggctgggcttgcatcacatcctggactgaagtttacagaagcacagctaatggctggtactcctatttacttcctaatgagctcactgaaatttaattccttttttcttttgccattgaaaatgagactaatgaaaataagtggaagaaactaa

SEQ ID NO: 109073 - DNA, 364 bp, Glycine max
  Peptide Sequence Number=SeqID_225851
atgagggacaaagatatcaactttatccattttaacattgtaactgtggtttacaataatggtacaaacttgaaaatcctgatgagtcatttagagacatctaacaacaactttcaaaattgcctcatgtgtggcatctcttgtcaatgtcaggatgtacacacgattctcctcaaatttcagccagcatcaattagaccttgcacattacgcttcagagccctacaatgctcaatggaaaccccgaggcttctccatgacaagcacacgttgcattcgagtcgtattcttggagaaatggaggttgatgaaccttggttggggttatggctaccattgaattatcaagtagatatgggagcaa

SEQ ID NO: 109074 - DNA, 1005 bp, Glycine max
  Peptide Sequence Number=SeqID_225852
atgtcccccgaatccgtctgggcttggcactccagccgcgtttatatcaaaacatctgccttgacctcttccattgatggaagattggtcaagagacacttatcctcctgcgtgatcagattgggaatgaccttgttgaccaaagtgttttacttgagttgttgccaccaacaaatagcaattgacatttatttgttttatttcagttctaaggttgaaaacaaaaacttcgaaaatgacgctacaattgaaagcaatgttgtttgccatatgctctcaaagggtggcctaatgttggtgatatatggggatagaaagtggggagaaggacaaacgagactggctattttcatgatagctacctttctcttccaagatctcttgagagatcttctcgccattcaaggagattccaaagcaagcctgttgttcagcgctggaaggttcccacaactaagcgaactcgtacaaaagcttggaatatgtcagtggtgggatgaatatttaagtcgtagaatggagcaaaaagcacattatttttggtgtgaatttcgtgaaataagttgggatcctatccgtcatgaaagggaaacaagtgatacaactgagaatttaggagacatgttacattctaaggaatgggctagtatgcataaagcagaagacacaaatcccatacaaaattttgataagtatctagataccttagacgacttacttggtatgcctcacactggcattacaccttgtgatgatgtgactcgtgatattaaccttagtgttgatgaactcgcaaagttgaagttggtggaacaaattttgttattaagtgatgctttcatggaggctaaggggaagtttaaagaggcacacaaattgttagctgatctaaaggaaaagcttaaagtttgcagactgaaaaatgactatgttcaattgaaagagaaagtaacacaaacagaggctataattgagggattggttttaaacatccaaagaaattaa

SEQ ID NO: 109075 - DNA, 348 bp, Glycine max
  Peptide Sequence Number=SeqID_225853
atggactcaagcggtgcgcttagcgggataatcccttgctcagcgaacatgcacaactcattcttcttccagattcttcctcgcgctcagcgaagggagttatgtgatgcaaggttcaatggagcttctaggcctaggatcttcttcatcaaaggaatcctttgcttcttggaagaagaaaggcaacggaatggaaaaaggaagagagagaggagacgccacttcaaggagaagatgagtctagaagttgctcaccaccatagcaggccatggataagagcttggaggaagaaggagatgaatgaggggagagggagagaagagcacgaaattttgtgctccaaatga

SEQ ID NO: 109076 - DNA, 438 bp, Glycine max
  Peptide Sequence Number=SeqID_225854
atggtggaaaaggaaaaattcgatcatatagaagaaaggctgagggccattgaaagagggggagattatgcttttatagacatggaaatgctatgcctagtgcccgacatcatcatacctctaaagttcaaggtgccgaatttcaacaagtacaagggaattatttgcctcaataatcacctgaagatgtactgcatgaaaattggggcatacgtgaaggatgaaaaactcttgatgcatttttttcaagagagtcttgttggggcggctatcacttggtacactgttcacgccccggtgttgcttgttattgtggaactaaaataccaattgtcataccctaatttcgtctggggaccatccgttgttgggatgcgaccctcgttgacgactttaaggtatttggcacccatcgttaggcaatttgtgaagttctga

SEQ ID NO: 109077 - DNA, 252 bp, Glycine max
  Peptide Sequence Number=SeqID_225855
atgtgcagttatgccaactgggagtatgcatgcttagctgaggaagaaattgttaatgttgatcaagaaaacggggaggcctttgacgaggaagttgagagtatggttactaagatattaataggaaaaccttatttgtgttcagctttgaagcaagggaagaatacaggtattgttggggatggaaaatttgagtatgataaaggactagcaaatttggctgaaagaggaacacaagatcatatctcctga

SEQ ID NO: 109078 - DNA, 615 bp, Glycine max
  Peptide Sequence Number=SeqID_225856
atgcctcctgctccaattattgctcaatcatcagcttacacacaccctgtcttgccaaacattactgaagaggcttttcaagagcgtcttaacaagaggattgctgatctaacagctgagttagggcggatcaagaaagagctagttgaattaaaccccaagatcactcttctcaataccaaactcaagggtaatttggaccagtgcattccgctatatgctttggctaactccctagatcccaacattacgcacttgctgcatcaacaagaaagattggagaaagatttgagcacaagtgagataggcattgttgaaggcagaaaaatctgtgatgacttgcgacaatgcctatctgtgtccattcctccagttccatccacatcggctcctccatctgtgtccattcctccagttggaattatggatcacatagtcaaaattgttctcaaagtgtctaatgctcatgttgccgctattgctcaaaatgctattattgttgccccaaccattgatgttggacttgtagatcaagatgaaggagatggaggcaatcttaacacttcttcaactgagtcgaataacatgataactgattcgattgccaacccttga

SEQ ID NO: 109079 - DNA, 255 bp, Glycine max
  Peptide Sequence Number=SeqID_225857
atggtagatgctcagaaggaagtagatcataaaaaagaattatttcccattgaaaggaagtctccaagttttgaagcacaaaatcctttagaagagatcaacatagagacaagtaataagttaaggatgaccaaagactatcatgagatgctaggattatcaagggagttagtggagcattggataccaaacaaagaaggagctaaaccgcattggcaacctccaaggaagtctaatccacagcttttgcaatag

SEQ ID NO: 109080 - DNA, 419 bp, Glycine max
  Peptide Sequence Number=SeqID_225858
atggcttccaccaatagctcccaatcgaagcctcatgaatatggcgatggatctgatgatgagtcattgtcttcctcttctagcttcttgaatagtcaggaatatcaagagcagtttgtagctcttggtggctttatcaaccttctcaaggcccacaaaggacatttctaccttcatccttgtgttgatgacgtgatcgacatcatcacttttcttgagcattacattcaccatgatagctatctaattcccattacttcttggtttcagataagctttattccctccaatttgggaacctgcttttgctccactacaatgaacatgtttgtgttccctttcggtttcatgaccatcacgctgcaagatgtggccactatgttgggtttccttatcgttggtgacgagattccttccct

SEQ ID NO: 109081 - DNA, 252 bp, Glycine max
  Peptide Sequence Number=SeqID_225859
atggttatttccttcaacggaaccaggattggatttggttttggcgtaggttgcggtttcggtatagtagggggtttcggaggggttaccagatttgttttcagtgagctcaaaagttatggaattttcatgagaaaggtctacagttcaacaaaggaggacttcgtggcaagatggcattcttggcacaaactatcctattcctgcaaagtggaactggacttaccagtttcaagtgaaggatcaaactga

SEQ ID NO: 109082 - DNA, 315 bp, Glycine max
  Peptide Sequence Number=SeqID_225860
atgttgaaagaagaaattggcagaatctacagaaccggtgtttatgtttgtgaaggaaacagaggtttgtcttggatttatgtgccttcgagatttttccaccatggacaaaatttctcatttatatgttctatgaacatggacactactgttgctatacgcactcttgaagcaacttataagtcattagcggatgcagctgctgttgaaacttttctgaataccgagaaggtcagtgtgactggtggaaatagtgaggttgaagcagcaaaagttgggcgtttagttgcatcatcttcacttgtaaagggatga

SEQ ID NO: 109083 - DNA, 401 bp, Glycine max
  Peptide Sequence Number=SeqID_225861
aagccctatcgacaaaagagggtaggacgccagctacaaattcaaacacccaaacagcacaggtgaaaacggcagctgaaacgacgacggtgcttgcaacgaaaccatcgattgttgctgttgttgttcttgttgaggctgaacctgaggcgatggaggcggagatgggtgactcagtaggcacgtggacgatggggaacgacagcagaggagataacagcgtggggggtttggaaaagatggagaagttgttaaaggtaacgacgacagaggaagttgcatggaagcttgagatgttaactttgtggtccttgtgcgaccgtgagctggtggccaaggcaagagtcaaaggaaggctagggatttcaaagtatatacacgcgacagtgacaattatgtaa

SEQ ID NO: 109084 - DNA, 393 bp, Glycine max
  Peptide Sequence Number=SeqID_225862
atggccgaaaatcatgagaacgcagctgcagaagtgaatcccattcatgcaaagaggaaatacacccgttggacggaagaggaacacagaaatgagaggatagtttctcgagcaattgaattaaatgagcaagttcagaaatttcttgcaagacatgatagtcttctttcgggcaggcccacaacaatagctaatcatttggagtgtgaagaagctgaggaggttgttttatgttgcacttcattaccagcaaagagtagccaatatcctcctaagtcaagcaaagggcaactcttggcaataatgggtccctctggttgtggcaaatcaactctacttgatactttagcaggtatatacatcatcacaagttctgaaccttatgagttctga

SEQ ID NO: 109085 - DNA, 345 bp, Glycine max
  Peptide Sequence Number=SeqID_225863
atgcatactatagagtttcaaaagcgaggactccctcacgtgcatttattgctatttctacatccagacaataaatatccatcttcaactgacattgacgagataatatcagcagaaatatcttcccatgaagatgacccagaactctacagattggtggaaaaccatatgatacatggcccatgcggaattttacaacccaactctccatatacatttctccctgtgaagctgcttggagaatatttgcttttccaatccacgacaaaaagtctgctgttgagagattgtattttcatcttccagatcaacacaacgttctttatgaagatcatgatgatatag

SEQ ID NO: 109086 - DNA, 381 bp, Glycine max
  Peptide Sequence Number=SeqID_225864
atggttggtaaggggaattggttttcagggtcagtggcttttgattcgagggagtctttccgaccgaggcggagatcaaaggtggggccaccgactgcaacaatgagatcgaggcgacgccagggcactcaagctagagggcgccttggcgcgcgccactgtgtcaaacccgtcccccgagagggggaggttgacggctgcgtcacgctccgccttgttgaaggtgttggaggtgacgaggatggaagtgtcgcagccgccaaccatacagttgtggaagaagaggcggagcatggcgccagcagtggttggcgtcgacagttgcttgtgggtgacggcttttcggacgatgtcgaagaatttgggacagttttttggtag

SEQ ID NO: 109087 - DNA, 438 bp, Glycine max
  Peptide Sequence Number=SeqID_225865
atggtggctctcgttggtgcacacaccatagggttatcccactttaaccaattttcccacaggcttttcaactttaacaagaattccgaaattgaccctgcgtataaccctgattacgctgcggggttgaagaaactgtgtcaaaattacaccaaagacccttccatgtcagcgtttaacgacgcgataactcccacgaagtttgataacatgtattacaagaacttgcggaaaggaatgggattgttggtcactgatagtgccatgtttgatgattccagatcgaggcccttcgttgacaggtacgcggatgatgaaaagaagttctttcaggatttcgcacgtgccatggaaaaacttagtgtgttgcaggttaagaccgaaggaaaaggagaggtgcggtcgaggtgtgactcattcaacacgcttaataattga

SEQ ID NO: 109088 - DNA, 360 bp, Glycine max
  Peptide Sequence Number=SeqID_225866
atgaaaaataaggaattgaaaggttatatgtcatatgcgaatggtgagattgagttgagcaagtggataataaacaaagatacattggggtatagtggatggagaggagcagaggacccacctttgcaaccaaaaacttttcaagagcaaatcttggagcatctgcggaggatgttcatgtggatcagtagataccgctatagttatacaatggaggaagaggatacaaccatcaaagtctacgaggaggtgggagatttcattgatgatgaggatctcatgacatccgagatggctttctaccttaggtgtctgggagaaaaagatatccaagggagaggtggtttcatccgacggtga

SEQ ID NO: 109089 - DNA, 429 bp, Glycine max
  Peptide Sequence Number=SeqID_225867
atggaggatgtaatgcaagagttacaagaaatgaaggaacaacatgaggactggaggagtattgccctcgaggccttgtcagcaaaccaggcgttgcaaactcgaataaggagatcaagaggaaagcagatgacacccaagcgacgcttagaagattggaggaagaaggatcaatcgatcatgggttttaaagaattctcccgcatagaagtaaggagaatcattaaaagatttccttgcaaggaaatcgttggttcagagaaatcctacaaccatggtagaagtctgctgataccacgtgacatgccagatagaagtgaaggaaaccatggcaaagaagagatcatgagagaagaaggacatgaattccagttcggcatccaaaccgatcaccaaatattatctccaaccaaagcaaaattggagtaa

SEQ ID NO: 109090 - DNA, 291 bp, Glycine max
  Peptide Sequence Number=SeqID_225868
atgaataaaactggagatggagaagaaacaattggtggaggccatatgaggaaaaggtgggatgcattagtctacccccgtttgtgtaagaggtcaatattggggttgaattgggggtgcacgaaagaaggttgggcaagaaggattaaggaggaagatgaagcttctcctcccgttttcactcggagacatcatttatggagtgtaaatccaaaaggccatcatggtcaaaaccccatccaccaacgggagaaggggctgagcaaaaacccttccccaatccccctttag

SEQ ID NO: 109091 - DNA, 699 bp, Glycine max
  Peptide Sequence Number=SeqID_225869
atgggatacaaggagatattctctccagtagttagacacacctctatacgtgttttgttggccctaatggcaattctaaacatggagttagagaacctcgatgtcaaaacttcatttttccatggaagattggaggaagaaattctgatgcaacaacctgaaggttttgaggaggaaacaaacaatctccaagtcagtggtacaagagatttgatgagttcattgtctctcatgggtacatcagaagtccctatgactcatgtgtttatcatagcaaggcacactacagacatggtaaaatctacctcaatcatggtcgaaagtgacactgatgctttagggctttgtggattgactacggtcctcatgattgaccatgacccttatgaattgaccatggttatgctttctaaagatatcaatctaaaagggcatactatggtcgtggtaaaatctaccacagttgtggtcgaacgtgatgctaaagctatgaggcgttgtggattgattacgccttctaaagatatcagtttgaaaaggcacactacggccgtggtaaaatctaccacagttgtgatcgaaattgatgctaaagctctaaggcgttgtggattgattacagtcctcatggttgaccatgaccctcatgaattggccatggttgtggtgaatttaccacaattgttgtcagattgttga

SEQ ID NO: 109092 - DNA, 946 bp, Glycine max
  Peptide Sequence Number=SeqID_225870
gaatgtgagctttgcaagacggacttacctacgtaccgagctaagctttgttaggaatgtgacgttaaagaattacttggatgcacagtactgtggtgaaatagctataggaactcctcctcaaaactcttcatctgaaggatcaagcagtggcgaagcaagcgaagaagagtcaagtagtaatggtgctgaaatccgcaccactgcttatgttggaaacccaaggaggtcttcatttgtgtggctggccttgttgctgatcatcacttatttctgttcatccatttatcattatcagtttcagagcatgcctgtgcctcttactgcagaagaggccggcaagagggggttttcggagattgaaacattcaaacatgtcagggccttaactcagttggggcctcatcctgttggttctgaagctctgcaggggagaggggatgatttcctagtggggagtattgttggagccctgatttttatggagaaaggtgttatgctggaacttgctcgtggaatttctcaatggcctgacggattggagagagctgttatattcttatttaatactggtgaggaggagggtctcaatggtgctcatagcttcataacccagcatccttggagcaaaactattcgtgtggctattgatttggaggccatgggcattggagggaagtctattatttttcagatgtcgttgtatgtcgacaacaacgacatcgatcacccaaggacccgtctttgtaataacccgtcgttgttggggtccatttcaacgttgggtacgcctaagacccgtcgttgttgtggtccatttcaacgtcgggtacgcctaacacccgtctttgttgggtttccatttcaacatcggtggcgggctcacccgtcgttgtttgacagtatgtcaacgtcggttggtgagtacaccgtcgttgttctttga

SEQ ID NO: 109093 - DNA, 381 bp, Glycine max
  Peptide Sequence Number=SeqID_225871
atggcagaaatcaaccaagggacggatgcgagtggggctagggtcacgaccgaccgattgttgccccttcccggcgataaacaagcagagaacatcgctgcaaggcagcccaaaatggccccgaggaaacttgcctcaaagagatccaggaaggataaggcggccgaaggaactagttccgctcccgaatatgatagtcaccattttaggagcgctgaacaccagcagcgcttcgaggccatcaagggatggtcatttctccgggagcgacgcgtccagctcagggacgatgagtataccgatttccaggaggagatagttcgccgacgatgggcaccactggttacccccatggccaagtttgatcgtgggatcctctag

SEQ ID NO: 109094 - DNA, 996 bp, Glycine max
  Peptide Sequence Number=SeqID_225872
atgaactggtatccgtggctgaaccagccgtaccgacagatcattgcccgccatcagagtggacaggcacatcatgcgctgctgattcaggccatcgacggcatgggcgacgatgcgctggtgtggggcgtcagtcgctggctgatgtgtcagcagccgcaggggctgaaaagctgcggcgagtgtcacggctgtcagctgatgcaggcgcacacccatccggactggtatcgactggaagcggaaaagggcaaagcttcgctcggcatcgacgcggtgcgcgacgtcactgagaagctgtaccattttgcccagcagggcggcgcgaaaattgtctggctgccggatgcgacgcagctgaccgaagccgccgccaacgcgctactgaaaacgctggaagagccgcccgccaactgctggtttttcctcagcgtgcgcgagccgtcgcgactgctggccacgctgcgcagccgctgtatgacgtggcatctgtcgccgccggaagagacgcacagcctgcaatggctgcagaaacagcagccgcagccgcagccggaagcgattctgcgcgcggcgctgcgtctgagcaacggggcacctgctgcggcgctggccttgttacagccggaccgctggcaggcacggcaaacgctgtgcgacagcctgaacagcgcactgagcggcgatattctgcagctattgccggcgctcaacagcgacgatgtggcggttcgcctcggctggctgctttcgctactggtggatgcgatgaaggtgcagcagggcgccagcaactggctgagtaatggcgatcgcccggacgtggtgacgcagctggcgcagcagttcagcagcagcgcgctgaatgccagcgtgcagcagtggctgcagtgtcgcgagcaactgctgcacgtggcggcgcttaatcgtgaactgattctgaccgactgtctgcttgcctggggacgtttgctgtctcccgcgacgatcggctaa

SEQ ID NO: 109095 - DNA, 225 bp, Glycine max
  Peptide Sequence Number=SeqID_225873
atggactcgggaaggttcaagattagtgtaccatgtgacggctgccccaataaggctctcttgaaagaaatgcatcaacaacttttcatctttcacgaggggcttgtcccaccgcaaaatgcaagggttatggttgtgggcaaaactgagggccctccgaagtgtttggcaggggtacaccaccaactgcttgctcttcagtggtgtattcaaggcaaggcttga

SEQ ID NO: 109096 - DNA, 7095 bp, Glycine max
  Peptide Sequence Number=SeqID_225874
atgggaatgaacagaagtggaagtcatcggctttgtgcactcgaatgcggtgcagtttttgaggaggagttgccgctttacgagacgcgacatcacgcttccaatcaactctaccaaaaccaacatcaacaacaacaggaaaacgacagcgccaagggttccttactgtccctgctttcttctcgaggtacgtttcggttttcttttgatttcgttgaattccgtccgatcaacgcttgtttggatccaactaatgttcgtctcgtctcgtacttcgaaggcgtgagccaactcaaggagaaatggaccgaatataatcaaccgaagagactcagaagattggtttcactttttgtttccgccacagccaaacacgtcgcagttgcctcgggaaatcggattacgattcttagtaaagaggacgactatcaaaatccatgcgccattttcaccacaattggctcgttaggttctagctttggtacgtttagtgtaggagcttggtctgaggacgaggacgttcttggagttgctgatgactctgatacactctattttattaaattcagcggcgaagttgttgcggaaatctggaagaaacatttgaaagtctcttctccaatcgttgccctattttctgatatcgatttggatacacgcgagtcctacttgttctccattgttacttcagatggctcgcttcaacgaattgagatcagtcatggacagagtggctctacctttcccaagtacatttctaatcacacgagtcttatttgcaacaatatattctgctttgactgccatggtgaacttaacctttttgtggctgttcacaagaattccggtatggtgcttgcatattttaagctggacaaagaaggctttacactctcccggtttgtcttgggggagagaaatgattcaccagtgtctgataatttatcaaatggaaggaacagatctttggtgggttttatggattttacttggtggtgtgaccatatacttgccgttgtagatagggttggcatggttatgttgattgacatccttaatggttctaaagttccggaagaggatcctgcatattatttacctgttctggaaagagcaccaaaatacaagggctatgcttttcttttagcgagtcaatcatccatagaaagaaataatccttctgattttggatcgacagaaaagttgcatcagacagagtggataattgaagacagactcaatcaatttcacctttctagattgctctggaacctcgtttcatttactgagaagtctgtccctgaaatttatggtatactgattagcaagaaaaaatatcaggctgctctggattttgctgatagtcatggattggataaagacaaagttctgaagtcacagtggttgaattctagccatggagtaaatgaaataaatatttttttatcaaatgttaaggatagagattttgtactttctgaatgtgttgatagaattggaccctcggaagatgctgagaaagctttgctggcttatggcctacgcattactgaccatcatagattctcagaagtagatgatgataattctagtcaagtatgggatagtcgattagccagacttcaaatcttgcaatttagagacaggctggaaacatatcttggaataaacatgggcaggttttctgtgcaggaatatagcaaattccgcattatgcctatcaatgaagctgccatagcacttgctgaaagtggaaaaattggtgcgctaaacttgctcttcaagcgtcatccatattctttgtctccatatatgttggaaattttagctgccatcccagaaacagttcctgtacaaatgtatgggcagcttcttcctgggaggtctcctccatctggtgttgctgtgaggaaagatgattgggttgaatgtgagaagatgtttcacttcatcaacacatcagttaaaaaccatgacatgcaaatccaagtcaaaactgaacctcttgttaagcatttccttggatttccttggccatcaattgatgagctctcaaattggtatacaaatagagctaaagctatggatgattttagtgggcagttggataactgcctcagcctactggagtttgctcttcgcaaaggcatatctgagttacagctgttccatcaggatgtcttatacttgcatcaaattatttattccaatgatgatagtagtgaaatgagcttcaacatgagtcttgctatgtggggagaattgtcagactatgaaaagtttaaatttatgcttaagggagtcaaagaggaaaatgtaactgaaagattacacaatagaggcattccttttatgcgtgaaaagattcacaaggaaacttctttggagaataaattggacatatgcttggtggtaattgaagaagggtgcagaaacttccaaagtaatgactatttcaaaactgaggtcgaagctgttgattgtgctttgcaatgcatatacttgtccacagttacagataggtggagtattatggctgcaatactatctaaacttcctcaactacatgttggtgcaattcaagttgaggaccttgagagaagacttagaattgctgaatgtcacattgaggcagggaggcttttggcattttaccaggtcccaaagccattaaactttttcctaggggctcaattggatgaaaaggctgtaaaacagattatacgtcttattctttccaaatttattcgccgtcagcctagtcgatcagacagtgaatgggccagcatgtggcgtgatatgcagtacttgagggaaaaggcatttccttttctggacccagagtatattttgactgaattttgcagaggattgcttaaagctgggaagttttctcttgcacgaaattacttgaagggtacaagttccgttgctttggcatctgagaaggctgaaaaccttgtcattcaagcagctagggagtactttttctcagcttcaagtctttcttgctctgaagctagagaatgtcttaatttatatccgagtagtggaaatgtgaaggcagaggcagatattattgatgcacttacagttaaacttccaaaccttggggtgaatattctgcccatgcaattcaggcaaataaaggatcctatggaaattataaaaatagcaatcacaaatcaaactggagcatattttcatgttgatgaacttattgaggttgccagacttcttggcttgagatcttctgatggcatatcagctgttgaggaagctattgctagagaagctgcagtttctggtgatttacaattggcatttgatctttgctttggtttggcccgaaaaggacatggtaacatatgggatttatgtgctgcaattgcaagaggtcccgcccttgataatatggatctggactctcgaaagcagctattagggttttctttaagttactgtgatgaggaatctattggtgaacttctccatgcatggaaagatcttgatatgcaaggccagtgtgaaacattgatgatatcaacagggactgatccttccaaattttcagtgcaaggctcatctgtaaactctcttccgaagcaaaattttcaaaatatattagatgaaaatggttgctttcgggagtttgatagtattagtgctgacaatgaagatgttcaacttgagaaaactagagacatgctttccatcgttgcaaaaaccttggctattggggatcgaactgattgggcatcgatcttgactgaaaatgggaaggttctgtcttttgctgctttacagctcccttggttgcttgaattaagcaggaaaggagatcatcataagaaatttaggactggaaagctgtatctaaacatcaaaacacaggctgtgctaaccattttgtcctggttggccagaaatggatttgcccccagagacaatctgattgcctctctagcaaaatcaattatggaaccaccagtcactgaagaggaagacataatggggtgctcctaccttctgaatcttgtggatgcctttagtggggtagaaattatagaagaacagctcaaaatgagaaaagactatcaagaaatttgtaggatcatgagtgttgggatggcatacagcttactacacaattctggaatagggattgatccttctcgacggaaggagctattgaagaggaggtttaaggaaaaacatgcatcacccagttctgatgatatagataaacttggcaaggtacagtcctcattttggaaagagtggaaattgaagttagaggagcaaaagcatctcactgagcattctagagcactagagaaaataattcctggggttgaaacagagcgctttttgtccagggattccatctatattgagaatgtcattatctctctcattgagtcagtaaagttagaaaaaaagcacattttgaaggacattttaaaattggctgacacttatgacttgaactgtactgaggtgttattgcgatacctaagcattgtccttgtttctgatgtttggaccaatgatgatattacagctgaagttgcaggttataaaggagaaataattggtaatagtgtgaaaaccattgaaaccatctcaacgattgtataccctgcaattgatgggtgcaacaaaattcgccttgcttatgtgtatggtttgttatcggagtgctacttgcagctggaaaataccagaaatttatcaccaatagtgcaggctgatcatgtgaatgccaatctaagcttaggtcaatattacaaggtcattgagcaagaatgcaaaaattcatcctttatcaataacctgaacttcaaaaatattgctgggttacatggtttgaactttgagtacattagtgatgaagtttatgcatgtattgaggaaagtagcttgtcagctttgtcaaaattggtacagactcttgtcaatatgtatggtgattcattgcctgatgatttcatgtcatggcaggatgtctacaagtattacatcctaagtttgcttagagctttggagactaaagttactactgattctggcattagaactcctgaataccttcaaggatttataaataagcttgaacagagttatgatttgtgccgagtgtatattaggcttttgagccagtctgatgctttggggatcatgaagcagtacttcgctgtaatcatgcctctctacagttcatatggacttctacctgacaattcaacgtggcaagagtgccttattgttcttctgaacttttggatgagattaacagatgatatgaaggaaattgcattggaggaaaattcaggagaaactagcagcttcaatccacaatgtttaatgagttgtctgaaggtttttatgaaattggtgatggaagatatcatctcccctagtcagggctggggcagcatatttggctatgtcaattgtggcttaaatggtgattcttctgcagaaatttataatttctgcaaagctatgattttttctggttgtgggtttgctgctgttgcagaggttttttctgttgcatcatcagaaactggttcagcttctggttgtggtacatgttctcaggatcttcctcatttctatttagatgttctagaggctgttttgtcagaattgattaagggatcccatgagagccagaacctgtatcatatattgtcttctttaagcaagctagaaggtgacttaaaatttatgcaatgtgttagacatgtaatttgggaaagaatggtccagttctctgacaatttgcagttgccaagttctgtcagagtttttgtgctagagcttatgcaatttatctcaggtaaaaatattaagggtttctctgccgaaatactagccaatgttcaaccatgggaagaatggaatgaattgatttatgctagtagaaagagtgagactgatgttgacaagcacttgccagatcacaaagactcttctagtagggttacaaatactttggttgctcttaaatcatctcagcttgttgcgtcaatttctcctagcatagaaattacccctgatgatctattgaatgcagacacagctgtgtcttgctttatgaggttgtgtggagaagctagtgaagatctccactttgatgctctgctgactattttggaagagtgggatgaacttttcactgcagggaaagatggagaaaccactgctgaagcatctgatggaggaaatgactggaacaatgatgattgggacgagggatgggaaaaccttgtggaagtagacaatcctgagaaagagaagatagaagactctgtttttgttcaccctttgcatctttgttgggctgagattttaagaaaattcataagcctgtcaaggtttactgatgtgctgagactgattgatcaatcatcattaaaacctaatgctatgttgcttgatgaagatgatgccagtagcttaacccggatagcacttggcattgattgctttctggctttaaagatgacattattgctgccttacaaaacattacagttgcagtgcctgggtgcagttgaggatagcacaagacaaggcatccctcaaacaaggagcaaagattatgagttattaattctcattttatcctctgggattctcacttctatcatgattgactccacctatggtactattttctcttatatctgctatttggtgggaaacttatgcaatcaatgtcaacaagctctggtgtcaggtagaggaactaacaacaatgaagataatgagaatcagttgcttcttttcacaaggatccttttcccaaatttcatatcagaacttgtgaaggctgatcaacatattctagccggatttcttgtcacaaaatttatgcacagtaatgaatcgctcagtctctttaacattgccggggccagtcttaataggtatctgaaaatgcagctacacatgctacaggtcaacgagttccctgtggagaagacatgtaaaacattgaagaatactgttggcaggttgagaggcaaactaagcagtttgattcaatccatattgccaatgctttctgctagtgttagttga

SEQ ID NO: 109097 - DNA, 264 bp, Glycine max
  Peptide Sequence Number=SeqID_225875
atggcagcggaatggagaagaaaaagagttgagaggagacgccacttcaaggagaagatgagtcaagaagaagctcaccaccataggaagccatggataagagcttggaggacatgcacaaagtgcgactatatgatgtggcaatggggtgtggcaagcaaatgctcacctcctgatgtgaacctgactaggagcggatcgcttgatataggttacaatgtttggatgatgccacttccaaagagggaagataagtcagggtag

SEQ ID NO: 109098 - DNA, 156 bp, Glycine max
  Peptide Sequence Number=SeqID_225876
atggagcaaagcttggagctaggtcaggaaatgagggttttcgattactcagtagtccagcacgacaacacgacaacgatgacgacaaccaccacgacgcgagtagctcagcgagagtcattttggagggttagtagcttgaacaaggtagagtga

SEQ ID NO: 109099 - DNA, 162 bp, Glycine max
  Peptide Sequence Number=SeqID_225877
atggtggtggtggctggtcaaggaggtcgcgctcaaaagtacctgggtggggggtggttgcgagatgttggggggttctgtgggtgggggaagggttgtcgtgcgtggatgacggcttgggttagtggcgcatgcgacagagtatgtggaggtgctgtttga

SEQ ID NO: 109100 - DNA, 237 bp, Glycine max
  Peptide Sequence Number=SeqID_225878
atgccaaattatgtatcaggtgttgtttactcctgtgagatgatgtcagcatccacgcagaaactattggacatgagagttgtacttgaaggcacgaatagtcatcaggccacacaaaaacttctactgatgacatataagggtcttgcaactgcatgtaactcagttgaggagtggtcgccgccaaggaagaaagccaacaaaggtgacaaaggaggtgaccacaaaagcacttga

SEQ ID NO: 109101 - DNA, 456 bp, Glycine max
  Peptide Sequence Number=SeqID_225879
atgggtacagcaaggggacggccaagagacaatgttgacttcttgggggtgacctttcgtagggacgtattgagattgcagctgattccgctccctctctccaccagccaattgcagagtgcagaacttccgcacgagctagcatcaacaggagaatcgcactctagaaggttgtgcggtggcagcggcgtacacgagcaggagaaccgcgcgcacgaagttggtggagtgcaggttgatgcggtgggaacacggtggagaaccaccagccaagtttgctttcactctctcttcgaatttcctttttttagcttctctttgttgtctacagaccttgtttttcccttggtggtttctggggttcttcagcctgccttgtcaccgaatgtggtgaaaaaggttggtgagaaatatagcctcgtgcgtgatttgaatggaaagttgaggcttttgtag

SEQ ID NO: 109102 - DNA, 198 bp, Glycine max
  Peptide Sequence Number=SeqID_225880
atggcattgatccatatcactgaggtattacgggtaacagatgtgtacattagtcaagctcttcttgacaaatatgatatggtagtccataaccttgccatcatgacttaccaacttcagtccctcttcgggttgatcgatccatacatgaaccagctatgtgatccttataggactgaagtagagtcaaatccataa

SEQ ID NO: 109103 - DNA, 996 bp, Glycine max
  Peptide Sequence Number=SeqID_225881
atgaaatctgttgaaatgtcagatgagattagcactagtcaattgacttctgaatcttgtccagaacatcttttagaagcaatgctggccaactttagccatagtaataatgatgttaatagtgaattatcattttgtaaatcaaagcaatctgcaattgtctctgcaaaaaatcatgaggcttctattcacaatgtgcatactattaattcagaaggctattcgatagatcagctctctcttgtcagagaggacaaacaccattctttgagttcatcatcagggatatgtggtgtgatgtcctcaaaaggtatttcatctacatttcatagttcaaatagtggacagcttgaaaggtcgtctgaaccatctaagaacagcaaaaaaagggccaggccaggggaaagttgtaggcctcggccaagggacaggcaactgatccaagatcgtatcaaagagttgagagagctggtgccaaatggagcaaagtgcagtattgattcactcctggagcgcacaataaagcacatgctctttctccaaagcataactaaacatgctgacaagttaactgacttttctgatacgaagtcaaagttgcatcataaggaagcagacattcttggatcatctagttatgagcagggctcaagctgggccatggaggtagggggtcatctgaaagttcattcaatattagtggagaatcttagcaagaatggacagatgcttgttgagatgctatgtgaggagtgcaaccattttcttgaaatagcagaagccataagaagtttgggccttaccattttgaagggtgcaacaaaagctcatggtgaaaagatgtggatatgctttgttgtcgagcgaagagcctctgggcaatggggtacgaagtttttgagggcgagccctggtgcagcggtaaagttgtgccttggtgacttgttggtcatgggttcgaatccggaaacagcctctttgcatatgcaagggtaa

SEQ ID NO: 109104 - DNA, 568 bp, Glycine max
  Peptide Sequence Number=SeqID_225882
atttaatgcttatggagttgatgggggacccacagcaaaagcactcagaccgaagtttgatgcctttgcacatcaagtacattctaaagctggctttcaacttccagatattgatgagtgtgacatggagttggacactgcttgtgaattcatgcatttttctgccattaagtgtagggtttctcgttttggccttgacacttattgcttgactgctacaagcagcacatacccaattttgacttctcagcagatgaaaattttagttgctggggctattgctctcaagggcctcggagggattcttttcatacttggcagctcttttggagctttccttttgcttttacatcaaatgattgctactccaatactgtatgatttctactattatgacagcgaggacaaagaatttatccaacttttcatcaaatttactcagaatatggctctcttcggggcattgttgtttttcattgggatgaaaaactctattcctagaaggcaacccaagaagaaggatttgactttaggtgtctgtctggttcagaacgaatgtacctcgtaa

SEQ ID NO: 109105 - DNA, 1134 bp, Glycine max
  Peptide Sequence Number=SeqID_225883
atgcatggtgtggttagtgataatatgatagcagtggatggtcaatggtggattacgctatgcgttaagtgtggttgtgttttagtgagggaaaaaagaaagaaagttggaagctttggttggtggggtggtgggaattgtcatgggtgcggatcgtctgatactgccaacagttggaccgccattaaaacggcgagcagggttgcggaggaagcaggctggaagagggtcctacagagggagctaggtgtgagtgagatcttgacatgggaggatgcatattataacaatcctgatgatttcgactcttcagaaaataaacactgccagaagaccttggaacagattggttgtgggaaattttcacacagtgcattagggttagcggtggctaagatgtcatatcatgcatattcattaggagaaggtattgttggacaggtagctgttactggaaaacataggtggatctgtgcagataatcaagttgcgagttctggcttgtcttttgagtttgctgatgggtggcagtctcagttttctgctggaatcaggactattgctgttgttgctgtagtccctcttggtgttgttcagcttggctctctaaataaacactatactgttggattcgataatgtgcttgctaacatggttcaagaaggcatctatcatctctttatggtgattgaagatatggggtttgtaactcatatcagaaatctttttttgtctactcaaaattactcaatccaatgtcctagtcaaatacagggtagtttgaagagttcatctcagaaatctatgaaaagtgaaacagcagatgttttaatgccccttcaatgttctgggactgggaggaactgtacacctccttctgcttgtgagaaaatgtctgataatgtggccaagcaagaggggcctgaattgtacaatgatgaaagttccattttgcttcagtcgatatccaatatgatgaatgtggactgtcaggaatttgaagagatgaaacctctatatgggacaaagtatgaaggaggaagtagtggctgcaaagatatgagattggaatcagaaaaaaatgtctcatcatttttaaatgattttgttacagataatgctagcttcaatgat

SEQ ID NO: 109106 - DNA, 282 bp, Glycine max
  Peptide Sequence Number=SeqID_225884
atgagttgtaacgagtgtcgcgtccttcgaaagggttgcatcgagtcttgtatcctgcggctgtgtctacaatggatcgatacgcatgaagcatctatgatatttttttcatctctgtttcaatctctgttgtgcgaagcgtgtggaagaacgatgaaccctgtcaacagtgctgaaattcactggtcaggatctccgtcaatgaactccaaggagtttgagacgatgacatcgtgtttggagagcggaattgaagataactatgcccccgacgaagactga

SEQ ID NO: 109107 - DNA, 2595 bp, Glycine max
  Peptide Sequence Number=SeqID_225885
atgtttagcaggcaaaggggtgccagtgcttttagtatattcaaatggaaacatccaggtgcatcatctctgacaacagctttacttcaggaagacctgccggagattgaattgtctgattatggaaagatccctagtccaggcagtgagagcccttcagggcttctgaatggtgagagcctaaatgtagagccaattagtgatttggatctcttctctgaaaggctttacagctactattgtgagaaagggctatggtgcatcgttataaagtggattgttgaacttcttagtctggggttcaccatatgtttttcaggattttttttactatatgttgattggaatgggctccgtaatgctaagtgtgggatggatgcagttgaatctggaattaagccctgtgatcttgctaaagaagctcttcatcaacaccctttaaccccactaacacttaccaaatctattattgttggatacttgggaatattttccatctatttgattttttgcttcttgagattctttgctcaactaaaggatactctggaaatccggcatttttactacaacaatctccatgttaccgacaatgaaatccaaaccatgccctgggctacaattcttgaaaaagttgttctggtacaaaggtctcgtcaactttgtgtggtaaaagatctttctgcccatgacattgtcatgcggttgatgaggaaggagaactacttaattggaatgctcaacaagggtgtactagctttccctatttcacagtggtttccaggtgctggtcctacagtgaattctagttctaatggaacacagaatcgtgtaatactaaccaagacccttgagtggactttgaattggtgcatcctgcagagcatgtttgatcgaagggattttgtgtcaaatccaaagacattacgaaaaaggctaatggtagttgggcttgcaatgcttttagtctctccatttctagtcatattcatgctggtatatctctttctgaggcatgctgagcaattttataatcaccctagcacggcatcatctcaaagatggtcaaatttgtcaaggtggatctttagggaattcaatgaggtggaccatctcttcaagcaccggattaattgtggtgtattgcatgcttctgattatctcaagcagtttccttcacctatcatatctatcattgcaaaattcatatcttttgtatcgggtggctttgctgcaattctgatcatcattgcttttctcgaggagtctctactagagggccatgtatttggtcggaacttgttttggtatgctgctgtttttggaactataactgccattagccgggctgccattaccaatgaggttctagtcttagacgctgatggagcaatgtctatggtggtccaacatacacattatatgccaaagagatggcgtggcaaagaaagtactgaaatggtccatgttgagtttgaaaccttattccagtatactggaatgatgttacttgaggagatggcctcaattttcctcactccatacttacttttgtgtattgtcccaaagcgggttgatgatatcttgcagttcattgctgatttcactgtaaatgttgaaggtgttggccatgtttgcagttttagtgcctttgattttcaagagcatggaaacagtcattatggttccccttgcaatgcacctcgtagccggaggagttcccaagggaagatggagaaatcattgctgagctttcagagtagttacccatcatgggaaccaagtgctctggggaagcggtttttgctaaatcttagaagatttagagaggaaacgttacctgtacatggaaacgtacatgcaccttcccctcctagaatgtggaggggtagtcccaatattggagacagatacaggtttatatccagggaaatgctatacagtactcgtgacaatcacttgggttctttgtggttggttgaagctaaccaaaacaatcatccttatcttcttgattggtactatacatcccgatctcatgacacaaatccaggagacgttcctttagaagaaccatttggatctcatgatgtgaatctgggagatgtgcatttagaaccatttggagtaataaagcatagttctagagagtttttgatggccccctccaacttgacacagaatgaaagtgggtatgaggaatactcagacgagtttcatgatggttgggctgcatcacatcttggaacttccacttcagctcccatcttcaggaaaagcgtgatccacaatcaaagttataatgaactgtcccatactaccagcagtcattggtgggctagaagtgatccacggggtggacagactcagacaagcatttttgagcctccagctttcaaccaccaaacatatgattatcatgataagttttctgatagagaatcagaggatcaagatcatgaacaaagcatgtattctagagatgatcacagattatctagaacatacacagatgacttaggggcaggggaatttaatcttcattttgatgatatttacagcagacctccagaaactccacctgcaagcttttga

SEQ ID NO: 109108 - DNA, 843 bp, Glycine max
  Peptide Sequence Number=SeqID_225886
atggcactgaaccacaacccctctggcaagcttgtgtatcaagctcctcatgctaacacaataatccatcacacaccacaacctgcttcagatttacccattattgccatcattgtgcccagcatctttgtcactgctttcatactcatcacctacttaacccttgtgaacaaatgctgctcaaactggcaccaacttaaccctttgagatggatttcaacactacgagccccacagaatgaagatcaagatcccttcatagcactctctctttctcctaggatgcggaaccatggacttgatgaatctgccatcaaagaaatcccaacacttgaatacaaaaaagaagaagctgagaagaatattcaaagtgtatgtagctgtgtggtttgtttgactgagtttcaagaacatgatatgctaaaagcgcttcccatttgcaaacacgcctttcacttgcattgcattgatatttggcttcaaacaaatgccaattgccctctttgtagatcaagcattatttcaggcaaaaaacattgtccaatggatcatgtcatagctccaagctcttctcctcaggattctcaattgctctcttacatgggaagtgatgaggattttgtggtcattgaacttgggggagaaaatgtggcaacactgcctcagatgatgcaacaagaaagaagtgacacaagggaaattagaatagtagagtatagtagaagtcactctacaaggaagtgtcaccgtgtttctatcatgggagatgagtgcattgatgctaggaagaaagatgggcagttttctattcagcctattcgaagagctttctcaatggattaa

SEQ ID NO: 109109 - DNA, 372 bp, Glycine max
  Peptide Sequence Number=SeqID_225887
atgaggcatagagagggagaagtgttggaatttagaaccccacaacacccatctttgggaacaaacaattggggtggttcatctcctttgctagcaaggaacgtacccaaggaatcacttgatcaaaagtattcaagactcaacacagttcggaccaaagatgagatctttccagctgatgatgactactatgttgtgaacccttccaatgagtcaggtgcaagtgtaagtagtgccaagagatggaacaaaggaagagaagatggataccgagaatggatcctacgactaggtggccacaaggttggtgttgatgcctcattgttccatgcattccatatgttgatgtcacttgcggctagtgccttgtga

SEQ ID NO: 109110 - DNA, 1062 bp, Glycine max
  Peptide Sequence Number=SeqID_225888
atgagagacattgaggtggctagcttgaacttgctcgtgaacaaagtgatagtccaagaagatgtgctacatcctagagtgaagaacaaggcaggcaaactcgaagttcttacgttgtttcttggaaaaccaggatatcgggttgctgccaaagaagatgatgaacgtgaaggtggaggttctgtcgtaaacattccctcctcaatctgcatccgtgcatttgaggtgttggaggtgaagggtggtgggttgtgcattaattgggaaattttattgatggaaaaggataggtcaggtctagtgatggtgaaagtgaggtattgtaaggcaccaatgatgctccaatatagggttgcaccaacggtgggtgtgccatcatttaaaatgaaggtagcaattggagataaaggtgtgggtgatggtttcgcttcggccatatcagatttggagaactggtgggatagggtagctatgaaggtgttcatgaggttaatgttgatgccgatgaggaaaagacacatcttccttgagggagccttgaaggaaggcattgttgacgtcaagctgatgcatgggctagttatggtcaaaagcaatggtgaggacaattttgatgcaagcaacagagccgttgagatgtcttttgatacggaagagccacttgcaacccgcaatgttatgattttagggtgcaagaacaagagcgagtgggcatgggatgagtgtggatgggggggtgtgatatgggaagatgttgtcatggaaggtaacatggcgagatgtgtatattttgttggtaacagggaagatgcttggtgtggatcttggttagagtttgttgttggtgtatgggcgaataagccatgggaaataaaggcaaccaaaggagtgaccagaaacatagggataagtgtgcatggtgtagaaggcctcaaccaatttcaattatgtggcgatgacatagctcaactattgcatttagttcaggtgttgaaaagctatttgtggcttttggctgtgctacatgaaatgcatggttgggttgagctcgaccttatttga

SEQ ID NO: 109111 - DNA, 231 bp, Glycine max
  Peptide Sequence Number=SeqID_225889
atggggccaagacaagttaaagattcattcataagtgtgacaaaaatggaggatttaaaggaaaaggtcaatgaaggggaaccaacgcaaattaagtatagaggagtacgtaggagaccatggggaaaatttgctgcagaaattagagattcagctagacatggtgctcgtgtgtggctcgggacatttaacactgctgaggagccgcaagagcttatgatcgggccttga

SEQ ID NO: 109112 - DNA, 516 bp, Glycine max
  Peptide Sequence Number=SeqID_225890
atgaagtttgtagcagaccgtagtagcttgcccatgtttctcatagtacttgcatatgaccttcttggtggcactgggggatgtgggacgagcattggacgtggaggagttgtacttgggtttgaagccccgatgtatgtctcaaagtcagtgagaaggtcatggagttcagtaaaaccaatagggttttcgcgggagcaaagcgcaacggtgacctctttgtatttggtgacaaggccatcacatctagggagaggaaaggagaaagagctcatcagagagggacttgatgccatgaaggtagtccacaaaggagataatggtgtgtcggaggagttgatcttgatgacgccaatagtgatagttcgcatggcttgtggtggggcacgtggtggtgccatcaacgaacctgagaaggttatggccggcgaagagagcattgagttggaccttccacgcggggtaattagaacacttgtcaaactggtggcatataagcgattgtctttctcgtga

SEQ ID NO: 109113 - DNA, 357 bp, Glycine max
  Peptide Sequence Number=SeqID_225891
atggacctggacctagggagttttatttctctacagattagccagatcacccagtccagcacctccaggcttgggtttccagcattgatcacagcgttgtgtgacattcagggggttacctctgacaccttgatctttgagtcactaagccctatgatcaacttggcatacattaagaagaactattggaaccctgctgacctgtccatcatatttcccaggacccgacacacccgcaccagagtcgcagcaccagcaccagatgctcctccgccttctcaggtcgctcctcgtccgcaggtttccacttcagcaccatccgacatgcatagccagacgctcaggtccttgtactag

SEQ ID NO: 109114 - DNA, 207 bp, Glycine max
  Peptide Sequence Number=SeqID_225892
atggatttctcttacagaaggttcctcttcacagttgtgcagcttctgcttatcatgctcaacatttttgttgcttctcctgagtccagagtagcttgcaggccattattattacatcgtcagtggtcgagagaatatgggcttcatttgcagtcgcttccaaacggccctgctccaccgtcaggtggatttcgcattcatacctaa

SEQ ID NO: 109115 - DNA, 189 bp, Glycine max
  Peptide Sequence Number=SeqID_225893
atgattttaccattgtgcatgtctaacaacagagacttcttcatgctgaaattcactagaaatgctgatgatgaataccaaacaattctgtataaccagagggatggtagtttcagaactttgttgtggtgcaacttcaagatttttaccaaaactttggtcatctcgaacgctttgtcagatgtttga

SEQ ID NO: 109116 - DNA, 636 bp, Glycine max
  Peptide Sequence Number=SeqID_225894
atggaaggaaactttctgaccagaaacacgcataataaaggggacaggtttgggtttgaggagcattcatggcctgctagaaactatgcttgtagcttttgcaagagagagttcaagtctgctcaagccttgggtggccacatgaatgttcacagaagggatagggcaagattgagatcttgcttaaccccatcatcatgggtttcttctgagtttccaaataaacctaaccctagcattgagcctaacccaactcatctttcatcctcctctccatcatcatcatgcatatctaataacctgttgaattgtgctcatacttctccactttatatcccttctttgactttgtcttcttcacttactccagcttctcccaatggagacaagaaaccaagaagagtatctccccatcttcttcctcttttgattcatcaacgctgtgaggaaattaagatgagtaagaacaaagcgagtggtttaggagttgaagaagtacggggttgtgcaataggggaggaactcaagtttttcaagagtagtactagtgagcataacatcaagctggagttgggaatagggttgattaaacaaccagaaaagttagatttggagctacgattggggcactgctag

SEQ ID NO: 109117 - DNA, 804 bp, Glycine max
  Peptide Sequence Number=SeqID_225895
atgaattcctattgggacaccggcgccggcggtggcggtggcgcgacgctcatcccgggtctcccaaacgacgtcgcggcgtcgatcctctcgatggtcccctactcccaccacgggaggctcaaagccacatgcaaatcatggaaactgcttctctcctcgaaatttttcttagcctcgctgaacggaaagaaccaccttctctgcatcttcccgcaagatccttcaatcgcttcaccctttctgtttgatccgaacgcgctcgcgtggtgcccgctccctctcatgccctgcaacccccacgtgtacggcctctgcaacttcgccgccgtctccctcgggtcccacctctacgtcctcggtgggtccctcttcgacacgcgctccttccccatcgatcgcccctcgccgtcctccgccacgttccgcttcagcttccacgacttttcgtgggagccacgcgcccagatgctgtctccgagggggagcttcgcctgcgcggtggtgccggcccgcgggagcatttatgtggccggtgggggctcgaggcatacgatgttcggggcggcggggtcgaggattcggtcggtggagcggtacgaggtggggagggaccggtgggtgccgatggagaatctccccgggtttcgtgccgggtgcgtggggtttgtcggagaggaggggagggagttctgggtgatgggagggtatggcgcgtcgaggaccatatcgggggtgtttccggtggatgagtattatagggatgcggtagtgatgggagtggagagtggcgcttggagagag

SEQ ID NO: 109118 - DNA, 219 bp, Glycine max
  Peptide Sequence Number=SeqID_225896
atgggtgattcagctaaagttgtgatcaaacaagacatgaagggaagaaggcataaatatgggtttaacaacaatgaacgtgagaaggcacagaagaaaagggtggtggatgatgaaactgccgacaaacatcagctggatgaacaccaagagcgactacgcaagaagtttgcacttgaggagggaaggatatttgcagctaatgaacaagtttcttaa

SEQ ID NO: 109119 - DNA, 478 bp, Glycine max
  misc_feature (46)..(46): n is a, c, g, or t
  Peptide Sequence Number=SeqID_225897
cataccggtcgggacccgaaagatggtgaactatgcctgagcgggncgaagccagaggaactctggtggaggcccgcagcgatactgacgatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggag

SEQ ID NO: 109120 - DNA, 525 bp, Glycine max
  Peptide Sequence Number=SeqID_225898
atggacttaaactacccagaagagtgctactccaagagctcctgcgaagaaaccaacgatgatatgggaattggaagatcctatgagtgcatcttttgcaagagaggcttcaccacagcacaagccttaggtggacacatgaacatacacagaaaagaaagagccaacaagaccaaagccagtttctcttctcatccttcaagttcaaacaacgttgatggcatcaacaactatgcagatctcgggttctattcacagattccaagcctctccactgctcctgatgctaatagctaccgtgaagttttctttcctaccgctgcaccaagtgttattaggccttcttcccatgaggttttgtgtgtagaaaaccaacggggtcatcacgtttttgagcaagattggaggaagagaaatttgagcttgtacactaatccgttgggttttcatgaaattaaagataagtttgaagagagtgaagacaatggcctggatttggagctgaggcttggtcatcatccatag

SEQ ID NO: 109121 - DNA, 612 bp, Glycine max
  Peptide Sequence Number=SeqID_225899
atgacaaaaggtttgacaagtcattggaggaggttcatacaccctatttcacggcgctgtaagtggattgaattgcagatgaagcaacttcagtctcaagcacgtaaatatgagaaagagcttgcagcatacaattacacaaagcagcttgattttgcacactttacatcagaagactctaatatcaaatctatccctatatctgatcggatgcatagaaataaagttatgaagaggaacaaaagaaaaagagttgaagaacagtgtgatatagaattatacatgtctaaccatagtttattctcctattacgagaaaacagattgtactgctgttttgaaagatgtttgtgatgttggtataggaggcgtcaatgatagggacaaagaattcaagctgaataatgagtggtcttttggagagtatggaaatgttgataaatccttgaatgacatcattcagaagattgaagctatacagtcacaagttcagcaattaaaaactagaatcgacatggtgataagtgaaagtggtggaaagttttgttctataattcaattgagcatacatggcccatctgatggattaatcattttgattctactttcacca

SEQ ID NO: 109122 - DNA, 747 bp, Glycine max
  Peptide Sequence Number=SeqID_225900
atgatagcaaaggcaattgcaaatgaagctggtgcaagtttcattaatgtctcaatgtcaaccatcacatcaaaatggtttggagaggatgaaaagaatgtccgagctctgttcacactggcagctaaggttgccccaacaattatctttgttgatgaggttgacagcatgcttggacagaggactagagtaggagagcatgaggctatgaggaagattaaaaataaattcatgacacactgggatgggctattaacaggacctaatgagcaaattttggttcttgctgcaaccaacaggctatttgaccttgatgaagctatcataagacggtttgagagaaggatcttgggttgtcttccatctgttgagaacagggaaatgatcttgaagactcttttggctaaagaaaaacatgaaaacttagacttcaaagagctggcaaccatgacagaaggatatactggaagtgatcttaagaacttgtgcatcactgtggcttatcgacctgttagagagataataaagcaggaaagaatgaaggacatggaaaagaagaaaagagaagcagaaggccaaagctctgaagatgcttcaaacaataaagataaggaagaacaagagtcaggtagggaggctgcaagttttgcatcagaaggatctgtaatgaatgagttgaagcactggaatgatttgtatggtgaaggaggttcgaggaagaaacaacagctcacttacttcctttag

SEQ ID NO: 109123 - DNA, 381 bp, Glycine max
  Peptide Sequence Number=SeqID_225901
atgagctgggtggctttgcaagacttcgcgtggtgggtcaaggacaatggcagcgccgagggtggctttgcaaggtgggtccggagcaatggcagtgatgaggacccttttcattgcccacgctcattctcgaaacttaccctagtcactggccgcgcacattctcgcaaacttaccctcatcactgccattgctcctgacccaccttgcaaagccaccctctgcgctgccattgtccttgacccaccacgcggagtcttgcaaagccaccctggtcatgctttggtcgcaaagccacccttttcactacgctctgccattggcaccaaagcactttttgctcctcttctcgtgtctgttgcgtctactgtgtcttggtaa

SEQ ID NO: 109124 - DNA, 276 bp, Glycine max
  Peptide Sequence Number=SeqID_225902
atggatcaagttgttgtttctgctcaagaccatattatgtgcattcagactgagagggaagcactcctccaattcaaggctgcacttgtggatccctatggcatgctctcttcttggaccacttctgattgctgccaatggcaagggattcgctgctccaacctcaccgcccatgttctaatgctcgaccttcactgtttaggcctcagaggagagatccacaagtcgttgatggagttgcaacaattaaactatttaaacctcagttctatttaa

SEQ ID NO: 109125 - DNA, 252 bp, Glycine max
  Peptide Sequence Number=SeqID_225903
atggccttgcctggtaagcattatgatgcaccaacacatgatgatatagagaactattatgaaacacggactaaatctgaggaagctcaaaaaaaggaggctttcatcaaattcgttactgagaatgtgaatcagagcaaagcagatgaatctatgatgatctctgggatagtgactccaccagttgccatggaagctaagaaaactggccaaactgtgccacagttaagtattatcaaagccgtccctgat

SEQ ID NO: 109126 - DNA, 540 bp, Glycine max
  Peptide Sequence Number=SeqID_225904
atgttgtcattggatctttctggtaacaagtttagtgaagaactgacagtgatattcaataacttgtctgggtgttttggatactcattgcaagaactgaatctaggttggaataaaattcacggcatactgcctgaattctcaatgtttttgaagttggaaacattggttcaatcagggaatcaattaaagggtggagttccaaaatcacttcaaaatgcaatgttcccatctttaagaagattgtacctttataggaacaagctaaatgggacaatttctgaagatgttggatttccagctcgcctagaacaactagatttgagttcaaacgctttatctgataactcattggctctggaatttagccaaaactgggccccatgtttaattgagttagataggattgagatcttgcaagttaggtcagacatttcccaaatgactttagctatattgacatttcaaaaactggagtatcagattttgttccaaagtggttctgggctaaatgagctgtggaaaagtggatggaaatag

SEQ ID NO: 109127 - DNA, 1623 bp, Glycine max
  Peptide Sequence Number=SeqID_225905
catcttgatctcagcgtcaatcgatttgaaggaaatataccctctcagattggaaatctctaccagttgcagcatcttgatctcagctacaattcttttgaaggaagtataccgtcccaacttgggaacctttcaaatttgcacaagctttatcttggaggaacagatgatggtcgtgctctcaaaattgacgatggagatcattggctgtctaatctcatttccttagcccatctttccttccactccatatctaatctcaacacttctcatagcttcctccaaatgattgccaagctaccaaaacttagagaactgagtttaattcattgtagcctttccgatcagtttatccttccattgaggccctctaaattcaatttttctagttccctttccgtccttgatctttccatcaacagcttcacgtcatcaatgatactccagtggctgtccaacgtcacttccaaccttgttgagcttgaccttagtgataacctcttggagggttccacatcaaaccattttggccgtgtaatgaattctcttgagcacctcgacctctcatataatatattcaagggtgaggatttgaaatccttcgcgaatatatgcaccttacattctttatacatgccagcaaaccatttgactgaagaccttccatcaatccttcataatttgtctagtggttgtgttaaacaatcattacaagaattggattttcaatataatcaaatcactggctctttacccgacctttcagtattctcatctctaagatcattgtttcttgatcaaaatcaattaaggggaaagatacctgaaggcatccgcttaccgtttcatttggaatctctgtcaatccaatcaaactctttagaaggtggaattcccaaatcatttgggaactcatgtgctttgagatcactggatatgtctggtaacaatttgaataaagagctttcggtgataattcatcaattgtctgggtgtgccagattctcgctgcaagaattgaacataagaggaaatcaaatcaatggtacgctttctgacctttcaatattctctgccttgaaaacattggatctttcacgaaatcaattaaatggaaaaattccagagagtaccaaattgccatctctgttggagtctttgtcaattggatcaaactctttagaaggtggaattcccaaatcatttgggaatgcatgtgctttgcgctcattggacatgtctaataatagcttgagtgaagagtttccaatgataatccatcacttgtctggatgtgctagatattcattggaaaaattagatctaggcatgaatcaaatcaatggcacactaccagacctctcaatattctcatctttaaaaaaattatatcttgacggaaacaagttaaatggagagattcctaaagattataaatttccacctcaactggagcaactagatatgcaatcaaattccttaaagggtgtgctcactgactatcatttcgctaatatgtcaaagttaaactacttggagttatctgacaactctttagtgaccttggcatttagccaaaattgggtcccaccatttcagttgacgtaccataggattgcgatc

SEQ ID NO: 109128 - DNA, 384 bp, Glycine max
  Peptide Sequence Number=SeqID_225906
atgaagaagcttgacaaggatgtctctcttagtgtcatttccatgagaacttcagaattcagtggtgcagacctagcaaacctcatgaatcaacaaaattctggtggcttaacatggttcataccaggtgaagatccatctctcatctctaagaaccaactacttgctagaatagttggaggcttaagggaaagagcagaagaggaagtcatatttagtgaaactgagataaccactggagctgcagtggacttgcaacaaattacacaaatagcaagacagatggtaacaaagtttggtatgtcagagattggaccatgggctttgattgatcctacagtgcaaggtcatcatgtggtactaaggatgctggctaggaactaa

SEQ ID NO: 109129 - DNA, 267 bp, Glycine max
  Peptide Sequence Number=SeqID_225907
atgacattcgtagggaacaacagaagggacaataggcttacctcgatgaagaacgaaacaacgaaagctcgcggaagaacgggaatgcgcggaagaaggagagccacttgcagggaacgaagatgcacctcgcggaagaaagacgaaccagaagctggtggaagaagaagaaatgcctcgcggattgatgctcagctcgcgaaagaagggatgggaatgcgcagaagaagaaaaggctgggtgcacaaaaatgttttaaaaaactaa

SEQ ID NO: 109130 - DNA, 312 bp, Glycine max
  Peptide Sequence Number=SeqID_225908
atgaagaataagaaggttgcagcagctggtgtctcgctaagcgaggcatatgcgcttagcgagcaacatccgttaagcgagacatcaactcacttagcgagtaaggacaatctggaagagaatctgccacgcatgcacgcactcagcacgccatcagctcacccagaaaaaaagcccttaaaagctgaagttggcgagaaaaaagggaggcgggagtctttagcttttggaagaatagagatatatgtgagagacgcagcagggcaaaggagcaccaaaaacctcagctttcaagaggattctaggttttag

SEQ ID NO: 109131 - DNA, 357 bp, Glycine max
  Peptide Sequence Number=SeqID_225909
gtctccaagtgtggaacagcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaaggtagccaaatgcctcgtcatctaa

SEQ ID NO: 109132 - DNA, 459 bp, Glycine max
  Peptide Sequence Number=SeqID_225910
cggtacttcctgatactgtatttgaagcagttgtacgaattccttatgatatgcaagtgaaacaagttcttgctaatggtaaaaagggagctttgaatgtgggggctgttcttattttaccggaaggccctgttcctggtcaaaaatataaagaaataacctttcctattctttccccggatcccactactaagagagatgttcatttcttaaaatatcctatatacgtaggaggaaacaggggaaggggtcagatttatcttgacgggagcaagagtaataataatgtgtataatgctacagcagcggtgattgatattatacctccaggaccagaacttcttgtttcagaaggtgaatctatcaaacttgatcagccattaacaagtaatccaaatgtgggtggatttggtcagggggatgcggaaatagtacttcaagatccgttacgtgtccaag

SEQ ID NO: 109133 - DNA, 884 bp, Glycine max
  Peptide Sequence Number=SeqID_225911
atggcgcagttagcgcagtcctcgaccccgccggtaacggtgccggcaaccgagccgcgaccattgccacagaccggcgcccagacaatgcaaacacagacggcgcaggcgcctgccgcgcgcgtggcggagccggcgtcgggtgatatgccggaagtcgatctcagtgcattgcgctatttcgccgcgagaggcgatacgcaacgccttcaggccgaaatcgcgcgacttcgcacgctttatccaaactggacgccaccggctgatccgcttgctgttccggaaaatggcgatgcaaagctcgacgccatgtggcagctttataccgacggccgttatgccgaggtcaggaaggcgattgccgaccgccagcagacagagcctggctggcagccgccggacaacctgaccggcatgctgtctctggccgaggcgcgtcagcgcctcatcaacgcgtctgacctcaagcaatatgcgacggtggtggataccgccgccaataattccggtctgctgacctgcagcgaggtcgacgttctgtggcgggttgccgatgcctttgccaatacggacaggatggcacgggcgcgcgacgcctatctctacattctcaacaattgcactgtcgcaagtgacaggctcgccaccgtgcaaaaggcatccgcgctgctgccggcggaaatgatgggtgagcttctggccaaggaaaagcccggcgccgatggacagctggaattcgagccggtcaagaacgatctcgcgcgccagttcgtggcgaaggcaggagaaaaagaggggatcaccgtcccttctgcctatctgatgcggcttgaacggcttgccgaaacggaaaagctcgcaagcgacgcgctgctgctcggctg

SEQ ID NO: 109134 - DNA, 276 bp, Glycine max
  Peptide Sequence Number=SeqID_225912
atgtcaactagctacatcgatccttatttttctctaagggggaatgagttgaatgcgaagcagattaaggaatacaggcagaaggttgaattggagctatcgaacatctgtaatgatgttataagagtgattgatgagcaccttatccctttggctgcagctgggatgttgaaatgttttgcttgcaagaaaggagattattattgttatcttgccgaatttaagtcaggcaatgagaaaaaggaagctgctgatcagtctatgaaagcatatgag

SEQ ID NO: 109135 - DNA, 279 bp, Glycine max
  Peptide Sequence Number=SeqID_225913
atgggactcaccgaggaagagttctacgcgaagcaattcgagatcaacaacgacatcccggagcctctcatgaaaccgcagcccagctcctcccccgtctccttgtccgtacagagggtcttccttttttcccttttcgcctcatgctgctacacgattggccgcctcgtggcaagcatggaccaagaagagcttgcgttcattcgcaaggcgcataaggtgcaggcgaggagggtgatgctggaggaggtggagagctttggatattggattgggtaa

SEQ ID NO: 109136 - DNA, 147 bp, Glycine max
  Peptide Sequence Number=SeqID_225914
atggagggtgtgtgggacctgcgggtaatcccaggaaagagaaaaggaagagagagaagacctcaacatcaccatttgaacaaggctgttagtggaccaagaagccctggagttattggtgaacggggatcaagagaaagtgagtaa

SEQ ID NO: 109137 - DNA, 462 bp, Glycine max
  Peptide Sequence Number=SeqID_225915
atggagtgtcaatatgaaagccatcttggtgtagcaaggatgtgcagaagccttgaagggaaagacacacatgtctaccactttatcacaaaaggagaagaacgacatgatcaacaagtgaagaccgtcactgctatgtgggctaacctggaatctttgtatatgacaaagagtttggcaagcaagctttgtttaaagcaacaattgtattttttcaagatgacaaaatcaagatccataatagagcaacttgcagattttaacaagattcttgatgacttggaggaaaccttagaactaaaggaaggaggaggagtactcgttgggaacaacaaatcaagcagagtgcaaggcatgagtattgtcaaactaaaaatgtttgataactgggaaatgttgttgcaaaatgtaaggtttgttcctgggcttaaaagggaatcttttgtctataagcatttttga

SEQ ID NO: 109138 - DNA, 312 bp, Glycine max
  Peptide Sequence Number=SeqID_225916
atgttgcttaggccatatgctagaaatgaggttcgttacaaccgttacaaggttgtcgttgatgccgacgagggtctcagaacagagaggtcactagccttacttgactatgaccataccccttctctttcaaagctaagggcgttgtctccaactccgacgaggacgtgtcaacaacaacgactatgtcatcaagcacaagtgtttctttcaaagccgaagacaaaatcgtcggagttgaagacagactttgtaaatcttaagcggattgcttgggaactggacgtaggcttcgaagcgataacgtcttag

SEQ ID NO: 109139 - DNA, 219 bp, Glycine max
  Peptide Sequence Number=SeqID_225917
atggatgattgtgaagaagggcaagaaaggaggggttgtcagtttcaaaggaagccacttaatccaaatcaaagcacgatgcctatgattaggagggagaataaggataaggtagttatgaatgtgcgtaatacaattgaggggaggaatccacaaaaggaacgtggaaaggaggctatcgctgggaacaaaattgtaaagatcgaaaaaggtggttga

SEQ ID NO: 109140 - DNA, 351 bp, Glycine max
  Peptide Sequence Number=SeqID_225918
atgtcagaggaggatgaccatctgaaacgtagttctaagaaggtcaaaacaaaggacaatgacatagtcgtggatgggagtatggaggattcccatggtgtggagaatgaagggactattgaggagaaagtagacaagacaccaaaaggggatggaattaataatgtaaagtcatatatggagaaccttctgatgacagaaggggatagagtattcacttattatcagagtctcttgaagaagatggaagtattggaggagaaatatgcaaaatcgttggaagctagggtggaggatgaaggggagcttgacccatgcccaactatacctcgtgactcaggtggagtttga

SEQ ID NO: 109141 - DNA, 311 bp, Glycine max
  Peptide Sequence Number=SeqID_225919
cttttggtctccttcctcacccctcacctcacatcaccttcgttcttcttccttttagtctaggctggtctcaaaaaagcttaacccacggtcctcatcatccacagcgcatttgttcccgacattcctacatcgtcgttgtcttcttcgtcggcgtttcattttgcgaccacgccaccgtgggtgttgactatcccaaccaagttgacggtggtgttgctgcctccgcgcgtcggtattggcgaggtaagcatcgttgcgctgaggtcgtcggcgtcatttgcagcaatggaagttatggatcaagttga

SEQ ID NO: 109142 - DNA, 183 bp, Glycine max
  Peptide Sequence Number=SeqID_225920
atgagagggtgtcatggggaggagttttttaagtgcagcaaggcagaggtgtcatggggtggcataaggaatgacagggtgaaaaacaaaggatgggcaaatgggaacacaaaaggaaccaatagtgatgagcaattgcaacaaatttgtaactttgttcccaagggtgcaagaaatcaataa

SEQ ID NO: 109143 - DNA, 1155 bp, Glycine max
  Peptide Sequence Number=SeqID_225921
atggttaggactagaggattaggtcatgccttaggtcacgttactagcagagtgcacgatgagtcagtacttcctgcaccagatgtagaggctgacgtattttcggatgacccgatggcaccagctgatgtaaaggacactggggaagacattcctacagacacgggcgctcaggctactaacgatgagcatgagggattttcgggtggtccgggcgacccatccgtgctgacccagtatgcggatcacattgcttgcagcgagcgtcctgagttgaagttatcctctcacgggaggaaggtccatagtttaggcaggcctgtccttgccattgagggagtagttgctgggataggactaagtcctctgatcgcatgtgacgatcacgctagacaacgtctcatcacttctgcatttgcccgtgggttgagacagggtagtgtcatggaccgtacgtactcttgcaatgggtacgtcatatctacgagcgtcgatgccaggcaggcccttcgtgacctcagtcagaccgggaggtacgcctggggagtagctgcactggtgcatatatacgtccagctgaacgatgcctctatcagcagcagccgacaacttggcggttacatcacactgctgcagtgctggatatacaagcactttccctcaatcgtggagtccactgctgatcaggactacgacgaggattcaccgtgtgcctgtaggtggattgcaacaaagaagaccgtgaagagcatacgtacatcggcgtacagggagcgcctggaccgactctggattccgaatgggcccgttgctgtgtattaccgaccagagagggtcatgcggcagtttggatacacccagaccattcttgctctgcctgtcaattcatgggtgtcgtatgatgatatacacgacaggtggatgcactactcggatcatatggttccaacaggtgaggtgtgcgttatgccagtcgtccctcaggccccacagacagatatcccacacgtgccggagccaggagcaccgtcgacatctgcgagacccgctgtggaagagcctagacatgcagtgaagtttgccatgggattgctgagagaggttggagcgtcatctgagcctaagggtggtcacgccaggctcatcgacacatga

SEQ ID NO: 109144 - DNA, 138 bp, Glycine max
  Peptide Sequence Number=SeqID_225922
atgggctgggattttcatcgaacacttaaggatagctactttggaaatcagacattaattagacctcgccaacctcttctaaaacatcatattcttcctcttcaacaacctcagcctctccgacttcctcaaatatga

SEQ ID NO: 109145 - DNA, 626 bp, Glycine max
  Peptide Sequence Number=SeqID_225923
atgaatataaaccaggcttttgttgaaggtcaaagcctgacttattctgaatttgttactaagtttgtgtataaccagaaacagagatgttggcaacttatgaaaaagggttatactattgtcagacttcaatgggttcccccaactacaggggaattattttatttgaggatgatgctgactatctctagaggaccaatctcatttgaagatatcagaacagttgatggtgttgaatatcctacatatagagaaacatgttttgctatgggttttttacaggatgatagagaattcattgctgcaatcaaggaagcaaaagactggagctcagcaccttatctaaggaatctttttgtattattacttttgacaggtaccatgaacaaacctgaacaagtgtgggaaaaaacttggcattggttaagtgatgatattctatatagtcattgcagatcatcaagcactccaggattacatattgatgactccaatatgatgaatctggtattgcttgaagttgaacagctgctacaagccaatcaaagatcacttaaagactatccttccatgccatatcctgagaacgcaaatttactaacacatgcagacaatggcctcatttt

SEQ ID NO: 109146 - DNA, 174 bp, Glycine max
  Peptide Sequence Number=SeqID_225924
atgacatcgccaatgaccacaaccatgcatgcctcgaaactgccacacataggaagagtgacagtggatactgccacgaaacctggtggtctcatccagatttgctctaaaaaggttcttgtggaagaacaaatctacacggtggatacctggggtaagatcttggaagaatga

SEQ ID NO: 109147 - DNA, 213 bp, Glycine max
  Peptide Sequence Number=SeqID_225925
atgactaccatgatcacgagcaataccaccaaagccaaagatttcagtgttgccatgacaactatcgttcgtgttgattttgaccacatgcataagaggcggaacctaacgaatgtcaaaggattcaaaaagcacacgaaggagagtttcttgggctcctccgcacctgttacaagagtcatcaaaggacaagtgtctaatttgacgaaaaag

SEQ ID NO: 109148 - DNA, 360 bp, Glycine max
  misc_feature (354)..(354): n is a, c, g, or t
  Peptide Sequence Number=SeqID_225926
atgccgcacgcgaggctcctgctcacctgccttatcaatggcatcgttccaacattgtcattgtcgtttcgtgaccatgagagccgccatcgtgctgttccacgttctctgctcccagttcaagagcttcggttctcgttgcactttctcattggcccttctttgtcacaccttctaccccacacatatattaagatcatagggagaccagccagggtcacgatgttttgcgagaatgcttcaaccatatgggatcagcataggcttaaaggagcactcaaacccggtgacccccaaggcctacacttcggaagagtcccgtcagggcctctccctcctgattcacgtcccaanccctaa

SEQ ID NO: 109149 - DNA, 660 bp, Glycine max
  Peptide Sequence Number=SeqID_225927
atgggggaagagagcactaatgcaaagagaattttagaagaccatgcttcatttatgggatcattccaatccaacactattatgaaacctaaattggaatatgtgaggaattttgaaatcaaaccagctcccaaacatttgattcaagctaatcaatttaatggtcgtgtacatgagagcctatatgatcatctctccaccttcaatgatatttgcaataccatgaagattaataatgtgtcggatgatgccttgaagtggtgtttgtttcccttctctttgactagtgacactatttctcagctgagatcctttcctccaaacagtttgtcatcatgggaagatgtggcagccatgttccttcacagatatttccctaagtctaaaactttcaagggcaagccaactatatcttcattccaacaacaacatgatgaggctttaattgaagcttgggagtggtatcaatctttactccaaaaaatgcaaacccatggttttgatagggttctccaaattaatatattcttaggaggtttgcaagctcaaagtaagctcatgttggatgctgctactaagggaaatattgttttgaaaactccagaaaagataagtgaaatcattgaaaatattgcatacaatgattatgagtttcaataa

SEQ ID NO: 109150 - DNA, 445 bp, Glycine max
  Peptide Sequence Number=SeqID_225928
atgggtgatgagatccctttcaatgtttttgatgttatgactcgtccaaatgatgatttgaattgctttggagtggacatggtaaatgaggcaattgacaacaagtgtaatcaaatgcaatcttctaatcctcttcaatgtgctttaatcaattcttgtgacaacatagatgaggaagatgtagaagaagtacatgatatcttgttgcaattagacaattcaaaggaaattccacctaataaggaggtgtttgaggaattaaaggtggaaagtgaaaaggaagagaaagccaaactaatctcatcctcaattgggaaaaatgccacttcatggttcaagtcagtaatccttggccataagatatcttcaagaggaattgaggttgatcctgccaaggtagaggtaattgcaaaacacccatcaccagttggtgttggtgaaaggg

SEQ ID NO: 109151 - DNA, 1233 bp, Glycine max
  Peptide Sequence Number=SeqID_225929
atgcaaaaacctttaaagaacaaacaaggtggctctagttaccatattgaagagactagaagagggaaacgagtgtattgcaccttaaaaactattattcaatcttcgtttgctggtcctcatccttgggctattgagaactttgctttggtagcaaaatatccatctggtcaagttattgcacaggatctgttttcttctggggccataaaatctgcaactgatttccaagtgtacaaagaggttgctggcctttctgggcttgactttgcatatttggataacacggctgtctatcataccaagaatgacaaattagagcttttgaagactggatctcttcaacatctgggggaaaatatgcttgctttcctgcttcatattggggcatcttctcatattccagaaggcaattcaactgaatcagaggaagatataagcaagaacaatgccatttactttgacattttgggaatgtatatggttgtataccgtcaaaagtttgctaatatgctgcacaattcagtaataatgcagtcacttctaatatgggttacatcattggttatgggtggtataccagctgcagcttcattggccttgtcgtgtttgagtgttctcctcatcccaatgttggtggttggattatttggtgcaccagcttttctcggagcattgactggtcaacattttggttttcttctacttcaaaaatatctttcgaatacactatcaaagggaaggcagttgacccccattattaaagcagctgttgtcaaaatggaggctgaaagatggctctataaagctggatcctttcaatggcttatacttctcattttgggaaactattttaaaattggctcttcttacttggctcttgtttgcaacactaaccccagccaggctaccaaagccactcaaactggcaaccataattctggggttagccactccgattttattttctgcaggcatatttattcggctggctgctacacttatagggggaatcctggtggtactcctgaatggctaggaaattttgtgattgctgcttttattgcttctcttttatccttgaccttggtgtaccttctttcatatgtccatctttcaggtgcaaaaagggcaatcatcctagctactttggtgctatttagtttatcacttgcagttgtattaacaggtgttgttccaccattttccgaagacactgctagagctgtgaat

SEQ ID NO: 109152 - DNA, 814 bp, Glycine max
  Peptide Sequence Number=SeqID_225930
atggattactgcatcccaatgtccttcatgtggagaattaaggaattcgtttacttcattcactgcaaagtagatgcctggacgatgactccctaccctgacagaagtatggcattaggatccataggagtatcagaaggtttagcacccatcaatcctgtatcctttgatgttcgttacatactttctttgggaaattacaaagcattcttggattgtgccacccctatccccaagaagtatccccaagggaatggaaaacttgatcaaggacagaatccaatatcatatgtatctttattttctaatactcctggaaatttgaacaaggaggttaaacagattgatgaaggttttgtatgtggtagagacaaaacagttgattttgtgactttctcggttaaatatggttgttggacctataatgacaccactaatgactggactgagatggatattcctacaatgaatgttgttagtgatgctaaaggaaatggaagaattacacaagtttcaatcaatacaaagggttctatccgttgggttcttgcaatcaatatagaagaaatagaagatttcgagtttaaagatgcaaggaattctgaagaattgatttcagttgacaaaaagagtagtgtggatggttggcacattattcagttttctggaggaaaaaatgcaccaacattgtttgatctgactctttactggaggtcaggttcaactcataactctgatagtcctcttctgaaactaaggactgatgtgaacagattaacaccaataaccgaacgagtccttgagaagcttcctc

SEQ ID NO: 109153 - DNA, 609 bp, Glycine max
  Peptide Sequence Number=SeqID_225931
ggtactagtaccctcacccttagagggctacacgccctcgccatcagaggactacacgtcctcgccttcaagggactacacgtcctcgccttcagagggctacacgccctcacctttagaggactacacgtcctcaccttagaggactacacagggcagcttgccctcaccttcagaggattacgcgtcctcgccatcagaggactacacgtcctcaccttcagagggctacacgtcctcaccttcagaggactacatgtcctcgccttaagagggttgcacaccctcgccttcagagggctacacgccctcgccttcagaggactggacgtcctcaccttcagagggctacacgccctcaccttcaaaagactatacgtcatccccttgagagcgctacacgcccttaacttcagaggactatacgtcctccccttgagaggactacacgtcgtccccttgagaggactacacgacctcgccttcggagggctacatgcccttaccttcagaggactacacgtcctccctttcagagggctacacgcccttgcctttagaggactacaagtcctcgccttcaaagggctgcacgcccttgccatctga

SEQ ID NO: 109154 - DNA, 1069 bp, Glycine max
  Peptide Sequence Number=SeqID_225932
atgggggcggcactgctgtttaatattatcggctggagtgatgttcagaaaaataaaggtggctggaataccctgatgtggtacggaggcatcattggtctgagcgccaccctgagcaaagagggctttttccgctggctggctgatttcctgtcagcgcatctggatttcctcagcgccggtaatatgaccatcgtgattatcgtgtttctcagcgtactggttcgctatttctttgcctccggcggggcctacgtggcggccatggtgccggtcttcgccaccgtgggtctggtcaccggcacggcgcccgtactgctggcgcttgccattctgttttccaactcgtatggtggctgtatcacccactatggtggcgcggcagggccaattatcttcgccttcggctataacgacattaagtcatggtggacaatcggcacaatcgtggcgctgggcaccacggtatgctgcagtattaatcgcccggtggcggctacgccttaccgggcctacagtccacgcggcggcattactcgaaggcatgttgatatggaaatcgtattacgaaataaattcagttcattgggaatgtttctggggggaattgcactcattctctcaatcgtgcagttttcattcggaccgttttctccaaagccgccagcgattgaggttattgttgctgagaaagtgtcggctgtaaaacaaggggtaattgcggggctaaagggagagcgtcctgctgcccgaaccgaaaaaacgaaggttgatattgacagcattcttcttaacgccgggattattctcgctgttgtggcactgggactttcgttcatcggaggaatgtgtaaggagagccgttggggtatctctggggcactgctattctcagggctaacgcttacctttcatgctgtgctgcttgcgtttgggctgatcgtcgcggtgttgttgctcccggtggcggttatgccttaccgggcctggaggaaccggaacgtaggtcgggtaaggcgtagccgccactcgacaaaatcatcggcgatcagcggcaacacgcgcccag

SEQ ID NO: 109155 - DNA, 279 bp, Glycine max
  Peptide Sequence Number=SeqID_225933
atgaggaagtttggagatgacaagtcttggattcaagtaataaattttagtgatgtacatcgtaatattcgtccttatgaagagaaatcgatgattttaccattgtgcatgtctaacaacagagacttcttcatgctgaaattcactagaaatgctgatgatgaataccagacaattctgtataaccagagggatggtagtttcagaactttgttgtggtgcaacttcaagatttttaccaaaactttggtcatctcgaacgctttgtcagatgtttga

SEQ ID NO: 109156 - DNA, 477 bp, Glycine max
  Peptide Sequence Number=SeqID_225934
atggagaaccaaaattctgttgaagaaactatatcttgtggtcataatgctgatattgtccaagccttgaaggatgaacttgattggaatgaagcattgataaaacgttatgttggaagagaggctctatggcttcatcgtcgctttctttccatgtgttggataaataattttctacttgattctggtgatgcatcctaccattccaaggaggcaatcagcatgcatcatgactttggcacctttctgcggaatgaattatgtcttctccactcctcaacttttgttgatgatgattttgtggatgtccaagcacaagctgtatattctgctagttacatactgtggttaaaagtgcaagttcctaagtctctggagaataagctccttcagaagataaaagatgttgatctgaagatcttgctggataaatcatgcccagagagatcctcactgtttaattactttatgaactag

SEQ ID NO: 109157 - DNA, 234 bp, Glycine max
  Peptide Sequence Number=SeqID_225935
atggcgaatcctctagttttagttttatttgcaagtataacgggcagtataggctccggtgaggaacctcctgatgacaatggtgttagtgtacaacctcaacagaagatgtcttttagggataagactatggtgaacaaggagaaaccgtctcctaggcaacgagttgatcttctgcgacagaatctagaaaaaataaaaattgaatatgaggatgaaaccccctcaaattga

SEQ ID NO: 109158 - DNA, 2472 bp, Glycine max
  Peptide Sequence Number=SeqID_225936
gtacttcgcgatggaaaatggagtgaagaagacgcttcagtgttggttccaggagacataattagcatcaagcttggtgacatcattcctgctgatgcacgcctccttgaaggtgatcctttgaagattgatcagtctgctcttactggagagtcacttcctgtctccaaacatcctggagatggagtatattccggttcaacttgcaagcaaggagaaattgaggcagtagttattgcaactggagttcacaccttttttggaaaggcagctcatcttgtggaaaacacaacccatgttggacattttcaaaaggttctaacatctattgggaatttctgcatctgttcaattgctgttggtatgatttttgaaatcattgtgatatatggaatccataaaaagaaataccgaaatggtgttgataacctgcttgtgctattaattggtggcatccctattgcaatgccaactgtcctttctgttacaatggctattggttcacacaagttggctcaacagggtgccataacaaagagaatgactgccattgaagagatggctggaatggatgtgttatgtagtgacaaaacaggcacattaactcttaacaagctttcagtggacaagaatatcattgaggtttttgctaaaggggttgataatgatatggttgtacttatggctgcaagagcatcaaggctagagaaccaagacgcaattgattgtgctatagtttcaatgttggcagacccaaaggaggcacgagctggaataaaagaagttcacttccttccattcaatccaactgataaaagaactgcacttacataccttgatgctgctggtaaaatgcacagggttagcaaaggtgcaccagagcagattctcaatcttgcacataacaaatcagaaatccaacagagggttcatgcaattattgacaagtttgcagaacgtggacttcgttctcttgcagttgcccgccaggaagtacctgagggaactaaagacagtccaggaggaccatgggagtttgttggccttctccctctttttgatcctcctcgccatgatagtgcagaaacaattagaagagctcttgatcttggcgtgagtgtaaaaatgatcactggtgatcaacttgcaataggtaaggaaacaggaaggcgtctagggatgggaactaacatgtatccttcttcatcactgcttggtgaaaataaagatggattgggtgctgtcacagttgatgatctcattgagaatgctgatggttttgctggagtttttcccgagcacaagtatgagattgtgaagaggttacaagctagaaagcacatttgtgggatgactggtgatggggtgaatgatgcccctgccctaaagatagcagacataggtattgctgtagcagatgctacagatgctgccagaagtgcttctgacatagtcctaacagaacctgggttgagtgtgatcataagtgcagttttaactagccgtgctattttccagagaatgaaaaattacacaatatatgctatatctatcactattcgtattgtgcttggtttcatgttactgaacagcttttggaaatttgactttcctccctttatggttcttgtcattgccattctcaatgatggtaccatcatgacaatatctaaagatagagttaagccttctccacttcctgatagttggaagcttagtgaaatttttacaactgggattgttcttggcagctatctagctctaatgactgtgatcttcttctatatagttgttgaaacaaacttctttcctgaccattttggtgtgaaacacttttcctataatccagatgctgatataaaagatccaaccaaaagaatgttgggatctgctgtctatcttcaagtcagtacaattagtcaagccttaattttcgtgacacgctcaaggggttggtcctacacagaaagacctggtcttttgcttgtcactgccttcatcattgctcaagcgattgcaactgttgtatctgccactgtcacctggcaacttgctgggatcaaaagtattggttggggctggacaggagtcatttggttatacaatactataacttatctatttctagatcctttaaagtttgctgttcgttacgcattaagtggaagggcttggaatacagtgataaaccaaaggactgcattcatcaacaaaaatgactttggtaaagaagctcgtgaggctgcatgggcaaccgagcagagaaccttacatggcctccaatctgctgagtcaaaagggtttacagacaagcacaccttcagagaaattaatacattggcagaagaggctaggaggcgtgcagagatagcaaggttgagagagcttcacactctgaaaggtagagtggaatcatttgccaagctaaggggtctggacattgatgccatgaacggacactacactgtttaa

SEQ ID NO: 109159 - DNA, 324 bp, Glycine max
  Peptide Sequence Number=SeqID_225937
atggaggctatgaatgaggaaatagaatcccttcagaaaaatcacacttgggatttggttgagttacttgaaggcaaaagatttgttggatgccaatggatcttcaagaagaaatttgatctttcaagcactgaaatcatcaagtataaagcacgtcttgtagctaaaggctatagtcaaaaggaaggttttgaggtgaaaggaaaagaagattcaatcagtaggttgaaaaagtctctctatcgactgaagcaatctccaagacatcggtacaagagattcgatcagttcatcatctttcatcggtacaagagatttgattag

SEQ ID NO: 109160 - DNA, 267 bp, Glycine max
  Peptide Sequence Number=SeqID_225938
atgacacgtgtgcagatagaagttgttcatagagtgggtggttggctattccgccttgcttgcgtgagtggaaatgcaagaagcagggctgggaatggggatgaagcaacagcggaaaaaaatatgggtggagaggagtgcacaacggtgaatgtgcacgatgacacggtgatggtggagaggagttgcgcttgtagagcctcaaaggtggagattatgcacgggtggagattgcgtgcaagcaggggctctgcgtggcagggatga

SEQ ID NO: 109161 - DNA, 273 bp, Glycine max
  Peptide Sequence Number=SeqID_225939
atgggagaggggtccgtggaacttgaggctattgtaaaggaagctgttgatctggagaacattcctcttgaggaagtttttgataatctcaaatgcacaagagaaggtttaagctctgagcaagtacaacagaggcttgacttgtttggatacaataagcttgaagaaaaaaaggaaagtaagatactgaagtttttgggctttatgtggaatcctctgtcatgggttatggaagctgccgctctcatggccataggcatggcacatggaggg

SEQ ID NO: 109162 - DNA, 687 bp, Glycine max
  Peptide Sequence Number=SeqID_225940
atggacttggtgatcatccctgcaggtgttcctcataaacatgggctgacaaaagatgatctcttcaatataaatgttggaattgttaaaacattgtgtgaagcaattgccaagtgttgtcctaaagccattgtcaacgtgctaagcaatccagttaactccacggtcctgattacagccgaagttttcaaaagagttggtacttacgatcccaagagacttttgggagtcactatgctcgatgttgttagagccaatatgtttgtggcagaagttctgggtgttgatctaaggtatgtggatgtcccaatcattgggggacatgttggaatcacaattttacctcttctttctcagattaaacctccttgctctttcaccctaaaaagaaaatgcttgggctgcaatattgaagcaatcacacttgaagccactgctaaaacaatgctaccattagagcgtatggcagatgataaagttttccagacaaagcatatcctattgggtatgacattgaagggaaatttccgtgcgagttggcagcatatcctattgagtaagatcccgtccatgatgattgttgattttcaaggtggaaataaagacattcaactgctggtgcacgtccatgcattgggaatgcaaaaatcttccgacatgcctcagggggcgacacgtacctggtga

SEQ ID NO: 109163 - DNA, 135 bp, Glycine max
  Peptide Sequence Number=SeqID_225941
atggtagaacataaaaaaatgtacaagctcttcggctgtacggcccaaagcgacgagaccggcgacgttggtggagatctggccgccatgggagatctagacggtgccggagacaacgacagtgacggtggttga

SEQ ID NO: 109164 - DNA, 468 bp, Glycine max
  Peptide Sequence Number=SeqID_225942
atgaacaatttcaacaccactcttgagtccgatgattttgctcttctagaatccattcaacgttacctcctcgacgacaacgaagacttcaactctctaacggaggttttggcaacacctaataataacgtcaatgccgttaactctccattatcttcgttggggcatgcaacaacggctgctacagaggggcgtggggcttcgtctgcagaggcgcgtggtggccacgtgcgtaaccaaaattacaaaggagtgagacgcaggccttggggcaagtttgcggctgagataagggacccaaataggaacggcgcgagagtgtggcttgggacttacaattcggctgaggatgcagctttggcttacgatcgagccgcttttgaaatgcgtggctcgaaagctaagctcaattttcctcatttaattgggtgcagtgatgctgagccaagccgaagaagtaatggctaa

SEQ ID NO: 109165 - DNA, 831 bp, Glycine max
  Peptide Sequence Number=SeqID_225943
acttgaccatctaccaagcaattcggggtgatgaatttgacatagatccgcgagatgaaacctccgacagaggcccaaaacccatcaaagagcttgttaagctacaactcggacctaaactcgggcagtgcacacggctcagtagggacctcaccaaccatgagcaccgtcgcattgccgaccttctacaaagaaatgcagatgccaaaccaatatcacaaaagaaaatgaagatgagaaaggaacggcgtaaagcggtcagagaagaagtcgacaaattctttaatgcaaacttcagtagagaagtcaggtttttttcctggctcgccaatgtcgtcatggtccaaaaggccaatgaaaaatggcgaatgtgcatcgattacattgatttgaatagggcatgccccaaagatgcatactctctgcctagcaacgacaggctagtcgatggagtgtccgggttccaagtgctaagcttcctgggtgcttactctgaatataaccagatcaggatgcatcctccaaataaggagaaaacaacatttatcactgaagatgtcaacttttgctatagggtcatgccttttggcctcaagaacgcatgcgctacataccaacgattgatggaccatgacctagaagaagtcattggggaactccgcaaatatgacatgtgcctcaaccctgaaaaatgtactttcggggtaggcagaggcaagttcttcagctttatgataacttactggggaattgaagctaaccctgaaaaatgcactgccataatagagatgcgtagcccaactaacatccaagaagtccaaaagttgaaca

SEQ ID NO: 109166 - DNA, 1002 bp, Glycine max
  Peptide Sequence Number=SeqID_225944
atggatcacatgacgtcattcaacgcggttaaaaatcaaagtttcagaaatattattaagtctgagatttcccttgataatttcctccgatgtcttttttggtctctcttttctcctttttcccaagctaaaaatatgcaatctactcttctagctgacacctcttgtggccatctttcaagtcatctgcctttcaacaggaatggattcaaatttttcacaaatgctggtgggtttgggaaggccgacattaaagatatcttagagcgagctgcagacatatacaatcaatttacagaagaaagtttgccaaattcagagagaaaagcttcactatctattaagaaagttgattacatgattgtttatacatctgatttagtaaaagcagttcgcaaggcagctggaaacataggcatgactttgttgaagtacttttataataagaaaccattggagggtttccatatagttgttgatgcaggcaatggagcaggaggcttttttgcagcaaaggttctggaacctctgggggcaataacttctgggagtcaatttttggagcctgatggcttgtttccaaatcatatcccaaatcctgaggacaaaacagcaatgaaagctataacccaagcagtccttgataacaaagctgatcttggaattatctttgatactgatgtggacagatctgctgctgtggatttcactggccgtgaattcaacaggaatcgtttaattgccttaatggcagctattgttcttgaggaacatcctggaacaactattgtcacagacagtgtgacttctgatgggcttaccacgtttattgagaagaaacttggtggaagacaccatcggttcaaaagaggttacaaaaatgtgattgatgaagctattcgtttgaattctattggcgaggagtcacatttggcaattgaaactagtggacatggagctctcaaggaaaatcattggcttgatgatggtgcatacctaatg

SEQ ID NO: 109167 - DNA, 306 bp, Glycine max
  Peptide Sequence Number=SeqID_225945
atgagtcctacggcgaagtcaaaggcatcaccggaagcagagccttggacagtgccaccagaatggagactcggctcaaagccctgcatgaagttgctagcagaggtcggcgcgaatctgaaccattgcgatcgaagtggtagcctcgaggtgctgcacatggtgacaagatacgtgaggctcaaggtagcgaaggttcttctagatcccagtgcagatcccgaggtggcggacaaccgtgggagaacgacattagatctagcgagggagattctagaggtgacgccaaaggggaatccgatgtag

SEQ ID NO: 109168 - DNA, 303 bp, Glycine max
  Peptide Sequence Number=SeqID_225946
atgactgtatacagtagagtattttacagaaagcttctagctacacaaatcccatcttcctttttattaagatggctagcatttattcggtcctacatcctgtacactgactttgacattcgtggtgtggctgttgatggtgttgagggagagctagttaacctcactgaacctgttgctgaagcaataggagctgcttttgctgcatggttaatggagaaaaagaaagctgatgcttctcagcatttgagagtttctattggccatgattcccgaatatcagccaaattattacaggtttag

SEQ ID NO: 109169 - DNA, 126 bp, Glycine max
  Peptide Sequence Number=SeqID_225947
gaatatgaatctgatgttgtagtgacatgggagaaccgttgtggagacctttacttcaccattgtgtttttcagtgctaggaggttggctatgatcctaaggtggactcacatccttcatcgctag

SEQ ID NO: 109170 - DNA, 1266 bp, Glycine max
  Peptide Sequence Number=SeqID_225948
gatggagcatttcgtgaccagaagaggcttgttgctggggactctattgtgtttctgagggcagaaaatggggatctatgtgttgggataaggagggccaagaaggggattggtggagggactgagttctcttctggatggaataaccctctctttggtggtggtggtggcttcttgtgtgggagtgagagtagttttgtgagtggtgcaaaaagtggtggtgatcatgagatagtgggaagagtggctcctgaatctgttgttgaggctgtgacttgtgctgttaatggaagaccctttgaggttgtgtactatccgagggctagttcaccggagttttgtgttaaggcttctgttgtgaaggctgcaatgcaaattcagtggtgttctggaatgagattcaaaatgccctttgagactgaggattcttctaggatcagctggttcatgggaaccatttcttctgttcaggttgcagatcccatccgttggcctgattctccttggcgtcttctgcaggtggtgtgggatgagccagatttacttcaaaatgtcaagtgtgtgaacccttggctggttgaactagtctcaaacatgcctacattcaatctctctgcatactcacctcctagaaagaaacaacgttttcttcaggatccttattttcaagtcatcaaccaactcccaatgccatcattctctagcaaccttctcaattacaccaactctctttgcaccattcaagatagtaatagttctggaggcatacagggagccaggcatgctcaatttggactatctccatctgattttcccttcaacaagctcccagcagacatgcttctaggtggtttctcaaggcttgaccatgcagcagcacagcctattaggccaccttgtggaacctataagaacaacaccactactaaggccaatgttggcatttcttgcttgttgacagtgggaaatcctggccagaatttcaaggaatccaatgaaacaaaagcacctcacatcttgttatttggaaaactcattcagactgagcaaaagagttcaaacactagctctgccaatactaatggtaatagtgtatctgaggggaattcacacaagacatctaatgcttccgatggcgtaggttctggtttgcatcaaggtagtccaattgagaacaattctgatggagggtctccctggtacaaggaccaacacaagtctgatcttggaactgacaatgttaacacattgtgtattgctttataa

SEQ ID NO: 109171 - DNA, 402 bp, Glycine max
  Peptide Sequence Number=SeqID_225949
atgtatttactgtgctgcacaggaataggattctatctaggaataggaatagtgagagaagagaaggttacagaaaaacaaaaacctgtctctgtttctccgtcgtggcaattgaaggaagcactgtctgtctctgcaactttagtcacattcacatggcagcaacaacatcagggaagattatccaaaatgtttttgtttcacactgccaccaacagaatacacggggtcgaagggactattattgttttggcccttctccgctggggaagttggcatggactgactcttccatgcaattgcgcactttattcaaaccccagaatcattttagtttccagagaaattttcacagcaatggtctgttctagactctcatttatacaggttgatatgaagtga

SEQ ID NO: 109172 - DNA, 207 bp, Glycine max
  Peptide Sequence Number=SeqID_225950
atggttttgtacaaaagagctatgagtaggagacaaagccttggagagaatatcaacatattgatcaagggcaggaacatagaccactttcagcaacttgctaaggaccaattgacaaaaaacagatcaagctacagtaacaacgaagactttggcaaagaagttgtcggagaagttaagaggaagatagaggttcttctattttga

SEQ ID NO: 109173 - DNA, 3401 bp, Glycine max
  Peptide Sequence Number=SeqID_225951
tatctacatttctgtcactgctgggaaatgtctcgaggatcaacaattgctgctgtttcaactgaagagcaacctcacattcaaccctgaaaattccagcaaactcaggttgtggaatcaaagcgttgagtgctgtgattggagcggtgtaagctgtgatgatgagggacgtgtcattggccttgacctgggtggagaattcatcagtggtggatttgatgattcaagtgttattttcagtcttcaacatctccaggaattgaatttggcttctaataatttcaattctgtcatcccatctggatttaacaagttggacaagttgacttatctgaatttgtcatatgcgggctttgtggggcagattccaatagagatttctcagctgacaaggttggttactcttgatatttcttgtctttcctacttaactgggcaagagctgaaactagagaacccaaatcttcaaaagcttgtccaaaatctcaccagtattaggcaactgtatctggatggagtaagtataaaagttccaggacatgaatggtgcagtgccttcttgttgctgcgtgacctgcaagaacttagcatgtcacattgcaatctctcgggacctttggatccttccctggcaactcttaagaatttatcagtcattgttcttgatcaaaacaatttatcatcccccgtgccagacacattttcccatttgaaaaatctgaccatcttaagtcttgtttattgtgggttgcatggaacatttccacaggggatattaagcattggatcattgtcagtcattgacatatcgttcaactataatctccaaggtgtctttccagacttcccacggaatggatctcttcagattttaagagtaagtaacacaagcttctctggagcatttccaaactctattggtaacatgaggaacttatttgaattggatttttcctattgtcaatttaatggaacacttcccaattcactgtcaaacctcacagaactcagttacctggacttgtcatttaacaacttcacaggtcaaatgccatcacttggtagggcaaaaaatctcacgcacttagacctttctcataatggtttgagtggtgcaattccatcatctcactttgaaggactggataatcttgtcagcattggcttgggttataactcaatcaatgggagcattccttcatctctttttacactcacacggctgcaaaggattctgctttcctacaatcagtttggtcaactagatgaagtcacaaatgtgtcttcttctaaattaaacaccctcgatttaagtagcaatcgtctttcagggtcatttccaacatttatattacagcttgaagcactctctatcctccaactttcttcaaacaagttcaatggatcaatgcatctagataacattttggttctcagaaatttaactacactagacctttcatacaacaacttatcagtcaaagtgaatgttacaaatgttggctcatcttcctttcccagcattagcaatctaaaattggcatcctgcaacttgaaaactttccctggtttcttgagaaatcagtccagattaaccactctagatctctcagataaccatatccaagggacagtgcccaactggatttggaaactacagactcttgaaagccttaatatttctcataatttgttgactcatttggaaggacctttccagaatctttcttcccatttgttgtaccttgaccttcatcagaataaacttcaggggccaatacctgtttttcctagaaatatgttgtatttggatctttcaagcaacaagtttagctctattatcccacgtgactttggtaattacatgtctttcacattttttctctctctctcaaacaatactttgagtggcagcatccctgattccctctgcaatgccttatatcttgaagtgcttgatctttccaataataacttttctggaacaattccctcatgtttaatgacagtgagtgagaaccttggggtgttaaatctgagaaagaacaatctcacaggtcttatcccagataagttttcagcttcctgtgctctaaggactctggatctccatcacaataaattagatggaaagattccaaaatctctttctaattgcacaacattagaagtgttagactttgggaaaaacgagattaaggatgtctttccatgcttgttgaagaacataaccacactccgggtcttagtcttgcgacaaaataagttttatggtcaaattggatgtccaaagaccaacggcacttggcacaggcttcaaatagtggatctagccattaacaatttcaatggcaagctacctgcaaactgcttcacaaggtgggaagcaatgatgtctgatgaaaacctagctgaatccaaggcacatcacatccaatatcagtttcttcaatttggtagtcaaatatattatcaggattcagtgacagttactatcaaaggtaatcggatggatctggttaagattctaactgtcttcacttcaattgacttctcatccaaccattttgaaggggaaataccaaaagagctatttgactttaaggcactctatatacttaacttgtcaaataatgctttttctggacaaattccaccatcgataggaaatctgatggagcttgagtccttagacctatcaaacaactcactagaaggaaacattcccacagaacttgcaactgtatcctttttatcattcctgaacctctccttaaatcatctgtttgggaaaatccccactggtacccaaattcaatcatttcaagaaacttctttcattggtaacaaaggattgtgtggccctccgttgactgcaaactgcacttccaacaccagtcctgcaactacagaatcagtcgtggaatatgattggaagtacatagtcactggagttggttttggggttggatctggagtagctgttgctacgttgatgatctgggagagaggaaggaaatggagcaatgataccattgacaaatgtcttatgcaagtttttcctttgttcgggttagcttatacccccattgaggatgatgatgcagaagcgaacaacgatgattctagtgaagaagaagaagaagaagaagaagattatttggattatccaagcttcagaggaagttggattaaaaagaaacaaggctcgcgagtcattcgggtccctctcacccttatcattgtcgtcatctccaccactatcgctcttatcattactattgttgtcatcatcgtcttagcaattacaattatcattgttgtcgacatcactctcatcatcaatggcatagtctatgccaccacctccactattatattgttgtccccaccaccaatat

SEQ ID NO: 109174 - DNA, 318 bp, Glycine max
  Peptide Sequence Number=SeqID_225952
atgttttctgcgccgtcttcgatctccgacaatggcgacccaaatgagcaagaagagaaagctgatggagtgttctttgttgaactgaacgaggttctaacaagagagttggccaaggacggttactccggtgtggaagttagggttacgccgatgcgcaccaaaatcataattaaagccaccaaaacccaagttgttctcgcttcgtgtgagaagggaaggagaataagggaacttacctctgtgtttcagaagactgcatcaatggttgtggtagcaggaacaggggaaggagtattcatcgtgcgagagacgtaa

SEQ ID NO: 109175 - DNA, 144 bp, Glycine max
  Peptide Sequence Number=SeqID_225953
atgtcgtttatctcaacaactttgaattccaataaaggctattcaagaatggtcaatgagggtggagaatcaagctgggatgaagatttgagtttggaacaacttgaaaaggaacagcagtcaattcctgtacgtaaatgctag

SEQ ID NO: 109176 - DNA, 246 bp, Glycine max
  Peptide Sequence Number=SeqID_225954
atggaggcgtttggtttgcttgcaggaaacagcaaggagaagacgaagaagaaccatttttcgtatttgctgaggcttgttgggccgcgtccaatcgcgcgtgtccacttggtgggctgcgtccaatcgcgcatgtcctactgtccaaccgtgtccggtgacgacagaagcaacggacactgcgtcgcaccggagtcgtacccgcatgcgtgtccggtgcgagtccgacgcgggacacgccgatga

SEQ ID NO: 109177 - DNA, 153 bp, Glycine max
  Peptide Sequence Number=SeqID_225955
atgtggcaggcaaggtatttggttgggggtggtatgggaaatgggagtagtagtagatttgttacattatatgttagtagtgtggggtggaagtccgtgaatggaggtgagaagatggagacagagggtatgtggggcccgcggtttatctga

SEQ ID NO: 109178 - DNA, 2013 bp, Glycine max
  Peptide Sequence Number=SeqID_225956
atggagttccaagtgggaaattcaattggattctcaagggaactaacaaggtcactaaccaaaaaggacccaacacaacaggggcatatgacaagagacaagtcaaagttcatgtctctaaaagctaaggaagaaggatttctaacatatggtgacaacaacaaaggaaggattctcggtgtagaaagtcctaaagaatcctctcctacaagcaaaaaggcagtgaacaataacccttttgaaggatactcactacaacacaactgtcttcctaaggagtggaaagaacctaaggatctttctattgaaaacatcataggttataaccaacaagagggtatagactttggtgaaacctatgctctggtagctagattagaagatatgagattattacttgcatttgcttgtattatggactttaaattgtaccagatggatgtgaagaatgcttttctacacatatacattaaagaggaagtctatgtttctcaacctcctggttttgaggatcataaaaatcctactcatgtgtataagcttaagaaagctctctatggacttaaaacaaacaccaagacaataggacaagttgataagacattttttattaagaaatcctctcatgacatcttgctcatgcaagtttatgcagatgacatcatatttggctccactaataaatttctttgtgaagattttatgcataagttgcagggggagtttgaaatgtcaatgatgggagagctgaactatttccttgtttttcaagtgaagcaaatgaaccatggaacttttctccatcaaaccaagtattgtaaggaacttctcaagaagtttgatatggataaaagtaaggaggagactacaactcctatgactataaattgctaccttagtgcggatgaaaaaacgaaactcattgacaaaacaaagtacaaagttaagagagttatgaagtatcttagaggaaccttagatgtcaacttgttgtaccctaaaggacttggcctagtatcttggaatatcaagaagcaagctcgtgttgccttatctacggctatggctgagtacattgttgtagggacttgttgtgcacaaattttgtggcttaaacaacaactttctgattttggattgcatttagagcacattcctttaagatgtgataacacaagtgccatcaatctcaccaaaaatcctaccatgcattctaagacaaatcatatagagattaggcataatttcattagggatcatattcacaagagtgattgtgatatagagtttgttgatacagacttacaactagttgtcttcactaaacctttagcaagggataggttcttccaccttcgtaatgaacttggcattgtaagtcagtctaatcttaagccaattagggagtattcattcatagcattggacacaaacccacaacccccagaacaaagaaggatgaggaactatcataggctggttcttcagttagaggaaaacggtatgtcagtttggcgtggctcagaagtaaaggcttcaactttttctgagttgattgagtatcatgagttgaagaagctagtggagatgaaggacacctactacacaaacatggaaaaagttttctgtagcgtaactcatattgatggtgatactaggttcttgtgtgttgaagtgaaagggcaacgaattctgatggcaccaaaggaagtctttggttttgttgaggtagaatttgaagggaagaccaaagtcttaaagcagatggaatacgtcaagtttgaagaagcggggattggaaggattgagaaaagtagagaagatcacacaaaacaagaaaaggctgaagagaagcccatgagcccctttgaacagatgatgttagcaaagatggatgagctcatgaggatactcaaagaagactatgttgagcttaatgagtgctttgagtctatctcgaaaaagttggatggcgtggatgctatgggagcacctcatgtggatgatatctaa

SEQ ID NO: 109179 - DNA, 420 bp, Glycine max
  Peptide Sequence Number=SeqID_225957
atggaggggtacatcctttgtaacacaagtagaaggtacatctacttgggttgttatattgagaacaagagaggatacatctcttgtggatcagttcaagtagagtgtacatccacttggttgttcaaagagaacaagggagggtacatcccttgtggatctttgacttgtaaaggattttacaaggcacggattgtgaatgaatgtaaagcaaagttgaattttccacacctaattggatctcacgtgccgttagagagattgagtgtggtggtagctctgaagtcaaactcgtcggagccttgtttgacggtaatggaggatagctcaaagccacaagggtcgaagaaaaggagaaacctagctgatttgcttaataggttagccaagaacagaagccaaagaatgggtttaaattga

SEQ ID NO: 109180 - DNA, 2868 bp, Glycine max
  Peptide Sequence Number=SeqID_225958
atgccgatcaatatacatccaagtaatgggtttttgaagcctgctgaggacatgggatttggtttggagttcagaaagagcagcacaaaacagcatagcagttcaaagacagtgaaagaaagtttggtattgccccattcgaaacgaagttcgaaggatgctgataagttgaagccaaagagtgatctcaaacagaaaggcaagatggatgcagaagggaagattcagaactccgaaactgtgaggaggagggcaacagaaagagatgaacttgtcaagcacatgtctaatttgccaggctatctcctgcgcaccgataaagtagaaaactttcaagagaaagcttttaatgttggcgttctagactggtctcggcttgagaagtggaagcacaagcagaagcatatcccagtactagctagtagtttcacatctctcaatagcagtgaattgttatcaagaacagctaccaaaccatctaccagtgttggtggcaaggaaaaacttagtgataagaaaagtttgccttcttcaggcatcatcaagtcatcttatagggaatcccttcctgaaagtgccaagcttcctttttacgatgtcaaacgatttgaatcttccaaaagtgtaactaagagcattggagatgagaagagcttgacacccagggcgtttgagtcctttggcaacaaaactcacttagatatatcacttgaaaagaagaggaggaatggctatagtaaaagaagttcacatgccaaaaattttgaatcaaaggcgaaactccatgggatctcatatcttcctaatgaaaatggtagggacgatggagctaagcagaacatggaagatttgcaagagcataaacacaagaaaaaagagagaaatcataagtccagctctgatatgggacatccatcagtaaaatcaaaaggcaaaggggcctcatccagttctaagaaaatgagttccagctgtagtgaaaccaggaaaaaggtggatcagctgcaggaattggattttgacggtggtcagaaacattgccatagcaagccaagtaatattgtgcttctttgtcccggagaaattccccagtcaagttcttcagaggattttcagctttctgaatcaagaacatcctcggtagaaaatttttcggaatcaaccaaaagtagtttgtcatatgtttcccttcctgatgaggattacacagcagatggatgttccgaaatccctccatcagggccaccgtgttctgcagttgagttttcttcttcggaaacaatgcaacacagcattagtactgatatgggtgtagaccattcttctgttgtgtctaagacaccatcttccataatacataagatgtctagtctgcaacctgcaagtggttgctttgaaaaggatatgttagactctaagctgagagatcagtatgccttcagtaagttgaaggaatcactggaccaggaaactgctgagctgacagctcagaaggaaatgaatccatcccataaccgtcggtttagcttcagcttaagtcgaattggaagaagtttcagtttcaaagaggggcccacgctgccacaatatagttccgtgtatgttagtgcaaagtctggtccggtgacgcctcaatcttctgttcgttgggataatccaagcaaagagaaggttaatagtcatatcagaaaccggtccagccccttgcggaggttgttagaccctttattgaagcacaaggcatcagatatacacaattcagctcaaagcagtcaggcactagagggtggaagtgcaaattcaagcttcaggactattggtgtcaatgaatcactgctggctgaaaagagcaaaggatcatcagttcaaggcctcttgcagcttacaataaaaaatggagtgcccttgtttaaatttgtgctcaacaatgaaagaaagatttttgctgctaccaggaatagtttagcatcactcgagaagggtgatttaggcagctgttttacattctacctggttaatgaaattaagaaaaagagtggtggatggataagccatggaaacaaagaaaaaagctgtggctatgcctacaatgttattgctcagatgaagttttctagctctaaaattgccgaaccaaccaatcagaactccagtagaaagtgtatggttaaagaatatgttctggtgagtgttgaaatcggccagacagatcaaggaccacctaagttcatccagagcgtggagctggcagctgttgttgttgagacctcatgcgaaaagaccactgaaggactgcatgatgataacaacatgctgaagaaaggatgctcaaagtgcttgacagatgaaagatgcttgtgcagttcaggagaaaatgaagcttctgattgcactactgttatacttccaggtggtgtacatggttcaccaaacaaaggtgaacctacacctttgatctatcgatggaaaaccgggggatcatgtgattgcgggggttgggacattggttgcagactgcttgtgctctccaaccagaaccagaattcaagtattccaaagagctataaaccttataatgatcgttttcaactttttgttaaggaaggaactgagaaagacacatcacttttcactttgttaccactgaaggatggtttctactcggttgaattcgactcaacaatcactcatttacaggcatttttcatttcagttgtggctttaagctgccagaaactaccaggttccttggaaatgggtagcatgcatgaagaggtccttaaccttaaggaacccagttccatgaacaacagaaaacttcaggggaaagcacctttaaaatatgctccaatacctccactatcccct

SEQ ID NO: 109181 - DNA, 294 bp, Glycine max
  Peptide Sequence Number=SeqID_225959
atggttgcgtcctttgcttatcgcaaagagcgtgatggatcttgcgtaaaaaagggtgctcaaccaaatgatgatgaaggacaattaccggttgaaggggactcttctctccttcaaagtattttggacaggtttgatggacttcaaacctatgttggcgagaggtttgatgctttggaacgacaaggggacacgcgatttgacgaaatggactcaaggatcacaaaggttgaagaagatgtcaccatcattcacgactgtcttgatttacctccaccaccaccatcaatttag

SEQ ID NO: 109182 - DNA, 174 bp, Glycine max
  Peptide Sequence Number=SeqID_225960
atgacgcgtggtggtaatccagtgtcgttgaataacaacatcggtttaaggaccgtctttgaagggcaacttttctacatcggttgtgtagctacaaccgatgtagaatgtttctacatcggttatcagtcaatcgatgtagaatggataggaatgggaaggtttctacattga

SEQ ID NO: 109183 - DNA, 264 bp, Glycine max
  Peptide Sequence Number=SeqID_225961
atggaactgcttgtacatatgaaggtggctccatttggtggttttaaacagtctggcctcggaagagaaggctccaaatatgggatggatgaatatttagagttaggggattgtgttgaattgttaatagcacttttagatgttttgggtcaatgggtatgggctgatacctgggatcctaggagaatgcattgtgtcatggattccattcctgccactgcaattgaaattggaggtgtagcacctatacagactgatggttag

SEQ ID NO: 109184 - DNA, 1431 bp, Glycine max
  Peptide Sequence Number=SeqID_225962
atggatgaacctaatggagaacaacagacgcttgtacaattgaatgaaagtgaggctatcaaaactattgttgaaaacattacgcgtttgttaaacaagacagagttgttcgttgctgataatccagtcggcatagaaccacgagtccaggaaatgattgaactattagaccaaaaacaatcaaatgatgttctaatactcgggatgtgggggatgggaggcattggtaaaacgactattgcaaaagccatttacaataagattggccgcaattttgagggaaaaagcttcctcgcacatattagggaagtttgggagcaagatgctggtcaagtatatctacaagaacaacttctatttgatatcaaaaaagaaacaaacacaaagatacgtaatgttgaatcaggaaaagttatgttaaaagaacgacttcgccataaaagggtacttcttatacttgatgatgtaaataaattgcatcaattgaatgttttgtgtggaagtcgtgaatggtttggttcagggagtagaataatcatcacaactagagatatgcatatacttagagggagaagagttgacaaagtgttcagaatgaaaggaatggatgaagatgaatctattgagctttttagttggcatgcatttaagcaagcaagtccaagagaagattttattgaactttctagaaatttagttgcttattctgcgggattgccactagctcttgaagtccttgggtcctatttgtttgatatggaggtaatagagtggaagaatgtattggagaaactcaagaaaattcctaatgatgaagtacaagagaaattaaaaataagctatgatggtttaactgatgatacagagaaaggaatattccttgatatagcttgtttctttataggaatggaccggaatgatgttatacatatcttaaatggttgtgggctttgtgcagaaaatggaatacgtgtcttggtagaaagaagccttgtaactgtagattataagaacaagcttggaatgcatgatttgctgcgagacatgggaagagaaatcattcgttcaaaaacaccaatggagcttgaggagcgtagtaggttatggtttcatgaagatgcgcttgatgtattatcaaaagaaactggaacaaaagctattgagggactggctttgaagttaccaagaaataatacaaaatgtttgagcactaaagcttttaaggagatgaaaaaactcaggttgcttcaacttgctggtgtacaactggttggagatttcaagtatctttccaaagatcttagatggctttgttggcatggatttcctttagcatgcataccaacaaacctttatcaaggaagtctagtttctattgagctagaaaacagcaatgttaatcttttgtggaaagaagcccagaatatttaa

SEQ ID NO: 109185 - DNA, 1365 bp, Glycine max
  Peptide Sequence Number=SeqID_225963
atgtcttctgcctacagtttcgactctgatctccatgatgaggagatggagatggagatggactttctgcgtgaacggtatcaggaggacaacagaaactatgatgtgtttttaagtttcagaggggaagacacgcgtgcttctttcacttcacatctctataccgctcttcacaacgcgggagtctttgttttcaaggatgatgagacactttcaaggggaaataaaatttcaccctcgctgcagttagcaattgaagagtctcgagtttctgttgttgttttctctagaaattatgcagagtcgcggtggtgtttgaaagagttggagaaaataatggagtgtcacagaacaacagggcaagtggtagtgccagtgttctatgatgtagatccctctgaagtacgtcatcaaacaggccactttggaaaagcatttcgaaaccttgagaacagacttttaaaagtggaagaggaagagctgcaacgatggtggaagacgcttgctgaggccgctggcatctcagggctttctgttgtccgaaattgcaaggagattggtgataagatatgtctccttgcgcagcattggagggaggcacttcgtgaggctgctggcatcttgggggattcagtctcagaattcgggagaggaatgttgattgctgaaaagttaatagatctccttgtgaagcattggagggaaacactgtgtgaggcactttgtgaggctgttggtttctcagatggtgcagacttatattacagagggaagtttgctaatgagataagcctcctcatgaagcattggagggaggcactttgtgagcataatggcatcccattggttttcctcttaaatttcagtgttgaagaggagattataagagattttaaggacttaatgatgtcttggaaggaagcacttcgtgaggctgctggcatctcgagggttgtagtcctaaattacagagctcctttttggaactctgctgtgcatagtcttcgaaaaatgccttcttgcaacaatctgaatgcgaataatccctcttctactctgaatccagtacaagatcctatgagccttttctatgtcaatccaaatgaaaatcccgcagcatcaatcgtttcttctccattgactgcgttgattacgaagaacaaacagaaatttgttgatggaagcatcggaaaacctgatcggtgtgatccgattgacaaaacatgggaaagatgcaacaacagtttggaggaattttcgagaaaaagattctcacaagcagatctggaattggagcctaaaaaggcaactgagcagcctgttgtaacgggcctcaatggtgaagaatacaagactctcatttag

SEQ ID NO: 109186 - DNA, 222 bp, Glycine max
  Peptide Sequence Number=SeqID_225964
atggaattggccatcccagatttaaagacgctcaagaaagttctcgacaatgagaagagacgttttgacacagtgtggcacacaatggtgagagtttcgacacagggtgttagtgacgagggttttgatgcatcgtggtggcgacaatggagtggttacagatctggtgctgccatgatgaaggacaacataggtgatagtggaagagataaggcttattga

SEQ ID NO: 109187 - DNA, 672 bp, Glycine max
  Peptide Sequence Number=SeqID_225965
atgaagaatatgaaagatgttgatttcgaggaggagggggagatagtcaaaatacctgaagtgggagaaaggagtaaagatgaagggttttgcccccaggtcagtttcttaacaaacacaaaagttgagattgaaggtgagttggaggagcctttaaggcttgaggaggtcctttggaagaagaggttgaaggtggagtggttgatgtatgtggataggaacacaactttctttcatagaaaaacatcccaccaaaagcaagtcaataccacaaagaagattcaggatgatgatggaaatgtgtataggaatgcagaggacattggtgagtattattatggcctcaaaggatataatgaaggaagagtgttatggaggattggagatggacgtagtgtggaggtttatgaagacaaatggcttcaaagtggagatgtatctttataccatgtcccacacgaatcacaagtaaatcctttgctagtggctgatctcattaaccatgaagcaagacaatggaagggggggcttattaatatgctttttctgtcacatgtgaaggaagaaattcacagaattcctttgactgaaacgggaaaggaagacaagctaaatggcgacattctatggatgggaggtacaatgtcaaatccggttgctggtgtgagatga

SEQ ID NO: 109188 - DNA, 411 bp, Glycine max
  Peptide Sequence Number=SeqID_225966
atgtttgtcttcatctctcccactcaccaacttggttgtgctgcttcctctgcccccatcaatagctgttgcggtggcggcgcaacaggtgatcctgttctcagagctggagaggctgaattgcatccttctcctctcatcgagccacccaccacttccacttccgattccgaggaagatctcccaccaccagcagtttccaaaaaccctcctccccttcagccccaacacttttcctccgaatccgaaactgaatcgggatccgagaccaaatatttgttggggttttgggcatttgcatactattgtggtggtggttgtgtcatagtgaaagtttttgtggctggcggcgattgtgatggcagaagcggttatgaaggtgaagaggaccaaaagggtggcgatgagtag

SEQ ID NO: 109189 - DNA, 126 bp, Glycine max
  Peptide Sequence Number=SeqID_225967
atgaaagctacaatgcttgttgcaagtgctcaattaggcacaaatgatgttgttgtggctggtggtatgcaaagcatgtctaacgtacctaagtggtggttgaagcaatgtcaatattgcctttaa

SEQ ID NO: 109190 - DNA, 198 bp, Glycine max
  Peptide Sequence Number=SeqID_225968
atggataatatcatagatggctcaaagacagggcagggtcgacggggatatttagaggaaggtgcatgggatgctatacatgttatagagatgagtatgaagctatcagttgttaatggtcatctttgtaacatgggaaggatgattgaagaaatggagagtaagctgaggaactcactagatcaggttaaattttaa

SEQ ID NO: 109191 - DNA, 300 bp, Glycine max
  Peptide Sequence Number=SeqID_225969
atgaccactctggctcagagatggagcttcctctcttatttcaaccttgctcccacctcccacacctccgacctcaacatggacaaagctcgactaatatacgggattatcatgaagatggacatggattcggggaaacctagtagatccttctatggtttttttggggaccaagaggactcaaggtcgtgctattcaggaggttcctatagcaccgcagccagtcgccatccctccatgccctatccctcctccttagtcctccacccttcaggatctcaagctacaaagcatccatga

SEQ ID NO: 109192 - DNA, 336 bp, Glycine max
  Peptide Sequence Number=SeqID_225970
atggcttcaaagcctggaatcctcactgattggccctggaagcctcttggcagctttaagtatgtgatactagctccttcggtcgttcacagcttgtattctatgttggcgaaagataagagtgaaagggacataaccaactttctcatattaccatttttgctctggcgtatgcttcataaccaaatatggattactctctctcgtcaccgaaccgcaaaaggcaacggtagaattgttgacaagggaattgaatttgatcaagttgatagagaaagaaattggtcagttagtgtaaatcaagacgtattcaatcttaagaccaatatattataa

SEQ ID NO: 109193 - DNA, 1515 bp, Glycine max
  Peptide Sequence Number=SeqID_225971
atggttcctcaacctctgctgacccttttcctctttttctcccttctctcaattgccaactcttctccttcccaacaccttcagatcgccaatgccgaacgcaggattgatttgacttctcacattattaaggtgtacttgacattgaagcatcatttacggaatttgcaaatcttatatttcaaagagctgtcctttcaggttgaaaatttggggacatctcctgcttcagaagtacatattgccttttcgcccactgaagtagaacatctagcaatagtcaaagctgctgcaacttctgggaagaggaagaagaaaacttatgttcctctagatgtcaaatctgctgagctacctgatggaccaaatggaactaagtttttctctataactttgttaactccactaagtaaaggtgaaaccacaacactagaggtgctttacatattgacacattctctggaacctttcccagtagaaataagtcaatcagagtcacagttggtttatttccgtgatagtgcaatattattgtctccctatcatgtcaagcaacagacaacttttattaagactccaagcacccgggtagaatcattcacagtggtggaccccactaaacgtgctggtacagagttgaaatacgggccatatgaaaatcatcccccgtattcatattctcctgtacttattcattttgaaaataacaatgcatttgctgttgttgaggagctagaacgtgaaattgaaatatctcactggggaagcattcaagtcactgagcaatatagcttggtccatgctggtgctcgacataaaggtgttttttcaagggttgaatatcaaactaaaccaggtggtactggtgtttcttcatttaaacatcttttagcgaaactaccccctagggttcactcagtatactacagggatggaataggaaatatttcctcttcacatctacgtacagattcttggaagtcagaacttgaaattgaacctcggtatcctctatttggaggctggaaatcaacctttgtcattggttatgggctaccattgcaagacttcctttttgagtctccggatggcagaagatacctcaattttacttttggttgccctcttgtcgagacagtggttgacaagttgattgtaaaagtgggtttgttattattaactgaaaattgtgcatcaactgcttctgttgtgctgccagagggatccaaagatcccacagttgagattccttttgaagtgaagcaacatctagagaattacatggtgatttggcctttcttggacctatgtattgtatttgtatatattgtgaaaatctctcactacatgccaaagtgggacctggctttgagcattctctatagtaatgcaatcttatctgagtgtagggaagaagaagacaaacacaagatttatactggttcggccacaaaccatgcctatatccagtccccaagcaacctgcggttcttgagatttctttcaaccttgtaa

SEQ ID NO: 109194 - DNA, 291 bp, Glycine max
  Peptide Sequence Number=SeqID_225972
atgcctcaccaaaagaggaaaattctaggtgaggcttcactgttatcaagcaagtcagagacccaacatgaccacagatcaacctctactctttatggctcacacagacctagttgtcatgtgtgcatagagcaatctaagaattaccccaccctacttgctaagcaaacagacgattcccaggtagatgcaataagttcgtcacatgtcgtctaccccaggattcaatggcacaaattatttctaactacgaaagtaatagatagacagatacacaccaagaggcaataa

SEQ ID NO: 109195 - DNA, 1383 bp, Glycine max
  Peptide Sequence Number=SeqID_225973
atggctagcatgaagctgggatccaaatctgaaatgttttacctctatggccaaagttggttgtgctcaactggacttccaagtgatgtcattattgaaattggtgacacatctttccatctccacaagtttccactgatatcaagaagcaaagtgctagaaagtatgatgaaagaaatatcaagtgaacatgagaagtctgttttggaacttcatgacctaccgggaggagccaaggcctttttgcttgttgctaagttctgttatggtgtcaaaatggagttgactgcgccgaatgtggttggtctcagatgtgcggctgagcacctacaaatgactgagaattatggagagggaaacctgatcacgcaaacagaacatttccttaatcatgtgtttagttactggacagacactcttgaggctctcaaaacatgtgaagaggttttgccttttgctgaagagcttcacatcacttcgcgaagcatacattctttggtgttgaaagttgcagatcaaagtttggttagttttcctgtctccacatctcaaagtgttactcagagtccagacgatgcagaagtgtggaatggaataagcctaacaccaaagacctcaggtgaagattggtggtttgaggatgtttcttctcttagtttgccattgtacaaaaggttcatgcaaggggctagtgcaagacaaatgaagcctaagagaattgctgaatcccttgtttactatgcaaaaaagcatatccccttattgagaagtcaagcaagttctcagaatggaaactcatcatcttttaagtcaactatttctaccccttctgaagcagatcaaaggaatcttattgaggaaatagtagagttgcttccaaatgaaaagggtatagcaccaaccaagtttttgctggggtgtctgcggacagcaatggccttatatgctagttcatcttgctgtgcaaacttggaaaaaagaattggtgctcaattagatgaagcagacctggaagatcttttgattccaaatattggatactcaatggagactcttcatgacattgactgtgtccagagaatgcttgactatttcatgattgtagagcatgatgtaattgattctacatcaaacgatatagaggaagaagggcgcatagttggatgttctcaacctgagagtccaatggcaaaagtggctaacctgatagattcttatttagctgaagtagcacctgatgtaaatgtgaagttaccaaaattccaatcacttgctgctgtacttcctgattatgctaggaccctggatgatggcatataccgtgccattgatatatatctcaagttggtgataagatccttgaaagtggagcttgttgcatga

SEQ ID NO: 109196 - DNA, 468 bp, Glycine max
  Peptide Sequence Number=SeqID_225974
atggcgccattgctggcctttagagaaagaggagaagggacagagagagataaagcaacgaccaaaaccggcgcctcagcatcaacgatgtttcctttgtcgacgtttcgtttctcgatggaaaccctcttagccaccaacattcagggttttggatccagaggagttgagactggtataattgaaggtgttgagaaggatgagaagcacatattactgcctattcaagaggatgtatacaagtcgtgtgagtctatatctacgttagcgagtgatttatttgaggatgtaagagcttcaattcagaaatctagcaagaagtccaccccatcaacttcaaacatcaaagtgtcatcttccccttcggttccattgttccaaactcatgattgtatgtctctgtctccactttgtgtatttagcatagatccttgctatttgtttgtgaattgtgaagagcatttataa

SEQ ID NO: 109197 - DNA, 240 bp, Glycine max
  Peptide Sequence Number=SeqID_225975
atgtgcatgatccaattggggttgttggctctcaataggtatgggtgcggagttgtcgacattctcatccagagcgtgtacaacattgagtggtgtatagttgggaggcaagccatatggtgggaaggaatgcttactctagacctgcacaaaatgggggctgcctgtacttcccaaagcttcggctccctaagctaccatatccgagactggacgatttacttaattgaagccagattg

SEQ ID NO: 109198 - DNA, 1269 bp, Glycine max
  Peptide Sequence Number=SeqID_225976
atggccgtgtttggatatgtgacttacattgattttatgaacaacatgggtcattgcaactttgagattgttccaatgtggctctttaatatcttcccgtgtcttaagtatctgatgtacaccccatcgtttcactctttgcaccacacccaatttaagacaaattactctttgtttatgccattttatgactacatttatgacaccttagacaaggcttcagatcaattacatgattcagcatcaaaacgagaggaagaaattccagatgttgtgcacctaacacaccttacaacgcctgaatctatttatcatcttaggcttggatttgcttatctagcctgcaagccttgtacatcaaaatggtacctttgtttgatgtggccaatgacagcttggtccatgatcctcacattagcctatggtcgtacattcattgtggagggaaatcattttgacaaacttaagctgcaaagttgggcaatacctaagtacagtcaacaatactttattagatcacaaaaaatgcccatcaacaaaatgattgaggaagcaatattggacgcagacaaaaaaggcataaaagtgttgagtttaggtcttttgaatcaaggagaagatcttaacagttatggagggttttatgttagtaagcatccaaacctaaaagttaaggttatagatggcagtagtcttgcaactgctattgttcttaatagcattcctaatggaacaactcaagtattacttaggggaaaactcaccaaggttgcttatactattgcattcacattgtgtcaacaaggtgttcaggttgctacaatgcataaggatgattatgtgaaactcaaaaactcgttcagtagctttggaaaaaattttatcattgaaaaaagctacacccagaagacttggttggtaggagaaggattaactgaagaggaacaactaaaggcacccaaaggaacattatttattacttactcgcaattcccaccaattaaataccgtaaggactgctcctaccacttcaccccagcaatgctagttcccagttctattcaaaatgtccattcttgtgagaattggctgccaaggaaggtaatgagtgcatggcgcatagctgggatagtgcactgtttagaaggatggagtgaacatgagtgcaactacacaatgcataacatagacaaagtttggcgttcaactcttcaacatgggttccaacctcttagtgtgccaattaataaggagttagctcattattaa

SEQ ID NO: 109199 - DNA, 372 bp, Glycine max
  Peptide Sequence Number=SeqID_225977
atgccgagtttgactgtgaataagatagggttagagagggttgaggaagggaaagagaataataataataagaagcagaggagggatggttctgaaattgatttgcagctgttgaagggaatgtgtttttggataagaagagatttggagattgtggaaaaggaaaatagggagatgaagcatttgttggatgagatgaaattgaagctgagtgaaagcaatggggaggttcagcgttggagaagttacaagagtgaaagacaagaggaagagaaaaaagtgcaacaaccaaacaagccacaaagtgtagccactaacgatgtggaatctgagttggagaaagccattaaggctgccacctctacttcttag

SEQ ID NO: 109200 - DNA, 723 bp, Glycine max
  Peptide Sequence Number=SeqID_225978
atgagccctcatgctttaaacaccaacgtgaatgcccttcatgacattgggctccctgtatcgacaccatttaaggatgcttccgcgtcagtgccatcgacggcagtgtttggccggaactccagcttccggaacattttcttggcgaagaactgggcagagcttccgttgaaggaggataacgccgaagacatggttatctacggtgttctgcgtgaggccgccaccatgggatggctccccgccaatggcaatggggtgagcaaggtagggatggctgtgaaaatggaaaatgagagtcaaaatagtgacaaagcagctgcgtgtggcactcacgtgcctccaaggagggggttgagcttccgaggcgtgcggaggaggccatggggaaagtacgcggccgagataagggatgctaagaggaatggtgtgagagtgtggcttgggacctatgagactgctgaaaatgcagctttggcttatgatcgagccgcgtttaagatgcatggctcaaaagcaaagctgaattttcctcatttaattgcctcggctcatcatcatgtcgagccaattaggattgccttaaagaaacattcattcgatgtttccttgtcatcgtcggaggtggcagcaaaacggagtaagaatggcactgcttccacaaatttggagctgaatgactcaaatatgttacagtttcctatggacaataggtggcaataa

SEQ ID NO: 109201 - DNA, 481 bp, Glycine max
  misc_feature (468)..(468): n is a, c, g, or t
  Peptide Sequence Number=SeqID_225979
atgagtgatggattttgcggtactcatttgcagatcatggttaggaccagaggattaggtcgtgccttaggtcagcgagtcgctgtgactgcggagcacgtcgatgagccagtcatcgctgacccagacgttcaggatgacccgatggaggcaccagctgctgtggaggacattcctgcggacgcaggcgcagaggcggctgaggatcagcctcagggatttccggatggtccgagcgacccatctgtgctgacagcatatgcggatcacgttgcttgcagcgtatggacgggagaggagcgtcctgaattgaagttatcctcgcatgggaggaaggtccatagtttaggcaggcatgtccctgccattgagggacttatcgctgatacaggactaagtcctctgatcgcgtgttcggtagacaccggcgatcggggacttttgtccgcgtttgtggagcggtggcantgggagacgtcta

SEQ ID NO: 109202 - DNA, 204 bp, Glycine max
  Peptide Sequence Number=SeqID_225980
atggctccgagaaagctttccataaaaagatctaggaaggacgcgcggccgaagggactagtgccgctcccaagttcgatagccatcgtttcaggagcgctgagcacctgcagcgtttcgaagccatcaagggatggtccttccaccgagagagacgcgtccagctcagggacgatgagtacacaggtttccaggaggagatag

SEQ ID NO: 109203 - DNA, 303 bp, Glycine max
  Peptide Sequence Number=SeqID_225981
atggacggcgaggagttgcctttacctgtgaactctgatgttggattcccgtccactgtatatctcttgtcacagtcttttaaaggaagagaacatggatttgaggcttcagtcctcgctttggggcataatcgtcttaggccacagtcggaggttgagacaaagctaaaagtagaaaccaatcaaggggttgtaggggatggccttaggcctatgttgcatcctgaagcaatggggcatgctacattgcccccactctcttgctattcatgcctaaacatgcgcccaccaagtgctcggtga

SEQ ID NO: 109204 - DNA, 823 bp, Glycine max
  Peptide Sequence Number=SeqID_225982
gatagagatcccataaaaacttctttcgaggaatgggcaaaaccaggtcatttctcaagaacaatagctaagggacctgatactactacttggatctggaacctacatgctgacgctcatgattttgatagccatactaatgatttagaggagatttcccgaaaagttttagtgcccattttcggccaactctctatcatctttctttgggctgagtggcatggggagggttccgaggaaatacaaataaccccccggtttttttcagatttggagagcatctggaataacctagtgaattacaactctatttgtaccgcaattggtgcattggtctttgcagccttaatgctttttgctggttggtttcattatcacaaagctgctccaaaattggcttggttccaagatgtagaatctatgttgaatcaccatttgacagggctcctggggttgggatctctttcttgggcaggacatcaaatacatgtatctttaccaattaaccaatttctaaatgctgcagtagatcccaaagagattccacttcctcatgaatttatcttgaatcgggatcttttggctcaactttatccgagttttgccgagggagcaactccctttttcaccttgaattggtcaaaatacgcagaatttcttacttttcgtggaggattagatccagtaactggaggtctatggctgaccgatattatacaccatcatttagctattgcaattcttttcttgatagcgggtcacatgtataggactaactggggtattggtcacagtataaaagacattttagaggcacataaag

SEQ ID NO: 109205 - DNA, 333 bp, Glycine max
  Peptide Sequence Number=SeqID_225983
ggtcaaggtcggccagtgagacgatgggggataagcttcatcgccgagaggggaaacagcccggatcaccagctaaggcccctaaatgaccgctcagtgataaaggagagggaaggacccgcgcgagcagtgctggacgaaagcggaagcgagaatgtcggcttgagtaccgcaaacgttggtgagaatccaatgcctcgaaaacccaaggggttcctccgcaaggggcctaagatcaggccgaagggcgtagtcgatggacaacaggaggctaggtttagccgaaagatgggtatcgggttcaaggacgcagggtgcccctgctttttcagg

SEQ ID NO: 109206 - DNA, 756 bp, Glycine max
  Peptide Sequence Number=SeqID_225984
atggcggaggacgccggggcagcggacctgatcgccaacggccgtttgcagctcggcctgagccgtggctcgccggagcaggtgattgaaggctaccgctactttggctttaatccgcgcgaaggggaaaccgatgcggatatgggacgtcgtcacaccgaagagctgctggaagtactgcgtggcgaagggtttgccaaacccaatccgcagccgatgttcccgaatccaccggggctgctacgcctggagccgtattccgaaggcctgcgcgagcgtatctggtggggctccggctcgaacgccacatcgatctgggcagcccagctggggatgaatttgcagagttcgacgctgaaggatgacgagaccggcgaaccgttccatgtgcagcaggcgaagcagattcgcgcctataaagaagcctggcaggcggcagggcatcagcgtgcgccgcgcgtgtcggtcagccgcagtatttttgccctgatgaacgacaccgaccgcgcttacttcggtcgcagcggacaggagcaggattccgtcgggttcctcgatgagaaaacccgcgccatctttgggcgtagctatgccgcagagccggagcagctgatcaaacagctggcacaggatgaagcgattgcggaagccgatactctgttactgaccatccctaatcagcttggcgtggactattgcgcgcacgtgatcgacagcattctgacccacgtcgcgccagagctcggctggcgttaa

SEQ ID NO: 109207 - DNA, 411 bp, Glycine max
  Peptide Sequence Number=SeqID_225985
atgttttaccccatcgcaatcgaagcgggagatgaaaccaccgcgtacggcgttacggtgccggatttacccggctgcttttccgcgggagatacgctggaagaggccgtaaaaaacgccaaagaggcgattaccggtcatctggagttaatggtcgagcttggccaggatattccggcggtctcggaccttaaatcgctgatgaaatcggcggagtttgctggttacgtgtgggtgctggtggatgttgatgtgacccggattctgggcggctcggaaaaaatcaatgtcactttgcctaagttactgattgatcgcatcgaccgttgcgtggcgacgcatccggaatttaaaacccgttcagggtttctggcgcaggttgcgctggagcgcattgcaaatacgcgctga

SEQ ID NO: 109208 - DNA, 270 bp, Glycine max
  Peptide Sequence Number=SeqID_225986
atgttaggacttacacacgattctcctcaaatttcagccagcccgcatcaattagaccttgcaccttatgcttcagggccctacaatgctcaagggaacgccctagggcttctccatgacaagcaaacatcgtgttcgagtcgtattctcggagaaatggaggttgaggaaccttggttggggttatggctaccattgaattatcaagtggatatgggagcaaggatggcctttgtggatgacagggtggtgggtaatgagaagggctga

SEQ ID NO: 109209 - DNA, 241 bp, Glycine max
  Peptide Sequence Number=SeqID_225987
atggtgggttacacaccttccagctttgcggatatgttcttcgccggcaaaaggatcgaagtgggtctgaaaagaggcaaatttggtcatcttgctttgatgaaaactggggcaagtgaagagggtgagaatgagggagaaacccgtgttgtgactgtcattcctgtacagtcaagtttcccaccaacccaacaatgtcattacccagccaataacaacccttctccttacgcaccaccca

SEQ ID NO: 109210 - DNA, 276 bp, Glycine max
  Peptide Sequence Number=SeqID_225988
atgcctcaccaaaagaggaaaattctaggtgaggcttcactgttatcaagcaagtcagagacccaacatgaccacagatcaacctctactctttatggctcacacagacctagatgcagcggaagacaaaggagaagaggtgagaggaggcgccatccactagggaataagccatggaagaaggagcttcaccaccaagaatatgccttggataagaagcttgaagaggatgctttaatggaggaaaaggaagagagaaggggggcacggaattga

SEQ ID NO: 109211 - DNA, 330 bp, Glycine max
  Peptide Sequence Number=SeqID_225989
atgtcacatcatattagagcattgtgtcccaacgtccttcagcacaaggttcctttaagcaattcacctagtcatttgctctcccaaacacaaagttcaagatcatcacaggatccaaacacaaacaacacacaggggggagaccagtcagaatcacgctgttttgcaagaatgctccaaccatgtgggatcgacacaggcttaaaggagcacccaaagcgggtgacccccaaggactacatttcgaagagtccatcagggtctctccctcctgattcagacactactaatgaattatacaatacccacgacctaacactcgtgttttaa

SEQ ID NO: 109212 - DNA, 474 bp, Glycine max
  Peptide Sequence Number=SeqID_225990
atgacaggagaaaggtgtatgttccaatgtctgactccttatcatggtggaaccgtcacttttggacaaaatcaaaaaggaagaataacaagagtggcttgcttgagcaagctcattcctttagggctaagcatcagctcgcttgggcgagcttcccctgccccaaaatggctttttcctataaataaccatgctgagggaagggttcaggagttggaaaaagaaagagaaagagagaaagaagaggaagaaggaagaaaaatgaagctgaagcgctaccgaatcgtgatcgtgatcattccctacatcgttctcttgttatgtgtccctcgtgcaatagtcggagtaagggtgatgcaatcctaccccgcaagggcattggataacagactccaagtagattgggccagagatccaagggaaggccctagggttctcatgagccttaggatagatttcgagcccatgggctaa

SEQ ID NO: 109213 - DNA, 279 bp, Glycine max
  Peptide Sequence Number=SeqID_225991
atgcccgacactagacaatactcgtccacacctgggggtttgactaactcatcaccctctgcttgtcaagattactaccccagtcgtcagatagattccctcgatgaggggcaatctacttcgacactggacaacctctttcgcccgcattccagctcagagcttggggggcttatgtactattcagggcccacaaaatctatgtggcatcccacatggcacccagagacatgtgtccaccctccatgtcaaccctactacaggagcgcaaacgcttag

SEQ ID NO: 109214 - DNA, 1637 bp, Glycine max
  Peptide Sequence Number=SeqID_225992
atgcgggcgaaagaggttgtccagtgtcgaagtagattgcccctcatcgagggaatctatctgacgactggggagtgttgcaggtcaatgtggcttgtcaagcccccgagcctggacatgtgttgtttgggttgcttctatcaagttgtccgtgatggacgtgtatttggcatgctaggcgcgtgcggtacacgtactagagtaatggtcgtgtgtgactgggtgaacgttatggtcatctcgataggcggttcatcctctgaggttactcgccaaggtgcctcttatagcaagtcatcctcctcggagagggtgaagacctcgcggggtacgaggagagctagtggtgatggagatgtgaggtcgtctcctcgtgtacgacctagcgtgagtgttaggtcgctgtcgtccattttggtcgttgttggctatgagtgggcgacgagtgtcgctgcacttcagcgccaggtgaagctggcgaaccctgaggactcttgtaagatggtcgttcaggcttgcaagagtgatgacttcccattttttagggcggcgcctgtgtgctctgctggagcacttgaatatggcctcttcccagctccacccaatcagttgggcaatggacgagagccccacttcctattctactggcagtctgatcccactaggttcaagtcgtatgatgaggatctgttgacccttgtgaagagggtcgtcaaagtaattttagagcagttgttggcctcgttggacacgtgggccatcttgtctcttcctttggaaagcggctttgccggtattatgagtgactttgcttggaggccacttgtgaagcaggtcgaacttgtaggtggaatcgtgccaccatctgttgctgctccatccgctggagaagggggccaacctactggcaaggttggtcctgtttttgttgttgttgaggtcgccctcagtgctccttcctctattttggtaaagaggaagggagattatgctgctaggccattgggccgcaagaagtcaaaggctcctatgagcctccacgccctgaggcaggctacagagttagggcccattacgggtcacctcacgattgtgcaagatgtgcctccagcttcaccggtcgttgaggctcttgctcctttatctcctcctgcgactgttgttcaacaggtttctttcactgttgttgaaactgttgtgccagccactaaggctgagtctgttgtggtgccattgtccatcgttgcgacccctttactaagtgtcaatatagcaaccattggtgctcccatggtgccacctttttcttcattgactctggtggccctccttgttgctgttttggtgactatggcatcacattcttcatcctcgcaccgccgcatctccctcgatcatttgtacacctccaatgatgctgactcactgtggggtgccacttacaagctgaagcaaaagaccccggctgactttgtgtcagccttcgacaaaaatctcatcaagttggttgtggtgcagaatgctactgactatgccaaggtgttcctccaaaggagtttggcaattctggaggagaacggtttacgacaccgagaggcggtgcaaaaggtggcgtccatcaagtatagaaaggaaat

SEQ ID NO: 109215 - DNA, 1070 bp, Glycine max
  Peptide Sequence Number=SeqID_225993
cccggcatcgcgctgctgatccactggctggagtggcgcggtgcctgtctggccattgccgcgctgttgtgcctggcggtgctgccggcttacctgtatgcgctaccggcgccgcgcacgccatccataccaaaagccacgcaacagcataccgcacagaattcgctggcccccacgctgttctggctgctgtgcagcatctttaccctcgcgtcggtgatcatgacggcgatatcggtgcagttgattactctgctgcaggcgagcgggcattcgctgagcgccgcgctggcgatcagcacgctgctggggccgtgccaggtggcgtcgcgcattgtcgatatggcgttcaaacgcggccatcccatctggaccactttcttctcagtcgggctggtggcgctgggattactgctgctggcctgttatcccgcgtgggcgctggtgagtatggtgctgtacggtgcaggaaatggcttgcgggctatcgtgcgcggtacgttgccgctggcgatggtaaaaccggaagagtacgccattgtggttggccgcatggcgcgaccggcgctgattggtcaggcgctcacgccgctgattggcggctatattttccagcattccggcgcgcaggctacgctgtggctgttatgcgggctggcgctcatcaacgtgcttttggtggtggtgctgaagcggaaattgccggcaggcgctccggaatccgcaggttgaaatcgccactgacggctaacgggcagagatggccgctgctgcgctttagtggcgatccgtcagatattgcagcaggcaacacaacgcgcttaacagcagagtgcagccagccgagacaacgaaaggcagcggtgccattcgtacgcattgccataaggtcggttgcgcacacggcgcgacacccgtgcagaaataatcgtccctttgtcacaacgtccttcaccagcccgcagctacagcggtgggggcaaaaaagtgacacgtcgcgcatattgttgcgcaaggctcagagtgctaaagcggtcagcggcatgccatgttggaatatacttatctaa

SEQ ID NO: 109216 - DNA, 669 bp, Glycine max
  Peptide Sequence Number=SeqID_225994
atgacagaaccaagggtttttctttgtgcacccagcaaaattgttggtgcacccaacaataatattgaagtgacaaaaatgcccttcagtaagaatttaaaaaagctctctccctcactccctcttcaacgtgctgttgttgctactattcatctcttcctttgtgcatccagagttccaccgttgggctgtgaatcaatccttgtcattgtctctgtcataagtgtcacgctccctacccctctagtgattatggttagaaccagaggtttgggtcaggctttaggaagggttataggaagagccccggggagagaagtaaatcgtgatttagatgaagcttcccaacgacgaaggcccacaacatctgcatgtaggcaatgggaagctgcacttgttgctgaggatgttcagcaggtggatcatgtagctaacgagatccacgaacagcccgaagaagcagctgttgatgatgtagttcctgatgctaagggttttctaggtgggccccacgacacatcagttttgattgactatgttgatcatgttgcaatgattgtttggaatggagaggaatgtcctgagttgaagttatcctcccatggaaggaaggtttggaaattcggcaggcctgctctagagattgaaggcttaatgattgccacatga

SEQ ID NO: 109217 - DNA, 567 bp, Glycine max
  Peptide Sequence Number=SeqID_225995
ccaaagtctgtcactctgttgtctaaatcagatgtctatatagctcctgaaaagtacctagttcttgcttgtgcgtgtcctcatatcaactttgtgcttctcattagtcgccaagggaaggtgagactgacaaaatggtactcaccttattctcagaaagaaaggagtaaggtaatccgtgagctcagtggaatgattctttcccgtgctcccaagcaatgtaattttgtagaatggcgaggacataaagttgtttataaaaggtatgctagtctctatttctgcatgtgcattgatcaagatgacaatgaattagaagtccttgaaataattcatcattttgtggagattcttgaccggtattttggcagtgtctgtgaactggacttaatattcaactttcacaaggcctactatatactagatgaaattctaattgccggtgagcttcaagagtccagcaagaaaacagttgctcgattgatagcagcacaggattcgttggtggagaatgcgaaggaagaagtcagttcattaagtaatataattgcacaagccactaagtga

SEQ ID NO: 109218 - DNA, 2292 bp, Glycine max
  Peptide Sequence Number=SeqID_225996
atggagagggttgcagagccgacggtacttcctcgaaccttgcctatcctggttgaggtatcgaactcgtgcacagttgctgctagagattccagtcagagactaaatcgccaggaggtttcgggtgttggtgggatttcgctgagagaagtgaatcaaatgtccagaacaagggatgtgcgtgttcctattacacatctggcctccctcagagaagtggctcagttaacgaatgcgcggatatatttggtgcaagaagatacgggattcgatgctcgatcctctgaagaatccctcacctttgagcctactatggcatggaaaggaaatggctcttcaccagaagaagccaaagaattcgtgcccgatgttgagacattgaaggggagcagtgattcatttgaggatggtggtttgagtttatttgctggtgctagtcatccccctgaacctgttgatacagatctaatgagaatggtttttgtaccgataggtcaaaacaaatctgaggctggatgcttaattaagaacttgcccacaaagggccctttcctggaagatctctcaattcgtgttcctgcaaagaaaccaagtccagctgttctttcctctgaagaaagtcttgttgaagaactaaatggtatagggaccttatcatttttgggtcctcgggcatcacagaatactgagaactctatcctccttctggatgctgaggaaaaagaatgtgtttgggatgcttctttgcctcctagtggcaatgtcagtccacttagtagtattgatagtatcggtgttgtcactgcgatgagcattgctaatagttgtgctagtacatatcggagtgatgcagtgactagtgatggcatgcttagtttagacaggaactgtgacagtactaaagggagtgtaaggggggattcactagagagtgctaaaactagtgttagtcggccaagtgatagcagtggcctcagcgatgacagcaactggagcaacattactggtagcgccaataagcctcacaaaggaaatgatcctaggtggaaggctatccttgccatccgattacgggatgggattttgggcatgagtcattttaggttactcaaacgactaggatgtggtgatattggaagtgtgtatctctcagagctgagtggaactaggtgttattttgcaatgaaagttatggataaggcatcgctagcaagcagaaagaagctgactagagcacagacagagagggagatattgcagttgctggaccatccgtttctaccaactttgtatacacattttgagactgaccgattcttgtgtttggtaatggaatattgtccgggcggtgatcttcacactttacggcagcgacaacctgggaaacatttctcagaatatgctgcacgcttttatgctgcggaggtcctgcttgctcttgagtatcttcacatgcttggagttgtgtatagagacctcaaacctgaaaatgtgttggtccgagatgatggtcacataatgctttcagattttgatctttccctcagatgtgctgtttcacctactcttattagaacttcctatgatggtgacccttcaaaacgggccggtggtgcattctgtgttcaacctgcatgtattgagccatcatcagtatgcatccaacctgcatgttttattccccggttatttcctcagaaaaacaaaaagtcacggaagccaagagctgatcctgggttgccatccagcacacttccagagctcgttgccgagcctactcaagctcgatctatgtcctttgttggcactcatgagtaccttgccccagaaattatcaaaggagaaggtcatggaagtgcagttgattggtggacattcggaattttcttgcatgagctattatatggtaaaaccccattcaaagggtcagggaaccgtgctacgcttttcaatgtagttggtcagcaactcaggtttcccgaatcaccggcaaccagttatgccagcagggatctgatccgtggcttgcttgtgaaggagccacagcatcgtcttggggttaaaaggggagcaaccgagatcaagcagcatccgttctttgaaggtgtgaactgggcgttgattaggtgcagcacaccgccagaagtgccgagacctgtggaaaatgaagtaccagcagggaaggttgttggacctgttgatcctgttggggttggcagcactagtaagaggatagtaggtactgacaacatgaagtctgggggtaaatatctggactttgagttcttttag

SEQ ID NO: 109219 - DNA, 1155 bp, Glycine max
  Peptide Sequence Number=SeqID_225997
atgcatctgcaaacatatggggttcgtcgggccgtaagcctgtcaggagtgatgttgctgggaagcctgctggccggttgtgatcgcggtgtggcgcaaaatgcgccgccgcctccgcccgaagtgagtgtcgcgcaggtggtgcaacaaaaagtcagccagtgggatagcttcaatggccgcattgaagcggtgcagagcgtgcagctgcgtccgcgcgtctcgggctacatcgatcaggttaactatcgcgaaggcgatgaggtgaagaaaggtcaggtgctgttcaccattgatgaccgcacctaccgcgccacgctggagcaggcgcaggccgaactggccagcgcgcggagccaggcggcgctggcccgcagcgagtcggcccgtaccgacaagctgatcggcacccaggtggtatcgcgcgaagagtgggaacagcggcgttcgaccgccagtcaggcgcaggccagcgtgctggccgcccaggcggcagtcgatatggcgcagctgaacctcgactttacccgcgtcaccgcgccgattgatggtcgcgccagccgggcgatgatcaccaccggtaacctggtgaccgccggcgacagcgccagcgttctcaccacgctggtttcgcaggaccgcatgtacgtctactttgacgtcgacgaagcgatctatctgcagtaccaggcgatggcgcgtcagggccagaaccgcggttcgctgccggtagagattgcgctgaccggcgaacagggctatccgcaccgcggcaccgttgattttctcgataaccagctgaccgccagcaccggcaccattcgcatgcgcgccacgctcgacaatcagcagcgtcagtttaccccaggcctgtttgcccgcgtgcggctgccgggcagcgcagaatttaacgcgctgctggtcgacgaccgcgcggtgctgaccgaccaggatcgtaaatacgtttacgtggttgatgcgcaaggcaaagccgaacgccgcgatgttcagctgggcgatctggctaacggcctgcgtattgtgcagcagggtctgaagccaggcgacaaggtgattgtcaacggtctgcagaaagtgttcatgcccggtatgccggtaaaagcgcagccggtggccatgcgctccgctcaataa

SEQ ID NO: 109220 - DNA, 651 bp, Glycine max
  Peptide Sequence Number=SeqID_225998
atgtcgaaaaaactctggattggattactgtttgcgctggtggtttgctggatcgggctgaagccccatctgagcggtactgcgccagaaaaacagacggatattgcacaactgaccgatgcacatcgcgtggcgcgctggctgcagcagcatcaccgtttgcctgatttttatctcaccaaaagcgcggcacgtcgtcagggctggaacccggcgcagggcaacctgtgtgaggtgttgccagggcgggcgattggcggcgatcgcttcagtaaccgcgaacggcggctgccgatgcaggcggggcggcagtggtatgaagcggacgtcaattacgactgcggccaccgcgatgccgatcgtctgctttactcttctgatgggctgatctttctcaccaccgatcactatcgcagcttcacgccggccttttatcaggcgctggtcgatcagagcggctgcggtgaacgctttggttacaatctggatgcgctgtgggactggctgaccggcggcatggcgctgccggcaacgctgcatttgcagcatgtcgccgaggtcagcgccagtgcggagtttgccccggtgctggcgctgctggaagaggcggcgcagcagctggcgggtgagctgcgcctgattactcactga

SEQ ID NO: 109221 - DNA, 372 bp, Glycine max
  Peptide Sequence Number=SeqID_225999
atggcgacgggagagaatgggatgatgagcgacgcttttattcacgatctgatcgactggattgataacaacattgaagcacgtctggatctggacaccgtagcggggcgcgccggctattcgaagtggcacctgcagcgcatgttcaaagagcacaccggctatccgctgggtgagtacatccgggctaagaagctgaaaaaatcagccgaccgcctgaccaccaccaacgaaccgatcctcaacgtggccatttcgctgggcttcgattcacagcagtcgtttaaccgcagcttcaagcgccagtatggcgtggcaccgggcgcatggcgtcgtcacgccgcgcacaccccgagcgcgatgcagcagtaa

SEQ ID NO: 109222 - DNA, 1344 bp, Glycine max
  Peptide Sequence Number=SeqID_226000
atggctcccaaaagaagtgatcttgttagggtttcaactatcaacaacattgaagaagtaaaaaaaaaattcctgaagattggttcattcttggaaaatgggatttgtttaatcgtgttggctggacctagttctttgaaatgttcagttcctagcactatgggtgttacactctattatggggaacaaccaggcctagttttcgatagagattgggaaaatgagataactcaagaaatgatggatttcatgctttatggaaaacaatgtcgagagtcatctgataagaagggtctaatcaaattcctaaggactaccaatctcttctatatgcacaaactcattcacaacttcctatttaacatagtcatgcctatagtaggaccaagagactatgttagtgacaaagatagattctgcatgtacaatataatggtaggcggaaagatcctaaggaataataaagtagatgtctttgtgatggaatcatctttaggaaccacacagcttaaaggcatgtcctttgttaagatgggaacaactaataacttccaagaatatgttgaaaatcatatcaaaagaaaggttaacaaggaggaaccacagtctgtggaagagcagttggagcaaattcaaccacagtctgttgatccaaagtttcgagcaccatctaagcagactcagggggagcaagttgaaattctcgacataccaacccctcaaccatcacctttcttagcacttccccctcaacttgaacccaaacatccttatcccattacaagcaagaaggaggtcactgctcttgccaaggaaactagattatctctagcggagtctagaagaaaatatgagtttgcattgaaagctaaacaagctgagttgaaagagcttaagagacttcaatctgcagttgagaatggcattgaagatgaacaacaagctactaagtggctacttccttcaagatcattgcctccctctattccttctcaaaatgttcttgatcctgagatgcaaagtctacttaagctctggaaggaaagattcatcaagattgatcctttctcttatccaacctgggacaccatacatgaagaggagcagcatcatctaccaccaaagcgcaaagtttatcctcttggcacgatcatttggaagagtagagaagcttcatatgctaatacacccttttctacttctatggatttacaacaattaatgggtcttctatgcacattcagcgttgttcttccatgggatcactttcagtctgacatgaccttccagactgaagatattttgttggttgatcctgaagctagtccatatttccctaactag

SEQ ID NO: 109223 - DNA, 462 bp, Glycine max
  Peptide Sequence Number=SeqID_226001
atgttgatcccacttaaagaagttgacttagacattgatgttgcgtctagttccatggttgttcaagtgtacgatccttcaccttctcgcaactatgttcaactacataagaaagaacttatcaaaactagagaagccttgaaggatcattcctttgctaagaatagggctcataaatggtctttaattggagacttcttttacaagaaagcatatggatggaagccttgtcgctcttctacacctcccagtagcccccttaccatctcttttgattttgaagactttggtgatgagttcctgaggaagcttgatgaagaagctgccaaacaaaaaaaggagaaaaatgtaaaatttgaaagctctctgggcaaaagaaaaatgtcaacgtttgaaggaagcacaatccaagggggagctcctatgggggagattgttgagtcaaaggacgcttacatctaa

SEQ ID NO: 109224 - DNA, 966 bp, Glycine max
  Peptide Sequence Number=SeqID_226002
atggcaaaagaaatttgggactctcgcagcatcaattatgaaggaataaaagatgttcaacttagaaaagttatcactctgacacgtcactatgaaagttatcatatggaggaaggagaatttgtggatgatatgctcgggagattgcaagtccttctaaacaaacttgaagctctaggacaaaattttaccaaagctcagattaatctacaaatcttaaatagctttcccagagtgtgggaacataaaacaacaactatccaagaagctagaaattttaaaactctggctttggataagttgttaggcattctaagagttcatgaggttcatcttcagaacatggatcatcttccaaaaagaaattttgttgcgctcaaaactagagaaactagctccaaacgtgaagaaagaaagagcccatctagggttttaaaggtacacatgaatgagtttgacgcttcagataacaactttgaaatatccatagatgatgaaatggcccttataagtgaccatggaactgagtttgagaatgctgagttcagatcattttgtgaaaagaatggtattttccacaacttctcctcactgagaactcctcaacaaaatggggtagctgaaaggaaaaatataactctccaagaaatggctaggaccatgctctatgagaactcacttcctaagcacttatgggtagaagcaataaacacaacatgttatgtgcaaaacggaatattgattagacctttcatcgaaaagactccttatgaactatggaaagcaagaagatccaacatgtcatactttcatccatttggatgcaagtgttttatcctaaacactatggatcaactaggcaagactttagtcatggaagaatctattcatgttaaattcaatgatgaactaacatttggtaggaagttattagatcttgaggatgatattcatatatgcagatag

SEQ ID NO: 109225 - DNA, 1253 bp, Glycine max
  Peptide Sequence Number=SeqID_226003
gtatgaaagttttagaaacaaatgaaaaggaattggtcatggaacaagttatcaaatgggctggtaatccaaacatagtggtgtccttgtatgtgtcatctttgaagatcaccattcagttggtagacttgcaaatatttgcagcaccacggattactttaagacctttggtgcctacatttccatgttttgcaaatattgtggtatctttgatggagaagcctcatgtggattttgggatgaacgtatcaggaggggacatcatgtcaatacctggtctctatagatttgtacaggaaacaataaaaaaacaagttgcaaacctctatctctggcctcaaaccctggaaattcctattcttgatgaatcaacggtggcaataaagaagcctgtggggatattacatgtgaatgtggttcgtgcacaaaagcttttaaagatggatttgttgggtacttctgatccttatgttaaactaagcttgacaggagacaaacttccagcaaagaaaaccactgtcaagagaaagaatttgaatcctgagtggaatgagaagttcaagattgttgtaaaggaccctcaatctcaagttctccaattacaagtttatgactgggacaaggttggtggacatgacaagctgggaatgcagttagtccctcttaaagtgctaaatccgtacgagaacaaagaatttatacttgatttactcaaggacacaaatctcaatgaaactccacataagaagcctagagggaaaattgtggtggacttgacttttgttcctttcaaagaagatagtaacaagtttggtggaccttcagaaggatatagcaggaaggaaagtggaattgatattgtatccgatgatgaggtccaagaaggagcaggtttgctttcaattgtgatccaagaggctgaagaggttgagggggaccatcacaacaacccatttgcagtgctgacctttagaggcgaaaagaaaaggacaaagacgatgaagaaaactcgacacccgcgttggaatgaagaattccaattcatgctagaggagcctcctctacatgagaagatacatattgaggttatgagcaagaggaagaactttagttttctgccaaaggaatcattggggcatgtggagattaacctaagagatgtggtgcacaatggtcgcattaacgataagtaccatctaataaattcaaggaatggagtgatgcatgttgagataagatggaaggtggtttaa

SEQ ID NO: 109226 - DNA, 480 bp, Glycine max
  Peptide Sequence Number=SeqID_226004
atggggttcttgagcagtttcttgggggtttttggttttgccgttggaatacctcttggcctcttggttgggttctttctctttgtctactcagaaaccaaacgtgtcaaggaccctgttgttaggccaattagtgaattaggcccaaattctctgcaggaacttctgcccgagattcctctctgggtgaagacgcctgattatgaacgagtttatgatgactacgatgatgatgttactgtgttattgatattatttttgcatgttattcaggttgattggttgaacaagtttttgttggatatgtggcccttcttagacacggcaatttgtaagattattagaagcacgactcaaccgatatttgctgaatacattgggaagtatcagatcaaagcgattgattttgatgagttaagccttggtactcttcctcctactgtctgtgacatgaacgagaagcagagaaggttgtgttga

SEQ ID NO: 109227 - DNA, 184 bp, Glycine max
  Peptide Sequence Number=SeqID_226005
atggcatatattttaatgctattggaggcaatgtcaaagggaatgttgttcgtgaatggaaaactttgccaggatccaaagcttgctaaagctgaagatttcttcttttctggattgggacccggagatacttcaaacccactaggatcaaaggtggcagctgtcacagtcaatgaaatattag

SEQ ID NO: 109228 - DNA, 489 bp, Glycine max
  Peptide Sequence Number=SeqID_226006
atgagaaggaggattggtgaacctttctctagatacaccattggtaacattttgtggccagtgatggtgttttctgaaacagtcaatgcagacactagtgttagatatttggtcagcattgccagggagaaatttggaaagctttcaagggagttgtttttaagagtgaaaagtgatcctaatatcctagggagcactcagtgtgtggatctgcctcaaggtattgaaacaataagtccaattccaattgtgctgacaagttggtgtggcttgaatttcagtgaactagattttggttttgggaagcctttgtgggttggtgttagaggaggggatcaggaaactctccccaatgtagctgttatcatggaaacagatgaaggcatggaagcttggttgacaatggaaatgcaacatattgctaacttggaaagagacgttgagtttctcagattagctttgcctaatcctagtgtttcaaacatctag

SEQ ID NO: 109229 - DNA, 336 bp, Glycine max
  Peptide Sequence Number=SeqID_226007
atgatctccttttataaatctgttacctgcaacgacattgatgttggaatagaattccttcaccaagggcacatcaatgctcttctatggcagcttggtgagcttcctatcttagtgcctcctctggagctcctccaagaactcatcagagtgagtgtaggccaactccacgtccctctccggaaggatgtttcagagatgaacgttgtcgatgtatttatgctaggcgaccttcgatgtgaacttggtggaatccccgactggttttgcttcctaagggtagctttgagatgtggaggcttgacatttcttagagatcatctacaaaaagaatga

SEQ ID NO: 109230 - DNA, 549 bp, Glycine max
  Peptide Sequence Number=SeqID_226008
atggaatattccaaggaaattcatagcaatggcaatgcaaatggttcattgaacctttgcaatggtagcacggacccacttaactggggcatggccgcggaagctttgaagggtagccaccttgatgaggtgaagcgcatggtggaggactaccgtaaccccgtggtgacgttgggtggcaagagcctcaccgtgtctcaggtggcggcggttgccacccaccaccacggcggagttacggcaatgcaaatgggtagccaccttgatgaggtgaagcgcatggtggaggactaccgtaaccccgtggtgacgttgggtggcaagagcctcaccgtgtctcaggtggcggcggttgccacccaccaccacggcggagttacggtgaagctggccaaggagacccatcgcggtgtcaaggccagcagtgactgggtcatggatagcatggttaagggcactgatagctacggggttaccacagggtttggtgcaacctcacataggagaaccaagcaaggtggtgccctccaaaccgaactcatcaggtga

SEQ ID NO: 109231 - DNA, 177 bp, Glycine max
  Peptide Sequence Number=SeqID_226009
atgggggccgatgggttagttgagaacgtgaggtggccgttggatcgtcatgggaatggagggctgagattgtgggacgtggatgtgggtgaagtgtggtggaggcagtgctgggtccaagttattgagcgtggtggtttcagtttactggtcaatattgaggaaaaggacaggtaa

SEQ ID NO: 109232 - DNA, 2136 bp, Glycine max
  Peptide Sequence Number=SeqID_226010
atgggtagtgttgaaatccccaattggctgaaagggttgcccctggctccggaatttcgccctacagacactgaatttgccgacccaattgcttatatttcgaagattgagaaggaagctgccaactttgggatttgtaagattatcccaccgtttcccaaaccttcaaaaaaatacgttttttccaatttgaataggtcactcttgaagtgccctgattttggtccagataatagttcattaggtgtttgtaattcatcgaaaaccagttctggggatggtagtagtgacggggtgttgcgagccgtgtttactacaaggcatcaagaactggggcagagtcagagtgtgaaaaaagccaaagggacagttcagaatccactgtcaggtgttcataagcaagtatggcaaagtggggaggcttatactctggagcagtttgagtctaaatcgaagtcttttgcgaaaagtgtgctaggatcggtgaaggatgtttctcctctggttatagagtctatgttttggaaggcaactttagagaagcctatatatgtagagtatgcaaatgacgttcctgggtctgcttttgaagagtccaagggtcaatttcattatagtcatagaaggcaaaggaaaaggacttattataagagtaggctagatagctctgattgtaaacaaactgaaacgggttgcgtaagagatacccaaaccgatgagaccaaggttgcttctgtccaaagtcattcggacacatgtttgcagatggccaaatcaagtacaactgtgtcaacattttcatcaaatgatgattcacaatcttctaaggaaaagagttcagatgccagcaatgaaatgcaaggcactgctggttggaagctttcaaacagtccttggaacttgcaagttattgcacgctcgtctggctcactaacacgttttatgcctgatgatattcctggtgtcacgtcacctatggtatacattggtatgctgttcagttggtttgcttggcatgtagaggatcatgagcttcacagcatgaattttcttcacactggctcatcaaagacctggtatgctgttcctggagattatgcctttgcttttgaggaagtcatccgcactgagggttatagtggtaacattgatcacttagctgctttgaaacttttgggtgagaaaacgactcttttatcacctgaggtaattgttgcatctgggattccttgttgcaggttaactcagcaccctggtgaatttgttgtgacttttccaagagcttatcatgtaggattcagccatggtctttctgcaatttgtgctacagagatctgtttgacatgtggttttaactgtggggaagctgctaactttggaactccacaatggcttagagtagctaaggaagctgcagtacgcagagctgcaatgaactatcttcccatgctttcccatcagcaactgctttacttactgaccatgtcttttatttcaagagtgccaagaacactattacctggcgtgcgtagttctcgtctaagagaccgtcagaaagaagagagggagtttttagtaaaacaggcttttatagaagacatgctgcaggaaaacaagcttctatccattcttcttgggaaggaagcaactaaaaaagctgttttatggaatgctgatttactgcctgattccagcaaagattttcagttgcctgatttaacttctactactggatcctctatggcacatatgtcaaatattagttctgcagaaaagagtggtcattatctgcttgatgaaatgagtttgtatatggagaatttgactaatttagatcttggtggtgatgatcttccatgtcacttccaaactgattcaggagcattggcttgtgtgggttgtggaatccttggttttccatttatgactgtgatacaaccaaccgagaaattgataatggaacttcttcctgataatcatctagttcaagtttcctctccagactctactgcttgcgttcatagttccatctcaagtttttatgccttttttgtgtttagtggtaaaattgagcttgtcaactactatggatgtgcgaaggtagatgaacaacgccttatttcttctatgaaataa

SEQ ID NO: 109233 - DNA, 357 bp, Glycine max
  Peptide Sequence Number=SeqID_226011
atgccgtatattgactatgtatttgtttatggggttgaggctagaaccttttcacaggcgcatggctggaagactgataataatgttatcattcaagatccagttcttcccgttgtactggctgaggatggaaagatcaaattattctcagctgttccactgccaaaagagaagattgtggataccaatggagtagcggacgcatttgttggtggattcttgtcacagctggttcaagaaaaggccattgaggagtgcgtgaaagctggttgctatgcagcaattctcatagtttgtcttgtgtcacacccagtgtgtaagatcagcatggcccttccaaaatggcctaggatgtga

SEQ ID NO: 109234 - DNA, 288 bp, Glycine max
  Peptide Sequence Number=SeqID_226012
atgaagctcaaacttctcaaatgctgcataagggaattttataaattcattagaaagtcacactcatacgtacccaaagatgtcccaaaaggtcacctagttgtctatgttggtgaggattgcaagagatttgtgatcaaagtaggtatgctcaaccatccactcttccaagccttgctggaccatgcagaggatgtgtttggattcaccaatgattctaaactccgtatcccttgcaatgagaacattttccttcttgttcttcacaatgctggtgatcttgtctag

SEQ ID NO: 109235 - DNA, 273 bp, Glycine max
  Peptide Sequence Number=SeqID_226013
atgtcaagtggatctcttggacatgcttctttgtcacatctgaaaaacatcaaaaccattgttatctcagaagatgaagatgctcatgacctaaaaaaatgttccactttcgtcatggggaagttcaattgtgaccataaaaaaaataaagacaaacctttcatgagtaactacaacaaggttattcacttcaagggaaaaatacctatggaagcaacattgccacctcagaagctgacttatagtgttggtagctcagttggaagaccttaa

SEQ ID NO: 109236 - DNA, 2537 bp, Glycine max
  Peptide Sequence Number=SeqID_226014
ttctgttggctcaaggtggtcagcctaaaaatttgggtggcgggttttcggggttgtgtgaggatgaggtggaggttgacccctttttctgtgctgtagaatggggtgatattagcttgaggcaatggttggataaacctgaacgatcggtggatgcctttgaatgcttgcacatatttaggcaaatagtagagatcgttagtgtagcacattctcaaggagttgtagttcacaatgtgaggccttcctgcttcgtcatgtcatctttcaaccatatctcgtttattgaatcagcatcttgttcagatactggatcggattctttaggagatggaatgaacaaccaaggcggtgaggttaaaactccaacatctctctgtccccatgatatgcatcagcagagtttgggaagtgaagattttatgcccatcaagacttcaaccacccctgctcggtcagattctagttgcatgctgtcgagtgccgtgtatgcagctcgtgcatcattgatagaagaaacagaagaaaataaaatgaaagataggagaaaggatgaagaagtagaaggaaagaagcaatcatttccaatgaaacagatactactaatggagatgagttggtacactagtcctgaagagggtgctggtgaatctagttcttgtgcttcagacgtttatcgattgggggttctcctttttgagctattttgtccgctcagctcaagagaagaaaagagtagaaccatgtctagccttagacacagagttcttcctccacagttacttctaaagtggcctaaagaagcttcattttgcttatggttactgcatcctgaccctaagagtcgtccaacacttggggagttgttgcagagcgagttccttaatgaacagagagatgatacggaagaacgtgaagcagcgatagagctgagacaaaggatagaggatcaggagttgttgttagagttccttttgttacttcaacagagaaaacaggaagttgctgagaagttgcaacatactgtctcttttctgtgttcagatattgaagaagtgaccaagcagcacgttagatttaaagagattactggtgctgaactggggagtgatgagcgttcagcatcaagtttcccatccatgacatttgttgatagtgaggattctgcttttctagggactagaaaacgagtcagactagggatggatgttaaaaacattgaggaatgtgacgatgatgtaggggatgatcagaaaagtaacggaagttttctttcaaaaagttcacgactaatgaagaactttaagaaacttgagtcagcttactttttaacacgatgtagaccagcctattcctctgggaaactggcggttagacatccacctgtaacaagtgatggtagagggtctgttgtcgtgactgaaagaagttgcatcaatgacttgaaatctaaagagcagtgcagggagggtgcaagtgcttggataaatccttttcttgagggtttgtgcaagtatttatcattcagtaagctaaaggttaaggctgacctaaagcaaggagatcttttgcattcttccaacctagtatgctcactcagctttgatcgtgatggagaatttttcgctaccgcgggtgtgaataagaaaattaaagtgtttgaatgtgattcaataataaatgaggatcgtgatatccactatccagttgtggagatggctagcaggtcaaagttaagcagtatatgttggaatacatacatcaaaagtcaaattgcttcaagcaactttgaaggtgttgtacagttatgggatgtgacaagaagtcaagtaatctctgaaatgagggagcacgagcggcgggtgtggtccattgatttctcatcagcagacccaacaatgttggcaagtgggagcgatgacggttctgtcaagctatggagtatcaatcaggcaattccatttttgcacttgggagttagtgttggtaccatcaaaaccaaggcaaatgtttgctgcgttcagttccccctggattctgctcgtttccttgcttttggttcagcagatcaccgaatatattactatgatcttcgcaaccttaaaatgccactttgtactttagttggacataacaagactgtgagctacatcaagtttgtagacactgtgaaccttgtctctgcttccacagataacactttgaagctttgggatttgtctacatgtgcatctcgagttatagactcaccgattcaatcattcactggtcacgcgaatgttaagaactttgtggggttatcagtatctgatggttacattgccactggttcagagacaaatgaggtgttcatataccacaaggccttccccatgccagcattgtcattcaagtttcagaacacagaccctctttctggcaacgaagtggacgatgctgtgcagttcgtgtcctcagtctgttggcacggccagtcatcgtccaccttgctcgctgcaaattccacagggaatgtcaaaattctggagatggtttaa

SEQ ID NO: 109237 - DNA, 141 bp, Glycine max
  Peptide Sequence Number=SeqID_226015
atggcccagcatgcgaccagacacaacagtgcggtgtgctggttctattgtcgagatgagaccaatgacttaaggcccgacgcggagcgcggtgcactgattttgttgcttcttttgttccattttgcttgtgtcaataag

SEQ ID NO: 109238 - DNA, 1152 bp, Glycine max
  Peptide Sequence Number=SeqID_226016
atggatcttgtctcttcaattcactccatcaattcactgtttttctttctcccatctcatttacgcccaaaccaaactgagccgggttttgtggagaggaaggcttctcctgctccagcgccggctaggcctgtgcttcctcgtttcgcttatttgatttcaggctccaaaggtgatttggaaaagctttggagaacccttcatgcactttatcatcccctaaaccattatgttgttcatatggaccttgagtcgccgcttgaggaaaggatggagattgcacatagaattgaaagacaacatgtcttcgctgaggttggaaacgtttttgtaatcacaaaggctaacatggtcacttaccgaggaccaacgatggttgctaatactcttcatgcttgtgccattcttctcaagagaagtaaagactgggattggtttattaatcttagtgcttcagactatcctcttgtgacacaggatgatttagatagaggccttaacttcattgagcacacaagtcggttagggtggaagtttgataaacgagcaatgcctttaattgtagaccctgggctttacatgtcaaccaaatctgatgtattttgggtcaatccaaagagacctttgccaacagcatttaaattattcactggttcagcatggacggtattatcacacgactttgttgaatatattgtatggggatgggacaatctgccaaggacccttctcatgtactacactaattttctgtcttcccctgaaggctacttccagactgttgcatgcaatgcgccagaatgggctaaaacccttgtcaatagtgacttgcattacattgcctgggatgtccctcctaaacagcaccctcacgtccttaacatcaacgacacagacaaaatggttgaaagtggtgctgcctttgcaagaaaatttaagcaagatgatccagccttggattggattgataaaatgattctccgcaagagaaatggactatttccactcggtggttggtgcaccggcagacccaaatgctccgagattgggaacatttataaactcaaacctggtccgggatctcaaaggcttcatcgccttgtcgcggggctaactttgaaggctaaatctggtgaggatcagtgtaaatag

SEQ ID NO: 109239 - DNA, 348 bp, Glycine max
  Peptide Sequence Number=SeqID_226017
atgtgccttagagacattaggcataacaaatttgaagattccttgataggaacggtagagacaagtttaggacatggtccagtctacttcaattgctatccaaacaaaatagtgagtctgatggacagaaacattcttgactctctgttcttaaacatccactttcatggccttgacatgaaagaaggatcaattccagcagcactaatctataggattcagtacaaggtcatgaatacttgtgcatcaagattccttctgaaaccacaaagaggagagacaaccttgtttatcatcgatatgacaaaggccaatgtttctcttccaagaaccataaaatgggatgag

SEQ ID NO: 109240 - DNA, 318 bp, Glycine max
  Peptide Sequence Number=SeqID_226018
atgaggctaaatcttgaagtgctaaaaggagcaatcgtgctaagcggaccttgtgggctcagtgcacatccaccgctaagcgcagcttcactcgctaagcgagacgtttgtctcttgccagactcaacgcacgactggcgccaagcccaaatccacttactcacgctaagcgcgagggtggcgctaagcgtgacgttgcgatttcagagcctatttaagcctgaattgttagaattagggtacgattttaaaagaccagagctgcataagaagaggaggagggactgtgcagagaagcctagggttctacatttttag

SEQ ID NO: 109241 - DNA, 921 bp, Glycine max
  Peptide Sequence Number=SeqID_226019
atggctgttacagcctctagctttggaactacatggtgtcttagaagagcagctcaggcttttgctatctctcattctcatattctccgcaacaatgttaaactctctttgcagaggaacttttgctctcatcttctctccgtttctacttctttagcttcaggtgtaagccagacagtacaagctctaaagggagaagttgacttgttactcaaaggagtaggagaaagaagtgtaacgaaagaagtaaaacatattcttgagatggctagacgagcatcattaaagcgagagattctccatacagattttctaacccctccagtgttaaaggaatctatgcaagttttggaaaaactagcagacgtgaaagcaattgctcaaggaggttaccctcaggctgaacgttgtcggatttctgttggacatccagaagaactgaccagtgatccagatattatttcagcattaagcattacaggaaacttccagtttgaaccttgctcgcatggtgacttccttggctcaattcttggtacaggaattgtcagggagaaacttggagacattatattgcagggggaacagggtgctcagataattgttgtacctgaactcgttgaatttctcatgtcaacactggttaaggttcgtaatgttcctgtatcttgcactaagattccattaatttctcttgattatgaaccaccaagaacaaaatcattcaaaactatagaagcatcactaagagttgatgcactagctagtgctggatttaaagtttcacgttcaaagctagttgacatgatcagctccaatgtcatctcaactcactataatcttctaaccttgatccctcaagtgatagaagctaaatcacttaaccccactcctaatcccttaggaagtgcagttaaatga

SEQ ID NO: 109242 - DNA, 315 bp, Glycine max
  Peptide Sequence Number=SeqID_226020
atgcctcaatactcatttcaagttccttctagaccaaatgtttttgaaggactctcacaaggcctctgtaccactttaaacactctgccatctgcatataatgcaccaacatcgaccttgtattaccgtccatcattacctaatgaaatgcatgacatgggtgatgaccatgtggacgaatatggtcataacaacaataccaataataacaatgatgcggatgatggtcaaggtactgaacatgttggtgaacaacaacaaccaattagttgtcaccatcctagaacaagaggaggaagaactcgtacaagatga

SEQ ID NO: 109243 - DNA, 510 bp, Glycine max
  Peptide Sequence Number=SeqID_226021
atggagtccatgggacttccatgtgatcataatgtttctattctactttgtttaaatattacaaactttcctaagtcgttgcttgctgataggtggttgaagtatgcaaaggaacccataaaaggaaagtacccagatgcatcatcatattgggaatcagaagatattgctagatatgcaacattgttgttgaaatcaaaggacataaatgcaggtcctgaaaatgaaatggacacagaagtggaaactaaaaatgcatttgatggtgttttggatccttctgttgtacaagcaaagggatgtggtcaaacaatgaataatgaatccgatagtcggaggaggatacaaacatgtgacatttatggagcaactgatcacaacagacaaaaatgtagtgctggctcccaaaattcacaacatgtagttggtcggggtggtattcctccaagtcaacaaacatgcaatgcttctaaagcgatggatgagtataattatcatttggttagttga

SEQ ID NO: 109244 - DNA, 396 bp, Glycine max
  Peptide Sequence Number=SeqID_226022
atgatagcaatatgcataggtgcagtttctgttggaattcttgttcattcaggtggtgtggatgaatcttcgaccttacagggtgaggagggggccccgccaatgccggtgcaaggtcctgctttttacatagatgatctggcacctgtgctgcccaggaagcttgagtgggctgggtttgtgttgaattccaagttgctttggaaggatcttgatgataagccggagtggattaaggatcttgaagtgttcgatggggttgatgatatagagagtccactgtatctgctcggggacacttctgtggttgaaccacttggaagttgtggccgccaggttttgctttggtggctgcgggttgaagctcgcacagacagcaaattccctgctcagtga

SEQ ID NO: 109245 - DNA, 126 bp, Glycine max
  Peptide Sequence Number=SeqID_226023
atgggattcaggggggatcatgttgcaagtgtgatccagaggatggaggagagtggacaggccattgatttcaactcggtacttgacagagaggaggatggtcagggtgatgaagaacttttctga

SEQ ID NO: 109246 - DNA, 171 bp, Glycine max
  Peptide Sequence Number=SeqID_226024
atggaatatggagaagattacatgaagcctgatacagagacatacaattgggttattcaagcttatactagagctgaatcttatgacagagtacaagatgttgctgagttacttggcatgatggttgaggatcacaaacgtatacagccaaatgcgaagacccatgcgtaa

SEQ ID NO: 109247 - DNA, 273 bp, Glycine max
  Peptide Sequence Number=SeqID_226025
atggtggtaacggtggcgaagtttgtgccaacgacaatgatgacaacaatcatggttttaaattgcagtccgcaaccgcaatgtcaaggctcaccacaatgcgaccgcaaccgcagtggtgggaatagtggcaacggtgatggttacagtgatagtggtgccaacgacaacaatagtggtgatggtaatagtggtagtggcaacaatgatcatggtggttacaacattggtggcgtgacggcaacagccgcattaatggaggtcgcacattaa

SEQ ID NO: 109248 - DNA, 996 bp, Glycine max
  Peptide Sequence Number=SeqID_226026
atggctagttgtttagtgtgttgtatcatagtgacaagcttgtttatgtctctaagttttgcttctgctcaacaagggagggctttcttcgtttttggcgattcactcgtggacagtggcaacaatgatttcttggctaccactgcacgagcagatgcccctccttatggcattgacttcccaacacacagacccactggacgcttctctaacggccttaacatccccgacataatcagtgagaaccttggcttggagcctactctgccgtatttgagtcctctgcttgtcggagagaggctcctagttggtgcaaattttgcatcagcagggattggaattctcaatgataccggatttcagtttgttcaatatacgggaccaaagctgaacatcattcacatctacaagcaactgaagctattcgcacattaccagcaaaggttgagtgcacacattggtaaggagggagcttggaggcatgtaaaccaagcactaatcctcatcacacttggaggcaacgattttgtgaacaattattacctggtcccgtattcagtaagatctcgccagttttctctcccagactacgtgacctatatcatatccgagtaccgactaattttgaggaagggccctacatgtcttaagttagcaaatgagtgtgaccatgcaggagacataaaaaatttgaggctgtatgatttgggaggtcgtagggttcttgtaacggggacgggaccaatggggtgtgtgccagcagagttagctttgagaagccgaaatggtgagtgtgacgtggaactccagagagctgcgtccttgtttaatccacaacttgttgaaatggtcaaaggactcaatcaagagattggcgctcacgtcttcattgctgtaaatgcatatgaaatgcacatggatttcgttaccaaccctcaagattttggtacgatttgttacatcaaagatagcttgttgtgggcaaggcccgtttaa

SEQ ID NO: 109249 - DNA, 288 bp, Glycine max
  Peptide Sequence Number=SeqID_226027
atggtggcaatcgtggtggcgtcaagagcagcagtaatggtggctgcagtggcgaccgcaataatggctgtcagtagtagtttggccagcaacaaccggagcaccagtagtggcctaccgggcaatagcagtggccatagatgccttaggctcttccacattgctcatacccctcatccaatggcccaccccttttctcacattggctcagacccaattttcagcaagcccaatagcgccaaacaaacatccttaggacaaaaccaccataggactacacggtggtaa

SEQ ID NO: 109250 - DNA, 912 bp, Glycine max
  Peptide Sequence Number=SeqID_226028
atgggtattattattgggagaaagagaaggtgctcctgttcagctcctcgtgaggaccatcatcttctccttctcactttctttgttgccatacttctacaaaaggctgtggttgaatccacgacgctaaattacacgaggcataggcaaaccagtacccttagacttgaaaggattagtaagcacttgaacaagatcaataagcctcatgtgctcaccatagagagtccagatggagatcttatagattgtattcacaaaagaaaacaactggctttagatcacccccttttaaagaatcacaagatccagaaaatgccaacggagatgccaaaagggatgaaagtgaagaaagaagagaatgataatagtactagtgaggtggcatggcaaatgtggcacctaaatgggacacggtgtcctaagggaacggttcccatacggcggagcacagtgcatgacgtgatgagagcaaagtctttgtatgactttggcaagaaacggtcacgagttgattccctctctcgccgccacgatgcacccgatattctcagcggcaatggccatgagcatgcgatcgcatatacggggtcatcgcaagagatgtacggggcaaaggcaacaataaacgtatgggatccatcaattcaagtaatcaacgagtttagtctatcacaactttggatcctttcaggatccttcgatggcactgatcttaatagcatcgaagctggatggcaggttagtccggagctctatggtgacaacagacccagattgttcacttattggacggatgaaacaaaactaaagaacaaacaaagaatcccgaagacaagcttccaaaactacaggcggaggttgctgccactccctaaccagaacgtgattgcagaagcaccatttggctaa

SEQ ID NO: 109251 - DNA, 204 bp, Glycine max
  Peptide Sequence Number=SeqID_226029
atgggtattttcttctccattgatattgaaaaccggactactccctacgatcagctaacggactggtccattccgcgagctctcaatctccctgacggggcactgaggattgttcccaggcccaccatagtagaagtaagtgccccattcgttgctgtagtagctcttgatgtcgtaacagtttgtgttttcggccaaggttga

SEQ ID NO: 109252 - DNA, 1578 bp, Glycine max
  Peptide Sequence Number=SeqID_226030
atggcttctctctcttgctccgccaacgaccttgccccactcatcaacgacaccgccgccgccaactacctctgcgcacaattcgattccatttctagaaagctcgtcgaaacaacctacgccgtcgacaacacctaccttctgttttcagcgtatcttgtcttcgccatgcagctcggcttcgccatgctctgcgccggctccgtcagagccaaaaacaccatgaacatcatgctcaccaacgtcctcgacgccgtcgccggcggtctctcctactacctattcggctttgcattcgccttcggcggcccctccaacggcttcatcggccgcccaaacttccgcctacgagattacccgatgggctcctctatctccagcttcttcctctaccagttggtcttagccatcgccgacgcaggaatcaccatctctcccttcggcgactacagcttcttcctctaccagtgggccttcgccatcgccgccgcaggaatcaccagcggctccatcgccgagagaacacagttcgtggcttaccttatctactcttctttcttaaccggtttcgtttaccccatcgtttcgcattggttctggtcctcagacggttgggccagcgcgactcgtagccacggaaatgttttattcgggtctggagtcatcgacttcgcgggctcaggcgttgttcacatggttggcgggatagcgggcctgtggggggctttaattgaaggcccgagaatcggccggttcgaccgttcgggccggtcggttgctttacgtggccacagcgcgtctttagttgtgcttggtacgtttttgttatggttcggctggtacggcttcaaccctggttcgtttgtgacaatagacaaggggtatgaaagtggagggtattatggtcaatggagcgctatagggaggacagctgtcacgacgacattggctgggagcactgcggctctgacgacgttgttcagcaagcggttattggttggccactggaacgtgattgacgtgtgtaacggcctgcttggcgggttcgctgccattacatcgggctgtgccgttgtggaaccgtgggccgcgattgtctgcgggtttgtggcggcgtgggttttgatttggcttaataagcttgccgcgaaggtagagtacgatgatccgttggaggcggcgcagcttcacggcgggtgcggagcttggggggttttcttcacgggattgtttgcgaagaaagtgtacgtggaggagatttacggtgttggaaggccgttcggggctttgatgggtggcggagggaggctgctggcggcgcaggtgattcagatattggtggtgtgcgggtgggttacggcgaccatggcgccgttgttctatgggcttcataagatgaaactgttgagaatttcgagggatgatgagactgcggggatggatttgacgaggcatggtgggtttgcttatgcataccatgatgatgaagatggttcaagcaggggagtaggattcatgatgcttagaattgagcctgctggtacctctccctctccccccgctgcaccacaagtttaa

SEQ ID NO: 109253 - DNA, 425 bp, Glycine max
  Peptide Sequence Number=SeqID_226031
atgaaactcaccgcaatgcgaaaccaccgcgaacctccgaggaatctcactgccgcccgtcatgacaaagatggagacccagctctagcacctcttcgaccgccttcatgcgccaccgacgttcgtcatcagcaacacggtgaaatgggtcaaccttggaagttcaatttgaggaagcatcggaggagtctgagattttggggttgggaggaacaacaaacgaagaaaccggagagcgttgtctgcaccaaaccctacctggtcgcgcaggtgacgtggctcgaggaccgcccttctccttccaccgttaacggcgacggcaccgtttacatggcatccgcggatgggaggattaaggtttggaggacggaaggcgaggcgaaaggacacaagtttgacggaggtggtggcgcggttggacggtg

SEQ ID NO: 109254 - DNA, 303 bp, Glycine max
  Peptide Sequence Number=SeqID_226032
atggcggagcagccccactccaccgccgtgattcctcctccgtccgcttcattgccggaggaaagtttgcccggcagctctcagacgccgctccggtccggaagaggaggctggagtatccgcgacggctctgccgccattttcagggacgatacctgctcctgcttcgtcgtggtcttcagcttgtggttcttcgtgtcaatgactatgatactgggggtttacgggtccatgaccgtcgtgctgggtccaaaatcatcaaccgttttccaacctagtcccgtgttcgtacaatctgtgaag

SEQ ID NO: 109255 - DNA, 421 bp, Glycine max
  Peptide Sequence Number=SeqID_226033
atggccaacacaatcctaaacctcacaacaattattattctactcatctctttggctctacacaattcccactttgttgtttcttcaactgatatagatcaagatcatgactttaatgaagaggaagaggaagagtatgttctagacactccaataccccatctaggaccaagaagcaggggagagaccttcttttctgctgcaagaagcattgccgcaatgttcttagtgacaagaacaactgcagtgtgtgtggcaacaagtgcaagcaaggagaaagatgctgcaatggggtttgtaccaatgttttatccaatgtgcgccactgtggcaagtgcaacaagcagtgttcacctggagattcatgtgggaatggagtttgtggctatgcatgaaactgatgtaagaaagttattgaaag

SEQ ID NO: 109256 - DNA, 579 bp, Glycine max
  Peptide Sequence Number=SeqID_226034
aggatccccggacttccaccttcaagaagcatagaacatcaagttgatctccttcctaaagcttcattgcctaacaggccaacttacaacagcaagccccaagagactcagcataaggatgcacatgccaaagttgagtatgtgaaaagattgtatgaccaagtgaaggtgcgaattgcaaagaagaatgaaagctatgccaagcaagccaacaagaaaaggaaggaagtggtacttgaacccgatgatgatcctgtacatttgagggcaaatgttttccaagaaggagggaatgatgagaatcctgaaactggccaaatgcaggctaaaggcccaagtggagaaggatgggtaattgaccctcctctggacatcactatcccatcaaaacacactccatggccagatgctcctcctcagctcccaatcaatgaaaaggagctaattgccacacaagaacggacgaccaagcattctacaaagacaaaaatatctagatcgcgttgcagtcgaagtaaaagaaagcatgacaccaaagtgataggtgtgcaagtctctacacattctgaacaaaactga

SEQ ID NO: 109257 - DNA, 276 bp, Glycine max
  Peptide Sequence Number=SeqID_226035
atgacggaggtctcacatggtctgagcgcgacagtctgcacgcagcaacgacgtgctttgcgtgtgaagatgaaggtccaacaatggtgtttggtttgcttgcagagcagaaaacgtgaaggagaagaagaagatgatctgtttgtgtttggatggtgggtcgcacccaattgcacgtgtccgacaatccaatcgtgtctgacgaactcagacacacccaacacacatcacgtcgcacatgagtcgtgtctaaatctatattcggtacaattctga

SEQ ID NO: 109258 - DNA, 267 bp, Glycine max
  Peptide Sequence Number=SeqID_226036
atggagatgaattggggactcaagatagcggaggcagctggcacttgccctgtttgtcgtaggaacatgaagaagctaatggtatctgctggtgagggtcgtattgaccattgccgaaatacctgggaaggtgtgtttccttcaaaggaaggaagaagaggggaggcaaagagggatatcattgtttggtttggttcaagaaaacgggagaagagagggaaaggtcaccttgtgtggttagtaaggagagaagaaaaatatggatga

SEQ ID NO: 109259 - DNA, 1116 bp, Glycine max
  Peptide Sequence Number=SeqID_226037
atggaccaagccatacaaaaccatgagtctatgacaataattatgcccaatgaagatgttagtttacctgttttccagatgaaaacgaacacaggaacatcaaacgcactaaagaaagtcatcacaaaagcaatgcaaaatgccttcgtgattgagtacctgcacgaaccagaacttgaactcggggaggcggcgaacgaagggacgaaattcgtcggaagcggtggaggggagggccgtacgaaacgacgtagaagccttgcaccaagtacacgcgcagcgcgtacaaaagcgcaaccgccgcgaaccccagccaccggcgtcccacgtgcggcgtcgatttatccagcaggtgctggaactgccgccacgccgcaaacttccaccgcgacatggtggctgtcggtgacgatgctccgcctcctccgccagtatccatcatcggtgggacccgctctgaatatctggctccgagtttgggcacaagaaaaagagaattgtgttgaattcctgggggagaacaagggagaacatctggtaactcaactgccgcctaagcccacggaggtcgtaggaggtgaaggagcaatgagggttgttgacataagctttatgtttgggcacaagaaagagaattgtgttgaattcctgggggagaacaagggtgaacatctggtaactcaactgccgcctaagcccacggaggtcgtaggaggtgaaggagcaatgagggttattgacataagccttatggggggagattacgggccatggttgactgttaaacggaattcaaggaagaaaagggtcaatggcggcacgggaaaggagttaggtaacggtggaaaggataaagaggtgcatgataaggaagcagaggtggtcgtggtggggtccacaaagcatgctgagaaagaacacatgaacaagcctctagtagtaaagttgatcacgggaagctctacccatgagaaagggtttaagaaagatgcaacacctaccattaaatacagggagaaggcaaaggaagctctagagacgcatatagaaccaaagataacgagagtattagcagaaaaagaaatattttggtatcagaaatccaaggccaaatga

SEQ ID NO: 109260 - DNA, 720 bp, Glycine max
  Peptide Sequence Number=SeqID_226038
atgatggatactggcggaggaggcggagcatcgtcaccgacagccaccatgtcgcggtggaagtttgcggcgtggcggcagttccagcacctgctggataaatcgacgccgcacgtgggacgccggtggctggggttcgcggcggttgcgcttttgtacgcgctgcgcgtgtacttggtgcaaggcttctacgtcgtttcgtacggcctcggcatatacatcctcaaccttctgatagggttcctctcccctcaggtggaccccgagaccgtgattctcgacgccgacgtccccaccctcccctccaccgcttccgacgaatttcgtcccttcgttcgccgcctccccgagttcaagttctgccaagatgttgaagtttgtgggttatctgcgctgccattgtggccggatttggctacaattttttgtgtggtgttaaggattgtgatgaaatggcacgtctgtctgcaaccgcagcaatttaaaaccttggtgttttgtatgataattgctggtgcctacttggcactgacagtgcagagtaggaaagggagactgcgttgtgggcaaatagcgaagtttcatagccattgcaaattgaaatatagacataatatgaactcaaaagttcatttggcaagacttgccaaaaatgataagagggcacatgccgcaatgacgacattgactgcaatagtggcagaagtcgcaatttgctaa

SEQ ID NO: 109261 - DNA, 564 bp, Glycine max
  Peptide Sequence Number=SeqID_226039
atggaaatagtgttgagatttgtggataaagatgggcatgttcaaaagagattttttgatcttattcatgttgttgatgcttcttctttaacattgaagaaagaaatttcaagtgttctttctcgccattgtcttgatattcaaaatatttgtggccaagggcatgatggagctagcaacatgtgtggtgagtggaatgggttacaagccttattcttgaaggattgtccttatatccagtgtcttgctcattgcctacaacttgctcttgttgcagctgctagagaagttagtcatgttcatcaattattttcaagtttatcattgtttgtgaatgttgtggctgcttctactaagtggcatgaccaattgcaagctccacatgcgacaataatagcaaatttgattgctagtgatgatattgaaacgggtagtggattaaatcaaattggaacattacaaagaaccatagatactcaatggggatctcacttaaattctgtccaaagcctattgatgctacttgtgaagttcttcaaaatgctagtgaagatgatatattag

SEQ ID NO: 109262 - DNA, 255 bp, Glycine max
  Peptide Sequence Number=SeqID_226040
atgcagactctgggttgctatgctctcttcttctcctctccaaccacaagaaatcatttatcatccaaagacaacaattcgaaggaggaagagcatttgagagaggagagtatggaggatgaggtgttcaacgtggagtcgcataagaaacttctagaacatcaattagggtttttgagggagaggcttagacagttcatcaatgatcaagagatacaacaacttcaagaagaacaagaactcattcttggatag

SEQ ID NO: 109263 - DNA, 396 bp, Glycine max
  Peptide Sequence Number=SeqID_226041
atgaaggtcatgccatcgaatgtttgcaagatgttgttgatctcgacattagtagtatcagtattagagaattacataaacatcatttttcaagcttggacaacatctcaagctgaggcacttcacgtgctgattaagaagtttgttggttcacggcaaatggagtatgatttcaattctagctatggcaaccccatgcttgttactagttttccacaacttgagaggtcagttgccaaattttacaccaaggagatatttgcattattcatgaaagtgttgtttagggcatcttggtttagagttattaattttagacatacattaggctacactatttacaaagttatgaaatataaagttattggcaaagcattcatcatatcatcaccataa

SEQ ID NO: 109264 - DNA, 280 bp, Glycine max
  Peptide Sequence Number=SeqID_226042
agttattggaatgagaaacatgtctcgacttcacagcggcgttgatatgagctcatacatgtctcaaggtcacagcagcactgatatgagctcatacacgtttcgagttcataacggcatccacatctcgagacggtgggtcagatttgagttcttgctcaaatctgagagggagctttcgagtgaaggaatgacaaggagtgagtatgaagctgctgtggatggtggtggagacggtagattcattacagcgggtggtgtttcaaatggacaaaattag

SEQ ID NO: 109265 - DNA, 753 bp, Glycine max
  Peptide Sequence Number=SeqID_226043
atgggttccaaacaacgcctacgtggctctgccactgccaaagaacgcctacgctggacacaagaactccatgatcgttttgtggaggctgtaaatagacttgggggccctgagatatgtcttaaacatagggaaaatgggcaacaccaaaaggatatagagaagtataatccagcaattttactttgtgcaaataatccagcacttgactcctacatcaattcaatgggcattaaaaataaatacaggatctccaaattgattccagagtcccccacaagaggaaagcttgagaagagaagcatgtcagatatactgccaaattttagttctataactgctcttcagctaaaggaagtccttcaaatgcagacagggatgcaaaatcgcctgcgtgataaaacagaggttcagagaagtttgaagctaaaaattgaagcacagggaaagtactttgagagaattggacaaagtaatcatagcaaaacaatcattggaaaggcatgcaagccttttgcttcgacaattgcatctctgccttcactttttgaggaatctgaatccttgaaaactcaacctgaggaagagcatcaatcagccaaaaagcaaaagatttcaggagagggtgtttttccaacaagttttgatcatgaatcatccaccccacctgaatgctacaacgaaacctgggatttttcttggagtcaacttgcagcagcatgccaatcacctttggtgcccagtttcttatga

SEQ ID NO: 109266 - DNA, 213 bp, Glycine max
  Peptide Sequence Number=SeqID_226044
atgataattaagaaggacttcatggttaggcaaaaagtgttattgtataattctaggcttggactcatgagtgttgagatcaaaagcgactccacaaacaaaagcttcaaggtcaatagacaccgacttaagccattcctcacaaacctttctttagtggacgcaatggtggaagagacttccttactccaccctacttttcctccaccatga

SEQ ID NO: 109267 - DNA, 483 bp, Glycine max
  Peptide Sequence Number=SeqID_226045
atgaaagataagagggatgaggaagaaaaactagaaaaacaaaagaaaaagaaggatagtaaggccttgtcttcaaaggccaaggggaaagaaaaaaagaaaaggattcctccaagaagattggaaacatcccatagcactggcataccacatgagcttgaggttattcctcaagtaaaggaggtattggatgagggttttgttcgaaagagcttaactccttgtgctttgttggtgcccaaaatagcaccactcattgagttggtgaggaaccatgttcccttgtgggaaaatgcccaggaaaggggttttcagaccttaccctactacaacatgccaaacaccactaatatatatattattattctttttaccggtgttgagggaagaatctctgagtttcaagaacctctgcatttgaggtcaaatccttttcaaggggaagggaatgatgcaatcctacctcccaagggcattggatag

SEQ ID NO: 109268 - DNA, 464 bp, Glycine max
  Peptide Sequence Number=SeqID_226046
atggtttctagaggtatcatccccttcgacaagcatattgcggcagtagggactactagcaacaatatgttatcaaagagaaaaactctagatgagggttcagtgttatcaagcaaatcgaagacccggcatgagcacagattcacctccactccttatgttcccctggacccgggtatagggccccttttcaactcaacgcctaactctctaaaaacagtccccagtggagtcgccaactgtcgcaacctacccttcggtgggagggcgacgcgagggctcacgggtgcatcttccatgggaggaaaatgcgcagagtcgccacccacgtttattcgaggaaaacgtcggaaaaaccggaaaggggaaatgagggaggtggttgccgcccagctcgcccaggcgagctgggttgcttccaccagaaagcaccaccttctgttggaacaccctagaaggtccaa

SEQ ID NO: 109269 - DNA, 1692 bp, Glycine max
  Peptide Sequence Number=SeqID_226047
atgggacaagcaccgtccacgccggtttcttcgacggacctgagtcaccgggatattttcaccaccgacgaatccatcggccgcgactacaccgccgacatccccgacgagtgcctcgccggaatcttccagtttctaagctccgtcgaccggaaaacctgctccgccgtgtgtcggcggtggctgcgcgtggacggcgagaaccgccagcgcctctccctgaacgcgaaggcgagcctggttgacttcgttccgtcgctcttctcgcggtttgactcggtcacgaagctcgccctgcggtgcgaccgcaagtccacgagcgttaacgacgacgctttggtcctgatctcgctgcggtgcaggaatctggtgcggctgaagctgcgcgggtgcagggaagtcaccgagcacggaatggccgacgtggcgaagaactgcacgaatctgaagaagctctcgtgcggttcgtgcgcgttcggcgcaaagggcgtttacgctttcgttaacaactccatcgttcttgaagaggtttctatcaagaggcttcgaggggttgaaaaagataataacgatggcgttgacggcgccgaatcgcttcctctttccgttacttcctcttcgttgagatcgatttgcctcaaggagctcgttaacggccactgtttcgcgccgttaatagttaattcgaagaagcttgaaacgctgaagctgattcggtgtttgggggattgggatgtgactctggaaagtgttggaaagttgaattcagggttggttgagattcatttagagaaggttcaggttagcgatgtgggacttttgggggtttctaagtgtttgaagttggagtctttgcaccttgtgaaaacacccgagtgttccgacgtgggactttgcgaagttgcggagaggtgtaagatgctgaagaagcttcacattgatgggtggaggaccaacaggattggggattgtggcttgatgtctgttgccaaacactgtcctaacttgcaggagcttgtgctgattgctatgtatcccacgtctttgagtttggctgcgattgtttctggttgccagggtttggagaggtttgcactttgtgggatttgtacggttggtgatgcagagatagagagcattgtggcaaagtgtggggcactgaggaagctgtgcattaaggggtgccccgtgtcgaatgctgggattgcggctttggcttcagggtgtcccaatttggttaagctcaaggtgaggaagtgcagaagggttaatggtgaagttgtggagtggctgcgtgagaggaggagttctctggtgtttagtattgattacagtactgaagttgaggctttggatggaagtggtagtgatgttggcgctcaggaaagtagcatggcgtctcctccaatcgacacaacacaagtgtccatggttgatgatcctccttcaagcagtaataatagcagcagcaacaacaacaacaacagattgtctatgttcaggaacaagtttggatttttggctgtcacaactgagaggaacagtctagacccagctgcagctccgtttgctaaaaatccaagagacatagaagggcttactgagggtgctagtataattgaagtggttaagaagattaggtcacatgtgctccttggtttgtctggcgttggtggtatttttaatgaggag

SEQ ID NO: 109270 - DNA, 429 bp, Glycine max
  Peptide Sequence Number=SeqID_226048
atggcgcttgatgcgcgggcgagcggtgagatggcgctgtggacgatgaacggtggcgactggtatcaaactgcctcacaagaacagaaacggttggctgatttgttgtttatccgctgtctggaattgccgctaatcattgaactgcgctgccaggatgataccacccacgtgattgcccatgccgactatccagccagcgtctaccgttggcagttgcccgtggcggagcatcaggtactctggagccgccagcgtttgaccgatcatctggcggggcggcacggtgagatcgccggggccgatcacttttggtttggccatacgccgcttaaacatcgttacgatagcgataaccaacactacattgataccggcgcggtatttggcggcgagttaacgctggtgcaactgcagtcggctgtttaa

SEQ ID NO: 109271 - DNA, 250 bp, Glycine max
  Peptide Sequence Number=SeqID_226049
atgacgaggtatgacatcgtgacggacaatagcctgcattcatcatgcacacttcagcaacgctcaaatttgattgccgatctggtaatggggcgtatcacgcccgcgcctatctggcaaaagcgcaactatcggcttaaatttttgctgcgtacggcactgttctatcagccgacccgcgagatgctggacaccctttctgcgcgtggtgatttccgccaactgctggcggcgcaggctacgctgccag

SEQ ID NO: 109272 - DNA, 1486 bp, Glycine max
  Peptide Sequence Number=SeqID_226050
agggctacacgccctcgcctcgccaacagaggactctacgtcgtcgccttcagtggactacatgtcctcaccttcacagggactacacgccctcaccttcagaggacaacacgtcctggccttcagaggactacacgtcctcgccttaagaggactacaccccctcaccgtcatcagagtacatcaaatcttcgccatcagaggactacacgtcctcgccttcagaggactacacgatgacacttcctcaccttcagaggacaacactcctttgccttcagacggccgcacatcctcgcctttcgaggactacacagggctacacattgtcgcctttagaggactacaggttttcaccttcagagggctacaggccctcacctttagaggacaacacatcctcaccttcagaggactagacttcctcgccttcagagggctacacgcccttgcctcgacgacaaaggactctacgactacacatcctcgccttcagatggctacacaccctcaccatcaaagggctacataccctcgccttgcttttggaggagaatacattctcgccatcagaggactacacgtcctcgcattcagaggactccaggtcctcgccttcagaggactacacgtccccgccttccgagggctatacgtccctgccttaagaggactacaaatcctcgccttcagagtgccacacgtcctcgccttaagaggactacacgtcctcgcctttaaaggactacatgtcctcgccttcagagggctacaagccctcgccttcaaagagctacacgccctcaccatcagaaggctacccgccctcactatgctttcagaggacaacacatcgtcgccatcagaggactacacgtccaaacctttagtggagctacacgtcgtcgccttcagaggactacacgtcctcgctttcagaggactacacgtcatcgccttcagagggctacacgtcctctccttcagaggactacacatcctcgccgtcataggactacacgtcctcgccttcaaaggactacacgtactcgccttcagaggactacacgtcatcgccttcatagggctacacgcccttgccttcatagggctacacgtcctcgccttcagaggattgcacgtcctcgccttcagaggactacacgtgctcagcttcagaggactacacgtcctcgccttcagatggctacacgccttcacctttagagcacaacaaatcctcaccttcagaggaccagatgtcctcgccttcagagggctacacgccctcgcccgacttcagaggactacacgttctcgcattcaaaggactacacatcctcgccttcagatggctacacgccctcaccatcaaaaggctacacgccctcgccttgctttcagaggacaacacatcctcgccttcagaggactacacgtccttgcgtttagaggactacacgtccctgccttcagagagctacac

SEQ ID NO: 109273 - DNA, 885 bp, Glycine max
  Peptide Sequence Number=SeqID_226051
atgcggcgcacgcggcgcccagggctgcccgcgcagttcgccgcgctcaagctgcacggcgctggcgccgaacagcgctttgcacagctcggttttgccggctcccgccagcccggcgatgccgagaatttcgccctcatgcagccgcagcgaaacgtcgcgcagcttgtggcgatcgcgcaagccttgcacctgcagcagcgttcgctcggcgtgcggcgggcgcggcggcgggaaaatatcgtccagccggtggccgagcatcttctcgacgatctgttcgccgctcagcccgcgcatggcgtcttcgctgacgcgacggccgtcgcgcagcaccgtcagccgatcgcaaatgtcgctcagttcgtggatgcggtgggaaataaatacgatgccgatgccttcggattgcaggcggcgaaccacgttaaacaggcgctcgctctcggcgcgatcgagcggggcggtcggttcgtcgagcaccagaaaacggcagcggtgcgacagcgcgcgcgccagcagcacctgctgtttttccgccagcgtgcagtccgccagccgcctgcgcgggttgagcggcaacgcccattgctgcagcagctgcgcggcgcggcggtgcagctccgcccagttcagccagtggcccggttcgttcagccagtccagcatgatgttttccgccaccgacagcgtggggatcagcgcgacgtcgacctcttgctgcaccacgtgaataccgtggcggcgcgcctgcagcggggagtggatcgccaccgcctggccgtcgatcaggatctcgccgcgataatgatcgtgggcgccggagaggatcgccatcagcgtcgacttgcccgcgccgttggcgccgaccagcgcgtggattga

SEQ ID NO: 109274 - DNA, 312 bp, Glycine max
  Peptide Sequence Number=SeqID_226052
atggcttccatgatggatgccatgctaagaatgaggcaactaatggagaataacgcggccaccgttgccgctgttagttcggctgtcgatgcagacccgactctcccagctaccgcgcaccatcctatcccaaacgtgtcggacgaggttcacgaggatcgtagagagcatgcccacggagacatcgattcctactccccggtcctcgtcaaggggccgacacccaacacaccacctcagcccaacctcacgggagaacctcaaaacctcctagcacaaccaatattcttgtccgcagaaggaccaccgccg

SEQ ID NO: 109275 - DNA, 231 bp, Glycine max
  Peptide Sequence Number=SeqID_226053
atgcatatgaaagcagaaattagaaaaaacaaaactgagagggatgctggggaagccagttaccccacaagtgcagatcgagtttgcaaaaaggattgcaatgaatgtcaagtacagattgtagggaagaaggcacgaactcctgcagtacgacattttatggtgcagtggttcttccatgttccatacttagacgtggacgattggggaaggacgtttgcttgtgtttaa

SEQ ID NO: 109276 - DNA, 213 bp, Glycine max
  Peptide Sequence Number=SeqID_226054
atggcttcttcaatcttcatacagacccatatcgtggatgcggcggcgcggagggcatgcaacagagtcacgcgtggaggcgtcgtggggtggcaacagagccaccacgtgaaggtggcggcggcaacaacactgagagcatgcgagtggcgacagagccagtgcgtgaaggtggctatgcttttcacagaggtaccgctgggacgaggatag

SEQ ID NO: 109277 - DNA, 885 bp, Glycine max
  Peptide Sequence Number=SeqID_226055
atgtccagacctctgcacagaggggtatctattcggatccctgatagcaacaacaatgacttatgggactctcaatccaaagataaatcagaaaaggaaggtttggatagaagaggttcctctggtcacccctcacccttgaggtctccctttaggttgcttttttcggataattctaattccaaatacggcatcagtgagaatggtttctcatctgatcccttcattattggcactccaagaagtaggctcaagttggttcttcttttcttgaggtttagtttagtgtttatagttattcttgctcttgctggatctttttggtggacaatatcgatttcaactgcatcaagaggtcacatttaccatggttatagaagactccaagagaaacttgtatctgacctgttggatattggggagatttcttatgctccctcaaggctgaaagaattggaattctgttctgaggagtttgaaaattatgttccttgctttaatgtttctgacaatctagctcttggtttttctgatggaaatgagtttgaccggcaatgtcgtcatgagctcaggcaaaattgtttagttctctctccaccaaattacaagattcctcttaggtggcctactggaagggatattatctggattgctaatactaaaatcactgcacaggaggttctttcttctggaagctttaccaaaaggatgatgatgcttgatgaagagcaaatttcctttcgttcagcctctctcatgtttgatggtgttgaagactactcacatcaaatcgcagaaatgattggactcagaaatgaatctagcttcatacaagctgggatatcatccttaaactatcttgaaggtattttcttcgaacaatga

SEQ ID NO: 109278 - DNA, 2616 bp, Glycine max
  Peptide Sequence Number=SeqID_226056
atgtggctgatgtgccttcaattgcagtcatggacaccccaaaaccttgatggttgtggccgaaattgtgatattgaacccatttttgaaaaccttgatattatgtgtgatttggcgataagaatgtcattgcttcgccatgttagcctactgagtgagtgtgcttgcctggttatctgggctgggtttgacaagttagagggtgagggtgaagttattcagcaagtacttcttctaggctatcgatctggattccaggtttggcatgtcgatgaatcaaataatgtccgagacctgatttcccgacatgatggtcctgtttcttttatgcaaatggtccctaatccaattgcatcaaagagatcacaagacaagtatgcaaacagccgccatctgttggtagtttgtactgatgggttctttgctggaggtaacaatgttcagggtgggtcaaccatcccttacaatgggagcacttcaaactcccatgaccaaataaatggaaactatctgccaactaccgttcggttttattctatgaaatcccaatcatatgttcatgtactgaagtttagatcagttatttattctgtgaggtgcagttctcgagtcgtggcagtttctcaatccactcagatacactgttttgatgctacaacattagaaagggaatatactttacttaccaatcctatagtaatgagttgccctggttctggaggcataggatatggaccacttgcggtgggaccaagatggcttgcatatagtggaagtccaattgcaatctccaactcaggacatgtgtgtccacaacagttgacaccttccgcaaggtttcctggtttttcttctaatgggagattgattgcacattatgcgaaagagtccagcaagcatcttgcttctgggattgtgacccttggagacatggggtataagaaactttccagatattgctctgatagcaatggttcattacaatctgtaaattctggctctaagggcaatggaaccgttaatggccattcaacagatgcagataacattggaatggttattgttaaagatattgtctcgaaagatgttattgcccaattccttgcccacaagagtcctatttcagcattgtgctttgatcctagtggcaccattttagtgacagcttccattcagggtcataatataaatgttttcaagataatgcctgcaagtgggactttgtcagcttctgttgttggtcgttcttatgttcatttgtacaggttgcaacgtggctttactaatgcggttatacaagatatcagtttcagtgatgacagcaagtggattatgattagttcttcaaggggaactagccatctatttgccataaatcctcaaggaggacatgtaaatattcagccctttgatgatagttttacagcaaaaaatagtggattaggcactacaactaatcatgcagtttgtcagtctcatagttcggccatgcaaatgcctaaacagcagagcctgtttgctactggccctccgatcacactttctgttgtaagcagaattaggaatggagctaatggctggagaggcaccgtaagtggtgctgctgcagctgcaactggtaggaaaaatgccctttctggggctattgcttcatctttctgtaactataaaggcaatgaaggcaacttttccaaggcaaagtatcaactgttggtcttttcacccactggttccatggtacaatatgctctgaggacaataactggtcaagattcagctgttgtttctggattgtcccctgcttatgaatccattccacaggctgatacaagattagttgttgaggctatccataaatggaatatatgtcatattcggagagagcgagaagataatgtagacatatatggtgagaatggaatttcagacgttaataaaatatatccagaggaagtgagggagaagatagacaccattagcccaaaaatcaagaatggagtcatgaaagtgaatccctgtcttgaggaggagcatcatttgtatatttcagaagctgaactgcaaatgcatcaagctcagactccgttgtgggcaaagccagagatatattttcattcaatgttgcaagaatctaccataatggatgaagaagcagctgcttcaggaggtgaatttgagattgaaaggattccaacttgcatgatcgaagctagatcaaaggacttggttccaattttcgactatattcagactccaaaagtacaacaaacaaggattcctgctatggatggcaagacaaatgaacaactgttacattacagttctagtcaggtggccggaaatggcaggatttcacccaggactattttggaatcccctgagtgtgtgactaatgctggtgatgctgtttctgaatttagaagtgggattgaaggaactgagtgggataatcatgtggtgccatccgaaaccgtgaactttgtaaataacaatgacacctttagacaaaatactcagcatgagattgtaaataatagaatggagcacttaaacaccggggctcatctcatgtatgtaaatagtgacggaaagcctgaaaatgaagaatcattttga

SEQ ID NO: 109279 - DNA, 618 bp, Glycine max
  Peptide Sequence Number=SeqID_226057
atggatacctcagagccctacactggggcaatggggggcaccgtgcatgagcctcaagtactagtacctatcttcttcagagtactacgcgtcctcgccatcagaggactccacgtccttgccttcagaggactacacgtcctcactgtcaggggattacaagtcctcaccatcagaggacttcacgtcctcaccttcagaggactacacgtcctcgctgtcagaggattacaagtcctcatcattagaggacttcacgttctcacctttagaggactatacgtcctcaccttcagaggactacacatcctcgccttcagaggactacacgtcctcgcctttagagggatacgcgccctcgccttcgaagggctacacacccttatcttaagaggactacatgtcctcacctttagaggactacacatcctcgccttcagaggactacacgccctcaccttcagagggctacactcccttgccttcagaggactatacgtcctctccttcagacgactatacgtcctcaccttcagagggctacatgtcctcaccttcagagggctgcactccctcgccatcagagggctgcacgccctaagcatcagaggactacac

SEQ ID NO: 109280 - DNA, 2028 bp, Glycine max
  Peptide Sequence Number=SeqID_226058
gttagaaccatactggacattggctgtggttacggtagctttggagcacacctctttcagagtcagcttttaactatgtgcattgcaagctatgagccttctggcagtcaagttcagcttacacttgagaggggtcttcctgctatggttgcttctttcacttcaaaacaattgccttacccatctctctcctttgacatgttgcattgtgcaagatgtggcattgattgggaccgaaaagatggcattctcatgattgaagctgatagacttttacgaccggggggctactttgtctggacttcaccacttacaaatgctcgtgacaaagacagtcagaaaagatggaagatcatacaaagttttgctgaaaacctttgctgggatatgctgtctcagcaagatgaaactgttgtatggaagaaaactattaaaaggaattgctatagttcaagaaagaatagttctccccctcctttatgtggcaaaggctatgatgtggagtctccgtattatcgagaactgcaaaactgcataggaggaacacatagcagccgctggatttctgtcaaagagaggcaaacttggccttccagagatcacttgaacaagaaggagcttgcaatctttgggttgcaatctgatgaatttgctgaagactctgaaagctggaaagcagcagttcgtaattattggtctcttctgtcacctttaatattttctgatcatcctaagagacctggtgatgaggaccctccaccaccttataacatgctaagaaatgtactagacatgaatgctcatgtcggtggttttaattctgcattgttgcaagctggaaaatccttatgggtaatgaatgtggtccctctgagtggactcaactatcttcccttgatccaggaccgaggttatgttggcgttttgcacgattggtgtgaggccttcccaacgtatcctagaacctatgacttggtgcatgcagctggacttttatcccttgaatttgctcagcagcgcagatgtaccatgcttgacatgttcattgaaattgacaggttactccgtccagagttcctctccgcccagccggagcacgtcctgcgcctcgacgacgccggcaagctccaccgcgagctcggcttcccgcgcggccgcaaggtctcccgcttcatccagcgccaccccctcctcttccagacctaccgccacaccgacgccaaaacatggctagggttcaccgaccttatggacgacctcctcgcagaggaacgctccctcatggacactttagaactcaaccgagtcgagaaggttcggaagctgctcatgatgtcatcgcgcaaccgcatccccctcagcaagatccaccactgcagaaccctattcggcatccccgacgatttccgcgatagggtttccaaataccctaattttttcagaatcgtggtcgaaaacgacgggaggagggtgctcgagttggtgaactgggacccactcttggcagtgagtgccttggagaaagagttcgttgttgacgaggattccgcgaagaggaagtttaggtttccggtgaagtatgggaaggatttggatttagaattggatgatagtaggaagcttaatttgctcaacgcgcttcctttggtgtctccgtattcggatgggagtaagattgatgggtggacgttggaggcggagaagtatagagttggggtgattcatgagttcttgagcttgacgttggagaagagggcgtcgattcatcaccttgtggaatttaaggaggagtttagtttgactaagcatacttatcagatgctgcggaagcagccgcaagtgttttacttggctggaactgagatgaattggggtgtcttcttgaaggatgcttatgatgggaatggagatttgattgagaaggacccccaggctgtgtttaatgagaagctttataagtatgctcaggtggatcagatggaacccgggtgtgatgatgatggggtggaagtgcagcatttgacttga

SEQ ID NO: 109281 - DNA, 2106 bp, Glycine max
  Peptide Sequence Number=SeqID_226059
atgactgagacaaatattcgtggagctttgaagagctgcggtgtagatatatacaacaactctggccaactctctagtcatatcttccccaactgtagcaggtgtctctcttttttgactggaaagagagagaaaaacaagggtactgaacagtcttccacaggggaccttaatacccaacttggtgaagtactacacccaaagatttcatcagagagtcgtgatttgaagccggccaccgttgatgttacagtacccagtggtgtgcagaagaattcaaggggcaatgtgagggttatgagtctcgagagtcctgtgaagactgaagtggaggaagcttatgaaggggaagatgagcatgaggagtctccttccatcaagagggagctctctgattttgatctccaagtccacgaagctgctgtgatccaaggaagatatcatccatcaagtgaagagataaaatgccccagtttatatgaacaccaagctaacattcaattagaagacagagaccataaatacagcaaaaagagtgatgatataatccaaagtggacatgttagtgatcctgggattggcaaggctgacttttgcgcttctcctaagctcaagcgttcctgctctgacctggaaagaagggatgtactaaggaagacttctcatctctttccgtcttcaaagtcacagtcttttgagaatttgcaggggttatcagcatatcagatggttaatctagaaagccccaggtcagtgatgactcacggcagtgctgatagagtgatgttgaaaaagcattcctcaagtcaagttctcccttctagaagtaaaagattgtggtggaagttgttcctctggagccacaggaatatacatagaatgcagttaggcaaactgaaaacaatacatcctgcaagtgctgctttaaagagtcaatgtgggtactcttcagacactcttgaagcaaaacatggcaaggcattgagacatgtggaattgccctcacccagctcatcttatggggaatactttcacaacagctgcgatgatggaaatattgataagcaaaggtggagcagatttcaaaaagagaattttggtttttggccacaaaaccaatgggtggctttctcaacagaatcatcctcctttagcagagtggatgagtgggtgaaagatctcgaaattcagcagccacctcctgaggatgattttgatgatgacaatattggaaccattgccttcccaccttctcctgatgctatcccacaattcatagcatcctcaagcacagctcagtctgttcgacatccagatgccaatctttcaaaagagatattgaatgccaatagtgtggttcagtccctgaacccagcctcaactgcagctcatatatcaggcattggtataaaagccatcccgtctatttcacacttctccactctccgctctgtcaatttgtcaagcaatctcatagttcacatcacacctggatttctcccaaagggtcttcatactctgaatctgtcaagaaacaaaatcagcaccattgagggcctcagagaattaacccggctgcgggtacttgacttaagttataatcgcatttcaagaattggacaagggttatcaaattgtaccctcatcaaagagctatatctcgcgggaaacaagataagtgatgttgaggggctacacaggttattaaagctaacagttctggacttgagctttaacaagatttcaacaacaaaagcattgggccagctggtggctaactacaactcacttcaggccctgaatctgcttggaaatccaattcaaagcaacatcagtgatgaccagctgcgcaaagtagtttgtggtcttcttccaaagcttgtgtacctgaacaagcaatctatcaagcctcaaaggggacgagaaatactcactgatagtgttgccaaagctgcacttgggaacagcagccggaactcctacagaagagcactaaagaaaggtggtggccaaggagggtcaagttcctccagtgtgcatagaagcagtgctagtgtttcccagaaaagcaggaacaggtcaaggagccgaactaaacatcattag

SEQ ID NO: 109282 - DNA, 937 bp, Glycine max
  Peptide Sequence Number=SeqID_226060
tctggtgcccaatttcgtgactccgagcgacgtaaaaggggaagggaaagggatgaggatttggggatcggagatcgtgttcgccatattgctctgtgggaccctttcatgcaccgctcaagctcatcacatcactgccagcacctgcccggctcgctccatcctcgatttcgtgttagggttttcagatttcacatgccaacttcccaattctcttggatccattgccgtcaccgagtctcaagaattgggagttgactatgtttgtttgcctccgctttttgtatctccttgtggagctgatggagatgaggtttctttgcagaaggttctgaatatggttcacaagaacaatcatgagcacgtggctgtgctcttctatgcgtccttgtgtcctttctcacaggtgtctagaccggttttctccatcctctctgccctgtacccttccattcttcatcttgccattgaagaatcatcagtttggccgagcacactgtccaaatatggtgtccatagtttccctacactgtacatcttgaattctaccatgcgggttcggtatcatgggtctcggacgcttggctcgctcattggtttctacaatgatgttactgggattaggattgattcacttgatgaactatcacttgaggaaattggccgttcatctgctgataagagtcatggtaacagtgagtcagaaagttctccattttcacaggctagatctccagaaaatttactatatcaggagacttatttggctctggccactacatttcggctaacacagtcatttaaccgtttgaaagagccatacaagagaagtaatctgcaggaaggagcaatgaatgctagagcatgggcttccaagtcccttgccaccgtttcaattggagaggaaagcagcagcagccgtgggacgcatcagtga

SEQ ID NO: 109283 - DNA, 318 bp, Glycine max
  Peptide Sequence Number=SeqID_226061
atggcaatggtgcctgcggtggaggagggaaaaggattaggaggcaacccatctattcttcacctgccacaaaattatgccactctggtggcaatccttatcttggataaagatggtgggagtgttttcatagaatccaagacaacatttcacgtagcaatcattctgcagtacttttctcggtatcaaatcacaaagatggctcatttggtgggtttccctaacatggtgcatgatcgttcaagagcatttgttcttgaaattgggactaaagagatgccacctcaaaatgttgtagacgcaagcaagtgtaattga

SEQ ID NO: 109284 - DNA, 714 bp, Glycine max
  Peptide Sequence Number=SeqID_226062
atggtggtggcaatgctcaacgggacaaaacacaagacacacctggtagaggagtcatgttatagcccttgtaggtacaaatgccatttggggaatatgttcgggtcctctggcaagataatcttaggcgacagtgaagtggaatcaatggtgttgtctgagccaaaatcgccaaaggatgggaaagcaatgacaatccggcaacaagacgatgaccataacagatggaacaacatcacacaaaggattgatgggcaaagcaatgaggctagacccatgggtagtaaccattggtctctgtcgctaagccaaatcaacattgttatcggtcaaattgcagcaatggagtcaaacaaagtggaaagccaaccaagggtacaacagtcactcactaagaagcactttacacaaaaaccagcaggttttaaccacgagttggatattcagaaaaagattagcagaattgagtcggagattaactctctggaatctgatggtgatggaagacaactagatgatcaagaaatacaactgagaaagaagttgcaggaggacctatgggtgacagccacctcctatgaatctttgctaagacaaaaggcaaggtcaaaatggattaaggaagaggactgcaactctaagttcttccatatcatagtcaatgggaaccgcagatacaactcacttagagcattacatgttgaaaaatgctag

SEQ ID NO: 109285 - DNA, 2712 bp, Glycine max
  Peptide Sequence Number=SeqID_226063
atggcgacgccggaaccggaaccctcctccgaccaccgcatcggctctcttcccctcgtcgacctccgcctcctctctcaacccgaactctacaccctctccctctccggcgccactcaccgccaccgccgtaacagcgacgatgactccgtgattcccaaaatcgaccgttccaatttcaacgaatccgccggcagccgcaaacagacctactccaaactccgcctcaacaagcgcaaacaaaatcccgcggttcccgcctcctcctccttccacattcccctccacatttcggagcctgaggaggaagaaaactcccgaattatcgctctgctgcaccaactcttcggcgtcgagcctctccgcaacaacgcgccgcgcaacaacgatgcgcctgaacgccgcctcgttcccgtccatgtcgagttcaaacagccgcctccgatatccgtggcgttgttccagaacgttccgattgacgttgtcccggacggcagtcagaggaagcggaagcgcgggcggccgcggaaggacgagaattcggtgacggtttttgttgaggaaccgacgaaggttaccaaggaggagaattctctgacggttttcgttgaggaaccgaagaaggttaccaatgaggagaaatctgtgaaggttaacggtaacggcgaggggaacgcggcggtggcgacggcgactgttaacgagagtgttggtttggatgaggatctgtttgaggtggagttaaagaggagggcgcaagggttggagacggagtcgcaagtgatggaatttttggagactttgaatggagaatgggcgagtcagagaaagaagaggaggattgtgccggccactgaacttggtgacatgttgcctgcgggatggaagatcgtgattattgttatgaggagggcagggcgtgcttccgctgtttgtcgccgttacgcacccactgctcctggatgttgtggcgcggtggtcacatttccagtcactccaaaaatcgtgaatgtttcggttgggggaagagacaaccctaaagtcgttgtttttggccttttcgaggatagaagccatttaaaatctagttatactgatggtgctcagcaattgtccagtagtatgaacagggcatctgaaagtagtgttggacatgtccccactggagacatgaagactgttgccaatgctagttatttgtcttcagctggtgcacctatagactctagtcatgagaagcagcccctcgtatcatcatcaattgggagtgaaaatttcattagtgatctggctttgggatgtaaattaggagatgctactggtggagcctttagagactttgaccatcaaactgaagataaacaactatcgaaggctgataagaatgatgaaaattcagttcaggaatgttctcttgtggaggatagagcttgtaatgaaaacagtgagaagttggttggtgttgttgagtctagtgatgctgcatgtaatctttatattcctttggttttctcaactcctttctccaataataatagtgacaatggtcaactttcagatgaaataaatgcttccacatgcatgaaaggtggcgttagcaattttgctagtcacgatagaaatactggatgccatgaaactgtttcttgtggaaatgtgcgagcacatgttgacaacaatggacttgggctttctgtgaaattagtggaagagaacattcagaaaccaagttttgaaagcagcatgctggctccaaattccgaggggaaaatacttgctggtaaaaatttagaggatacaaatcatatcagttcattggaggatacggagattagagatggaaaggccgttaaggatgacaaacaacaaattatttgtagcagagaccagactgaaattaaagatgtttctactgatgttaaactgcagagtagttctgagggttgttcacttgtctcatctcataatgaacttaatacatctaaaaataatatggacaagacacagacttccgagctgaaggactctgctgaggaaaatatttttgatagtgatttatttagctcatctattgatgaaagaacacatgttcacagtggctacattagtaatgtttcttttagctcttgcacacatgcatccgagtatggtggatttgattttgcttctgatcttaaactagctaaggatgttagtgataatcatattctttcaaacgaggaagctgtgacaaggtgtttacaggaaaggagttccttgaatgaccaaaatagcatgatggacaatatgttgcacagaagttctgaaagtaacttatttgctctaactggtaatcagcactcttgtgcttttcatgataatgtaaatatctctgatggaacctttgatgcactcaaagctgttgatgctggttgcatggagcctcagttgggcattgtttcttgcagcaatattgctgtagatgcatatactactgcaagcattatgcagggaaaaccacaaggatgtgtatctgttcctcttggtggaaatatattaaactttgagaagccaagtgatgatggtgttaataaagcaaataaatcctgcttaccagagacagctcagaatgaagttgaaatattccaaactgaatctatggagtgtgctggtaaccacaaggctctgcttgtatattctcaatttcctattgaagatgatatgctagaaaag

SEQ ID NO: 109286 - DNA, 408 bp, Glycine max
  Peptide Sequence Number=SeqID_226064
atggcagcattttttgttgttgatagattcagctggtggtgctggtggcttctccgttccagaggacctttgctagcgcatgatggatgtgttgcccaacttgtagtggttaagatcgagtcttccttcaacatcgtagacattgcccagcacaaaataaacctcgcgaatgtgcctcttgcgaataagtttttgacaggcttctcactcaaaggagaaatcaaggtgtggccaataggctttgataagcaggaagtccaagtagttcaatggaggcacgcttcattgccttatcttatagcaatggaggcattccttgaattgcaacctgtcaatggaggtatattcaggcataatgctatatgtcagcgcacatgttgctggaccgaaggctcatcggttcactaa

SEQ ID NO: 109287 - DNA, 672 bp, Glycine max
  Peptide Sequence Number=SeqID_226065
atgagcgaggctggaggagtagttctgctgcttggattcttcacccctctccctccagcgccagtgcctcttcccactttgggtttgtctcaacttgtgtgggacagtgtcgttatagagtcgtgtaaagctgagctgcacaagtgtcaaaccaattttcagaaactcaggaagcaaaatgtgaaacttgccctcaaaaatggtcaaatgctggcagagcttaattcaagtaggcagaagcaaagggaacttcagctagaacaagaagcaaaaatgttggtcttcactcccttcttaatggcaccgcaacaattcacttttttctcaattactgctaggtatacttttcaaaggcaatctttagggttgaaagctaaaaaactggaacaacaaaagattccttggagctggttgaagtcaaagatgatatttcacatctacaagaaaatttggccaatgaaaattggaccaacatcattggggtcaaaggtccatgatgaagccaaagaagctactcaatcttcgacacctactaacatagagcaagttcatgttaaaaagaatattgataagaagaggcaaagtatgagaagacagactaataggttcaggcctggggactttcaagatttactactgatggtgcctcgagtcattggagatccagtttag

SEQ ID NO: 109288 - DNA, 246 bp, Glycine max
  Peptide Sequence Number=SeqID_226066
atgccgccgcctaacctactaagacggttttttcgcgatagtcgtcgaagctgtcaaaataaattgcttcaggcatgcacctggacaatagctgaagaagtattacgaagaccacatgacaagtttccactacataatatacaaacatggtgtcgtagttacggtctcttgggaggttgccttaattgcagcatcaagggtggtggtttagtcctacatcaactagagaataaagatatagcttaa

SEQ ID NO: 109289 - DNA, 894 bp, Glycine max
  Peptide Sequence Number=SeqID_226067
atggctcgtagaactctgaaaggctctatttgtatgataggggctgttaatgactattcaatttctgtgttggttgctttacagcttgtagcagcacgttcttcctccagcactggtaaggggaaaaatcatgaaggctcaataaagtatggtttcagccttgtaaaagggaaagctaatcacccaatggaggattatcatgttgctaagtttgcacagataaaggataatgaattgggtttatttgctatttatgatggtcacttgggtgaccgtgtgcctgcctacttacagaaacatttgtttaccaacattttgagggaggaggaattttgggaggaccccactctttctatctcaaaagcatatgagagtacagatcaggaaattctatcacacagttctgatcttgggcgtggtggatcaacggctgtaactgctatattgattaacggacgaaggttatggatagctaatgttggagactcaagagctgttctatcaagaaaaggtcaagctgtacaaatgacaacagaccatgagcctaacaaggaacgaggtagcattgagaccagaggtggttttgtctctaacttgccaggtgatgtgcctagagtaaatggacaacttgctgtttctcgtgcatttggagacaggagtctcaagtcacatttgcgatcagaccctgatgtacagtatactgacatagatgttgatactgagattctaatccttgcaagtgatggactttggaaggtaatgactaatcaagaggcagtggatattgctagaagaacgagagaccctcagaaagcagctaagcaactaacagctgaagcattaaaaagagatagtaaagatgatatatcttgtgttgtggttaaattcagatga

SEQ ID NO: 109290 - DNA, 179 bp, Glycine max
  Peptide Sequence Number=SeqID_226068
cttttgcaaacttcgaagggaaacagcatggactatccgagtccaagtacaagttgaatcctttatcaattttgattggactggttgtgattctggacacaggaagtgggtttcttttcaaatttgagttgaaggtgtcagccaagtggtttgtgctgaaaattagttgcaaatattga

SEQ ID NO: 109291 - DNA, 498 bp, Glycine max
  Peptide Sequence Number=SeqID_226069
atggcaccccacctgacgtccccaaggtctcctgacccccgcgacatatctccagggattatgattgattcacttgatcaactatcacttgagaaaattagtcgttcatcggctgatgagagtcatggtagcaccgagccagaaagttgtccattttcatgggctagatctccagaaaatttactacgacaggaaacttatttggctctggccactacatttgtggttttcagattactatacttgtttttccctacactgcttatatgtattcgatatgcttggagaagggtcatccaaagtattagaatatggtgcttgcttgaacatcctttgatttatttgaagcgcctaacacagtcatttaactgtttgaaagtgccgtgcaagagacgtaatctgcaggaaggagcaatgaatgctagagcatgggcttccaagtcccttgccaccgtttcaattggagaggaaagcagcagccgtgggatgcatcagtga

SEQ ID NO: 109292 - DNA, 393 bp, Glycine max
  Peptide Sequence Number=SeqID_226070
atgttaaaattcgcactgttgaaaaggatgggaagacaattaaactatagattgtattgggatactgctggacaagaacgatttaggacaataactagtagctactatcgtgaagcacatggaatcattattgtttatgatgtgatagatgaagataggttcaataatgtgaagcaatggctcagtgaaattgaccgttatgctagtgacaatgttaacaaacttttggttggaaacaagagtgatatgacaacaaatagagttgtctcatatgacacagctaaagaattcgcagatcaaattggcatacctttcatggaaacaagtgcaaaggatgctacaaatgtggaagatgcattcatggccatgtctactgccatcaagaatagctag

SEQ ID NO: 109293 - DNA, 297 bp, Glycine max
  Peptide Sequence Number=SeqID_226071
atgccatatgctgacttacccccctatatgctcgataatgcaatgacaatcataagcccaacaaagatttctcaacctatgtttcccaaaggatacaaccctaatgtaacatgtgcttatcatgggggagtttcggggcattacattgagcattgtatgaccctgaaacataagtttctttcatttttccttcctacaaggtcaggacaaaagctagcaatagatacctcagagccctatactggggcaatgagaggcaccatgtatgagcttcaagcgaacctaggggcagattag

SEQ ID NO: 109294 - DNA, 279 bp, Glycine max
  Peptide Sequence Number=SeqID_226072
atgtggcatgatgttgagtttggagcaatgtcaaggtttgtggctcacaacaatgtgtgtggtggtggtggtggtgggagggggcgaagtggttcctttggtgtggtgtggaggcattgggtgatggtgtttgggtgcgacaatggttgttggtggagtcgtggagggaggcttccatggaggtttgtgagagaagaggctaggattttgcttgggagaaggataaaaagggatataaggaaatttggtagtgcaccaagcaaaaataggatgcgttaa

SEQ ID NO: 109295 - DNA, 327 bp, Glycine max
  Peptide Sequence Number=SeqID_226073
atgcgcaattgccctacatgtggggtctcacgctacaaagtgaagtatgacgaatgcagtgatgatgtagccacaaatagtgatcgtcccgcaaaggatcccagaaacctaagggttgttcttgcttctaacggaattaatccttttggcaagaaaggatggtttgaaatgtcgtcaagatttggtagacatgggtatatggcagcagttgcaagaaccaacccattttgtgtcatcaatagacataggtcaatgataatgattgtacaatgcaaggaagattttatggtacttatgatttggattctggttgtcagggtggtgtaa

SEQ ID NO: 109296 - DNA, 453 bp, Glycine max
  Peptide Sequence Number=SeqID_226074
atgggtagctactggaataacaatggtgatccttgtgatggagatgatcttggtgcagtgccaccattttgggcaaccatccacccaccatttcatatgactccagaggacaaaattttttatagaaatgacactgccaatttcccctacttggcgtatcactattattgtgttcccgataatgccaaacacttggagcaacctgttagcacttgtgatcctaacaacaatcctaaggcacaagagattgttcagttattgtctgaccctatatgggatgcttgtgactatcccaccaaaaaaggagatggttgtgggttggggatccaaggatttgggaacttgatgttggtggaatgtctagaccctggcacccctcctgctaaaagaatatggacttctattgatacccaaactgagatatttgttagcgcacaagatgaagtagcatga

SEQ ID NO: 109297 - DNA, 426 bp, Glycine max
  Peptide Sequence Number=SeqID_226075
atgaagttgtaccttaattcagatcatggatatatattatcaaagtatctatttgtgcagcaaaaaatagtccttcaaatgcaactggacagtgacaaaagcagaagcaaggccctcaagattgcagcacaagaaataggtgtgagctcagtggcattggaaggagacaataaagacaaattgacggtgactggagatgtggatgcagtgcacttgggtcgggtgcttaggaagaagtttcagtgtgtcacccttgtcagtgtggaagaagtgaagaaaaaagatgacaataaatgcaaaattgaaattgaagacgacaaagggtgttattattatacaccgtactgtgctcctccaccatgtggtccttctccctattgccacccagtttatgattcatatgacagtacttgctctatcatgtga

SEQ ID NO: 109298 - DNA, 426 bp, Glycine max
  Peptide Sequence Number=SeqID_226076
atgcaacataagcttgttggaatatataggatcatgaaactacctttacttactcttcattctgagatcacaatagaatacgcccagttacctacaagtcaaaagacatctttacttggaagaatgaacatagttaagcacgcgaaaaatgacacgttgctttggcatatggcttcgaggcacttcactgctttccctatttcccatagcccctctcgtggtattctgcgagtccccatagcccttccgtcaccgcttccatccaaacgcgattctgcttccatccaaacgcgtagctctttctccatggagtggaacacgggggaaaggaacaaacgtggtgacatggagaagaggaaaaggcgtgaggagaaagaggaaagaggaacagacacgaggagaaatgaatgtgagggaaaggaatga

SEQ ID NO: 109299 - DNA, 318 bp, Glycine max
  Peptide Sequence Number=SeqID_226077
atggccttttccacttcaggacctatttcacttggaagagggctaagacaaggtaacccactattgtcttacctattcattatttacactgagagtttatcttgtctccttaaaaaatatgagagcaaaggagagttacatggtattaaggactcgactcaagctatcaatttcaacaaattagaagtatttttcagcactaacactctctcatccacaaaggcacaaatctcctcatctcttggagttattgagtgcattggtattggaaaatacctggcaagaatggaagcacatctagaggcaaatgatctctag

SEQ ID NO: 109300 - DNA, 765 bp, Glycine max
  Peptide Sequence Number=SeqID_226078
atgacagaatctggaaatttacttcaaatggactttatactgtttcgttctgtttatcataacataatggacagtttgcttgtaaatgataattacaaaatagatgccaattggaagaaactttggtccctgcaaacacctccaaaagtgaagcaccttctttggaggattctcagacaatgcctcccctctaggcaaaggctttgtaccaaaggagctcattgtcctgcaacttgtgctttctgggaaaccaatctggaaaatgactggcatgtatttttcgggtgtgaaaaggcaatcttggtgtggcaacaagctggactatggtctacaatcagcagcaacgttcatcaagcagaaggtataacatattttctctccaacttgcggaattctattgcctcggaatccctttgcagtaaaatcagtatcattctttggagtttatggagacaacggaatgacaaagtatcgaacaacttggagatgcttcctaacatagctgacaaccaagcttttcaatttctgtcagagtggcagcaagctctttctcgcaacaacaatctcattcaactgcatgatcatgaaccagcacaagtatggcagaaaccagaaccgggcaaggtgaaatgcaacataggcaactgcaattttcaaagagcatcagagttttgttactggcatttgcatgagaccacaacggcaaattcctggcagccaaaacatcgtggcagcgaggcattccagaagcaacaggaagcatag

SEQ ID NO: 109301 - DNA, 2184 bp, Glycine max
  Peptide Sequence Number=SeqID_226079
atggcgacgtactttcatggcagcacttcagaaatcccttcctccgctgaagggttgcagacactttaccttatgaatccaaactacgtaccgtactctgacgcggcacaacacccaacgcaaaacatgctcctcgtcaatcccaacaacaacaacactagtaacactagtcccacttccaccaacgcgctcaaccttggtaacttctcccacgcgccgccacctccttctcccaacaacaacaacaaccaccgtgaacaacaacaacatcacctgattggggttaccattccctcttcaaacatccttggatccaacgctgccgccaccgaccccgctcgatcatcgttcctcggacaacacgaattctccagcttccacggtggtgctgccgccacctcaacggtgacagcatctcgtggtaactataacttatggggttccataattgatcaatctgcgttgaatatcatggcagcaacgacacacaccccatctagtaacatggggtgtgttgccagcagtgtcatgtcgacgcagattggattccacaggcctaatcatttgtcactgagcctatcttcacaacaaacaccatataggtctctctctggggagattcatgctatttctccggcgagccgtggcggtggcggcgatgatatgaggggcttgcacaacggggtttctagtatgcatagtgttgctttgggttccaagtatttgaaagcaacacaggagcttcttgatgaagttgtgaatgtgggcaagggaatctccaaaggggaggaatctatggaaggggctaagaaggagaagatgaaagggaatattgaatccacttctggggttggcgatggttcgagctgcggaagggagaataatgatcgagccaaacaaggagttgaactcagcacagcacagagacaagagcttcagatgaagaagtccaagcttgtgaccatgctcgatgaggtggagcaaaggtacagacagtatcaccaccaaatgcaagttgtgctaacatcgtttgagcaagcagcgggtgttggtgcggcaaagtcttacacggcccttgccttgaagacaatctcaaagcaatttcggtgtctcaaagatgcaatctcttcacaaatcaagacaactagcaagaccttaggtgaagataattgcctgggagttaaggtagagggttcgaggctaaggtatgttgatcatcaacagagacaacaacgtgcattacagcttggaatgatccaacacaacgcttggaggccccaaagaggcttgcctgaacgtgctgtctctgtccttcgtgcttggctttttgaacatttcttgcacccctatcctaaggactccgataaggttatgcttgcaaaacaaactgggcttactcggagccagccaatggtagaagaaatgtacttggaagaggtaaaacaagagccaaacaatagctcccaggataacaacaacacaaaaggatcaaatgaatcaagcaaggagttatggtcagaagctaatgctgctgcacaagaatcaggtgcaatgagatttgatcagattaacattctccaatcaaaggcagaaagcttcaagaacaaccaaaccacttccccaacagagatctccaattccaactcactccaatctggtttccatcttgctgacatgcaaagtccaaacaagccaaaaagcacttctgagatgcatcagaattctccaggtagcattctttcagtggacatggaaatgaagcctcatcatcatggagaaacaaataatatcactagagaaggccagaacaacaacacaacaacaaagtttggcattgaaagccatggtgggggttttggagcatttcccaatatggaagacattggaaggtttcatcatcatgtcacagagcaacttgctcctaggttccatggaaatggtgtttctctcactcttggacttccacacagtactgagaataacctttccctctcaggaacaacccaacatggattcctctcacagaacatgcacttgggaatgagaaacagtgaaaatgatgagttttgtggtgcaatcaacactaccccaccttcttctcactcaggtatcagttatgagagcattgacattcaaaacagaaagaggtttgctgcgcagttgttgcgggatttcgtggcttaa

SEQ ID NO: 109302 - DNA, 528 bp, Glycine max
  Peptide Sequence Number=SeqID_226080
atgaggttaggtggaaattactatagcttggtaatagtggatgattactcaaggtttacttggaccttgtttttgaaaaccaaaaatgaagcttttgatgtttttcgcaaacttaccaaggtgattcaaaatgaaaaaggtctcaacattttttcaattagcagtgatcatggaggtgagtttcaaaatgagtcctatgaaaacttttgtgaagaaaatggaattcaccataaattttcaaccccaagaacacctcaacagaatggtgttgtggagaggaaaatagatctcttgaagaagggtacatcctttgtggtacaagtagagggtacatctacttgggttgttgtaactgagaacaaaagagggtacatctcttgtggatcagttcaagtgaagggtacatccacttggttgttcaaagagaacaagggagggtacatcccttgtggatctttgctagtaaaggattttacaaggttgaaaagaaatctcaaggaccgcatgtcgcttcggaactggatgtag

SEQ ID NO: 109303 - DNA, 915 bp, Glycine max
  Peptide Sequence Number=SeqID_226081
atggacagagccaggttggtttacagattagtcacaggcatggacatgaatatcagagccttaatctcgggtcaaatttctaccattgcccagagtaactcctctaggctcggattcccgaccttgatcactgctatatgcagagctagaggagttatctctgacattctaacctatgagagcctgagcccgaccattaacttggcctacattaagaaaaactgttggaatgtggatgatctgacagttaactttagaggggctaggaaggtggtagctcctccagggtccattatgtcagtagagcagttcattgagaaggtatcctggcctggaaccttaccttctgttgtgagagagggtgagggtcccagtgctcaagtacctcaacaggtacaagatgcgtcttttgaggctaccatccctagagattttgatttttcaggtgcaggagtagagatgagacctgatgaggatgttcttcctgagccaattgtgccagttatacatgagactgttgaagcagatcctcctacaccagtacatgagagacaagtagatcctcctacacctatcatggagatgccagaagaccctaccacgccattaaataagcaagtttgtggaagtgctgattttgagccgctcgctaagccaattatctggtttagcgagccatctgctaagcatagaagttcatggctaaggagagaatcgagcttgaagaggaagctatcttgtaaagcattggacgagattttgagtgattgtgaggtttctagagcctccctgctatggagagctaaatcctcaattggttcttcctatggggtacttgatatgcatgctcagttagggtcattcaacattgggaaatgtttagtccaacaagagggatctgaggatgatgcttga

SEQ ID NO: 109304 - DNA, 525 bp, Glycine max
  Peptide Sequence Number=SeqID_226082
atgtctccaatccaatctcaagactcttcaaatgtactcaatgtcgtattcaagtttggcatcatcaaagccaaaaaggaggagattgttagagatagggggagcaacatgagcaaaacggaaaaggctgatcaagctacaactattgctaccaaagctgctggtgggttgactacgccagttactcctcctttaaatgttgtgtccatgatggagaaaacccatatttctaaaaagagggcttggacgaaggctaacgatgaaacatacatccaagtggactttgaagacttggatgctaggtcgggtactattctacaaatgcaactagccacgaccattgataaggttgaggaggtgaaggctaaggtgatcgtggctaacacagaattagtcgtgcagtttgttgaaggctttaattccaccatggaacaagtcaaagtattggcggatgacatggattatggagtagtcaaccctttcaaggaagtggtcaatagggatattgttgaagttgtcgactga

SEQ ID NO: 109305 - DNA, 216 bp, Glycine max
  Peptide Sequence Number=SeqID_226083
atggttggagcattctcgcaaaacatcatgaccctgactggtctccctatgatcttacttagtgagagtgacctgacaaacccattgtgtggtgtgtcttgttatgtactcctaagcgccccagggtggtttttcactgacatgatgaataggtggatgactatgaagaacctcatgctagaggacacgggaacaccacgctctgataggatgtga

SEQ ID NO: 109306 - DNA, 117 bp, Glycine max
  Peptide Sequence Number=SeqID_226084
atggctcggagcagtctttgttctatatctgtaccttttcttattgatctactgataatcgcctttactttcttggcacaccttactccaattagtgcagtccatgttggtgtttaa

SEQ ID NO: 109307 - DNA, 213 bp, Glycine max
  Peptide Sequence Number=SeqID_226085
gctgtggaagtggtgacatgtgaagaagagggaggggtgatggttgagccacaatatccaagggacacaaatgatgacatcatcaatggcaaagtgaaggtatttgttggggcttcggcccttgaaggatgtatgtgcctaaaatttccatgtgctagaaaagaattctcttgtagtagcacaatgttgtggtatctagagaaaggaggatga

SEQ ID NO: 109308 - DNA, 378 bp, Glycine max
  Peptide Sequence Number=SeqID_226086
atgatagaggagcatggagacatagccaaggaacatgtggacgaggaagtggaggttggaggagaagccgaaggagaggtaggagagggtgacgctaacgatggaggagtagaggtgcttggggaggccgcgggggaggaagcacagaggaagttgaggggtacgatggcagcgaagcaaagaaggaagcagagcatggggatcgagactccgatggaagcgaccatagaatccacaaattttttgttgttcttgattatgtcgtcgagcgacatattcatggctgtagacatgtttgctggttcagagttagggttcataaggataatagctatgaaaagaggggaaaaaaggagcagtggtgacttatttccctaa

SEQ ID NO: 109309 - DNA, 1881 bp, Glycine max
  Peptide Sequence Number=SeqID_226087
cagcggaaccagcagaacacgctacaggcggtgaggaatgcatacaaggatagcaagaagaaggatgcgaaggcaatattcttcctgcatcagagtgtagatgatgcctgggataaacatgagaaatgttatgctggtggagatcgaatcaagaaagtgaaacttcaagtgtttcagcgacagtttgactcgatgacgatggaagagaatgagaagattgctgacttctttgcacgagtaaaggtagtcatcaatcagatggctacacaagaacttagattgctagagagaaataagcaaaaaattgttgaacatgccttattggctcaatctagtaacaagaattctggtaatagtaacaaaggaagaagtggttttagaggaagagtcgtggtaggaacaatagaggaagaagtggctatgtttttagtagtggaagaggccagaataatgttgaaaataaacttgatcagtcgtagagaggcaggggcagaggctactatcgaggtggtagcaatggtagaggaagaagtggtagaaaaaggtgatgaggcaaatcttgccaaatgtgatgatgaggaaaatgagctagtaatgctcatggtgactactgcagatgaaacgtgcaccattgatgaatggtatcttgacacaggatgttctacacatatgactggtcataaagaatggcttgtcaactttgattcaagcaagaaaaatagaatcaagtttgctgatggtagagctatgctagcagaaggagttggaaatgtgatgatcaagatgccgaatggtggcaaaaatagtttgatatttgatgtttctatgtctagaaacaggacatttagagccaatcttgaagcactttgccataaatgcctagctgcaatagtgagtgaagatgattggcacagagagccttttaagaaatttgttgaaactaaggcaagagaaaagcttgaagtgatatactctgatgtgtgtggcccaatgaagtgtgaatctcttggtgagagtagatactttttatcattcctagatgatttcactaggaaaatgtgggtgtatatcttgaagagaaagagtgaagtgccaggagtattcaagaagttcaagagaatggttgagagacaaactagtttcttgataaaaattatagtcactgatggaggaggagaatatactagcaatgaatttgatgaattttgtgtactggaaggtattgtgcatgatgtgacacctccctacactccccaacataatagtgcagctgtctccattgcagtgtatgtgctaaaccgaagcccaacaaaaaggctcaataaaatcacacctgaagaagcatggtctggatgcaaatcagtggactggagttgggataaagagatggtagagaagcctacaaaagttgtgattgaagctcctattgatgagtcaagtgattcttctgctgtagtaattgatgacactgaccaaggaggagtaaggaaatcacagagagctagacaagtctctagcaggttacatgattatgaattgatacaagatttagcaataggggaggaatgtgagctagtacacttagctctatttgctgaatctgaatcagtgagcttggaggaagcaatgaatgacacaaagtggattaatgctatgaaagaagagctgaaagctattgaaaagaataatacatggcaacttgccagactagtggcaaagggattcttccaaaaggctggcattgattttaatgaggtgtttgcacctattgcaagaatggagacagtgagaattattactgctatagcaagtcaaaaagagtggcatatgcaccatatggatgtgaaatcagccttcttgaatggtcctctagaggaggag

SEQ ID NO: 109310 - DNA, 135 bp, Glycine max
  Peptide Sequence Number=SeqID_226088
atgatcactttatttgaaagcttgtatgttggaggtttggataaggcaatgcacttgatgcaagacaattttctagaactagggttgaagagagaagattgtgctaagatgacatggatgacatggcttctttga

SEQ ID NO: 109311 - DNA, 264 bp, Glycine max
  Peptide Sequence Number=SeqID_226089
atgtcttcctacgactcgaagtctaaatacttttccccagagaaagtacatggtattaagataaagtcaacaaaagaatatcacagtgtatctaatcttggcacccttaagctggaatttgatataggaaaaaggtgtggtatcagattgacaacacaactaaataacaacaagagccaagcaaacttagcaaagtccaatgttgcaaatttgatggcaaagatcaataagctagaactagagaccaaatccctacaagcataa

SEQ ID NO: 109312 - DNA, 303 bp, Glycine max
  Peptide Sequence Number=SeqID_226090
atggtgttgtttttctacgtaaaatgtgggcaaagacatgcaaaccgccagccccattggcgagtttgccctggctgcgacacatggcgtttgcagtggtctcgccactgccattggcgatttggtcatgcaaaggggtctagccagtttgactggcgatttggccatgctagggcgcagcaggcttgcagggctaggcaggagcagcaggttgtaggcttgcagcgcttttcagactgggaatcgccagcaccaatggcgacttgtgcttggatggtatcgccaacaccacttgcgatttga

SEQ ID NO: 109313 - DNA, 306 bp, Glycine max
  Peptide Sequence Number=SeqID_226091
atggaacaggtggcagtgaaggtaaaggcagtggaggttgaagctgccacatcggtgcaagtttcaatcatagagagcaatatgctgttggagatcaagtgcccccacagagaagggttgtttatcaacgtgatgcagatgctaagggaggtgaggatagaggttagtggggttcagtcatttaacaatggagtgctcatggcggagttgagggccaaggtgaaggaatatgcaaacgggaagaaggtcagcattgtggaagtgaagagggcacttaaccaaactataacccatgcagttgactag

SEQ ID NO: 109314 - DNA, 402 bp, Glycine max
  Peptide Sequence Number=SeqID_226092
atgtggactgacatgctacaatggaggaaggagtttggtgttgatactattatgcaggattttgagttcaaggaaatctttgatgatgttgcacaacaagttcctcatatacctccttttccctacattgaagtccttgcttctgaggttccttcatccatcaaacacaacgtggactctgtaaatttggatggagttactttgttaaagtgtggaattgataaattgctccctcatgtcagtacagatgcaaaaaatgatcatggtgatggttatgaccctattcttatggcagagacaatttactcaatcaacaatctccaaatatctatgatcttatcaagaagtgtcaatgcacagtgcttgcagcatcctaatggagttgtgtacatggcattatga

SEQ ID NO: 109315 - DNA, 192 bp, Glycine max
  Peptide Sequence Number=SeqID_226093
atgaagtccttgaccagtgctaagtacaccaggagaagagccagtataatgtatgcaataactaggcagtcctcagttctaagcgatgatggtccactagtgagacacgaaaatgcagtgcttcctagcattcttgagcctagaaagcacgaatatatcaatcccagatgcacttctcgatcatcggcctaa

SEQ ID NO: 109316 - DNA, 867 bp, Glycine max
  Peptide Sequence Number=SeqID_226094
atggagaaaattcggcagaggaaattggagattttacaaaaggggatttgttggctctcattcacaaacaagggacgtcttcttcacattgttggacataatggggtagcatacggggttaatactgaaacaggagagcttttaaaggaatttaaaatcacaaaaaagtctattacttctctggctttctcgcatgatgaaaaatatttagctattgtcagctctagaccacgggttataagctgggaaattggggaagagattctgaagttccctaatgatttggtaaatgtagagcacatttctatatcgaatgatgctaaaaatttagttacatcatattttgaggatcaacatgaggttgttgaaggagtccttcttgatgatgatttgaatgagccaacaatgggagagaaacttgctagtctaagtgttctggatgggaacaaatcaaggagtgatatagagcaagaatcttttgtcccagcaaggcctccaagtgcagactctgtacatgttttgcttaagcaagcattaaatgctgatgatcgcacccttctgctagattgcttgtttacacaaaatgagaagattaatagtgcagaactcaatatttgccttgttgcaagccttaaaagtgtttatatattgaatatacatagtctaggtgctctcaatgaaacacactttgtgggaaatgttgatgaagagtctcgccaactaataaaatgcacatatgagtgcctggagaaggcaatatccattgttaaacttggggtacgattccgtgaaattggtgaagctattaatcgtcatgcttcaatgtttggcttttcaatggtaatgatttacttctttgttctttga

SEQ ID NO: 109317 - DNA, 3324 bp, Glycine max
  Peptide Sequence Number=SeqID_226095
atggttgacactcgcctcaaaatgttacaagaccaaattactgcacttacgagctggatgaatggtcaaattgaacaagatcagaggatgcaagatcacttagacctcatgcaacagccgatagacttgttgattgtgaatagtgttcagcacaatgatggttcgaacttagaaggtggtccttcacatcaaacctcgccgctgaatgttgtttcaccggtgaaagatatttcgcttggatttccccattttgatggttctactccaatgctggaatggatctttaaggctgagaatttcttttctatcacaatactccagacgcttcgcatgttgatattgttgctatgcattttgacaaggatgttgttccatgaattgactaaggctctagaatctcagtttggatcttcactatttgaaaatcctatggctgagcttttcaaattgcaacaaacaggttctgtttctaagtattatttgcaatttatgtctcttgcaaatcgttccgttggtctttcagaggatgcattttttaattgtttcatcagtggtttagatcctgatattagacgtgatgtgattgatatgactccttctactctattgagggttgttgctttagagaaattgtatgaaaagaagtataatcctattgttaagactatcaaaagtaattttgttcaacgttattctcaattgtcctctaatacaaaatatcctgctcaagcaaaatctgttactaagacacaacttccacctttgttgcctacaccacctggtccaccactgaaaacttcaaatgtgaaacgtatcagtcctgctgagatgcaattgggtagggagaaaggcctttgttatttctgcgatgataaatttacatttaatcttcgatgtcctaataagcagttgttgttgttacaaatggaggaggaaggggttgatgaccttggtgattcattacatcatgataattcggtcactgatttagttattcatgaggatcatcgtctttcttttaacgctctgaagggaggccttggcattggtactattagattcctggcttacatggaaaaacttccagtgacagtattaattgatggtggcaactctgatagttttctacagcctcgcatcgctaaatttttaaagttgcatgttgaaccagctactaagttcaaagtaatggttggtaatggcaactatatgactgctgaaggattagttaaaaaattgagagtgcaagctcagggtaatgtgtttcacttaccggtgttcttattgcctatttttggagctgacttgattcttggggctagttggttaaagactattggtccacatattgctgattatgagcatctccagttgaaatttttgttagatgctgaaatctatagcatgcaagtgattgaggagaattcaattacttttcccttactggatcttccagctgacatagatcctaagctagccttgttattacacagttatgatgaacctgttaaagtcaagccataccgatatcctcatagccagaaggaggagattgaaaagttaatggctggaatgattgatgagggaattatccagcctagtaaaagtcttttttcctcaccaattattttggtaaagaagaaagatggttcttggagagtttgtacgaactatagagctttgaatgccataaccattaaggatatttttcctatacctactgttgatgagttgtatggtgcatcttatttttccaagttggacttaagatctggatatcaccagattttacttaaaccagaagatagatgtaaaactgcttttagaactcatcatggccgttatgaatggctaattgaatatttaggtcatacattatctggtgatagagtatctatggatttgagcaagctaaaggctattaaaaactggccagaacctactaatttgaagcagttgcaaggatttcttggcctcactggttattataggaggtttattagatcttatgctaatatagcagcaccacttactgatctattgaagaaggactcttttaagtggaatacttttgctgctagttcctttctaaaattgaaggaggctatgacttctgctcctgtgttagctattcccaattttcagttacctttcaccttggagactgatgcttctggaatagggatagagttctttgctattactgaagctatggctaaatttcgacattacctcttggggcataaatttgttataaaaactaatcaaagaagtttgaaagagttgcttgatcagaaattgcaaacacctgagcaacaacaatggttaccaaagtttcttggttatgatttcactattcaatataagcctgggaaggagaacatacctgctgatgccttgtccaggagtttttttatggctatttctagtcttgagttccatgcttcaaaattgggtggtcatgctagagttaataaaacaattgcacgaattgcctcacaatttcattggcccttaccaattcctcaacagatttgggaagacttagctatagatttcatcgtggcattacccatgtctcagggatattctattatctttgtggtgattgaccggttatccaagtttggatactttatacccttgaagagtggcttactaaatttgttcaaagctcagggtactacattagcaatgacctcttcataccatcctcaatcagatgcagcttttggtaagcatcctcctactgtgcttcgttatgagattaacccttccgatccagtggatttacaggaatccttgaaagaaagagaccagttgctgggacaattaaaagtcaagttgcaaccttatcgccaacattcagttgttttaaaaagaaatcagaagttaggtttacgttattttggaccctttaaggtcactaagaagattggaacaacaccttatgttcccttaccattaagttccaatgagtttggtccattggttcaacctatggaaattcttgatgcgcgaattgttcatagagttggtatggaagttcctcaagttttgatacgttgggacttatctgaagttaatgatgatgtttgggaggatcttcgggagttacaactttcttatcctcatctcaatcttgaggacaaggttgtttctaatggaaagggaaatgtaacatgcaaaggtaaaaatgagcttatggcggaaaagtttgttacgcctttagaacacgtggcaattgattcgggtctaatagaaagaaggcgaggctcacgtgtgaagaaactcagtataaagcttaaccttgtgtttggatga

SEQ ID NO: 109318 - DNA, 810 bp, Glycine max
  Peptide Sequence Number=SeqID_226096
atgacggacaaaagaaaagttttaggaaaaaataatgaggaaacaagaagttattttacatggaatttggaaatggaacgtgtattggctgatgtacttagagatcaaaggaatttgggcaacaagggtgacggaggttggaaaaggtcagcattgaatgctgcagccgcagtgttatctacaagcttcaatgttaatgtcacatcagataatgtcaaaaatcttatcaaattatggagatcgtggtatggtattgtaagtgacatccttggccagagtggatttgattgggatggcactaagcacatgatcacagttgagaatgaaaatgcttggaatgaatattgcacttcgcataaatcggctaaaccgtttcgattcaaggtgcttcaaaattgggatgatatagtggatttgtgtgctaaagatagagccaccggtcatggagctgaaactgctatggatgctgatgaagcgatgagtagagaaacaaatgaagtggaattcatggggttaggtgctactgccatagatttagaagaaccaagctctaatacaaaaggaaaaagacaatgttcgacttcttctggcacacatcctcacaagagaaagatgggagaaaaagaaggaataacagcttctttggataaaatggcgaactcttttaaccgaatggtggaaagaatggatggtaaagttgatgatgaagatattcaagaagtattacgtgaggcagctttgataccagatcttagtagacaacaatgggctaaagctattaaatggttagctgacgatccaaagcgttag

SEQ ID NO: 109319 - DNA, 555 bp, Glycine max
  Peptide Sequence Number=SeqID_226097
atggattgcatggctttgtttactttaacaagcttgatcatccccaaaagaaaaaatttcgaaaccaagtggtgggaaagggaacgaagtaaactaaagaagggcacctatcgccttaaaggaacacaggatgaaacacaaaagggagtaaaagaagagtcccaaagattctcgagacagatatatggttgcaaagacacctacatggttggtggcattagtaatgcacaatatcgtcttgcagggtgcgtatttaatggttactaccacaattcttcgtttaatagccaaagggaatgggaatgggaatgggagacacaaaagaagacgtacaactgttcttttctttttggtcatacggggatactgtttctgtcgtttcccatactgagacctagacagaaagctaaaaagagtggtatcctagcatggagaggacttgaattaaatgttccaatggacacttctttagaccaagctttcaatgaagaaattcaatcatttagagacaatatgcacttattgaagaaaacctataaatacaagaagctttga

SEQ ID NO: 109320 - DNA, 168 bp, Glycine max
  Peptide Sequence Number=SeqID_226098
atgtcacaaaactgtacgaattacgcaaccatcccctcttcggcttctggaatgttacagaactttacggattgcgcaataatgtttccttttgactcccgacatgtcgcagaacttcacggattgcttaacgatgggtgtcaagttcctcgaagcagtcaggcgaag

SEQ ID NO: 109321 - DNA, 165 bp, Glycine max
  Peptide Sequence Number=SeqID_226099
atgaaatttgacaaaagaggacctaaagtagcaatgacactaaaagtaaataagacaacccggtcaatgaagaagttcaaggtttccgtggaagaaaggtgccaagaaattccatcttggaaacgacacagtttgaatgaagaaagctcagcatatgtgacataa

SEQ ID NO: 109322 - DNA, 243 bp, Glycine max
  Peptide Sequence Number=SeqID_226100
atgtttgtattcaagagtgttttgaaaggacttgacaatactcaacaaagtaaatccaagcctcctactaggtggattgttgttaaatgtaatagacaaaaaggaagcactgagtgtgggtattatgtcatgcactggatgtcaactataatcttaggaaatttcaagaataattggcaaatgtatttcactgatgctacaccattggaaccagagagattgaaggtgtttcgcatccagtag

SEQ ID NO: 109323 - DNA, 207 bp, Glycine max
  Peptide Sequence Number=SeqID_226101
atggccaaatgggtcaccagtattttcgtaatatcagagcaggggcatttatctttgacaaaggacacaatagccctaactggattcagaggctgcattcacaagcaagagaacgagaacacacaaggaccagttaaaaatgattgcagtgcacaccttctttctttttgcatttttgttgataaaacatcttcaatcgatcgatag

SEQ ID NO: 109324 - DNA, 987 bp, Glycine max
  Peptide Sequence Number=SeqID_226102
atgctggtgagtgaatcgagtggttcgaaggtggatcttccggaggagttgctaaatgttctaccgtccgatccttacgagcagctcgatgtggcccgcaagatcacctccgttgcgctgtcgacacgtgtcgacgcgctccaatcagagtcgtccgctctacgcgccgaactcgccgataggaaccggctcatcgccgagctccagtctcaggtggagtccatcgacgccgctctctccgaagccgccgataagctagcccgagccgaccaagacaaggagaatttgctgaaggagaacgcttcgctttccaacacagtgagaaagctcaccagagatgtctccaagttggagactttcagaaagacgcttatgaaatcacttcgcgaggatgaagatacttctgaaggaacgccggacactgcagctaagttacacagtcaagcaagtttcacttccacatcgcaatttggagatgatgatgcatcttcaacgctttcttctagaacatcttcgatgcgaataaacacttctgatatgggaaattatttagcagaggatcgtgagtctgatggctcaaaatctcgagcatcacataatctcctcttagcatctcaaactagcacccctcgaattactccccctggttcccctcctagtatgtctgcattggtatccccaacaagaacatcatctaagcctgtgtctccaaggcgccatgcaatttccttttcaacctcaagaggaatgtttgatgataggtcttcagtagggtcacaaactggggttggaattctaagtgaaacggcacttcaatctgttagcacaaatgtcaaatttggtgcatttttggcaaatgttaaggaactgaattctcataaacaaactaaagaggaaacactacagaaagctaatgagttatttgggcctgaaaacaaggacctctatactatatttgagggactgataacgcgcaatgtccattag

SEQ ID NO: 109325 - DNA, 562 bp, Glycine max
  Peptide Sequence Number=SeqID_226103
atggcgtccacaaggtctgaaaccccaagttcaagggccagcacttctgattcggagagtcagggatcttttgctgggacacctaataacaataaccagtggcgtggtttctttaaactactcaagaaaggatcccaaatgcctttccaaacttttcacccacttaaaaatgttccaaaactgacaagaagaaaaagcaagagaatcagggaggacctcattccatcactgaatgcagcatctcttgacactgagtttggctgcttcaaatcttcctggaaaaacttcaccctcgcggagatccaggctgcaactgatgactttagccatggctatgctgaggtttacttgggcaaattggaggatggaaactttgttgccattaaacggttgacaagagggtgccaagaagaaatgactgcagatttcttgtctgagcttggcattatagtgcacgtggaccaccccaacatagctagattgattggatatggtgttgaaggaggaatgtttcttgttcttcaattgtctccacatggtagcctgtcatccatactttatg

SEQ ID NO: 109326 - DNA, 936 bp, Glycine max
  Peptide Sequence Number=SeqID_226104
atggcatcagcgctggcgttgatgttgcaatggcacgaagcattcagctcctacgctggctccgcaagtgcgatcatcgacccttccaaggtcaaacaagtttcgtggaaaccgagagctttcgtttacgagggtttcctgacggaattggaatgcgatcacctgatttccatcgccaaatcggagctgaagagatccgcggtggccgataatttgtccggcgagagcaagctgagcgaagtcagaacgagctccggcatgttcattcccaagaacaaggctggtgcaaaatcaataggtgccggagctgctataattgcttcgatgggagttgctgatccaattgttgctggtgtagaggacaagatttcatcatggacccttcttccaaaagaaaatggagaagacatacaagtattaagatatgagcacgggcaaaaatatgatcctcattatgattactttgctgataaagttaatatagctcggggtggacaccgagttgccacagttctcatgtatctcactgatgtaaccaaaggtggtgaaacagtgttccctaatgcagaggaatctccacgtcacagaggttctgaaacaaaggaagatctctctgagtgtgcccaaaaaggaatagcagtgaaaccgcgaagaggggatgcacttcttttctttagtctctacccaaatgctatcccagacacaatgagtctacatgcaggatgccctgtaattgaaggtgagaaatggtcagcaacaaaatggattcatgtggactcatttgataagatggtggcagatgggggggattgcaatgataagcaagaaaactgtgatagatgggctacccttggagaatgcactagtaatcccaattatatggttggatcaccaggccttcctggctactgcatgaaaagttgcaaggcatgttag

SEQ ID NO: 109327 - DNA, 615 bp, Glycine max
  Peptide Sequence Number=SeqID_226105
atggacgtgggtcagatgcagagacagtggatcgactacaccaaatccctcttcctcgagtttctgcaacttcagcagcttcaggatgagaacaaccctgactttgtggtcgaagttgtctctctcttctttgaagattctgaaaggcttctcaaagatctcacctttgccctgtcagtactattactatcataccactctcgttttccttccttccacagttcttgcattcattattccatggttgtcatcaaggttttaaatatccatcgtttgcattgtgatttcgtcgcgtttgttgatatcacaccacatcgcagacaaatgcagccgatgcgagatcagaatggcgttgacttcaaaaaagttgatgctcatgtgcaccagttaaagggtagcagttcaagcataggtgcacaaagggtgaaaaatgcctgcattgctttccgcaacttctgtgaggagcagaacacagatgcgtgcgtcagatgtctgcaacaagtgaaacaagagtactgccttgtcaagaataagcttgaaacaatgttcaggcttgagcaacagattgtggcagctggtgggtcaatccctacggaactgagtttcagtggatga

SEQ ID NO: 109328 - DNA, 510 bp, Glycine max
  Peptide Sequence Number=SeqID_226106
gactttcttcaggaaaagctgattccatttaccttatcgggagccattttgatggataagtctggaagaagacctcttgtaatggtttctgcagctgggacattcttaggttgcttgattgctggcattgctttctttctcaaggcaagtcttaaattagaccaaaacttattgcttgagtgggtacctatattagcagttgctggcgtgttgatctacatagcagcattttcgattggtctcggatcagttccatgggtgataatgtctgagatatttcccttacatttgaaggggactgctggaagcttggtggttttggtggcttggctaggagcttgggtagtttcatatactttcaactttctcatgagctggagttctcctggtacattgtttttgtatgctggatgttccctcttaactattctatttgtagcaaaattagtcccagaaaccaaaggaaaaactttggaagagatccaggcttgccttagttcacagagataa

SEQ ID NO: 109329 - DNA, 228 bp, Glycine max
  Peptide Sequence Number=SeqID_226107
atggagttcatccaaggactcatcataatgtgtgggagccaactcgacgttcctctccagaagaatgtttcgaagataaacgttctttgtgtatcgtatctaggcaacctcagaggtaaacctggtggaatcccatgcttgatccgcctcctgagcgcggctctaagatgtggatcctcggtgttttctagaggccatttgcaaaacgaaggacaacaaaagaaatag

SEQ ID NO: 109330 - DNA, 189 bp, Glycine max
  Peptide Sequence Number=SeqID_226108
atgcagagcctccaacagatcactattgcgctctaccagcctatcatgacatcgaaggacttccttcagcgagtagcttggcccggggaccaaccttactctatcaatggggttggtgagggtgatgttgcaaagcctagatatgatgaggactacattgcaaacatctcagttgcccagacagcttag

SEQ ID NO: 109331 - DNA, 150 bp, Glycine max
  Peptide Sequence Number=SeqID_226109
atgtccatgtccatcttcatcccaatcccagagatcaggcgggctatgtccatattcgagttcgaggtatgggttgtgggagctaggttagagtgcatattagcttggctaagcgggtttctcgcgctaagttcatctttactttcctaa

SEQ ID NO: 109332 - DNA, 1158 bp, Glycine max
  Peptide Sequence Number=SeqID_226110
atggcaatggcccagctccctcaggacctcatagaagaaattttgtcatggcttcccgtcaaatctcttatgcgtttcaggtgcgtttctaggacttggaattccctcatcttccaagcacactttgtcaaattgaaccttgaaaggtcatctagaaacacccacgtcctattaaggtgtcaaattaatactgtgtttgaagatatgagggatctcccaggcatcgccccatgctctatatgtagtttacttgagaacccatcatccactgttgacaatggttgccaccagctagacaacagatacttatttataggttcctgcaatgggttggtttgcttgattaatttggttgctagaggtgaattcagtgaataccgggtctggttttgtaacctggccacaaggatcatgtctgaagattcaccacacttatgtcttcgctcatgcaattataaactttggtggtatcaagtgaagtgtgggtttggttatgatgatcggagtgacacttacaaggtggtgttagtcctttcgaatattaagtcacaaaatcgggaggtgagagttcaccgcttaggtgacactcattggagaaaggttttaacttgtccggcattccccattttgggagaaaaatgtggacaacctgtgagtggcactgttaactggttcgcaattcgcaagttgggttttgattatgaatgggaaactgtcaccgtcgatcaattagtaattttttcatatgatctaaacaaggagacattcaaatatttgctgatgccgaatggtctttctgaagttccccgtggccctgaacttggggtattgaagggctgcttgtgtctttctcatgttcaccggagaacccatttcgttgtttggctaatgagggaatttggagttgaaaattcttggactcaattgttgaatgtaactcttgagcttcttcaagcccctctgccctgtgtaatactgaagcttctgtgcatctctgaaaatggtgatgtcctgttgctggcaaattatatatcttcaaaatttattctctataataagaaagataatagaatagtctatactcaagatttcaacaaccaagtgccaatgtcctcccatgattatattcaaagcttggttttgccatatggaaattaa

SEQ ID NO: 109333 - DNA, 138 bp, Glycine max
  Peptide Sequence Number=SeqID_226111
atggcggtggaggtggtgaatatagcaacgatcataccagcaaaggtggtgacaatcatggtgatgggaccagggttagaatcaacccttgcaagaagtaaggaaagggagataagtcatgcagttaaccaagtctga

SEQ ID NO: 109334 - DNA, 573 bp, Glycine max
  Peptide Sequence Number=SeqID_226112
atgcttggagctataacaagcgggcggatacagatttcattggccggaaagggtaagttcacgcaagaattgttcaatattctgaaccatgctatgaggatttcaacaggattctgcattactggatggttagccgtcttcttctcaaagggttcttactcccttgacatgggaagatttttcacagggtacggcataggagttatctcttacgtggttcctgtatatatagcagaaatagcacccaaaaatcttcgaggaggactagcaacaacaaatcagcttttgattgttactggagggtcagtctcattcttactaggaagtgtaataaattggagagaactagcactagcggaaaggtataacaattggcttggtttgaattttgaagggctagtgccttgcatttgcttgctggttggtttgtgctttatccccgaatcccccagatggctggcaaaggttggccgcgaaaaagaatttcaactagctttaagtagacttcggggtaaacatgctgatatttctgatgaagctgctgaaattctggtactttccaagctctcttaa

SEQ ID NO: 109335 - DNA, 906 bp, Glycine max
  Peptide Sequence Number=SeqID_226113
atggctgcagtggttaggagagttattgactttgagctttggaatccagtggagaatgaatctggtttatcaaacttcattcctgtactcattggggacaaagaaatttgtactgaaatgaagacactgcaacaaaaattagatgtttctctcctttctaaacaattccagtctgcatctggtggttctatctgcagctcatgtgaaacttttgcacttagtcacacatcatcatcagacttccttgtagatatagcatggttgcttaaggacaccacttcagaaaattttgacagagtgatgacagcttcacaaattcaaagatattgccatttgttggattttctgatatgcaatgattcaacaattattttgggaaaaatattaccaaatttgataatcttgacagagagcgtggaatccaacaatgttgtaattaataggacaagtgatgttgacataacgcaactcctgaatcacatacataatgctagtaatgtcatatgtcagaaacatcagcaaagtagaagtataattgtgcactctgaaatggaaggctttaaacttgctcagggctgctcccaagataacatgctatcagttgcaattaacagccagggtatcctgtcgagaacagatgagaagtggggagtactgaaaagtccaacttctaatgacaaaacggaaagaataccacttttgaagagggatattataatgagcgtggaagagttgcctgaaagatatgggcgtcgatgtttgggcaggggattcttgacctctcgaccagctatttttgtgattgtttcggttgctgtttgtcttggggtatgtgttgccgtccttcatcctggtagggttagtgagttagcagtatcggttagaaggtgcttgtttaactattag

SEQ ID NO: 109336 - DNA, 3203 bp, Glycine max
  Peptide Sequence Number=SeqID_226114
atggcatgctctcttcttggaccacttctgattgctgccaatggaaagggattcgctgcaccaacctcaccggccacttctgatatgccttcaatcgtttcactggaattgcctcgcaccgttatatcagaggagagatccacaagcagaggaatcccagagtttcttggttctctcaccaacttgagataccttgatctgtcattttctcattttggcggaaaaattccaactcagtttggctctctttctcatttgaaatacttaaatcttgctgggaattattatctggagggttcaatcccacgtcaacttggaaatctctcccagttgcagcatcttgatctcagggccaatcaatttgaaggaaatataccctctcaaattggaaatctctcccagttgcagcatcttgatctcagctacaattcttttgaaggaagtataccgtcccaacttgggaacctttcaaatttgcagaagctttatcttggaggtcgtgctctcaaaattgacgatggagatcattggctgtctaatctcatttccttaacccatctttccttcgactccatatctaatctcaacacttctcatagcttcctccaaatgattgccaagctaccaaaacttagagaactgagtttaattcattgtagcctttccgatcattttatcctttcattgaggccctccaaattcaatttttctagttccctttccgtccttgatctttcctggaacagcttcacgtcatcaatgatactccagtggctgtccaacgtcacttccaaccttgttgagcttgaccttagtcataacctcttggagggttccacatcaaaccattttggccgtgtaatgaattctcttgagcacctcgacctctcatataatatattcaaggtattctcatctctaagatcattgtttcttgatggaaataaattaagtggaaagatacctgaaggcatccgcttaccgtttcatttgaaatctctgtcaatccaatacaactctttagaaggtggaattcccaaatcatttgggaactcatgtgctttgagctcactggatatgtctgctaacaatttgaataaagagctttcggtgataattcatcaattgtctgggtgtgccagattctcgctgcaagaattgaacatagaagcaaatcaaatcaatggtacgctttctgacctttcaatattctctgccttgaaaacattggatctttcaataaatcaattaaatggaaaaattccagagagtaccaaattgccatctctgttagaatctttgtcaattggatcaaactctttagaaggcggaattccaaaatcatttggggatgcatgtgctttgcgctcgttggacatgtcttataatagcttgagtgaagaatttccaatgataatccatcacttgtctggatgtgctagatattcattggaacaattatctctaagcatgaaccaaatcaacggcacactacccgacctctcaatattctcatctttaagagaattatatctttatggaaacaagctaaatggagagattcctaaagatattaaatttccacctcaactggagcaactagatatgcaatcaaattccttaaagggtgtgctcactgactatcattttgctaatatgtctaagttagacatcctggagttatctgagaactctttattggccttggcatttagccaaaattgggtcccaccatttcaattgagctacttaggattgcgatcttgcaagctaggtccagtatttcccaaatggttggagacacaaaatcaatttcgggatattgacatttcaaatgctggaatagcagatatggttccaaagtggttttgggctaatttagcattccgagaatttatttcaatgaatatttcatacaataatctccatggtataattcctaattttccaacaaagaatattcaatattccctaattcttggaccaaatcaatttgatggccctgttccaccatttctgcgaggttccgtatttcttgatttatccaaaaatcaattctcagattctctttcatttttatgtgctaatggtacagttgaaactttgtacgaattagacctttcaaataatcatttctctggaaaaattccggactgttggagccatttcaagccattaacttatttggacttaagtcacaataatttttcaggaaggatacccacatccatgggatctcttcttcatcttcaagcattgctattgagaaacaacaacttaacagatgagatacctttctccttgaggaattgcacaaatctagtaatgctagatatttcagaaaacagattatcagggcttatccctgcttggatagggagcgaattacaagagttgcaatttttaagtttgggaagaaataatttccatggaagtttaccattgcaaatttgctacctaagtgacattcaactcttggatgtctcactaaacagcatgtctgggcagattcctaaatgcatcaaaaattttacttcaatgactcaaaagacatcttcaagagattatcaaggtcattcatatcttgtcaatatcattggcatgtctggtagttatacatatgatttgaatgcactcttgatgtggaaaggttcagaacaaatgttcaaaaataatgtgttactacttttaaaaagcattgatctctcaagcaatcacttttctggagaaattccactggaaatagagaatttatttggattggtttcattgaatttatcaagaaaccatttgaccggaaagattccttcaaatattggaaagttaacatcacttgactttcttgatttgtcaagaaaccatctagttggttcaattcctttgagtcttactcaaattgatcgactgggcatgttagatttgtcacataacaatctatctggagaaattccaactggtacacaattacagagtttcaatgcctcatgttatgaagataatcttgatctttgtggaccgccactggagaaattgtgtattgatgggaagcctgcacaggaaccaattgttaaacttcctgaagatgaaaatttgcttttcacccgtgaattttacatgagtatggcaattggatttgttataagcttttggggcgtttttggctcaatcttaataaatcgttcttggagacatgcttatttcaa

SEQ ID NO: 109337 - DNA, 315 bp, Glycine max
  Peptide Sequence Number=SeqID_226115
atgctagcaaaggcaattgcaaatgaagctagtgttcaagtttcattaatgtctcaatgtcaaccttcattcacatcaaaatgctttggagaggatgaaaaaaacattggagctctgttcacactgcctggtaaggaaaagaagcaaagagaagcagaaggccaaagctccgaagatgcttcaaacaataaagacaaggaagaacaagaaattaaagcgaggcctttaaacatggaagacatgagacaggctaagagtcaggtggatgcaagttttgcgtcagaaggatccgtaatgaatgagttaaagcagtga

SEQ ID NO: 109338 - DNA, 948 bp, Glycine max
  Peptide Sequence Number=SeqID_226116
atggcgaaatctactctaccaagcctgtttcgccaaccccaatggccaaatgctgattgttttgccaaccccaatggccaaatgctgactattttgccaaccccaatggcgaaatgcactccaagttgccacgtggacgaattcgctgatcgtactggtgcaatttctggatcaacactgtttgaagagcttggactttactatataggtcccgttgatggtcataacatgaatgatcttgttgccattctcaatgaagttaaaaatactgaaacaactggtccctgcgtgatccatgttgtcactgaaaaaggccacggatacccttatgcagaaagagcagcagccaagtaccatgtggtatctaagtttgatccagcaactggagaacaattcaaggccaaggccaccaccaagtcatattcaacatactttgcagaggctttgattgcagaagcagaagctgacaaagacattattggaattcatgctgcgatgggaggtggaactggcatgaatcacttccttcgtcgtttcccaacaagatgctttgatgtggggatagcagaacagcatgctgttacctttgcggcaggcttggcttgtgaaggttttaagcctttttgtgcaattaactcatccttcatgcagagagcttatgaccaggtggtgcatgatgtggatttgcaaaagctgcctgtaagatttggaatagacagagctggattagttggaccagatggttgcacacactgtggtgcatttgatgtcacttttatggcatgcctccctaacatggtggtgatggctccttctgatgaagcagagctttttcatatggttgccactgcagctgccattgatgatcgacccagttgtttccgatacccgagagggaatggtgttggtgttgaactaccaccagggaataaaggcattcctcttgag

SEQ ID NO: 109339 - DNA, 1299 bp, Glycine max
  Peptide Sequence Number=SeqID_226117
atggaaccccaatctctccctcctcctcccaccatggacgacgcccaagacccttcctcaatttgggacttctcttacctcctcgacttcaacctcgacgaccaagatggtatttttactagcagtaactctctccctcttcccttaaacgacgacgacgacgccgccgctcccgagatttctcaaaacgacagggtccgaaagcgcgacccgaggatgacatgctccaacttcctcgcgggtcgggtcccctgcgcctgccccgaactcgacgcgaaactcgaggacgagggtttgcccgtcaagaaacgcgcccgcaccgcgcgtgcatctgcgtccgcacgctgccaggtccctggctgcgaagccgatatctcagagctcaaggggtatcaccgccgacacagggtttgcttgcgctgcgctaatgccgccaccgttatgctcaacgacgaggccaagagatactgccaacagtgtggaaagtttcacgttttgtcggatttcgacgaaggtaaacggagctgcagaaggaagttggagcggcataataccagaaggagaagaaagcctccggcggattctggaggtgctgctcatagtgaactacttcaacctgttgctcaaaatgaggaacacaattatcatgtggaagctggaaaagataaagttggttttttgtgttgcaagaatgctcactggctgagtatgaatcgtacagattgttcgaatttgagtaccgatatcaacgacgttggagtgtctctggatcttgaagatgaaccggctcccattccgagctcggctcctgaagcccagaatattaatagtgatagtgttgtgtctttggctgtttctggtgaaacgcgagtgaatagtgggaacacttccaattcgccttcttattgtgacaataagagtgcctattcgtctatgatattccaatggttggcaagtatgcctgtggagttggagggatatatccgccctgggtgtacgatcctgacaatttttattgcaatgcctaacatcatgtggataaatttactgaaagaccctttggagtatgtgcatgatattgttgctcctggaaagatgctatctggaagaggcactgcactagttcatctgaatgacatgatcttccgtgttatgaaagatggaacttctgtgacgaatgtcaaggtaaacatgcatgcaccgaagcttcactatgttcatcccacatactttgaggctggcaaacctatggagtttgttgcttgtggaagtaacttactgcagcctaagtttcggtag

SEQ ID NO: 109340 - DNA, 3444 bp, Glycine max
  Peptide Sequence Number=SeqID_226118
atgagtccgattgattctacgggcaatgatgatcgcaaaatccaccaagattttgacttcgtcgacactcaaccattcgacaccgatggcgaggaggacgatgtttgtggatacttcgaggacacagtgcctttcgacgaagacgacgacgttttggagaccgaagcggtggaccttgccggtgaaactcaggcattggatgatggtgacgctttcgatgatgtccttttggagaccgaagcggtgaaccttgccgaggaaattcaggcattggatgacggtgacacgcagttgctggaggaagagtcggattcggatagaacgcaagttttggagactgtggatgatgatgaggtatctgtcgacaatgtcaatggtgaagccgcggatagcaagaaggttgaatcctcacaacaaaacagctatggttctatgccaccacggtttaattttctccatgcagaatctttgcggcaagctgctctagcctgcgacatggatttgaaagaaaccctggatgtgaccaattctgtcaagggtacgagtcagttttgtcaggaaccactggttgtaaaggataagggagaatcctttcttagatgttctgagaaggatgggggagttgatcaagaaaacgagcatgggaaatacagtgtggaagttggggggtttaagagcaaaagtatgtgcaaggttgctaactcaacagtgagaaaacttttcaatgatgttttacctgttgaaacaaaccaaccttctcttagcagcaatgattttaatgaaggagacgacttggacaagttgcctatttaccatggtgaattgtcggggttaagctatgtgaactctcaagaacctggagttttgtcacaggacaatgctctttgttttgtagataggtttctcaaagataatatcatggagtttgatcaagaaactaactgtcttaaaatggagggaaagtcaaaatccatccccagtacgaaaaggcaacacagtttggccaagacagtaaatgataaaggcaaagctagaagaactgggatttatgactgggatgatagccgtgaggatgaaggtggaggagatatattcctaaggagaaaagaagatttttttaagggtgaaatgcgtaggccaaggtcgttgccaggattccagaagagcaaagtacacagactaaatgatgataaggaagacaagaaacaatttagtattcctaataaaagaaagactgcagttcattctgattcaaaactagggatgcatattctgaaagtaagggacaatattataccagaagcaacaatgttaaaacggaatcttgctaacgaattggatgaacaatttaacactgattgctctagaggagagatggagcccaatgctaatgcatgtgcacaggagatgctggatgtaggtttagatactcaaatggctgctgaggctatggaagctttatgcaatgtcggggatattgttgatcatgttgctaataatgccactcatgttactagaagtggtttaacttataaacttaataactcttctactggaaaagtggggtcgggttcgtcaaaggaacgttcggtacaatatgacaggaaaaggaaagttgatgttaaatcaaagttgcaaacttcaggtttatcaaagaaaagtactaaagaagtcaagcaatgcacagaggacaatatgatgacaagatcgaagagaagcaagttaaatgcagaaggcaaccaaacctccagtgctaatgaaaatggtagagtatccttgtctccaataattgcacaaagaaagtcagatggagctttgaaaagacatcagcttgatgagttggataatcctgatggtaataatggagaaggtggagggagttcagtcgacaaaaggcattttcaggatggtgtttggcattttacaccaattgcctgcagaactcgacggtccttagcagtaaaccaattgataaatcgagacataccatccaaaagtttgagaggtggggatatagggattcgttcccttgagaaaagcagtggaattggcctacaggcatccaaagcattgaattctaaatctactacaggatcttctgatcactttgaagtagatgataattccaaatcatgtcaatttgagaattcggttccaaaggcaagtgctgttaatgtcagtgatgatgttaaaatagatacattagattgtcctaaaagaaggagatctcttaggattaggcagttgtctaatgatgataaacaatctgagacattagttggttcatctaaaccatctgcacaccctgaagatattgggaaatctactgctgggaagagaaaaatgagaacagattctgtagtcaaattccatgtgaattgccaagctcgctcatcttcgtatgatggttcagtaataacttctgttgatcgaaaacaaggtaaaatatcagagataaatttagataaagctaacccaggggacaatatcaataattctgaagtctccagttcagatgaatcaccaagagagaggtacaagtcatctgacttggcatctgcaactcaggcaaagtgtaagatgcctgtgaatgatgcatcacccatttgtatgggtgatgaatattacaaacaatcatgcaatagaaatctttcaagatcatgtaaggagctccatagagaacttcaaagcttgagtgacatcagacctgaattacttactccgtctaaagattcaagaaagaggagggacatgactgatgttcgaattctttacagccaccacttggatgaagatattcttaagcatcagaagaagattttagcacggcttggagtttctgtggcttcctccattgcagatgcaacccatttcatagctaatcaatttgtgcgtacaaggaatatggtagaagctattgcttttggtaaaccagtggtcacacacttatggattgaaagctgtggtcaagctagctgttttattgatgagagaaattacatattgagggatgcgaaaaaggaaaaggagttaggtttcagcatgccagtctcactagcacgtgcaatccagcatcctcttttaaagggtcgaagagtattggttaccacaaatactaaacctagtaaagagattgtttcaaatttagcgagagcagttcagggccaggtggtggagaaagtaggaagatctgttttcaagggcaatacaattgcagataatctcctgatcttatcttgtgaagaagattatgcctcttgtgtgccttttcttgaaaagggggcaatggtgtacagttcagaactgttgctgaatggcatagttactcagaagctggagtatcaaaggcatcgactttttgcagacaatgtgaagaaaactcgttccaccttatggttgaaaagagatgacagaacatttattcctgtgactaaatctaattag

SEQ ID NO: 109341 - DNA, 2208 bp, Glycine max
  Peptide Sequence Number=SeqID_226119
atgcaagcacctcaagctgcatcagccactgatgaagctcctgagatttcccatcaggctgtcccccagcgaaacaaagaagtttcagacagtggacccggtggtaggcgccctgatatttcacttcaagttccccctagacctatagggtttggtagcactagtagtggaagggttctggaccattgtcaaagtttcggtaaagggatttcatcatcaagaggcttcttgcgggccttgagcttgaaaagaaaaggaaatgtagcagatggcgaaagaagttccctccttaattcagaccccaagacagctgcagacggacctaatatggcctccatatctgaaattgcatggaaaagatgtacttctcttcctgttacacctgcatcaaatctgtctccttcagtttctacacccatttctgcaaggacatataatgaacagactaagcctcataaagatgttgaccgttctaaggtttcaaggtccctttctgtacctgggcgaaatgttgttattgagctttctatacttggccaatcagatcaaataactcctgtgcaagtagaagttactgccgatgaagaaatccccgaagaggaagcggtgtgcaggatatgttttgatgtatgtgatgaaaggaatacctttaaaatggaatgcagttgcaaaggtgacctgagattggtgcatgaagaatgtttaattaaatggtttagcacaaaaggagataaggaatgtgatgtatgcaggcaagaggttcagaatttgcctgtaactttgcttcgtgtgactagctctgttagacaaaacagacagctgcaaggtcagcataacctacatccagagtcaataagcgcttggcaagactttgtggtgcttgtcctgatcagcacaatatgctactttttcttccttgaacagctactgcttcctgaattaaagactcaagcaattattatagcagcaccatttgcctttaccttgggcctcctagcttctatttttgcagtcatcctggcaattaaagagtatatatggacatatgctgctcttgagtttgcacttgtggctttaactgtgcatctattttatactatggtgaatcttatccactgtcaagttgtgatgttggatcacccaaaaatgccgtatcctgcaaactttatgtctaaaggaattgcagagcgtgttaagatgtctgtccgcatgcaatattattgttctgattatttcatgcagtcttcctcttttgtcatgcagtcttccttgttgcatttgacagccatatatgccatactactttcatcagttttgggttttggaattgctatgggcatcaactacgcatatattcagtttgtcacttggagacttcaggtttctcatgatgataacccaataaattggaatccaagtctactccatcgacaagaaagtttgtttaagtatgcggtgaaggggcagtggagagaggcattagaggcctacaacaaaaacctaggagcattggaggctaagatcacaagagtggaagacacggtgctacatgttgctgtgtatggagtgtgtcggataacatcgacagagaggtgtctctcaacatcttgtgcttgcaaaactcaaagggaaacactccccttcaccttgcggcacagcttgggaacgtggaattgtgcgacaacatggccaaaaggaaccccaaacttgtttcatgtcacaacattgaaggtgagacccctctcttctaggcagctgttcacggcaagagagaggcgttcttttgtctccatgaaaaccaaccaagacgtgatcatgaggatggctcgttgttggttaggaaaagcaacggggataccattcttcattctaccatctctagtgaatactttgattcttgctgggaagcctaattgtttcaaaagcagcatgcgaatggagttacttcagcgtattatttacaattgttcgattgttgatgagattgagaaaacagatgatttacgttgtaatgaagcagacacagctcatcactacccaatgaactatgaaacacgcgcgaccttcttatcattgttgaagagtatatatcatggcaaagtaatttgcgtggatacttcaataggaaaagatgacaacgctgcgagcaatgacgaagagaataatgtctcccgaaaatctgataatttttcgtcttgcaaatcatga

SEQ ID NO: 109342 - DNA, 132 bp, Glycine max
  Peptide Sequence Number=SeqID_226120
atgttgtcaagagttctaggttgggtggcttgcattaaagacaggagaccaatgagagtaatgtgttatttagcttttaaaagggaggtgggtgttgatggattggcaagtgcaccaattcgtcccaagtag

SEQ ID NO: 109343 - DNA, 492 bp, Glycine max
  Peptide Sequence Number=SeqID_226121
attgggaaaggtaggatactaattgaaggggaaagagtggctttgttgggctatggatcaactgttcagagctgtgtggctgctgctaccctcttgggagatcttggcttgcatgcaacagtggtgaatgcacgtttctgcaagccattggatcattccctaattcgaagccttgcaaaatcgcacgaggttttgatcaccgtggaagaaggatcaataggaggatttgggtctcatgttgctcagttcatggcccttgatggccttcttgatggaaaattgaagtggaggccaatggttcttcctgattgttacattgaccatggatcacctgctgaccaattgaatgaagctagacttacaccatctcacatagcagcaacagttttcaatttacttggacaggcaagagaggaactagaggtcatgacaaaagagaaatgcaaagaaggggttcaattttcatcccctgaaatgtacaaagtagcgtga

SEQ ID NO: 109344 - DNA, 2968 bp, Glycine max
  Peptide Sequence Number=SeqID_226122
cttggttgtctgtttgcttggtcatagcactcgctttcaggttttgaaatctggattgttgatggagtgcaataaagaagaggccttaagggccaaggaacttgctgaaaagaaaatgcaaaacaaagatttcattggggctcggaaatttgctcttaaggctcagcagctatatcctgagttggagaatatcactcaaatgcttattgtttgtgatgtgcattgctctgcagagcagaaattgattggcaatgagatggactggtataaaattcttcaaattgagctaacggctaatgatacaacaattaagaagcaatacaggaagtttgccctccagcttcatcctgacaaaaacaagttttctggtgcagaagctgcgtttaagttgattggggaagcccaaagagttcttttggatagagaaaaacgatctaggcttgacatgaatttacgcagggttccaacaaacagaactactatgccatctcatcatcagcagaatgttcagatgagttttaatcccatgatgcaaaccagtgccaggcccaattttacaaacttaaatcctcagccgcaacaaaagtctaggcaggcatctcagcaggggcctaatggtggccgccttactttttggaccatgtgctcattttgttctgttagatatgagtattatagggaggttttaaacagatctcttcgctgtcaacattgcagtaggcccttcattgcatatgatgtgaatatgcaaggcacaacaccagcaactaattcaagtcagcaagcttttggtgcgcagaaccatagtcagaatcagggtgcttttgacgttgctgctggatctcaaggtaatttgcatactagccggtccaatacagaatcacataataaaaaaggtcctgctgctgatgtctctgtaaagccaaatggaaagagaaggagaaagcgagtagcagaatccagtgaaagtgccgaatctgttggtagcactgattctgaatctgaagaggatacactttatgacaaggatggtttttcgactcatagagatgagaatccccgtagatctacgcggcaaaagcatcaggtttcctacaacgagaatgtgagtgatgatgatgaagggggtggatctccatctggtgctgctgaaaatacaggggaggtatctaaaatgaataatcagaatggtttggctgctgatctgaaaggtgataaacaaggggcaaagcggaaacagaacttttattctggagagagcttacaaaatatagatgaggaaattaaggaggtgagaggaaaagaggcagtgggcagctcaaagatagacaaagcttcagagcattcaccctcgaaatcaacaaatcaactagataattttgtttatcctgatgcagagttcagtgactttgacaaggacaagaaagaggggtcttttgccgttgggcagatttgggctatttatgatactatagatggtatgcctagattctatgccataatcagaaaagttttctctcccggattcaagttacggataacatggtttgaaccagatcctgatgagcaagatcaagtccactgggtagaagagcaattgccaattgcttgtgggaaacataaacttggcatcactgaaaccacagaagatcgtctaagtttctctcatctgattgtttgtgaaaagattggccgctgtacttataaagtatatcctagaaagggagaaacttgggctctttttaaaaattgggatatcaaatggcatatggatgcagaatctcatcggcagtatgaatatgaatttgttgaaatcttgtcagattatgttgaaggtgtgggagtagttgttttgtacttagctaaattgaaaggttttgtgtctctcttctctcgaatggagggaggtaattgcacatttcaaattccatctaccgagttattcagattctctcacagggttccatcttttaaaatgactggtcaggaaagagttggtgttcctgtaggatcttatgaacttgatccggtatctttgccaatgaatcttgaagagattgctgttgctgaacatttggaagtaaaggagggtcattgtccatctagtggggtgggcacaaggtattcagatatgtcgaaattcacaatgaactcagagggagaagcttctactgaaaaggttaagtgggaaagaagcaattcagcagaggagaacaaggatcctgttgatcatataggtaatggtagtgacccttcagcttcagccgcagatgcttttgaaattcctgatcctgagttctgcaattttgatgctgagaggtcccttgaaaagtttcaggttggtcagatttgggcattttatggtgatgaggatggactgccaaaatactatggtcagattaagagggttaagagtagtccagatcttgagttgcaagttacttatcttactaactgctggctaccggagaaatgtgttaaatgggaagataaggatatgcttatttccattggaagatttaaaatcaaagcaggtgcgcgttcctgcacatatgcaaacacctattctgtttcgcatcaggtgcaggttattaccgatggtaagaagaaggaatatgaaatttttccaagggaaggcgaaatctgggcattgtataggaattggacgactaaaataaaacgttccgacttgttaaacctggaatatgacatagttgaagttgttggagaacatgatttatggatggatgttttacctttggagttggtaagtggttataattcagttttcaagcgcaagtcaaatgcaggatcagctagggccacgaaaatatactggaaagatttgctcaggttctcccaccaaatccctgccttcaaactgacagaagaacaagatggcactctgagaggcttctgggaacttgatccgggagcagtaccccttcattattttaacaacaaataa

SEQ ID NO: 109345 - DNA, 171 bp, Glycine max
  Peptide Sequence Number=SeqID_226123
atggtgagtctgttggcttcaattgcttttgtgctaatcgaagttcgtgatgatggaagtagggtgtttatggtgaggaactttatactactgcttctcaagctactagaatgtagaaacatagacctctactttgctaatgaggatgaagcagctggacttttaaggtga

SEQ ID NO: 109346 - DNA, 405 bp, Glycine max
  Peptide Sequence Number=SeqID_226124
atgaatggtatcatggatgtgtcatcgtggttgcttattgaggacagtgcagattctgaaggagactctggctgctttagtctatgcccttgcaacattggccacaaggaggatgatgctgaatcttgtacctgtgacccagctggtatgtgtggcatatttgaggatggtgaaggtcatgaaggtgagaaggggtgtggtgaattctgtgctgatgaagatgagcattgtggttcagaatggaacagctctaccatgtggctctcagatgcagccttagaaatagaatgctcttcacctttggttgttgaagatgaagaggaaacaaggattgttaaagttaatgtgaatgatgtggaagataaaatattttgggagatatgcatggcagtagggtatccttga

SEQ ID NO: 109347 - DNA, 396 bp, Glycine max
  Peptide Sequence Number=SeqID_226125
atgcatttctctgtcgacattggagttcatggctttgcaccaaagtacacttcattggaggcacaattggagctcattattctttggaacaagaaggcatgttctaagggatttggaaaagggatcaagtctcaaaggacaagaaagggcactgctggcagaaaataccagggagggaccagggacaatcagtctatagtttgtgttccagcgggggtgggtgagtcgacaagaaaccctctaacttatggtaaattaaaaaaggaagaattatctacgaaagggaaaagagatgtggagaagaatgagaagttaggtactatggacccttcagaaatggccaagaggtttgttgtaaagagcaagaagagcttacatgaagatggtgccaattag

SEQ ID NO: 109348 - DNA, 359 bp, Glycine max
  Peptide Sequence Number=SeqID_226126
atgattgaatctgagaacaataacttgattcagtccaaagctaagattgaagcggagaggaaaagattggttgatcgggagaaagatttgcttgccaagattgaaagggatgagactatttttaaggtcatggcaacactaaaggaggagaaagaattggctgaacaagatgctaagtcagttaggttgaaaccagaagaagccaaaaaaaaaaaatcaaatgatttattctttgcccttgaggatgccagagatgatgcagtcgaaagctttaccaaagtttttgatgctgcaaatgatcaagtgattcaaggcgaccaagtcatcgagcatatggcagacgttgaagaaaaattaag

SEQ ID NO: 109349 - DNA, 744 bp, Glycine max
  Peptide Sequence Number=SeqID_226127
atgagtccctcacaattccatgcaaagaaacaaactacctccaccaccaataacaacaacattaatgggttgctatcaccatctttgagaatcaacaaggaatcacatttaataaaaaaatcatcatctacatcaccatcatcgtcatcaacatcatcatcatcccttgttaatagtgccatgacacaggcaatgccaatgtcattatacaaacaaacgccaccacaacaacaacaatgccacccggtaattatctacacacattctccaaaggtcattcatactcagcctaaagatttcatgtcattggtgcaaaagctcaccggcctctctcgctcagatgaaaaggaggatgaggacggtggcaacccaacgccgcaacaaccctcaaaccagaaatttgggggtgacgttgcggtggccgtgggagacaaagaaagtggtcgaaaaaatgaggacaacgagacatcatcggtcataacaaccgaagaaaattattgtagtagcgtgggagaaaaccaagttaactcttgtttcatgatgggggagccatcaatgctagagcctaggttgaacccttacgtgacaaatttgccggtgttggcaccgagctcggcggagtttgcgtgttcgagtcagccattcttgaattacacggattctttgtttttctctcataacatgaggaactctattccatcatctgtgacattggaagggatgaaagagttccgtgagcattga

SEQ ID NO: 109350 - DNA, 138 bp, Glycine max
  Peptide Sequence Number=SeqID_226128
atggaattgctcagaaaggagcacgacgagaagctagggattgacgagaacgagaacggattcaagaacaacaagaatgagattttagggattcgattcgagaaccagaagttcgagttcaacaagaacgagaggtag

SEQ ID NO: 109351 - DNA, 159 bp, Glycine max
  Peptide Sequence Number=SeqID_226129
atggaagtgcaatgggacgctatggcaagcgatcaggaatacaaaagctggagaatgagcattaatggagtgatggctggtcgaaatgatcgtgcgatagttgatggcctcgaagctttagcccaagctatggggaatcagaatagaggagaaacttaa

SEQ ID NO: 109352 - DNA, 1251 bp, Glycine max
  Peptide Sequence Number=SeqID_226130
atgggatcagaaccagttgtactagagtttccagaactgaaaggtcatgctcgtcgtgattattggctagctatcatccaagagattctatatgttcacaaattcataagcaagtataaacttaaaggggttgcacgggatgaagcgctttggaaggctgttttaggaattttgcgtttacaagccattcaagatattagttccacgattcctatacagaatgatgctcttctcatgtttaatttatgtgatcagcttccaggcggagacttgatattagaaacccttgcaaatatgcctaacttaagagagtcagatcatgagaatgatttcaagggtggaagtggaatgtattctatctcagctttggacatggtttctaacttgggatttgtatttggagcaagttcaaacaactcaaatgagagtaggattgctgtgggtgaaatatctgttggagaaatgactgaattggaaagagcagttaaagaatctaagaacaatcataaaaaggtcatatctgcacaagcgacagttgatggtgttaaagttgatggtatcgacaccaatctggctgtcatgaaggagttactttttcctctaaatgaacttgggaagtctcttcagtccttggcatattgggatgatccacggaagtctttagtgttttgtttgtttttcagttacatcatctacaggagagaagcgaggggttggcttggctatgcagtagcgctggtgctcttgttacttgcagtttttatgataattactcgatgttttagccaaggtaggtcagttcctgaagttaaagtaattgccccaccaccgttgaatacaatggaacagcttttggctgttcagaatgctgtctctcaagctgaacagctcatccaggatggtaacgtaattctgctcaagttccgtggcttgttgctgtccattttccctcagggtaaaaacttttacattgatagtgtatgcctattaaattcttcacaacttttgtctggacagaagcatgccacggagaagttagcctttggtcttctatcaacagccttgattttggctttcttgcctactaaatacataattctgctactcttcttggagatatttacaagatattcacctccaagaaaagctagcactgagagattgacgaggagattaaaggaatggtggttcagcataccagcagctcctgttacacttgaaagagatacagaggaaaagacacgaacctag

SEQ ID NO: 109353 - DNA, 594 bp, Glycine max
  Peptide Sequence Number=SeqID_226131
atggccgtcgctagcaaaaccagaaatatgcttgaaggtctggtaaaagaaggatcattgaaatggttgcttggcaagaagagttactttggtgaagaatttgaagagatggaaaattctccttctgctgggaagaactttatacgagagctctctcctgttgcaaacctagttgttcgtagatgctcaaatgatcttctggagagcttcaatcaagaggcttctgattctatgaagcatccatcacgatatgcgaggaactttttggaatattgttgtttcaaggcacttttcctgacaacacaaatgactggtcatctctttgataaaacattccggcgtttgacatatgacatgatgttagcttgggaggccccggctgctgacagccaacctttaactaatgtcgatgaggacatatctgttggtttagaagctttctgccgaatagctccttcaattcctatcattgccaatgtcatcattagtgaaaatctttttgaggtgctgagttcatcaactggtggtcgccttcagttccccatctatgacaagtacctcactggcctggaaaggtatcaacctttaccttga

SEQ ID NO: 109354 - DNA, 360 bp, Glycine max
  Peptide Sequence Number=SeqID_226132
atgggtaaggttatgggggaaggatcactcaacaaacaagaaaagttcaaaatctcacaggggtctgtttccgacgtgggtgccgccattgacactggcgggaagcttgaaccgccagtgccaatggcggtaaggtgggtaccgctagtcccggttgcgggacatgtgctgagtaggagagagggggtgggtgccgctgatggcatctgcgggacaagtgagagacggtgggtagagtgggtgccgccaatgctgtttgcggtacagggtggtgccgccagtactgcttgcgggacaccttcagctagcaatcccgccattagagctggcgggacaggcttctcatgcacatggcactga

SEQ ID NO: 109355 - DNA, 438 bp, Glycine max
  Peptide Sequence Number=SeqID_226133
atgtcctcatttcctcccaataattcagcaatgaatgctaatgatgaagttcatgcgagacctattgacaaaataaaaattcttcttggctttgattcttgtctctctgtggatactaatggcagaagtggaggtttggtcatgttttggaaacacccttttgactgtcaacttctcaatttctcaagcaacccttcatggaggctcacgggcttctatgggtatcttgagtgtcgaagaagtaaagattcatggaatcttctccgatatttggcaaatgatacttctctcccattgtgtgtcttcggtaacttcaacgaccttctctccagtgatgaaaaaattggttttattgatcaccctaattggcttctaaatggctttagagaggctttggcggattgcaattcgcatgacctcccaatggagggctactaa

SEQ ID NO: 109356 - DNA, 285 bp, Glycine max
  Peptide Sequence Number=SeqID_226134
atggtgtgtgctgagagggagagagagctcgtaaggagagagagctcgtctgcagtgtgcgatgagatagagggagagcgcgtgtgggtactcttttccttgtaccttcctaaattccctttctccaccttctcagtctctggcaacagtggtggcgaaagacggttcagagttgtcaacgctggttatttttcctcttctggctattttcttagttgcatggaggtgcggcactggatgatgggtcgaggtggtgtgcagtggtcaagtgttggtaaattttaa

SEQ ID NO: 109357 - DNA, 819 bp, Glycine max
  Peptide Sequence Number=SeqID_226135
atggctgaattcacagaaaatatgcaattgcaaagcaatattagaccctcccagtttccattcttagagattgatccaagcatggaactcctaaaccagttcttagggatgaaccaacatgtcctagaaaactcaaacttgattcctatgcacaacttggtgcctttctcctgtgacacctttttgggccctcaagagcctgagtgtccaggaaacttggaagaaaatttccctgcccatgtcaaccacaatgcacttcctatttccctccccattttccaagcagaaaatgagatccatgaaggtaaaaagaggaaatcaatggatcttcctgagacaagttcagctaactcaactcctgcagtttctgaaagtggaagcaagatcaaacatagttctggaagagggaagagagtaaaaagcaatgtaacagaagaggagaaagcaaaggaagtggttcatgtcagagccagaagaggtcaagctactgatagtcacagtttagcagaaagggttagaagagggaaaatcaatgagaaattaaggtgcttacagaacattgttccaggatgttacaagaccatgggtatggcagtaatgttggatgaaatcataaactatgtgcagtccttgcagcatcaagtagagttcctttctttgaagcttactgcagcaagtaccttttatgacttcaattccgagacagatgctttggaaacaatgcagagagcaagggcatccgaggcaaaagagctaggaaagtataagaaagaagggtatggaggagtttctttcttccaaccagcatggcccctttga

SEQ ID NO: 109358 - DNA, 444 bp, Glycine max
  Peptide Sequence Number=SeqID_226136
tgggtttgagcctctggatggtgatgggtggggttctggtgattattcgaaagggtgttaccgtggggacgcggggtgtgatgggagtgatgggtttcgagatctgggggatgtgaggtttgggtttgggaatgtgagtttgatcaaggggaaatctagaagcttttgtgagggggagtgtttgagggattgtgggtgtgttgggttgagttttgacgaagggagtgggaatttgactggtggtggtgaaagtgggggtttttatgttagggttccaaaggggggatctggtgggaggaagaaggtgtttgataggaaggttttgagtggggttgtgattggagttgttgtggttttgggggtggtggtgatggctttgttggtgatggtgaagaagaagaggggtggtggaagaaaggggttggaggaggaggaggaagatgg

SEQ ID NO: 109359 - DNA, 1383 bp, Glycine max
  Peptide Sequence Number=SeqID_226137
atggatttgtatgtttttgcaacaccctacaggattacttgggactactacttctcttcacgagaacataccttgaagtttgactcgtgggaagagcctgcagagttggaatatgtgaagcagcatggggtttctgtgtttctcatgccatccgggatgcttggaactctgctttctctgattgatgttttgcctttgttctcgaacactggttggggtcagaaagccaacctggattttctgaagaaacacatgggagctacatttgagaagcgcagccagccttggcgtgcatatatagatcctgcagatgttcattcaggagacttcttagctgtgtcgaagatccggggtaggtggggaggttttgagacgctagaaaagtgggttactggttcattcgctggtcatactgcggtttgcttgaaggatgaatggggcaatttatgggttggtgaatcagggcacgagaatgaaaagggtgaagaaataatagtggtaattccctgggaagaatggtgggaattggctcttaaggatgattccaatccacagatagccttacttcccctgcatccagaaatacgagcaaaatttaactccactgcagcatgggaatatgcccggagcatgtctggcaagccatatggttatcacaatatgatattcagttggattgacactgtagcagacaactatcctccacctcttgatgctcacttggtaatttctgtcatgtctatgtggactagattgcagccagcttattcggcaaatatgtggaatgaagcattgaataagcggttagggactgagaagggattctttaagacaggaaaatttataaagagatgggacatgggaggaaaagtaatcctccaagaaaaaaacgtgcttaaaattcttacagcattttgccaatcaaatgaaccaaagtgtagtctttctttcggatttggatcttctatgggtttggatttgcatgatattttagtagagactgagaagcgtgggataccttttgatgaattactcaccattccagaacaagatgaatgggtatacagtgatggaaagtcgacaacttgtgttgcctttatcctttctatgtataaagaggctgaagtttttggtcccattgctaattccattcaagtaaccgagttcaccattcgcgatgcatacatgctcagaattttcgaggacaaccaaacacgcctaccaagttggtgcaacaatgagaatgaccggattccattctgtcagattcttggtgaatacaagatggaactgcctggctataacaccttggagccatatgccaacatgaatgagtattgcccttctcttcctccaacttatgataggccttctcgatgttag

SEQ ID NO: 109360 - DNA, 318 bp, Glycine max
  Peptide Sequence Number=SeqID_226138
atggcttcctatggtaaagcaaaggactctattgatgaagaagatctaaggcctaaaagctcctcatggagctacatcagtgactctccgacaaatcatcttgatgcaaatcgtggctataccgacatcatcatcgacaccacaatgataaacatcaacatggacaaccaaacaacagtttggatagaatgtgaaagacgtcaatggtgccacggagaagaggatggagagggagaagaactagggaaaaaaagaggtgttgctaccgaaaattgtcttcggcagcacgccaatgaagagggttatagagggaattga

SEQ ID NO: 109361 - DNA, 138 bp, Glycine max
  Peptide Sequence Number=SeqID_226139
atgtactctcgtgcacttgttttcaaacatccttctttatcttgccttcaattttttaagcatctcggacaatctgagctcccctctggacatcatggtgaaggaatgtcgatagcagcagcaccgagtccggcttaa

SEQ ID NO: 109362 - DNA, 609 bp, Glycine max
  Peptide Sequence Number=SeqID_226140
atggacttctggctctctttcatggctgtggttagcacttttgtatacctagctacaattgacgaagtatataagagggcaatccacacagctgttgctatcctcactgcccttttggctgcaaccaaggcaactaggtcttccaatgttgttcttgtcattgtgattggggctcttggtcttcttattgcatggttgatagagatctcaaaaaagtataggtccatctccttttcatttggattatcgctaagtttccttcaaagcttgcaaactataaagcaatggttctgtaatctggtcaagacacttttgagacggtttcgctggggatttttattggttggtttcattacattggccatggcaggactaagctggacgctcgaaaccagtgcaaactactggttttggcatagcttttggcatgttacaatatatacatcttcattcttcttcctttgctcaaaagcaaacattgttgatgctgaagattcatcatcaccctcaagtggaaactatgcactgactcatcaggattcatttccaagaggtaaaaagatatggctactgagtagaactagaaatcaacataagagtgaattgtga

SEQ ID NO: 109363 - DNA, 1116 bp, Glycine max
  Peptide Sequence Number=SeqID_226141
atggattggatccttaaggaagaagaacagaggggaaaaattgcagctgtatcaaatgcttccagagctggtagtcagagagggcatggctcgaaacgaggtaccagcatcagttcatacaacatattaccagcgaaagaaccaggcagtgttgagttcaccatggaggaaatcttccgagtcacaagaaacttctccccttctttcaagattggccaaggtggttttggtgctgtctatagggccaaactcctggatgggactgttgttgcagtaaagcgtgctaagaagagtgtgtatgagaaacatttgggggtggagttccagagcgagatccaaacactatcacgtgtggaacatttgaacttggtcaagttctttggatatttggagcaagaggatgaaaggatcattgttgtggagtatgttccaaatggaacccttagagagcatttagattgcattcatggaagcgttctggaccttgctgcacgtttagatatagcaattgatgtttctcatgctattacctatcttcatatgtatatagatcatcctatcattcacagagacataaaatcttcgaacattcttctcactgaaaattttcgagctaaggtagcagactttggttttgctagacaagcccctgacagtgactctggcatgacacatgtttccacccaagtaaaaggaacagctggttacttggaccctgaatacctgaaaacttatcaactaactgaaaagagtgacgtgtattcatttggagttttgcttgttgaacttgtcacaggaagacgccccattgaaccaaaatttgaactcaaggagcgaatcacggcaagatgggctatgaagaggttcattgagggagatgctatctcagtcttggacccaagactggaccagattgctgcaaatactttagcactagaaaagatccttgagctagctttacagtgcttggctccacgtagacaaagtaggccaactatgaagagatgtgctgagatcctttggtccatccgcaaggatatcagagagcagctatccgcttcaaatttccgctcattttccacttcttcccaaagaagcacctcattgaaagagtga

SEQ ID NO: 109364 - DNA, 1737 bp, Glycine max
  Peptide Sequence Number=SeqID_226142
atgctctgcaaattccatttcaaaaagcagcttcttttccctctaaccccttgttcatttgtcactcaatgcacccattcatggagcataatcagagcttcagtgcccgttcctgaagaaacccatttcagggaccctcacattgttcacttgttttgtgccaatgccctcaaagtttctgccagaagggcccttctccctgaaggaaaacagctacatgctcatttgataaagtttggattttgccatgttctgtccctgcaaaatcagattttgggtgtttatcttaagtgtatggaagctgaagatgtggagaaactgtttaaggaattgcctttgagaaatgtggtgtcatggaatattttgattcacggtattgttggatgtggcaatgcaattgaaaattactcaaatcgacaactgtgtttttcttattttaaaaggatgttgttggaaacagtggttccggatggtacaacttttaatggtcttattggtgtttgtgttaagtttcatgatattgccatgggtttccagttgcattgttttgcagtgaaattcggattagatttggattgttttgtggagagtgttcttgttgatttatatgcaaaatgtggattagttgagaatgctaaaagggcttttcatgttgttccacgtcgagatttggttatgtggaatgtgatgatttcttgctatgcattgaattggttaccagaagaagcttttggcatgttcaacttgatgcgattgggtggtgcaaatggggatgagttcacttttagcagcctgcttagtatatgtgataccttggaatattatgattttggaaaacaggttcacagtattattctaagacagtcatttgattcagatgttttagtggctagtgcattgatcaacatgtatgcgaaaaatgaaaatataattgatgcatgcaatctatttgataggatggtgattcgaaatgttgtggcgtggaacaccattattgttgggtgtgggaattgtggagaagggaatgatgttatgaagcttctcagagagatgcttcgcgaagggttttttcccgatgaactgaccattaccagcattatcagttcatgcggctatgcttctgccattactgaaacaatggaagctcatgtttttgtagttaaatcatcatttcaagaattttcatctgttgctaactctttgattagtgcgtactccaagtgtggtagtatcactagtgcatgtaaatgcttcagattaactagagaacctgaccttgttacatggacttcattgataaatgcatatgcattccatggtcttgccaaagaagcaattgaagtgtttgagaagatgctatcttgtggagtaattccggatcgaatttcctttcttggtgttttctctgcttgttctcattgtggccttgtgactaagggacttcactactttaacttgatgaccagtgtgtataagattgttcctgattcaggtcagtatacctgccttgttgaccttcttggacgacgaggtcttataaatgaggcttttgaattcttgaggtcaatgccaatggaagctgaatcaaatacattaggagcattcattggatcctgcaatctacatgaaaatataggaatggctaaatgggctgcagaaaagctgttcatcaaagaaccagagaagaatgtaaactatgcggtcatgtctaacatttatgcttcccatagacattag

SEQ ID NO: 109365 - DNA, 826 bp, Glycine max
  Peptide Sequence Number=SeqID_226143
atgtccttgtctcttttcttccttctcattctcattttctcttcttccacttcctcaagcaccaccataatcctccaaggcaataccactctcaagagccccaacaacaccttccaattgggcctcttctccttctccttttccttctacctcgccatccgccacacctccctccccttccccaacaccacctgggtcgccaaccgcctccacccttccccaacccaaaccggttcaatcctccacttaacccaaaccggttcattgatcctaacccactccaacaccactctctggagcaccgcccccaccttcaacacctcatcaaacctctccctcaagcttctcgactccggtaacctaatcctctctgcccccaacggcctcgttctatggcagagcttcgattcccccaccgacacgtggctccccggcatgaacctaactcgcttcaactctcttacctcctggcgaacccaaaccgacccgactccaggactctactctctgcggctaaagccaccgttctttggcgaattcgagctcgtctttaacgacaccgtttcttactggtccaccggaaactggaccgacggaaaattcctcaacatccccgaaatgtccatcccttacttatacagcttccactttctctcccctttctcccccgccgcggagtttggattctccgaacgcgcgtcggagaccggaacccaacctccgacgatgttccgtgtggagccgttcggacaaatccggcagtacacgtggaacaaccaagcaggctcctggaaaatgttttggtccatgcccgaacccgttgcca

SEQ ID NO: 109366 - DNA, 216 bp, Glycine max
  Peptide Sequence Number=SeqID_226144
atgaagaggagatgtgaagggaacaagacatggggattggatgcaagggacaatcatgattataagtggaatataaagaaggttgatggtgggcataaagatttgaatgagtataacaaatgtccgaagatcagggtgactgatgaagaactcgtgaagtgcgtaatttccatgcagagacaggggagggtcatgctaaggtgcaacaaaatttga

SEQ ID NO: 109367 - DNA, 414 bp, Glycine max
  Peptide Sequence Number=SeqID_226145
atgcctcctcgcattcaattccacgctctggtggcatcatcatcatggatcgtggtaataacaacaataacggcgttgttgttgttgtcgtttgggtgcgaacggggacacgctctgaaggtgccgtttagagtaaacgacgtgctccccgtgctgccgcgcgagatctcgtggccggttctgaacaacctgcacagcgccgtcgacctgctcccttatttcgttgggtccctcactcctgccaatgcctccgtcaagtggaaaggggcatgcttcttcgataacaccgccaagattgagttcgcaccctctttggagggtgccactctctatctcaagttcatgactgaggttgctgggttactcccagaggacgcattttggatagttaagaatatgacgcattttggatag

SEQ ID NO: 109368 - DNA, 2430 bp, Glycine max
  Peptide Sequence Number=SeqID_226146
atgagtctcctcgttcaaactctgataatctcattggttcttgttaaccaatgttgtgctctaagtagagacggtgttttgttactctctttcaagtacgctgtgttaaacgacccactctacgctctcgcaaactggaactacagtgacgagacaccgtgttcctggaacggagtttcttgttccacggaaaaccgcgtcacatcgttgtttcttcccaattctcagcttctaggttcggttccttccgatctgggttctattgaacatcttcaaattcttgacctttccaacaactcccttaacgggtctcttccttcgtctctctcccaagcctccgagcttcggttccttaacctctccaacaaccttatcacaggtgaggttccggagtccataactcagcttcggaatcttgagtttcttaacctctccgacaatgacttggcgggaaaattgcctgaaggcttttccaacatgcaaaacctaactcaggcttcgttcaagaacaattacttgttcggctttcttcccagcgggttaagaacgttgcaggttttggatctgtctgcaaacctcttgaacggttctcttcccacggatttcggcggtgatgtcatgcgttacttgaacatctcctacaacagattctccggcgaaatcccgacggagttcgcggcgaggattccgggaaacgccaccgttgatctctctttcaacaacttaaccggcgaagttcctgactccgctgtattcacgaatcagaattcgaagtctttctctggcaacgttaatctgtgtggagaaatgacaaagaacccatgtcctattccttcttcgccgtcgtcggaaccgaaagcttccgctcctatttctcctcctgcaatcgccgcaatcccgaagaatttagacgattctccgctggcgccgacggggcagaaacagagtggtctcaaacaaggaacgatcataggaatcgtggtgggagacgtcgtcggcgtcggaatcttggccgtgctgtttgtctacgtgtaccggttgaagaaaaagaaggaggaggagggttcaaagacgaacaacgaagcggctataacaaggagcagaagcgagagttcttcgtcgacaacctcggagtcaagaggcttcacgaggtggtcgtgtttgaggaagagaacggaagaggaagagtcttcggagacaacaagctcttccgatagcgacttggagggtgccgccgccgcaggacagaataaccagaatcttaataataatcacaataatagtaagggtccgcaacaagagaacaacaaaacggggactcttgttacggtggacggtgaacgacaactcgagctcgaaacgctgctgaaggcttcggcgtacatattgggcgccacggggtccagcataatgtacaaggccgtgctcgaagacggcacgtcgttggcggttcggagaattggcgagagcggcgtggagcggttcaaggacttcgagaaccaggttcgggttattgctaaactggtgcaccctaatctggttcgcgttcggggattctattggggacacgatgagaagctcatcatctacgacttcattccgaacggttgcctcgccaatgttcgttacaggaagttggggctatcgccgagtcatttgccgtgggaaatccggctcaagatagcaaaaggggtggcacgtgggctggcttacctccacgagaagaagcacgtgcatggaaacttgaagcctagcaatattctgttaggcaacgacatggagcccaagattggagactttgggcttgagaggatagtgacgggtgacacaagctataaggctggcgggtccgcgcgtatttttgggagcaagagatccacagcgtcacgagatagtttccaagatatcacgtttgggccaagcccaagcccaagcccgagttcaataagtggtgtgtctccttaccatgcacccgagtcgctcaggaacctcaagcctcaccccaagtgggacgtgtactcttttggggtcatgtttcttgagctgctaacggggaagattgtggttttggatgatatgggccaagggcccgggcttttggtggaggataataatcgggccttgcgcatggttgatatggctatacgggccgacatggagtgtagggaggaggccttgttggcctacttcaagctagggtatagttgtatgtctagcgttccgcaaaaaaggcctccaatgaaggagtacagtggaaacaacattgttgaggcagaggccattgatgagcgtggtgacatcataggagaggtcacgcttgagaaacttcccaaagacggagaaggagagaacgaccttgtcgacatggcaaaagcagttgatgaggatggtgagagtgacgtggcaggggtagcgtcagactccatttag

SEQ ID NO: 109369 - DNA, 921 bp, Glycine max
  Peptide Sequence Number=SeqID_226147
atggaatcacgagtgcttcagtgcccacttggaaaggctggatcaaattgcacaatggacagctacacacttcagattggggatacaatcacatgtagtcatatcttgatggttaagaaaaacattagatgtaacaattcaaaagaatccattaagatgtttataatttgcagaaataggaatgtaccaagtcttattctaaggagaggtgcaaccccctttgaatcatattttttacctgtggctattggtgaaggagcatcttctgccaactttcctcttgagccacttttaaacaagtcatcaaatgtgggagaaactggtgacatttggacttattttactttggatattccccatggtgcagctggacggaatattcacatacggctatctgcagatgtgaagatcagttatgaagtctatgctagatttggtggattgccttctcttgatagctgggactattattatgctagcaggacaaggaagagtgatcaatctgtgtttttcatgctatatgattcaagtgatgacaaaattgacttttacattatttatgctagagaaggaacttggggtataggtctaagacatctttataccggcagtgattctttgaaagcacaaactgtcatgtctatttcacttgaaggatgccctaaacaatgctcctctcatggagattcttctgctcttgtgatcgaaaccatggtggctttgactgtagcattgaaattgtatcacataaagggcatatactacaatcaatttttctcattggatcaaatgctgcagccatacttcctgcctattggtcccttcggcagaaggcatttgcagaatgggttttgttcacatccagtggcattgctagtgcactatatcatgcatgtgacgttggcacctggtgtgcattga

SEQ ID NO: 109370 - DNA, 852 bp, Glycine max
  Peptide Sequence Number=SeqID_226148
atgtccgctgtgagagttcaagtttcggcgtgtgcggtttccgccaccgtcaaccaccttcgcctccgccaaaacgccgtcgtttccttcaggaagaagaagcctctcactctcagagtggtctcaatgtcttccgttcctccttcccaacccttcgaaatcgccgttaaagcttccgtcaccacacccaacaggctcggcgacttgtttattgagaaatcagtgaatgcgattgtagtagaagagattcgggtgctgctgacactggaggaaaaacatctaccttatgaccccaagttggtggatttgaccaacaagccagaatggttccttaaagtcaaccctgatggtaaagttcctgtcataaagtttgatgagaagtgggttcctgattcagatgttattactcaaacattggaagagaagtatcccagcccaccattggtgaccccacctgaaagggccacagcccttctcagaagcagtaaaggtcctgagtggtttgcttatgatagccggtttggggttgatttggtgaagtttgaagtgatgggttttgggcctgctaaaaaatgcagagggtatgttcagaggacaatgtcacttgtgtcaaggccatctcacaaggcatcaataaactcctttacacttctaggtcctttcatcaacggtagtgagatatctgcagctgacctatcacttggaccaaagctataccatttggagattgctttggggcattataagaaatggacagtgcctgattcacttacctctttgaagtcttatatgaagaacacaaaactcgaatatttcactaaagatgccgaagatgcttttgcttctgcatag

SEQ ID NO: 109371 - DNA, 150 bp, Glycine max
  Peptide Sequence Number=SeqID_226149
atggcacataagaatgaatttgtcactgaaatgattgttaacatggttatgctgactagattggacaaaaatgtcagaacgcatttgtcagggaattacacgttcagagacaaaaatgactatttacccattcatattcccaaagagtga

SEQ ID NO: 109372 - DNA, 549 bp, Glycine max
  Peptide Sequence Number=SeqID_226150
atggcaactggggtattcattaataaacccccttcacttcctccgtaccccgagatgattttggaggcaattgaagcactgaatgaagacaatggttctaataaatcatcaatttcgaagtacatagaatctacctacggtggattacctcagggccacaaggttttgctcaatgtgcacctcgcgaaaatgagggacagtggagtgttagtgttttggaagaacaactacaccaagcgtgacccaaaggcgccgccaaggcgtggccgtggcaggccacccaagcccaaggagcctctgccaccgggcactgtcttgtcaccgcccaggcccaagggccgtcctccgaaggacccgaatgacccagggaagccacctaaggccttgacagaaagtggcaggcccagaggccggcccaggaagatgacccggcccactggtggacttagcgaagcatcgccagcctccaaggtgaaggcttccaccagtgggaggcctagaggtagacctcccaaagtgaagcccgtgtttactgaaataagtgcttaa

SEQ ID NO: 109373 - DNA, 567 bp, Glycine max
  Peptide Sequence Number=SeqID_226151
atgtttggctggttttgtgtggaccggtgctttgttggatcctcttgccaagttgggttctacagtgcaagaattcagtatacttccctaattcatggtattttgcaaaggagcttttcgcttagaaccagaactggagctctcactagtagcatagcactgtctattcgcagagctaggccctttccatggcagcatgatttgtttgaagatagcttaagagctgctgggattcaaggagtagaagttggcaccaagttgtatgtttccaatttggaccatggagtgaccaatgaagacataagggaacttttctctgagcttggagagttgaagcgttttgctgttcattatgacaaaaatggacatccaagtggttcagctgaagtcgtttatactagaagaagtgatgcatttgctgctcttaaacgatataataatgtacttttggatggaaagcccatgaagattgagattgttggttccaattcagaattgcctataagtgctcgggtgaatgtcactggggtgaatgggcgcaggaagaggactgttgtaatgacgtaa

SEQ ID NO: 109374 - DNA, 573 bp, Glycine max
  Peptide Sequence Number=SeqID_226152
atgaaacttcattgtttatgtgctcccaaagtttccaaaaacttcattgtctctatatcttcttcgacgtggtctcaagttgctcaagctcctctaaagcgtgctcaagctctagtgttgggttttagcgcttttgaaagtttcactttgaatttccattgtaccggttgttattggcaatcaattgattttttttcccatgaagcattcttagataatttttactcgatgcttgttgtgatggttttggaccataaccaccctttaggacttccagaggcaacccatatgcttgcatctcatagaaagataaatgaagtccaagcttatgagattgagctagatgatgactctgaattaaaacaaaagtccatatttcaacttttgagcacacatgtaggacatagtactaaccttggatctacactcatggatgtaaagaattaccttactgcaagaagacaaagaagcatggtgtatggtgaagttggatgtctttcttccatgcataccaaatggatattgacgaacgaattacaaatgtcttttgggccgatacaaagatggtattag

SEQ ID NO: 109375 - DNA, 216 bp, Glycine max
  Peptide Sequence Number=SeqID_226153
atggaaaaattgataaaaattctacggcaaatagatcttcctagttgtacagaacagatgatccgtttcagacttgaggaactaaacattgatcagaaaaaggtgctaagagctattagaaaggagaaggttggggccatggcagttcgagggagatcaccaaaaatgttgcttcaagaaagattagactatggtggacgatcgatcgatagatga

SEQ ID NO: 109376 - DNA, 729 bp, Glycine max
  Peptide Sequence Number=SeqID_226154
atggcacttttgaaaacaataggttgggtgaaggagttgaatgcagatagaaccaagagcaacaataacatagtgatgccatcaacacctctgatggacctgcgcgcacatgcactcacactcccacgtgagagagcaagaaaaaatgttgatatgcattcaagagaaagaaaggatattcatttggtgttgcttatatcatatatagttaagcttaacaacctccattcaaagttaaagatgcctcgtaccagcactctggagtgctccggttgccctccgcttcgcgctctaacctttgacgcgcttggtctcatcaaagttgtggaggcccgcgataagcaacgaggagctccccaggtcgtagagaggtggggcgaccttgaatcatccaaatgtgtgatggctgtttcaatgattgaccgagagtctcaccctttattagctgtagcgaggaaaaacaaccagattgaagttttgagccctgttaatggagatattcaggctacaatcacggatgccaatgatttagatgttcaatctgaagtgaataatattgttggattgcatttatttgcaaaacaaaattcggaattagcttccaggcacttgaattcctgggaagtacctaacggtacatcattcttgctcttcttgaccctggatactaatggattcagagttggaggagggcatcaaaaacagatttcctcattttgtttgtgctaa

SEQ ID NO: 109377 - DNA, 864 bp, Glycine max
  Peptide Sequence Number=SeqID_226155
atgcctttgaattcgattccgtggtgtcatctcaagctgattcttctcagtgcgctgttacttttttgttgttctcttgacctctgttctgcaatcactgattatgaggatgatgtcttcactgtttccagcttcagctaccctcagactacccttagaccctatgatttgcgctacatcagagttgatattataccatggttttccgcagttttcatatcattggactcagatgtagacctggatgtttcaagagttgaaagggtgccaaaaagctctctgccactattatgctttagagatggcagccctcctctgccagatgctttaaatatatctctgaaggattcagctgtcacaggaataaatggtcttgaggtcgagcagtgctttcctatggagaaaaatatcactatgaaattgacaaatgaacagaccatgaacatgcgaattattgttcagatatctccaggtgctttgtacattggtcttttcaacggcattggagatacaagaacacaatcgaagatgattatccgaggttcagcatactccttcagtgccaatataagtgtggaagcatgctcgaattcaatgatgaggggggagttatgtaacagtacaatctatccactttcatgcacagcatttgatgtctataattctatgaaggctacagtgaagaagccaatgatggaaaatgcaatgacctgcaaaagtaacttagaaacattttgtgctcaggaaggtgtaccagaattttactccttggatataacaaatatggcagaagaattgaccattatggcgccaaatgttacattcaatactacagcttcaaataacatttctagtgcaaatgat

SEQ ID NO: 109378 - DNA, 168 bp, Glycine max
  Peptide Sequence Number=SeqID_226156
ggagtagcgacgccaccaacgcctcccatcttttactgtggtgcagggttcttcgtcgaatggagacttttcgtcagatctggctccgaaaaatcacactacgagtccgatggacctgtgtgcacaggcactctgactctaacgtttctatgcacactcgcactttga

SEQ ID NO: 109379 - DNA, 282 bp, Glycine max
  Peptide Sequence Number=SeqID_226157
atgggtagtgggagatcgaggcgacggttacacagtgaacgtgcgatcatgacgccatttcaggaaaactggctaagacaagaaagagggtttcgaaccattgggcgaatcgagctggcgtatggtcgaatcgaagtcaaggcaacaagatttctggatttggtgcaatttctgacaaaacttcacaaaattagttcgacttcgagcaatgtgggtaaccgttctaaggagcagttatgtgcatgcaaggtgtacgtagcaggacacttggcattaggatag

SEQ ID NO: 109380 - DNA, 582 bp, Glycine max
  Peptide Sequence Number=SeqID_226158
atgaataagtactttatctgtaggaaaggtgttgaaatgaatatttgggatcttaacaacttcactaagatctggaattccaaacctccgccgaaggataacctcggtatatttacaccgacttggttcacatctgctacatttcttatgaaagatgaccatcgaaaatttgttgctggcaccaacagccatcaggttcgcctttatgacatgtctgctcagaggaggcctgttctctcatttgatttccgtgagacaccaattaaagcattggctgaggatatagatggctattcaatctatgtagggaatgggtctggtgacatggcttctgttgatatacgcacaggaaaaatgctaggatgtttttctggaaaatgctctggaagcatcagatccatagtcaggcaccctgagctacctgtaatagcttcttgtggactggacagttatttacgcctttgggatacaaagacaagacagcttctttctgctgtaggttctatgctctatttctttgtccgtggcggcatgctctatagttctttttattgggatatgtatgcctggaaactaaaatga

SEQ ID NO: 109381 - DNA, 1371 bp, Glycine max
  Peptide Sequence Number=SeqID_226159
atgtccgcctcatgcggggtggtggagtgcgttttcgttctgggctgcgcgcggtggctgtggaagcgctgcacctacgtgggcagctacgacagcgccacttggcccgccgccaccgccgacgagttcgaccgggtgccgcgcgtctgccgcctcatcctcgccaactacgagcccgatctccgcaccccgcagtaccaaaaacccacctccgccaccggccaccgcctgaacccggactgcgtcatcaagcgcgtgacctacgaggacacgctgggccacgcgcctccgtacataatctacctcgaccacgagaacaaggagatcgtgctcgccgtgcgtgggctgaacctcgccaaagagagcgactacaaggttctcctcgataaccggttagggcaacaaatgtttgatggtgggtatgttcatcatgggttgttgaaatcggcagtgtggttgttgaaccgtgaatcggagacgctgaagcggttgtgggtggagaatggttcggagtatgagatggttttcgcggggcactcgttgggttctggggtggtgtcgctgttgaccattttggttgtgaatcatagggaccgtttgggtgggattcccaaggagaagattcggtgctatgcgcttgctccagctaggtgtatgtccctgaatttggctgtcaagtatgccaatgtcattcattctattgttttgcaggatgatttcttgccaagaacggccactccattggaagatatattcaaatcaatattctgcttgccctgcttgttgttcttggtttgcctgagagacaccttcatacctgagggtagaaagcttagagatccaaggagactttatgcacctggaagaatgtaccatattgtggagagaaaattctgcagatgtgggagatttcctcctgaagtgaggactgctattcctgttgatggaagatttgagcatattgtcttgtcctgtaatgcaacatcggatcatggaattatttggattgaaagggaggctgagaaagccttacaattaatgaaggctcagagctctgaaactgtgacagaccctccaacagtacaaaagtttcagaggttgaagaccatagagaaagaacatagagatgctttggaaagagctgttagcctgaatgtacctcatgcagtggacactgctgagaaagaaacatctgagaacaatgaaggtgacgacgatgcatccgccagtgcaaacaataacgtctcaagtaaccaatcaaaatctagtggtggaaggtcgaactgggatgaggtagttgaaaaacttctaaagaagaagagtgaaacgggagaacaaaacctggaaagggatacgaatgtcacacaataa

SEQ ID NO: 109382 - DNA, 462 bp, Glycine max
  Peptide Sequence Number=SeqID_226160
atgagtttcctccgcaggttgtgcccctgtttgcacaagggcggcgcagccttccacgacggcgatgacgacgacatagatcgcaaccaccccggcgactccttcgacctaatcttcggcctccacactctccaactcgccaccaacttcttctccgacatcaaccggctaggtcatggaggctttggtcctgttttcaggggattgatgccaaatggtcaagaagtggcggttaagaagctgtcattggaatctaggcaaggagatagagaattcaccaatgaagtcaggctattactcagaattcagcacaagaacttggttacattactgggttgttgtgcagaagggcctgaaaagatgcttgtatatgagtatctgcctaacaaaagccttgatcgctttctgtttggtattgagaagagacgtttatttatctatttatttaccgttgttttgtag

SEQ ID NO: 109383 - DNA, 333 bp, Glycine max
  Peptide Sequence Number=SeqID_226161
gtaattgaggtccgttacttccattcattctacacttctaatgttatcttagcaaatatatcctcaggagtggattcgctaccatgcaaggaacaaactccaactgagatcttggtcagcgaagaagttgaagaatcacctttgaaaagaaaaaaatcttccagaaacaaagagcatataccagatgggggtgaaagaaagaaaagatctaaacagagtaaagagcgcaagaaatctgaaggaaatgatggaggtgagaagattgcatcaagagatgagggaagcaggtcagcatccaagaaaagaaacaagagatcaattccagtgttgtga

SEQ ID NO: 109384 - DNA, 399 bp, Glycine max
  Peptide Sequence Number=SeqID_226162
atgtctccctccgaccaagaagaggccatacttcataagttccccagggctttacattgtaagaccttggtagacatgcctttctccaaaaatccaaccacgattgggatcgtgagtatctttttgaattatggccaagtttatcaatccatcaagaaggcccaagccgagaaggtttcaaaagcaaggctaaaaaggttcaggccgacaaaaccaagggaaagcaataggatcgcgtcaatgattgggttcctcctccccttcacatcatccggagtgctgccaagaaggccaatatgggtcctaaagatgaggggccttcaaaaaggccaagagtggagtcgatgccacttgtttctcgttcttccattgagagtcacctcacctttctttctataa

SEQ ID NO: 109385 - DNA, 351 bp, Glycine max
  Peptide Sequence Number=SeqID_226163
atggccctcatgtgtcgatggactccaatgcttgcttcgcaacaagaacttgaggtgggtgctgcgaaggctgaggtgaagttaaagagtgatcttgatgaggttgagtccgacatcctaagaactcatgaagccagttttaagaagacaccccatcaggtcaagtttttttttctaaagaatgttgacctttccctttttgatgtcgacaacccttcctctacaaagtttatgtttcagagagatggttctctaacttctactggtatcatgacatttgacccatatgagagtcaaaaaagggtctcgcctgtggtgactatggagagcaacaataagcctaaaggatag

SEQ ID NO: 109386 - DNA, 303 bp, Glycine max
  Peptide Sequence Number=SeqID_226164
atggctcacacaaagaaaaccgaccaaatgacgtctgaggtagcaaaggaaatcgcagacaggattgattccttggaggagcaggcctcacaggaaagctttttcatctatggatgtcaggatgtactgactgctgccattgggcgaccaaagcacccaggtcgtgttcatgctgttgaagccggtgtcaccatcaaaaactactttggaccagcttcaaggggctcccacacctcttcgtccatggttgttgaagaccttgagcagctgacacaaaagatcaaagaccaactggaggattag

SEQ ID NO: 109387 - DNA, 477 bp, Glycine max
  Peptide Sequence Number=SeqID_226165
atgcagatgacagatggaggtagaggtggtggtcgtagaacatttaatcgtggtagaagacgtggtcttagttttaggagctcccaatttaccaccaacccttccacctcatccattcatatatcaacctcagagtcgatgattcatgccgtttcaccgactccaaacacacttcctacagctcaagaccaaccaaatcctacctttataagggagtcaatttccactacccctgttagagatgcttcaccttcagcaccagatgattctcttacacttgagtacccatcaaatccaaattgtgaacatattgttgatcagaggcctttcgtttgtgcatataaaggagagtttcaaccaacatataggtgttctaatatcatatcaaatatcattagggcaaaatttgatgaaccagctgcaagttggttgaaggtgtcagttgaccttcgcgataggtggtttggagagtttaag

SEQ ID NO: 109388 - DNA, 1074 bp, Glycine max
  Peptide Sequence Number=SeqID_226166
gttagcgcgcagttgggcaccgtaacccagcttccggttcatcccgcatcgccagttctgcttaccaaaaatggcccacttggagctctcgattccatggcgcggctcaacagagcagccgcaccgtcctacctatttaaatctttcgcccctatacccaagtcagacgaacgatttgcacgtcagtatcgctgcgggcctccaccagagtttcctctggcttcgccccgctcaggcatagttcaccatctttcgggtcccgacaggtatgctctcactcgaacccttcacagaagatcagggtcggtcggcggtgcaacccacagggggatcccaccaatcagcttccttgcgccttacggacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccggggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggggacttgggcccggtccgccactgaggacgcttctccagactacaattcggacgccgagggcgaccgattttcatggtgggcttttcccggttcgctcgccgttactaagggaatccttcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggtgctcgcgggag

SEQ ID NO: 109389 - DNA, 618 bp, Glycine max
  Peptide Sequence Number=SeqID_226167
atgttcaaaaatagtgtgttactacttttagaaagcattgatctctcgagcaatcacttttctggagaaattccactggaaatagagaatttatttggattggtttcattgaatttatcaagaaaccatttgaccggaaagattccttcaaatattggaaagttaacatcacttgactttcttgatttgtcaagaaaccatctagttggttcaattcctttgagtcttactcaaattgatcgactgggcatgttagatttgtcacataacaatctatctggagaaattccaactggtacacaattacagagtttcaatgcctcatgttatgaagataatcttgatctttgtggaccgccactggagaaattgtgtattgatgggaagcctgcacaggaaccaattgttaaacttcctgaagatgaaaatttgcttttcacccgtgaattttacatgagtatggcaattggatttgttataagcttttggggcgtttttggctcaatcttaataaatcgttcttggagacatgcttatttcaagttcataagcaatttctcagatgctatttatgtcatggcagccgtgaaagttttcaagtggcatcacagaggatag

SEQ ID NO: 109390 - DNA, 525 bp, Glycine max
  Peptide Sequence Number=SeqID_226168
atgtcaaccatcacatcaaaatggtttggagaggatgaaaagaatgtccgagctctgttcacactggcagctaaggttgccccaacaattatctttgttgacgaggttgacagcatgcttggacagaggactagagtaggagagcatgaggctatgaggaagattaaaaatgaattcatgacacactgggatgggctattaacaggacctaatgagcaaattttggttcttgcagcaaccaacaggccatttgaccttgatgaagctatcataagacggtttgagagaaggatcttggttggtcttccatctgttgagaacagggaaatgatcttgaagactcttttggctaaagaaaaacatgaaaacttagacttcaaagagctggcaaccatgacagaaggatatactggaagtgatcttaagaatttgtgcatcactgcggcttatcgacctgttagagagctaatacagcaggagagaatgaaggacattgatacggatttcaccagggggtacgaatga

SEQ ID NO: 109391 - DNA, 237 bp, Glycine max
  Peptide Sequence Number=SeqID_226169
atggagggtggcgcgggccctgacgcttcttgcacaggggcctggcggcggggcgaaggcagcacagctgcacggcggtggggcgatggcagagttaaaaaaatgaaaatgcaacgaggaaggaagttcttgacaagtgacaacgagtttgagaagcgtataagaccagagcttatccatgaaaacgaaataggggttagacttgcagatgttggtgcattggatgagatcaaataa

SEQ ID NO: 109392 - DNA, 201 bp, Glycine max
  Peptide Sequence Number=SeqID_226170
atggcgaccttgacggagaaagggctttggtgtggtggaaaagggaggccgacgagaagcgaagcacgggaaaaaaggtttggagtatcaataattttgtccaaaacaaacaattatgtggcaattaaggaacaaccctatcattgcctcgctagtgccaagtcatatcacaaccactatgaaagattgaacattatttaa

SEQ ID NO: 109393 - DNA, 120 bp, Glycine max
  Peptide Sequence Number=SeqID_226171
atggctcataaggaaagagatgttcggaaaaagacgagtttgcatgattctcgtagaactcacgctaaaagtagcacgtttccgtgtcgtttaactgaaggacaaactaaatggatttga

SEQ ID NO: 109394 - DNA, 1347 bp, Glycine max
  Peptide Sequence Number=SeqID_226172
atgggcaagccggcggtcatggccggcttctggggctcccatatgggccttatcgacctgctgcttgaaaaggatggcaagagctggaagatcgtcgacttcacctcagaagcccgcccgatctaccatcgcgatgaaaatcgcaaggtcgttgctgactataccgaaaagccggaggttctcgccgcagccaaggtggatcacgaagcggcccttgcctatgtgcgccgcccggtcggcaagacatccgcgccgctctattcctatttcgcgctggtggcagacgatccgtccgtgcagatcgtctccaacgcccagacctggtacatcaaggacatgctgaaggaagggcagtataaggatctgcccgtgctttcggcagcggcccccttcaaatcgggcggtcgtggcggcgcggattattacaccgatgtccccgccggtgacatcgccatcaagaacgtcgccgatctctatctttatcccaacacggtgcaggcagtgctgatcaacggggcgcaggtgaagaactggctggaaatgtccgccggcatgttcaatacggttgaggccggtgccaaggatgcgccactgctcaacccagacttcccgtcctataatttcgacgtgatcgatggcgtgacttatcagatcgacatttccaaaccggcgaaatttgacaaggacggcaaggcggtcaacccggacagcaaccgcatcgtcaatctgcagttcaatggcaagccgatcgatcccgaacagaaattcgtggttgccaccaataattaccgtgcaagcggcggcggcaaattccccgatatcgccggcgacaaggtgatcttcgtcgcgcccgatacaaaccgcgacgtgatcgtgcgctatatcatcgatcagggcaccatcaacccgtccgcggatgccaactggtcctttgcaccggtggaaaacaccaccgccgtcttcgagaccgggcccaagggacgccattacgcagccgacatcaagggcgccaggatcgaggatgccggcgacggcgcggaagtcgctgccgtcacggttacggcggatgagtctcaggccaaccatgtcgcgcctcagcatggccgcatccccgaacaggtgcaggctatccagaaagctgctgaattctcgctcggaaaaactctgcccggcgggaatttttgcccagagataccagaggcacagttcctgatgcgaccggcgggccggccattgcatcagccggccggcggcatcaaagccacgaacggtcttcagcaccctgccctcattgacggctggcagcagctcaggctgagcggttgcgctttcggcggaaaagatgcg

SEQ ID NO: 109395 - DNA, 348 bp, Glycine max
  Peptide Sequence Number=SeqID_226173
atgatggcacatcaaaattccccatacttagccttttgcactcctgggcaaaatgaaacaaagaacaaaatccaaggatatcaaagagaggcaaacgaaaacattcacatatttctcaatgaacatcaaggaatgaaaggaatggtgagcttcaaaacaaggaaagggaaacaaggctcaaaagggctatcaaaggaattaagtcaaggtaagtccatttggctagaagcttataagaacaaaattgcctcagtcatatccaaatatgcatgtgaattaggaagcatcaacaagaatcaagccaaggctattgtgcacgcaatcaatggggcaaaacacaccaaatga

SEQ ID NO: 109396 - DNA, 234 bp, Glycine max
  Peptide Sequence Number=SeqID_226174
atgcaagtgggatcagcaactttcattatcagagtaatcaagcacagcggtaagttgcaagagcacagcgcagttcactgcggcattctgcaagttgcaagtcgtttccaggatgtcaagacatctcacgtgacatcagctttctgctccccctgtctccatgctcctactgctgtgaagcaattcactgcagcatcttcactgcagcatcttctatcagctatcagctactag

SEQ ID NO: 109397 - DNA, 1755 bp, Glycine max
  Peptide Sequence Number=SeqID_226175
atggcacgtttcatctactacgacaccaaaccccgatccaaaaaactcctccttctcctcaacatatccttcatttatctcacctttctcttcctcaaaacctatctccacccttcttctagtcctaatattgttcatgcctccacaaaaatcttcaaccatgctagaatgctaagtgacatcagtgttgatggctgcactgatcttcacaagtactcagattatgactccaagtgcttatatgtcaaatccaatgttcactgcaggtcaaaagggtacataaactatctccaaatcttctactgcagctttggccactccccaattttgggtcattcactgcttgtaatgtggcttgtggtattgttttatcttttggctgatacagcttcaaactacttttgcaataacctagaaggtctctctgacatcttaagactatccccaaccatagctggggtaaccttgctttctcttggaaatggtgcccctgatttttttgcaagtgttgtttctttcacaagatccaatgatggggcagttggcctcaatagcattctggggggagcattttttgtctccagtgctgttttgggggtcataagtttccttgttagagcaaatgaaattgcaattgacaaggcaagtttcattagagatgtcatctttttcctcttctctcttttcatcctgcttgtcatcatttccattggtaaaattaccttgctgggttcaatttgttatgtttctatatacttcctttatgtctgtgctgtctctgccacatatttcatctatggaggggacaggacagaatgtgagcttgtctcatcttctgaggacttgacagaatctggtatacccttgctaggctgtgttgatgatgagaaatcaaatgtatcaaataaagaggttattaaagataataatggggacaaacaaaagtgttttggttatgattcatttgactttacttacttgagcaagtttctacaagtactagagttacctcttagcttgccaagaaggcttactataccagttgttagtgaggagggttggtcaaagccatatgctgttatatcagttactttggccccagtgttgtttgcaactctttgtaacacccaaatggaaaatgtgagttcaaagagtagtcttgtttcatacttgacagctgctttaattgggattgttttggggaacatggcatgtgtgaccaccaagagcactagtccacccagaaagtgcttgtttccttggctagctgggggcttctctatgagtgtaacatggacctacatcattgctgaggaattggtttccctcttggttgcaattgggagtgtcataggggttagtccttcaatccttggactaactgtcctggcttggggtaattctctaggggatttgatagccaatggtgcaatggccaagaatggtggagctgatggggcccaaatagctgtctctggctgttatgcaggtcctatgtttaacattttgatgggcttgggcttgcctcttgttctctcagcatggtctgaatacccagactcttatgtcattcccaaggatccttctctttatgcaacacttttgttcttgatgggaggggtgctttgggcccttgtgatattgataaagaagaaaatgaagcttgataagtccttgggagttgggctcttgaccatttacctctgctttttgtttataaggatggccatagcaattggtgttattaaattctag

SEQ ID NO: 109398 - DNA, 642 bp, Glycine max
  Peptide Sequence Number=SeqID_226176
atcgctctcgcggtgaagtcggtgccgttcgaggacatcgtgttcgtccagtatccgaccggtgcggactacgacgacccgaacaaggtcgttccgaactacgaggccgccaccgcgctctgggatgcgatcgaggccaacgcgcagctgcagatcacgcaccagaacaacagcaacgacggtgtcgtggtgaaggagccgaccgctccggtcgagcaggcgacaccgaacccctcggccacgccgacggatgtggtggcattgcccgactccatcaagggcaactcggccgcccaggagacctgctccaacggcaacgctgaccccatgtcgaagcgactcgccgaggtggcgcgcaaggtcggggtgagtgaagcaacggtcagccgtgtgctcaacgacaagccgggggtgtcggatgccacccggcaggcggtgctcaccgcgttggacgtgctcgggtacgagcgcccgaccaagctgcgcggcgaacgcgcacgcctcgtcggactcgtgctccccgagctgcagaacccgatctttcccgcgttcgccgagatcgtgggcggagcgctgacgcagaacgggtacacgccgctgctgtgcacgcagaatgcgggtggcgtgacggagtccgactac

SEQ ID NO: 109399 - DNA, 231 bp, Glycine max
  Peptide Sequence Number=SeqID_226177
atggctacaaccccaaccaagaaagtagtggatgaagtacctaaccatgattcacaagctagaatgcctattactccaaccaagcgtagttcagttgaggcttatcctctcgcgtctcaatgcagcgaaaaccaaaagctctgcaatctccctagaattatgtgtgatatggaaagagatgcagatcaatccctctttcccaatcaacaagacaaagacttgacaagataa

SEQ ID NO: 109400 - DNA, 612 bp, Glycine max
  Peptide Sequence Number=SeqID_226178
atgcaaggtccatactggattactggtgttagaggtccatgtaagcagttaaccctggggtgtggtcagaaatcggtcatgtccatggtctactccgagctatgtagttggctggcaattgtgctggggtgcattgttggccagtgtttggtgtcggagacaataccacgtcaccgagactatagatcatctccaccaaggcagaaagaatcattgaaaaagaaattgttaatttctttgaatgaactggagaacttgaaaccagtggtccaacagaagatcaatgagcttaacagcaaacttgcataccaacaaaatggacagggaaaatttagttcaaataattcactggatttttctcccgtgaaaaagcaaacttcggctagttatggcctaataaaggctgtcaggcctactgctggggagtttgtttaccaaggatcaaggagccaacctttctcttatgtcaggcctgtggaagagcatgcacgaagactttacaatatttccttttcctgggttataccggccatgggagaagaattgggatcaaatcgtgaatcggaaggcctattttccgaatcacgaattgaactgtatcgtgaagcttag

SEQ ID NO: 109401 - DNA, 291 bp, Glycine max
  Peptide Sequence Number=SeqID_226179
atgagaaaaggtcaatctattaattatgtaattcaaaggaaaataatgcaatcaacaaaattgactgaattatgtgcgagattggcttttccaaaacaagcaacatctagtgttgttgctaatcttaacaaggttgctcaacaagtaggagatacaagggtagtggacaaggctgaagttgttagaccacctaaactagtgacaagaagcaaagtcaaaagaagggacaatctgtctaaagaagttagtagcctttccgtcgaacaacaaggaatgcctaagaagcaataa

SEQ ID NO: 109402 - DNA, 255 bp, Glycine max
  Peptide Sequence Number=SeqID_226180
atggcagaccctggtagagagcattggagtgttgtgaagaggctcattagatacatcaaaggatccttaaatgttgcattatgttttagaggaccaaactttgttgttgaaggatggacaatgagttggttatccaaattacaaactgttgtagccctatttactatagaagctgaatacatggcagctaccgaggcatgcaagggagctatatggattcaaaggctattggaagaacttgggcataggcagtag

SEQ ID NO: 109403 - DNA, 537 bp, Glycine max
  Peptide Sequence Number=SeqID_226181
atgcatgaccggtcaaataacgaaaccgacccggttatgccaccaggtcccagttggaccggtccgaccggtcaagccaaaccggatttcacaactatgttgacaacaatggtattaaattatctgtacacttttgtaatttcctactcacggtacttggaaagtattttcaatcaatatgctgcaaaatattcaggattagaattgctgctggatattcttgaatctacaagcgtaaagcagaagggtaatgcttcagcagctcttcacaaattggctggcaaagccagttcttctgtctctctttttgatgctgctcctccatcgacatctcaccaggatatttcagtggaaagtgtttcactaatgtacaagatgtcggaggatttcaatgatactaaactaaaacatgcatgtatactgtttatgctggagaattttgataaaccgaggttggaagcatggtattgtcacgttgtaccaggcattcgtatgttcttaacttaccaagtctcatccatccaactggacttatga

SEQ ID NO: 109404 - DNA, 241 bp, Glycine max
  Peptide Sequence Number=SeqID_226182
acaaagcaagctaaatatacggtttctcacagtggtttatggtagtcccagctatcagaaacaaaaatctttgtgtaatactgtagaaatgacaaatgaggcttgggcgatagtgggtgattttaacactattctcaactctcatgatcctagtggagtttctactaatccttcttggaggggtgcacaagatttccaaagaatgatacaagagtgtgatctagttgatgctggtttctag

SEQ ID NO: 109405 - DNA, 490 bp, Glycine max
  Peptide Sequence Number=SeqID_226183
tctctacccttccattaactacaacgacctcgctgaaaacatattccctgaggatgccactgtcgtcggatccccctctgcgccaccagaggccaccgagaaagccgtcctccgaatcctcgccgcgatcctcaacctcatcggcaaggactatagtgtcgagctcgcatgtgacgatttctccgacgccaccgtcgtgaaagtcaactatttgcactacttcttctccttctgcatccccaagggttccgatcccgacaaggaggaagaagatatgctcagctacggcttaacgatcatgttgaatgggcaagagcggttactaaaggaactagacgccgcgattttggaggactgcagttgtttctccgtgcgaagtatttcagagaatgtcaagaagaaagaggaggcaatggattgtttcatggggagagagaattcgtcgaaggatttggagttgaggaagaagatgatggatggacggttccat

SEQ ID NO: 109406 - DNA, 630 bp, Glycine max
  Peptide Sequence Number=SeqID_226184
atgccttctcaactcatgccctcccacatgcccccatcatgctcaaccgagtcctcaccttcctcgcgaaggcgaagtgcttccccgtcacaattttcctttgcgccagaacggagtctgacgttgccccttgccacatcaccctcaccatcctcattaactacttctgtcacgttggcaaggtcgctcttgccttctccttcttcgggaagcttctcaagcgcgacctcccctaccgtgttgtcacacttaacaccctcatcaaaagcctctacctcaacaacgtcatttccatcgtgctcaaatttcacgatgaaatggttgcaaatggctttgaattcaacgaaatcacttggtgtaggagatggcaaagaaatcactgtcggctcggttgtagaagccggcgttgatggcgttgctgccaccaagaacgtggccacacgtgttggggattccctcctcggaaatgaaagtttgggcgggagagtctctggtttcggtgttcaagaggttggccaagaagccttcttggttgatcaaagttggggtcgttgtgaccaacactttgacgttccagcaaaagcacccgaaacgacttcaagattagagagagaaagagaaaacgagtag

SEQ ID NO: 109407 - DNA, 426 bp, Glycine max
  Peptide Sequence Number=SeqID_226185
atggggaaaaagatattcaaacgcatcccatctttcaaaaagtacactccaaatttgaaagactcaacaccagtcaccaaaccaaaccctgtgaattccaacacatccaccttaaattctgacaattgcgagccatatttgatctgcagagaccctatggtgatgcaacaaatcgaaagaaaaccagttattggacaagttgatgaaaagaaacacatgtttctgggccagtttggtccactaccccatcatcttcaggccccatcaactaccccttacccaaatttttgggaccagaataatgttgaggattatacatttgccaatgagaattgggatgacctaagatctgtggttcagtttgcaattgatccatccacggtgtttgattgtacaggaacatatattccaccctacttttcttag

SEQ ID NO: 109408 - DNA, 210 bp, Glycine max
  Peptide Sequence Number=SeqID_226186
atgcgccaattatgcactgagttgcgagctacaacactcgaaggaaaattgatgaaagaatttctggtgcagatcaaagcgatttctgattctctcatttccgttggaagtccaatcatgcttcaagaacacattgactcgattcttgaaggtcgtgttggtggtttcaatcgtgatggtggtggtggtggccgttgcagtggcgactga

SEQ ID NO: 109409 - DNA, 207 bp, Glycine max
  Peptide Sequence Number=SeqID_226187
atggctaaaagccaatttagatcagacaaggcgtgtttcacattctctgggggagtattggatggtctaggtgaagaagaagaggtgtttgaagatgaagactttgtgatattagtgtttaatgatgaagggataaaagtatttaatgatgtagagggtaagtattggaagactgaacaggaacaacataagattctgactgattaa

SEQ ID NO: 109410 - DNA, 786 bp, Glycine max
  Peptide Sequence Number=SeqID_226188
atgcagtggctggattttggatttgggggttggggatttcggaattgggggttaggggttggaggtggtggctgtttggttgagcacgatggaaatgacgttgttgaggtagaggcttttgatgagggtgttaagtgtgacaacacggtaggggaggtcgcgcttgagaagcttcccgaagaaggagaaggcaagagcgaccttgccaacgtgacagaagtagttaatgaggatggtgagggtgatgtggcaaggggcaacgtcagactccgttctggcgcaaaggaaaattgtgacggggaagcacttcgccttcgcgaggaaggtgaggactcggttgagcatgatgggggcatggaggacgaggagagcagctttaagttatactacgatggcttcaacgatgaggggctccacccactaccatccaccatgtcaaagttcttactgggattgggatttgaccggttgctgcagcaggtttcacagattgagatcaacgacttcacattccgctccaatcaaattgttcttctccgtgcggtgatctggcggcaagcaaaagcggctcatggaggtcaccggtggtcagtggtggtggaggaggattttgggagtgttggaggagggtttaggggaagagaaggaggaagaagatggctgttttatgctgctgggcgagctgatccagctccaatttttatgcttcggaatcctaagacaatatttgaagatgatccaacggttaacgaatccggagtgaggattttactgaaatatgtttag

SEQ ID NO: 109411 - DNA, 240 bp, Glycine max
  Peptide Sequence Number=SeqID_226189
atggatgaagaatgttatctactatcctatgcatcaatagatcttgcgggaaattcctcttcgaacaagtttagaggtcaattgctgaaactcgggcttgggaaagatgattcacaaattgcaaatagtcgtttgtgtttactaataaagggacgaatttatgctgctattttttgtgacagtgatgaatttaggaccctaaatcaagtgttagggttcgcgacggcgcagcaagagtga

SEQ ID NO: 109412 - DNA, 636 bp, Glycine max
  Peptide Sequence Number=SeqID_226190
atggcagcctccaccaccagccaggtctacatccaggtaatcgacgatgtcgtgaacaaggtccgcgacgagttcgtcaacaacggtggtcccgacgacgaagttctcaaggagcttcaatctatgatgcaagctggtgccattgttggtctcatagaaaggtccggggcgcctaagccaacgcctggtggtccaattactccggttcatgatcttaacatgccttatgaggggactgaggagtatgaaactcccacagcggaaatgcttttcccccttacgccattgcaaactcctcttcaaacccctttaccaggaactgtggataactcaatgtataacattcccactggacctagtgactacccgtctgctggaaatgagcctggtgcaaataacgagataaaaggtggaaggcctggtccatacatgaaccagaaccaaagggctccacttgacgtcaatattgggcgggatgaggcggaaagaggagcttcaaatcaacctctgacacaggacttcttcatgtcctcggggaagcgaaaacatgatgaaattgcttctcaatataatgctggtggatatatacctcagcaagatggagctggagatgctgcttctcaatggcacctgtaa

SEQ ID NO: 109413 - DNA, 450 bp, Glycine max
  Peptide Sequence Number=SeqID_226191
atggattcttggtctggttgttcccaatttgtatcagataggaccatctcggaccattatccttttcttagaaattctaaccttgattgtggacctaaacctttcaagtcctcaattgttggttctcttgtgaaggcttcatacaagaagtggaactgttggaacaaagagagcttcaaggatatccagaatcaaggaaaagaattgctggctaaaattaatttcttggacgcgaaggatgaagtgataaagaggaaacaaaagtctttgcttcatcaaaaagcaaggattaggtggcttagggaaggtgatgggaattccaaactcttccactataccattaattggagaagaagactaaatggggtgaaaggaatagaggtccatgaatcatgggtggaggagttattgcttgttaaaagaggggtaaaaggagttcttccaaaggag

SEQ ID NO: 109414 - DNA, 276 bp, Glycine max
  Peptide Sequence Number=SeqID_226192
atggatttccgtagttttaagcaggctatggaaaatttcatgtcagaagtgagaggtgggagagtgagatttgatccttaccgtatattgatgagtggaggggccacaagagcacatgaggtaataatgttttgtttggctgatgctggagatgcttttctggttcctagcccttattatctagcgcatgtgtcctctctttcatcacgcctgttttcattcaatgaatcacactatttcacacccatcaaaatgttaaaagtggacacaaattaa

SEQ ID NO: 109415 - DNA, 1080 bp, Glycine max
  Peptide Sequence Number=SeqID_226193
atggcttctccgccacccttatcgctaaacgtcgtcggatcagacattgacccaaacactaacacgttccccaccgttacaagttcgttaacgccgccatcaccacgccgttcatctccgttacagaacctcagccccagcattctgattatcgtcacggtcctcgccgtcaccgtcatcgtttccctcgctctctgcttcctcctccgccacctcaaccgccgctgcctccgccgcttctcctcctcctctgccgctccctccgccgccgcgacgccgattttcgcctccagccgccgcatctcgccggagatactccactcctccgcctccgcctccgcctccgtgatcgacacgctcccgctcttcacgttctcctccgtcacgcgccgctccgccgccgtctccggcgactgcgccgtgtgcctctcgaagttccaccaccacgacctcctccgtctcctcccgctctgctgccacgccttccacgccgagtgcatcgacacgtggctccagtcgaacctctcgtgcccgctctgccgctccaccatagtcgcggacgattccgacctcgctaagatcctccggccgccgtcatccgccggtagcagcgatagcttccgcctcgagttaggaaacatcagccgccgcggaaccgacggcgccgccgaaggcggctccgtggcgcgtggcggttcgcggtcctattccattggatcgttcgagtatttgatcgacgacgaatcggaggttccgttcagccacgctcgccggaggagcgtcgatgatgcgaaggagtttccggccccggcggaggctccggtgagtcacaacgaggcgagtctcgccggagaagttggcggcgttagaagctggcttaaggagtacatggatagggtttccgtttctatttcatctcgaacggcgtcgtttcgaggctctggaaggttcttcagcggtggcgggagcagtgatcgccgaagcgacatcgttccggtcgctgctccggagtacgacgctgaagggaaccgaattggcgaagagatcagcgaaatgtttcgttggctttcaggggtatga

SEQ ID NO: 109416 - DNA, 234 bp, Glycine max
  Peptide Sequence Number=SeqID_226194
atggtaaactatgattttcatgtggttgccggtggagataagccttctgcgacactggttgtacaaaaagccgatgtcgtaaccttggacaaccctaaatctcagtttttcttctaccctcgctcattcttacattctcattgccgtcatagagagagaaagagagagagaagaaatgtcaccaaagttgtaaggctcacttcactactccgtcgggcatgcactgcgtcctaa

SEQ ID NO: 109417 - DNA, 2346 bp, Glycine max
  Peptide Sequence Number=SeqID_226195
atggctgatcatggaacacggaaaactaccacagaccgtcttgaagatgccattgcgcgcctcaccaacagccaagccaacctcaatgagcgatacacagacctttcaaggaaggtagattcaatcttagaccacctcaaacttcgagatcatcaccaaaaccaacctccttcaaacagctctaaccaccaccgtaactctgttaaacttgatattccatgtttcgatggccgtgatcctcttggatggatattcaagatgaatcagctcttccagtatcagaacacgtcgtatcctcttgacggtgcagcccttagttggtatcaatggatgtttaccaacggcctcatcacgtcgtggcaaggatttcttcaagcgctcgagtcacgatttgcacctacgttctacgacgatcccaagggggctttgttcaaactcgttcaacgaggttcggtgaatgattacttaaccgaatttgagaggttggcgaatcgtgtgataggtctccctccaccatttctacttagctgtttcatctctggattaaatccagagctccgccgcgaggtattggctctccagccaatctccttattacaggccactgctcttgctaagctccaagaggagaagcttcgtgacaagcgcactccacctccacaatcgtcccaaccacttccatccaactcttccactaacctcaaccctaaatctaagactccttatgttcaacgcacgccggaagacatggcgtttcgccgggaaaaaggactttgctacaattgtgatgacaaatggagtcctaaccaccgatgtaagggacgcattctcttactcgtggcggatacctctccttcagatgacggtgacccgagcttagatacaactatttccattctagaagctaacgaaggcgagccagagaaggttcccgatacaagcttccctcacgttagcctccatgccatgtccggcctctcatcatcggaaacatttagagtttacggcaccgtaaggaacgctcgtatcaccgtgctcattgacagtcgaagcactcacaacttccttcaaacaaggattgcgcagttcctccacctccccgtcgaaaacacaccacccctccgagtcttagttggtaacgggtccatgctagattgcaatcaacgttgtgttgacactctattgaccatacagggtcattcttttccagttactttccacctacttcagatcagtggggcggatgttgtgctcggcattgactggttaaagcagtttgggccgatcaccactgattattcctccttcataatgaggttttcgcacttgggccaggacgtctctttgcaagcagacgtagcatctggacttgaacctgcctccacaacccaagtaaagcgcttggttcgcacaggttccacttttgccctatttcatctatgtgtttttcctgatacttcaccaaaccacaccgtaggccatccttcccctttaccggaacctgttgcaagactcatcactcaatacgagaggctcttccagaccccaacgcgcttaccacccttgcatgaggttacccaccacatcaccctcttaccctcaaccgcaccggtaaatgtacggccataccggtacccgtactttcagaagacagaaatagagaagcaagtctccgaattgctctccgccggcctgattcgaatgagcactagcccatactcgtccccagtcctcttggtgaagaagaaggacggaacttggcggatgtgcgtggattacagatcccttaacgccgtaacggttcgtgaccgcttcctaatccccaccattgacgagttgttggacgagttaggtaacgcctcatggttttccaagcttggtctcaagcaaggattccaccaaatccttatgcacgaagctgatattgagaagacaacttttcgaacgcaccaagggcactacaaatacctcgttatacccttcggtttgtgtaatgcgccttccacgttccaggcagcaatgaaccttctcctagcaccgttcctgcgacgtttcgcggcagtatttttcgacaatatactcgtctacaatagttctttatctgctcccattcaacacttggagttaatcttccaggctctccttcacggccagtattttttgaagaagacgaaatgcttgtttgcccagaatcaattagaatatcttggacacatagttttcggcaagggtgtaacccctgaaccctccaaactccaagctatcacgcaatggccgattccgacatccgccaaagagcttcgcgcattcctgggtcttaccagtttttaccggaagttcatttag

SEQ ID NO: 109418 - DNA, 936 bp, Glycine max
  Peptide Sequence Number=SeqID_226196
ggtaacaacaacttcattccaaccattgcaaggagcaactttgagccttatggtcgtgactttttcaatggaaaccctactgggagattctccaatggacgcattgcccctgacttcatctctgaggcctttggcattaagcaatcagttcctgcatacttggatccagcttataacatatctgattttgcctctggggtgtgctttgcttctgctggaactggatttgacaatgctactgcaagggttgctgatgtgatacctctatggaaagaaattgagtactacaaggagtaccaaaagaaactgagggcacatcttggggatgagaaggccaatgaaataataagagaggctttatatttggtcagcatagggaccaatgacttccttgagaactactacacactccctgaaagaaggtgtgaattccctattgttcagcaatatgaggacttcctcctagggcttgctgagagcttcttcaaggaaatttatggccttggggcaaggaaaatttctctgactgggttgcctcctatggggtgtctgccactggagagagcaacaaacattttggagtaccataattgtgttgaggaatacaataatttggccttggagttcaatggaaagttggggtggttggtgacaaagctcaacaaggacctccctggacttcaattggttgatgcaaatgcttatgatatcatactgcaaatcgttaaacacccttctcgttttggttttgaggtagcagatacgggatgctgtggaacagggagatttgagatgggtttcctgtgcgatccaaaatttacatgtgaagatgcaaataacaaccatgctacctccattgaagacaaacctcgcaccacgataaggccagtccgcgtaacaaccaaacccagatatttgcaagattatgttagttag

SEQ ID NO: 109419 - DNA, 666 bp, Glycine max
  Peptide Sequence Number=SeqID_226197
atgaaacaaggtgttccttgtagtgacacactgttgcatgactcaaattctgactttgagttcagcacaagcacctgccttgagttcgaatcatcttcagcagatgaactcttctctaatggggtgatccttccaattcagatgcaagacaaaaccacagctagaaaactcactcatcatgtgaaatatcctcacacaaaacttcctcctcgtccgtgtgcctcaagtgttgacaaagtgaagaaagaaaccattagagaactcctagatgtgaatcctgatcatgagaagaagcctcattccaaatccttttggggattcaatagaagtaaaagtctcaattgtgatacaaagaagaacttggtatgctctatacctcttttgtcaagaagcaactcaacaggttcagtggcaaatccgaagagagtgagttcaaacaagcatccatcagcagctaaatcatcatcatattcgttttctaccttaaatatgtatcccatgcaaaaatctccttcaggtaagagttatggagggtcttatcccaaaggccttaggattaatcctgtcttgaacgtaccaacaccttgtgtttcaaagggaagtgcacatctgtttggtttgggttcatttttacgtgttgggaaggttaagaagagcaagaaatga

SEQ ID NO: 109420 - DNA, 444 bp, Glycine max
  Peptide Sequence Number=SeqID_226198
atggtaaaaggagaagtggaaaacgtagcaacatggactacaccccataagagagaagtgagaacaaagagcacgtacacggaagcacagagttacaatgaagacatcaagctttcctcgaacccaacagcgacaatggcagcaaggctggcagtgagatcagtgacactcaggttaccacaagactggcacgtacctcagaaaccaaaaaaggttcttgggttaaccaccagttcccaaaacagacctacatattcaatagaacaacacaggttagacgaaatgtacctaggtaacaaaaaacgagttgtcacggtcttcggcgcaatggagaacaacaagcttaggtgcaaaaccgatagagggtacacggagatgaagaggtgcgatagagcgtacatggagatgaagaggcgcgagcaaaatagctcacgtatgatataa

SEQ ID NO: 109421 - DNA, 387 bp, Glycine max
  Peptide Sequence Number=SeqID_226199
atggtagaatcattccctttcttggttcttggttcaaagaactggccatttctgaagattctttcactgccatttgctcgatggtgtgatctccagcacaaggagtggagagagttagtggtaatgcaatatgagagtaaagctacctattggaagctctttacagttttgtcgatgctacgctcgacttcaggcaatttcttgggcacgccgacaataacgaccagtttgggcacacccaaatcgaacatggcgttgcaactcaaacctttgtttcttcatcgaccattcactgctacccttgctgaattgaacaacttgggtgtgccgaaacacaaagatgaagaggatctcacactaatagcgcctctcataactgaactctga

SEQ ID NO: 109422 - DNA, 208 bp, Glycine max
  Peptide Sequence Number=SeqID_226200
atggcagtgaaagaatcttcagaaatggccagttctttgaaccaagaaccaagaaagggaatgattctaccatttcaacctctttcacttgcattcaatcatattagctattatgtagatatgtcagctttcgcatatgctttccttacactggcatgttatgattacaaaaatttccttcttgcagatgttctatctgtccctagat

SEQ ID NO: 109423 - DNA, 249 bp, Glycine max
  Peptide Sequence Number=SeqID_226201
atgaaggcgtggcatacatgccgagtgcacggtaaaagcttagacagttaccgcaaattacgggggccacgtgacaagacggttaggctgcacacaagatgcgtgaataggtcgaggtcagtttggggtcctcgtaaatcttccgatgttgcacaaaatttggagatgtcatttgttcacccatcacagagcaaattcgatattctctttagcagaatcttgaatggtgttggtgataaaatttattga

SEQ ID NO: 109424 - DNA, 1299 bp, Glycine max
  Peptide Sequence Number=SeqID_226202
atggatgagttgaattgcgcgatgacgaagatgggagaggtttctgccgcggatggtgctcagagtgctgcttttattgcggttccggatggattaaaggcatgggaaatgttgaagaagaaggcacctgagctagatctcatattaacagaagtggagctaccagcaatatctggatttgctcttttttctttaatcatggagcatgacatttgtaaaagaattcttgtcataatgatgtcttctcatgattcggttaacatggcattgaaatgcatgttaaacggggcaattaattttcttataaaacccattcgcaagaatgagcttaggaacttgtggcaacatattagcactcctactcaaaatacaacattttcaccgaaaaaacttaaaactgcctcagaagacaattctgcaagcaataaatctaatggttctatggcttcctcaaagaaaaacaatgaatgcagcgagagattaagtgaggctcaaaaaccacaagtttgcaaactcttgtgcagagcacttgtacatcaccaattatggaagctaagagtatggattctagacacaaacggtcagtcaagcccggagcactacggattccagacagaatcagacagagatggcatctccatcttcgggccgaaggacatatggatcgaccactacaccctttcacggtgcaaggacggtctgatcgacgcggtgatggggtccatagggataaccatcaacaacatgctctcccaccacaacgaggtcatgctactcggacacagcgacgactacctccctgactctggaatgcaggtcaccatcgccttcaaccacttcggggagaagctcgtccagcgcatgccccgctgtcgaaggggatacatccacgtcatcaacaacgacttcaccgagtgggagatgtacgccattggtggcagcggcgagcccaccattaacagccagggtaaccgttacatggcaccggaaaatcccttcgctaaggaagttactaagagagtcgacacgcaacagtccaagtggaagggatggaactggcgctccgagggtgacattctcctcaacggggccttttttgttgcgtctggtgaagaacttgaagtcaagtatgagaagacatacatagtccaaggactattttgtaaaattgccaaaattgccatggtcatacttgagtgtgatgttggatattggatagttcacgtgacactaaaatttccaacaatgcatttcattaacggtgttacattaaaatttaatggaaaaactattttataa

SEQ ID NO: 109425 - DNA, 930 bp, Glycine max
  Peptide Sequence Number=SeqID_226203
atgcttgatttattttctgctgccacgtgctctgctgattttggtcttggtatgaggttgtgcttttgggttggtcattccgggttttattcgcttggctctcttcttcctttttcgttgcttctacagttcaaggtgggactgttgtgcatgtctcttttccactctttttcccttccttctatctttttcaataatttgtcatcgttttcctccacaggaaaaagatgcgtgaagccatcgaaggttacaaaggatatacatactgatcgtgagaaattgatgttcaagcttgctacattgccatttctagattcttattggaaccaggttgcaagtgttttgaacattttggatgatgagttgatcaagaatgttggagactacattttaaggctgattgttctttcattgcctcaacagaggagatctaagaggtccttggaaattcaacaattgagggagcgtaagaaagagtatgacttgaagacagcaatatctttggttaaagaaatagctaaaaccaactttgtagaaacagtagaagcccattttcgcctcaacattgaccctaaatataacgatcaacaattaagagcaacagatatttccgtgattcaaatttgtcaccatgagcaggtcaggacaataacaggatttgaagaagatatttgcgtgattcaaatttgtcaccatgagcaggtcagggcaaccacgggatttgaagaagatattcccgtgattcaaatttcttaccataagcaggttagggcaaccacgagatttggagaacttgcagcaaatgccatattggcagtctctcttgcagtctgcagagttggtgttgctgtcctgaaagttcctctttacaaggctgttgagaatctttccactgctgacatacaattggagaagaagggagcagaatga

SEQ ID NO: 109426 - DNA, 555 bp, Glycine max
  Peptide Sequence Number=SeqID_226204
atggcaaagtattattgcaacatttgcaaattttttgatgatgaaaggaatgtttatcattgcccattttgcaatatatgccgtgttggacaagggcttgggattgattattttcattgtatgaaatgcaattgttgcctggggataaaatcagcatctcacaagtgcctggagaaaggtttagaaatgaactgcccaatttgctgcgacgacttgttcacatcaagtgcaacagtgagagctttaccttgtgggcattacatgcattcatcttgctttcagccactacacatgtccaatctgcagcaaatcactgggagatatggcggtgtgcttgagagagggagttcctttgggaaccattttgttgggagttcacttctactcttgggggctcacttagctgtttctttacctatccaggtttactttggtatgcttgatgctttattggctgctgaggagcttcctgaagagtacagggaccgctatcagctttttgagcgagaaaaagaaaagctgcaagagcagccatattgctctaaacaaaggtag

SEQ ID NO: 109427 - DNA, 537 bp, Glycine max
  Peptide Sequence Number=SeqID_226205
atgacatttgggaccgtggtagctcgcccaggcgagctgatgcttactcctgaagtaacaggctcgcccaggcgaggtggttccttcaggctgaagaaactggaagacagtgaagctgctgagcaatattgtgctgagataggaagagctgatgcatatatgcagttgcttgaaatgtatttggatccacaagatgataaggatcctatgtttactgctgctgttcgccttctccataaacatggagaatcactagatccattgcaagttttagagaaactgtctccagatatgccgcttcaacttgcttctgatactttactaagaatgttcagggccagagttcatcatcatcgtcaaggacagattgtgcataatttatctcgtgccgtagacattgatgcaagattgtcaagattggaggagaggtcaaggcatgtacagattaatgatgagagtctctgtgactcctgtgatgcacgccttggtacgaagctatttgcaatgtatcctgatgactccgttgtatgttacaag

SEQ ID NO: 109428 - DNA, 1050 bp, Glycine max
  Peptide Sequence Number=SeqID_226206
atgtgggacttcctaattccctccctccaggttcctaggaataggtattggggtttgcatcctccaccagcccctcttgaagatgtaatagatgatggcttgatgacaatccaaagagcttctttcctgaggaaagcaggcgtagaaacaatagtagatagtgacctttttctcaatccagcgaatagagctgatttgttggagtcagcaatcaagaatattagcaggtatttggaggcctgtcgagaaaaagacctaacggaatcagtcagggagggagttgatactctactaatgtatctgtatagagctttaaattctgtcgaggacatggagaggctggcttcttctataaactggtgtgttgtggaggaattggaacaaatgctagaagagtctgggcacctacggacacttgccttcctatgtgcaagtaaaggaatgagctcaaaagctgtgcatatttggcgcatcctggcacgaaattattcatccggcctctggaaagacccttctttggagaatattacacagaatagtggggaaaaccttatttctggcagggcaattgctgcagctgaagcttcaaagattcttgaggaatcatctgaccaagaattgattctacaacatctaggatggattgcagatatcagccaggttcttgcagtcaatgttttgacttcagacaaacgagagatccagctttctcctgatgaagttgttacaactattgatccgcagaaggttgaaattttacagaggtatcttcagtggttgattgaagaccaggactgtaatgatacacagctgcatacattgtatgccctctcacttgccaaatcagcaatcaaagcctttgaatccgaaaatatttctgagaatcttgatagtggaaatatagggacaagaagtttggccatgttgaagaactcaatctttaagattcctgtcagggaaagattacagatatttttgcagtcctcagacttgtatgatccagaagaagttcatgacttgattgaaggatcagaattgtggttagaaaag

SEQ ID NO: 109429 - DNA, 2028 bp, Glycine max
  Peptide Sequence Number=SeqID_226207
atgagagagagagagcgacacagagagagagagagagtgagaagagagagaaacattgggagggggagagatacactgaggggtaagagagtatggcgtgagagagtgagtttcggggaggcgtctcgacgaagctatgccggaaacacaggaagagttgcgctgactcatacggtgactaattggagagatcataaggacatcacgtccttatatttctctcgtttcgccgacgacatcacagagaaagaactgtggtatcacttcaagagatggggggatgttcgagagattttcatcccgaaaaggagaaaccttgcggggagaagatatggcttcgtcaggtttaaaggggtacaagatatcccttatttggtgaggaagttggacagcattgttatagggggattgaaattgttcgtcaatctcccaaagtatggcagggagatacgtcgggagacagcgggaactatccaaacaaaaggggtggttcgtaatcgccattcgacgccaacctcatacgcagatgcattgagaagaaacattaactgtgtaggagatcagaaaacatcattcacccccactaagcaaaatacctcctcgtcggtggtccatatagaagtgaaaccagaagatactttatggttgaaggaagcatgggtagcgcgtctaaaaaacccagcactgtttgaacgaatggaggaagagctactctgggaggctggaatggatgtaaatcctacattcttgggtgatgatcaagtcctcctgctgggtctctctgaaaatgatgcacaccagctcatcaatggaggcagaacattgttattttcatctactgaaagatggcgtccaaatatacgagtagactatcggcttacatggattcagtgttgggggatccctgttcaggcatggaacccaaaacacattaaccagattgtagccgttatgggagagatggtggacctagatgactcagtggaggagaaaagaaggctggataaagcgcgggttctcatctggactcagtggcgaccattaattcaacatacgatgcaagtcatgatcgatgacgacaagttcacggtccacatcatcgaggagtcctgtcaaggccatttagattgtttgcggaggagggggaacgtaggagggtcatcggaggagattaactccgacgataccatgctagatagctcatcccacatcaactgggacccaggtgataacgtctcaaacttaccggagctggaatcgtgtagcaaccttcacggagtagttcctcagaactccgtcggcgccgaagaacagggggggccaacgcgaccatgtccgtcggcgtcggaactgcgttccgcgcgacaaggcgaagtcgcgacctcttcgcagagcaccgaagtccaggacacagggtatttacccgctgggtataaagaaggtcgcgacccattagacacttaccctcagtccataccagagacctgtgtaactccattgcctggacaaaatttcaaatcctcttttcaggctatggagacaaacacagagaggaggcaacaggtcagcctatgtgccaggaatgtagaggctaaggaacatcaccaaaatggcaatggtggtaacgggaggtctaggggggtgatatatggtcaaaaggaatctcatgcagaggatagacacgtggccttggctgaagatagaacggacacatgtgacaagtctaagtatagtgagttggaggggcatataacagacaaaacaccacgtacagcacataatggtgaacatattcccatttatacccccaaagagaaaaattatttgctgggccttcaaacacaagaagggttggatgggaatttgtggcaagtttactccaagaagaggaggtgccaaaagcaaccaaatacgggcttcctcccctctaattcaagaagcacagcaatcattggagacacacaacagcaacataatgataactcgacacagctagaggcaattcacaaagatatcttgcagcaatag

SEQ ID NO: 109430 - DNA, 1188 bp, Glycine max
  Peptide Sequence Number=SeqID_226208
atggcgaaggttgaaagcagcagcagcattagcatgagcatgagccgcgtggtgctggagccccacgcgcagttcgacctcacggcccactcacgcgccagctccattcgatccctcgcaatcgcccactcgaaacgacaccatacgactcttttctacgttggaactcactccggaactctcttttccctctccgccgaagattccaactacaccgacgacgacgccgttttgcgcaagctctccttcctaagaagcgtttcggtcagcgacaccgccgtcgagtccatttcggtcatcgaagagttcgggaagcttctgctgctctccgatggggctctgttcttggtcgattccgagctctcaaatggcgccacgaaattgagtttccccaagggggtttcgttggtcacgaggagaaggttcaggaacaacggcggtggagaatctgagggtttcggttcaggtttaggttcaggttcgggtttagggttgtttcagaaattgagaatgaactcaatgaaggaggttgatgtgcagagtgagacaggtggtggatttgtttttgcagttgttgttggtaagaggctgattctagcggagcttgttttggggaataggaatgggaaaactgagagggatgatggtggtggtggtactcttgtgattttgaaggagattcagtgtgttgatggggttgttagtgccatggtgtggctcaatgattctatagttgttggtactgtgaatgggtacagcttgatttcctgtgtgactgggcagaatagcgtgatcttctcgttgccagacgtgtcacggccgcccaggttgaagctcttgcacaaggagtggagggtgctgttgttggtggacaatgtgggggttattgttgacccccacgggcagcccgtgggggggagtctggtgttccggcacggcttggacttggtgggggagattgattcctatgtggtggttgtgagtgatgggaagattgagttatatcataagaggcattgtggttgtgttcaggtgttgccctttggcggggaaggggttgggcgatgtgttgttgccagcgaggaagataggggtgggaggcttgttgctgttgcaactgctaccaagggttcaactcaatggataaatgttttattagggttgtggattaatggattgttgaggtaa

SEQ ID NO: 109431 - DNA, 1350 bp, Glycine max
  Peptide Sequence Number=SeqID_226209
atgagcccactccatgtcttagtaggtaatgggtccgtccttgattgtaaccaagtctgccccgatacctcactatccctccagggccaccatttcacggtcacgtttcatttgctccctatcagtggtgcaaatgtcgtgttggggatagaatggttaaggcaatttaggcctataaccactgattacaccgcgttttccatgaagttcacctatatggggcggcccattgaattacacgttgatattaccactgggccaaaaccaatctcagccccacaagtaaagtggttattacaaaccggatccgcctcagccctcttccacttaaaaatggtacccaacccacaacccgacccacaacttcatcttcctcacctgatacctgtagtcgaagcgcttctcacccattttcaccacctgctccaacaaccctcttcccttcctccgcctcgctccatcgttcaccatataaacctcctacctaatacaacaccaatcaatcctagtatgagcccttactcctcgccgatattactggtaaagaaaaaggatggaacttggagaatgtgtgtctactatcgtgccttaaacgccgccacagtccgcgatcgttttctgattccgacgatcgacgagctactggatgagttaggaagcactgcttggttctctaagctagaccttcgacagggattccatcagatacttatgcatggccctgacgtggagaagatggctttcagaacacaccaagggcactacgaatatcgcgtgatgccctttggattctgtaacgcaccatccacttttcaggcagccatgaacattttgctaacgccatttctgagaaaattcgcggcagtatttttcgatgatatcttagtatacagcaggacgttatccttggatcttcaacatctcgagttcgtcttccaaactcttctccaaggacagtatcatctgaaaagaaccaaatgcctatttgctcagaagcaagtagaatatttagggcatatagtgtctggtaaaggggtcgagcctgagccttccaaggtccaagctatggtacagtggcccacaccatcatcagctaaggaactcaggtccttcctaggacttactgggttctacaggaagttcattaagaactacgctatgatcgcggctcccctcacttccctctttgccaaggattctttcgaatggtcattagacgctcagtctgcatttgaacaactgaaggcagcaatgaaaaccgcccctgtccttgccttaccagacttcgaagaaccattcgtgatcgaagcagacgccttcggcgccgacatgggcgcggttttgatgtag

SEQ ID NO: 109432 - DNA, 339 bp, Glycine max
  Peptide Sequence Number=SeqID_226210
atgttgcggcggcaggtagctgggtctcgatgctgtttgtttgggccttgcttctgcggtttcgggcccagttctggtatccacgaggtgattgctatcatacgccgtccactcccccgctgtcttaggaggatattcttgcgaagtggtggaacaaggatgaaattcgaagcgtgtaagaaggctacaagcggattaagcgttgcttgctttggaaagacgctcgctcctccatgtctgaactccaacagagttatctcactccgatcacttcttccggagaggattgtttctatagatggccatttaggaatgtttctatgggaatcttgtgcataa

SEQ ID NO: 109433 - DNA, 555 bp, Glycine max
  Peptide Sequence Number=SeqID_226211
atgcgtccaccttcgaaaccaaacccgcggaggcttttaggccactccctccatgacttcagcggaacaacctatgaagaagcgaaagctctacgagcctttaccagaaccgccaccgtctttgtcgctggaatccgaatcaacgcctccctctccgtaaaccctacctacgctgttaggagcagaggtctcgtgaggggaagagagggaatgggtaaccttgcttcgagggaaggtgattgctatcaataccctcacccgcgaagaccaccttgtcctcaaggtggtgaaggtctcgaacttctgaccactgttcccaggtggtgtcctcagggggttgaccctaccattgcactagcacgagtcgcgttggtggagacgatgatgtgtcaagaccatgatgctcgcgtaggagtgaacaatggaatacggggtggatccttgcctcctcagcttaacatagacccactggccgatgctgaaggtcatgtcgcggcgcttgttatccgccaatctcttcatggtgtcttatgccttttgaagacgatgttgtag

SEQ ID NO: 109434 - DNA, 2361 bp, Glycine max
  Peptide Sequence Number=SeqID_226212
atgtcttcagctatctttcttcctttcatactttcactttcactttcactttcacttctgaatggcttagatgtcatacaattaaacacaaacatcactgccggttcaaattctacctggaagtcaccctcgggcgattttgaattcggattctatgatcttcgcactggtctctttcttgtgggaatatggtttggaaaaatcccagacagaactttggcatggtacttccagagtccccctgtggaagcaaattcccaaatccaattcacttctgcaggaaaccttgtggttgcatacccgaaccagactattgctcaaaccatatacagtggtggtgctgcaacttcttcctacatgcaagatgacggaaattttgtcatgaaggactccaactcggaatctgtctggcagagtttcaattctccttccaacacaatgttaccgggacaaacgttgcagagtaccaaagttctctattccaaggagagaggagattcaaactactcattgggaaaattcatgttacaaatgcaagacgatggaaacttggtgctaaaagcgtaccaatggtctggccctgcatactggtacaattcaaccaacacccccaatgtgaatttggagtttaatgctaccagtgctctcatgcactttgttagcggctctaggagcatctacaccttaacaaaaagcacttcaacccccgtggaagattactatcaccgcgctacaatagatgagaatggaaattttcagcaatatgcatatcccagacgaaacgagaatgacaccactgggtggaggagggtttggagagctgtggaagatccctgcagagtgaatcttgtttgtggtgtttatggtttgtgcacttctcctgacaatgaatcagtcaagtgtgagtgtattccgggttatatcccattggatcatcaagatgtgtccaaagggtgtcacccaccagatacaatcaattactgtgcagagaagaagttcaaggtagaggtgtttggggacactgatttccaattcgataataattttgttcgcgtatatgatgttgatttggaaggttgtaagaagtctttaatggatgattgtaatgtcattgctgcaacttataacacctccacccgcacatgtgccaagaagaggttgcctttgctgaatgctagaaatagctcttcttcgaagggacagaaagcactgcttaaagttcctaacagtgttgatgatgggagatctaataaagctaccaacaaaaagagctttaatgtaagaatatttttgaaggttatgcttgcagttactgccactcttgcatgtttctttggtgcccttgttgtctactatcaccctttcactcagagactagcaagaagaaagcggtatttgaatgcaagcgctattggaatcaacttcagagaattcaccttccaggagctgcatgaagcaacagatggattcactaggattcttggaaggggttcttcgggtaaagtctatcacggaactttaataatagacgatgcagtgattggtattgcagtaaagaaactggaaaagaaaattgagaaaagtgagagtgaattcatgactgagctcaaaattattggccgtacccatcacagaaatttggtgaggcttttgggcttttgcattgagagtagccatcgagttcttgtgtatgagttgatgacgaacggagcattgtcaagctttttgtttggagagggagaaaggcctcaatggggtcagaggatcgaaatggctcttggagtcgcacgaggcttactatacctgcacgaagagtgccacacccaaatcatacattgtgatatcaagccccaaaatgtgttacttgattccaatcacacagcaaagatagcagattttgggctttccaagcttttgctcaaagatcaaactagaacaagcaccaatttaagagggacaataggttatatggcacctgaatggctaaagagcgcaccaataactgccaaagttgatatatacagttttggggttatgttattggagattatttgttgcaggaggcacttcgagtctcctcacgatgcaaacgacagcgaagatgatgatttggttctttcaaatttggttttaaggagtgtggtgtctaggaagctagaggtagtggtgagacacgactcagaagtgctgaatgatttcaagaggtttgaagaaatggcattggttggactatggtgtgttcatccgaatccggctcttagaccttcaatgaagcatgtgatgcagatgctaaatggaactgtggaagttgggattcctcctttggtttatgatcagatgatggaagatcagggcttgtag

SEQ ID NO: 109435 - DNA, 597 bp, Glycine max
  Peptide Sequence Number=SeqID_226213
atgacctctgcgcttcgtcctctcgcatccgtcgtcggtcttttcgctgcggcactcctcgtcgccggatgcactgcggggcccggcgcgcaggcgccgacgaactccccggcgccggaggcagacgcgggcgacgaccgggacgacatggacggcacccttctcgacgacggccgcatgttcgcggtcatcacgatcggatcatcgacctgtgtgccgcaggtggcggacgtcgccgccgacggacagacggtcaccgtcacccttgcggaccccgagggggagtcgccgcagccgtgcacgaaggatctcgccccgcgggcgagcatcggtgcgctgccggacggggttgacccgacgaaggacatcacgctgaacgtgacttacggcgacctcacggacgacgtcgacatcgatggtgaccccgaggcgacgggcaccccgggatccacgaccgagttcctgccgtctgccggctgggtcgacgacggcctcgtgctgctcacgtggggctcttcgtcatgcgcaccggtcgtggagtcgctcgagggttcgggtaccgcaggcacggtcacgttcgccaccgacgaggaccag

SEQ ID NO: 109436 - DNA, 99 bp, Glycine max
  Peptide Sequence Number=SeqID_226214
atggagcgcggaggtgagacgggcgaggttgtcgagcaccgtcgaacgcaacggctgctgcatccactcctccagcgtcagctcacggatgacagagcg

SEQ ID NO: 109437 - DNA, 201 bp, Glycine max
  Peptide Sequence Number=SeqID_226215
atggaaattgaagcaagtgcaagcccacgtcgtgttattgacgttgagaaaaggcatggccaagagcaaagtttttccagtctcttgcatatcggaggatatataacaaagctcttaataaaaacacaaaccctaagagccaaacacgacgctgtgccttgtgtagttgcccaaccgcgtcaccacaggttttccatctaa

SEQ ID NO: 109438 - DNA, 243 bp, Glycine max
  Peptide Sequence Number=SeqID_226216
atggtgttgcggcggtgcgaggcccctccgatctctcgttttctccccttcttgtatcttcgctttcttcgccatcaatttatcgccaaagaaaaaattaaaatctgcaaaagtttggagcaggaccaaaaatccatcaaacaaaaagccacaagtcggataaaaacgcatgaatcattgtgcggtgcagacatgctagggattttagtttttgtccctgatcggggcttgagaaatgcgtga

SEQ ID NO: 109439 - DNA, 519 bp, Glycine max
  Peptide Sequence Number=SeqID_226217
atgaggctccttagcatcatgaccacctccttaacattattcttcatttttctctttctctccatacaccttcaagcaaccattttaactgaagcagcaacacaagatccttctgtcaatcaagttccctacaccacagcacggttatcccgttctcagttcaattacttcttccccgtttctgcgagtcccaaattcattcgcctcttcttctacctagcttattacccttcctttccccacactgatgcctctttctccgttcaatctaacggattcaccttcttaaaaggtttcaatgcctctctaaacgctgacacagaagccaccaaaaccatcttcagggaatatgtggtcaacgtcaacgatggtgagattctcatcctcagcttcactccctcgcaaccaaactcctacgctttcatcaatggaatcgaggtacaaggtggagaaaaagagaagaaaatgggtttgagcttagtaagtgtggagaagaagagaagaaaatgggatttgtaa

SEQ ID NO: 109440 - DNA, 690 bp, Glycine max
  Peptide Sequence Number=SeqID_226218
atggagcctgagttagctctgttgctgcacacttatagtgttgtctttgccacacctatcaatctacctcctcgacgatctcatgatcactcaattcccttgctggaaaggtcacaacctatcaaggttaaaccttacaggtatccacatagccagaaggaagaaattgagaaactagtctctggcatagctatggatgcaaacaaattagaggtagttcaaaattgggtagagcctatgaagctaaagcaattaaggggcttcctaggacttacagcacctttgattgatctattgaagaaggactctttcagatggagtcaagctattgctcaggctttccaacaacttaagatagccgtgacttctgcacttgcccttgctattcctaatttcaatgaaatttttgtattagaaactgatgcttcaaggagtggagttggtgttgtgttaagccaaaacaagcatcctattgcttatttctcaaaaaagttgtctagtagaatgcagaaacaatatgtatatactcgggaattctatgctattactaaagctttagctaaattcgggcattatcttcttggtcataaatttatcattaagactaataaaaaaagtttaaaagagttaatggagcaaaagttgcaaacccttgagcaacaactgcaacatcccatttttcgtaaataa

SEQ ID NO: 109441 - DNA, 846 bp, Glycine max
  Peptide Sequence Number=SeqID_226219
atgtccctaactaatagatctcttagattgagtgatgaggctttccttaattgtttcattagtggtttaaatcttgatatacgtagagatgttgttgctatgactcctcctactttactttgcggagtagccttagctaagatttttgaagaaaaatacaatccagtccctaaatccacttgtagctcttatatacaaaaatactctcagatctccactacttctgtttctgttagttcccaaccaaaaattcaaaataaaaatagtttacccggacttttacctactcctcaaggacctcctttgaaatcctctaatgttaagaagattagtcccacggaaatgcagttgagaagggagaaaggcctttgttatttctgtgatgagaagttttattttagtcataaatgtcctaataggcaatttctgtttctacagttggaagacgaggatgttgaggattcttctagtctggttgtgcctttggttgttcaggaagtcgaaacaacaaaacctaatgatcatcacttgtctctgaatgcttcaaagggtggtgtaggagtcggtactatcaaatttatggcctatattgataaacttcctatgactgtgctaattgatggaggaaaaggattagttaaacaacttaaggttcaggctcagggtaatgtttttcacttgccagtgtttttgcttcctatatctggtgcatatctcatcttgggagcaagttggttgaaaacaattggaccctatattgcggattatgatgcattacaattgaaatttctaatgaatggaaaattcactactctacaaggacatcataatttgattcttgagtag

SEQ ID NO: 109442 - DNA, 303 bp, Glycine max
  Peptide Sequence Number=SeqID_226220
atgcagatgaggttccaaactaaaccagttgatgtagaaatggaagatcgcttagaggatatgattcatgatctaggacaagagtattttcaacaagcacatgcccctatgcaaggatttgaagaaatgcataaattctcgaggtgtggagtatcacagtacaaagtgaaggatgatgatgagtgtaacaatgatgaaagcacaatgaaataccccccaacgaatgtgttatggtatcttccgatcatttcaaggtttaagcatctatctgcaaatggaaatgatgaaaaagaccttacatga

SEQ ID NO: 109443 - DNA, 733 bp, Glycine max
  Peptide Sequence Number=SeqID_226221
ggcatcacaacaacagtggcttcttaagttcttagcagatgactttactattcagtacaagcctgggaaagagaacatactgactgattcattcatggataaatcaactaattacgatgctaaagtggttgttgaggcttttattaacaacattgtgaaggttcatggatttccaaagtccatagtatcggttagagacagagttttcatcagttcattttggcaacaattatttaagtctcaagaccaactcttttccaagcttaaagtgaatttatggaaggcagataagaagaggagaaatttgcaattcaaagaagtgctggagaagaatggaaatgtcacatacaagcttaaacttccagaatcagcaataatacatcctattttccatgttgctcagcttaaaccattccatggcatggtgttggacgtgcgtgttgttaggagattggagaaggaaatctctcaagtattgattcaatgggaagctactgaagttaaagatgctagggaagatttgcaagacatcgtgaactcttatcctcagttcaaccttaaggacaaggttgtttttgatgagaagggtaatgaaaagcacacggttgaggagatagaacatattgctgaaggacttcgcacattagggggccatgaaagtgatcttctctctaatgcctcttcctctctgaaattctctggaattctgattatattccctttctctctctga

SEQ ID NO: 109444 - DNA, 273 bp, Glycine max
  Peptide Sequence Number=SeqID_226222
atgagaacacatcctatagatgaaatattgctctggcataatgcaataaaaaaagagttaaatgagatagcagcacagactagaaagatacaactctctggagattttactaacctgtcagctttcaatgaaaggttgcaattcattgctgaagtttgcatatttcacagtaatattgagagggaaagccttagtgcgatgataaggttactactaccttgtgaccttgaggtcctgggttcaaattctggaaacaaccttttcacttgctga

SEQ ID NO: 109445 - DNA, 411 bp, Glycine max
  Peptide Sequence Number=SeqID_226223
atgacacgcaaagtagaggaagaagaaggaaagaagaaaaatcacatccacacgggaagtggaggaagaagaagaaccacaaccacaaaaaagaagaaggacaacggtgacaggaacaccgaaagaggagcaagcggatcagaggaagaggaagacgaagaagtggtcgtaggcagagaagaaggaaagttgtatggacagataagtaggagtatttatagtattagggttaagggcattttggactttttgtcatcgttgttgggtgtcccaacaaaaatgctagatgcatcaagggaagtgtggcacaatgcaatctggttggatctcgactcggaaagggtggcgcagcgcaacacaatctacatgaatcttgacttcggaatggtggcgcgaggcgacagtgcttga

SEQ ID NO: 109446 - DNA, 638 bp, Glycine max
  Peptide Sequence Number=SeqID_226224
gcttttggtttatgagaaaatggaaaatgggacactctccaactttctttttgagaaagggaatcatagacccagttgggagagtagagtaagaattgtgattgagattgcaagaggcttattgtatctgcatgaggagtgtgaccaacaaatcattcattgcgacataaagcctcagaatgttcttctcgactcgagttacaccgcaaagatttcagattttggactggcaaagcttctaatgaaagacaagactcgaacaagcaccaatgctagaggaacagtgggttatatggcaccagaatggctaaaaaatgcacctgttactacaaaggttgatatctacagctttggcgttgtgttgttggaaaccatattttgcagaaggcacatcgagttacaccgaatcaatgacgaaacaacgggtggtgatgacatgatactcatagattgggttctgtatctggcaaaagaaaacagtttaagagcagctgtggttgatgatcttgaagttgaaagtgatttcaaacggtttgaaagaatggtaatggttggattgtggtgcgtatatccgaattcaactcttcgaccatctatgaaagtggtggcacagatgttggaaggaaatatagaagtgg

SEQ ID NO: 109447 - DNA, 342 bp, Glycine max
  Peptide Sequence Number=SeqID_226225
gtgatttttccagctctagatatacgagtgaagaatgtagcacaaacatactccctcgaacaccagggtgaaagtgatctttttgatcatctatttgagctgttaaactcttccatccataatgacgaaagtttcccaaaggagttagcatcctgcacaggagctctgcagacgtctgttagtcaacacatggctaaggaagaggagcaggtatttccactgcttcttgagaagttctctcttgaggaacaggcatctttagtttggcagtttctctgcagtattcctgtgaatatgatgaccgaatttcttccatggcttttcaacatctatatcacctga

SEQ ID NO: 109448 - DNA, 387 bp, Glycine max
  Peptide Sequence Number=SeqID_226226
atggagaagcaacaacaacaagcaccatctaaggaaacaaaggcacagagtgatgaatcagttaaagaaagcagcactgaagggcttccaatggaggatagtccctatgtgaaatacaaggatttggaggattataagcgtcagggttatggtacacaaggtcatcaagaaccaaagacaggtcgtggagctggagccactgaagcacccactctctctggtgctgcagtttcatctgatgcacaagtcgctgccactgatgccattaacagtaaaggattcgcgtatccagctgaatgggtcaaccactcaaccgccaacgtaaaattgggcctatttgcaggaagggctgggccttctgaatatgatcgtttcattctcacgtga

SEQ ID NO: 109449 - DNA, 2721 bp, Glycine max
  Peptide Sequence Number=SeqID_226227
atggactccaacaaacaagtcaatggtctagtgttgagagagttatgcaatgtttggagccatgttgataaactgctcctttatgcattgtggtcgagttcgtgggcagtagttggggattgccatgagccgaaatgtgccgaggtcacgggccatacgacacataagccttctgagttcacacgagtagtttcgttgagttacctcagacggacatcaagagtttcccaagtatcggctgacacatgtctcaatctgtgtggttggcctcgtgatggtcattgggtgtcttgtcactttgagaggcatgacggggccaagggttttacgaaaggttgggaaacccttataaaaaagagcttgaatgaagatagaaggtcacccctattttcttgctctctcgccccttgctgtcctttcaccggcattgtttgctcatttcttcgctcttgccttcatgcggttgaagtgttcattttgcttccctttgcgcttgcttttcttatgcttcctattaggtatgctccttggtcatgctccttatttccttcagtcccttgttcttccttgttctttgtttcttgcaccatgtcttcctctgctacagaggatgggtctcccgtttggggtaggtccctattggccaaagaggttaggggcataggggagtctgggagtgaggaagagttttttgtgttgtccccttcatctatttttgattcggagagaacaaaggatttcttggtgagtgttggtgagggggtagagtctatagaggagttgaaaaagaaggttgacatgatgaccttggacgaggtcgagttgttgattgtcgagccccgtagtactgaggagcatgcgtctatggggcatcaaaggaacgcatctaagcctgagaagaaattggttaagtctgtggatgggcaaaatgaggtcagcaatgccaaggtagagattgttaacttggatgggcctgaggtggcgaaagtgagcaaagtgtctgaagggcttgtggcgatgttaaaagagggagtagggggaaaagaggttgagaaggagaaagaagtagagggcaatccgagtatgggggcacctcgaaagaataaggtggtcctgcgttacgatgaaggtaaacttcttcgcttggacctttcgattaaggttgagtttgggaaggccaaggaacttgacctagaattggccaaaagtaaagaggtggcaaaaaagttgcaagaggaattagataagcatattgggtgtctatccaataaagccaaagagaacaaaatgttgaacggtcgagtctccaaccttgagaagcaagtaaaagatgtggggaggaaaatggatgagttgtcttcgaagaagaagactgtggacgagaatgctctgatggtcgagttagatgtggctaagaggttgattgtgctaaaccatcgagagggtgttaagaaggcgcaacgccaagttaaggtgttggtcccgagcatcaactctgcacaacataacgtgaatggcgacatcgtggatggttcaaactcgaccttctgggaactgcttgaaaaagccgaggttcagattcggcctcctgagagttacttgaaaaaatcgtggcttagacctaacctccttagagtcctagggatgacctttcctgtgacatcttcaagcctatacgcatcgttttgcatggactcggtgatgcggaatgggccttctcagtttggtgagagctttccttctgagctatccttcccggcatctccttggagcctccaaaccaagttattgggcttaaagctacatttcttgagcttcgagttatatttccaagttattctttgtttacatccttcctcctctaggagggtcaagcttattacggagttcgaaatggatagatatagtaacaactcagctctagacgtgagtcgagtaaagatgggtagagtgaaatcgagacagatctgccaatctattggtcaacttatgtatttccttcaagctttgtgggctgcacatggcaatgaggtcttcacatttgtttgggttgccctcgatccccatacaggtgatcatgaaaccaaggaacttacccctttcgaccccaaagacgcatttttctgggctcaaccgcatgttgtgcttttagagtttggcgaatatctccaccaagtctttcgaatgattgttgagaccgaagggcatgactttgtaacagaagttggcatctttagtgatgaatgtcgtcttgctttcatctgctcatcgatgctccttgccgagcttttgtcgttgttgtgccataggtttggcttcaggaaaaatggagagtttgtggcatatgaaattaggatctatgcctggcatgtcaatgacgcttcatgcgaagagatcaacattctgtgtcagcacgtccttgattcgtttctgaaggtgctcattaagtcattcccctatcttagtgcattggtgtggctcctttctgagttggaaataatgcaactcctcagttggtgttggccttttgtcttccttatctctctttcgttcgagatcgacccagcttggtatagcgttttccacatgattgacatctgctgcatcgacatgcttcgcggaggcatgtgtgtagggcttgacgaatcgaatcttgtgaagtcgacatcggtgaacgtatttggtgggattgatctcctcaagcccgctgcaattgggaag

SEQ ID NO: 109450 - DNA, 1560 bp, Glycine max
  misc_feature (1555)..(1555): n is a, c, g, or t
  Peptide Sequence Number=SeqID_226228
atggttacaaaaccccttgttctctttgtttctttctttctatgttccagtgttctaagaaatgctaactcaattgaactaggttccagcattgtggctggcaccaataattcatcttggagatcatcaaatggtgattatgcctttggcttctaccaccttcttagtggccactatcttgttggaatttggtttgacaaggttccaaacaaaacactggtttggtcagcaaatcgcgacaatccggttgaaattggatcaaccatcaatctcacatcaagtggcgaatttctgctccaacctgtcaaaggggctacatttcaaatctacaaaggaacaaacactcctgctgcaactgcaaaaatggaggataatgggaatttggtgttgaggaattcactttctgaatttatatggcagagctttgattctcccacggatactcttctattaggccaaactttgaagatgggtcagaagctctattccaatgccaatggatcagtggactactcaaaagggcaatacagtttggagatccaacaatctgatggaaacattgttctcaaagcttttcggttcaccgatgctggttattggtccagtggaactaaccaaaacacagatgtgagaattgttttcaacagcacaacagcttttctttacgcggtcaatggaaccaaccaaaccatccataacatgacagtcgatcctttaacgggcgcgatcgaagactattatcatcgcgtgctgatcgatgatcggggaaacttgcagaagttgattcacccaaaagaaaatggaagcgattggacatctgtctggaacgccatagaactgccctgcagagtgaccgcgctttgtggggtgtatggcttttgcaattcatctgacaaccaatcatatagctgtgaatgcttgcctggctatacacatttggatccaaatgtaccttccaaagggtgttatcttagtacggaggccaatggcttgtgtgctgcaaattcctctaaggttgaagtgaaagcaattcaagatgctgatataccaaataatgattatttttattttgatctacaagttataaacaacatggatctggaaagttgcaagagggaactgatggatgactgtctctgcatggctgctgttttttatggctcagattgccacaagaaaacgtggccagttataaacgccataaaaatcttccctgacactagcaatcgggtgatgctgattaaagttcctcttcttgacaatgatatggaaaatgaaaaggattcacaatctttggttgttttgatagtggctcttgtctcttgttccctacttgctgtattgtttgctgctacttttatttatcatcaccccatcatttgtcaacatctcatacacaaaggggagccaccaaagccaaagcctatggatatcaacctaaaggcattctcattccaacagctgagagaagcaacaaatggattcaaggacaaactcggtcgaggtgcctatggtacagtgtatagcggggttctaaacttggagggtcaacagngttga

SEQ ID NO: 109451 - DNA, 451 bp, Glycine max
  Peptide Sequence Number=SeqID_226229
caacttccaagaccagctcgtcttctacgtcaccccaaccgaagccctcgaaaaatacgccaccaaccccacaaaagcgcggttccggttgggaggccttgttctcgaaggcagcgtggtttacccggcgtcgtcgcctgaggtggagttcgtcgtcaccgatctcatctccgacatggtggtacgggaagggcactctgtggttgtggaagggctcgtgaaaccgtttacggaggagatcaggaaggaggtgtcggtgaagaacgtttccgagaaggcgaggaagatagagtgctatttttcggctaccgaggttctcgccaagcatgatgagaagtacatgcctaaagaagttgctgctgctattgagaagaataagaagattattgaggatgctgccactgccaccgtggccgccgccgccaccgcggagggaccgaagacaccatag

SEQ ID NO: 109452 - DNA, 219 bp, Glycine max
  Peptide Sequence Number=SeqID_226230
atggcatgcattagcaagagcagagcaatgctcttcttcatggtcttctttgtggggcttctgtttgctgctggggtaagtgctcagaccagtgagctccctcaagcgccggcgccagcacccacaatggatgccggagctggatttgtggtgacttactctggagcatttgtttgctcctcactgctcctctctcttattgcccttctatgccattaa

SEQ ID NO: 109453 - DNA, 363 bp, Glycine max
  Peptide Sequence Number=SeqID_226231
atggtgtctgtacatcgatgtgaggaaatggtagcgttggaagaggggctggatgtcggagcagtttccggtggcgaacgccatcgccaatcggtgcagcgcgtcgagctcgttccgaatcgccttgtggaagaacgagaatatcagaattggcgactccgacagcgaccggccgaatccgccgccgccattggcggaggaatccaccttgctcacaggattcgccagcaccgctactccgccgccgccgccgacgccgttcagccccgtcagcggcgtcgccatgcgctttcaatttttttctcctccgtcgggaaattttctcgcggctcaattttccgggaattttttttctctctctag

SEQ ID NO: 109454 - DNA, 159 bp, Glycine max
  Peptide Sequence Number=SeqID_226232
atggaggctgatgactcttccacacagaaagaagagcagatgaaacctatgcgaaataaggttgtaggcaacttggttaaatacttaaatcccaaaagtcctaacaaccaccccaacacaaggcatcaactaccattcaagatcatgtacgacaagtaa

SEQ ID NO: 109455 - DNA, 111 bp, Glycine max
  Peptide Sequence Number=SeqID_226233
atggaagtgctgaaaccacccacggatgaaagtgcaacaccaagcaacacctgcgaatccatgacgctaaggaagataacgtacgtctcgatggagggaaagccaaagtag

SEQ ID NO: 109456 - DNA, 426 bp, Glycine max
  Peptide Sequence Number=SeqID_226234
atggggttgaaccaagcgccctctttcaaaaaaaggttctatcatgtcaaagtcaagagcctagaactagccggcttgcaagagttagggcagcagatggatcaagatttggccatgatagaagtgtctattgaagccatcgcatccctcgctcaatattttgatcagtcgctaaggtgcttcacgtttcgggactttcagttggtaccaaccattgaagactttgaagggatcttgggatgcccgctaggaggaaggaagtcgtatctgtttaccgggttctacccctccatggcaagagtagaaaaagtggtcaagatctcgacacaagagttagaccgagtgaagcaaaataggaatggagtggtagggataccaaggcagctgtcgcaacctacccttcggcgggagggcgaggcgagatag

SEQ ID NO: 109457 - DNA, 426 bp, Glycine max
  Peptide Sequence Number=SeqID_226235
atggggaataaaaactcagcactttcaaaggcacatagtagccagagaccaaaggttgcttcaatagagccacaaccaaactatgttgtttcgatgcaaagcaaactctcgacaaagtccgaggtggtgagtctttgggcgtacccaacagaacaacaaggtgagaaagagaaaccagaactatgtgatgatcacactttcttcaattacattcaacgtactaagtataaaatcaagagcaagtcaaacattaatggctgcgatgccgagcagcgttaccctgcagcacctgcagatgtggctaacggtaccagcatcgataaggaaaacgaaagagaccctttttcagattatattcagagtgctaggaagaagttgagaatgagaactttatccagaaataatagttccttcagaagagggtaa

SEQ ID NO: 109458 - DNA, 759 bp, Glycine max
  Peptide Sequence Number=SeqID_226236
atgagtgctatacaaatttggagtgtttatcttacttgggatataatttttgctagtattgctccaaaggatattcaatttttcccttaccaacctcaaatctttgcaagacaatttgggcattgccaactaccttcagtaaccatctatcgaaagaagacacatcgatatcaaattcaaggggatgaaagtctaatccctaaagtcatcgaaaagggaacccctaaagtgaagctacaatttcaaccatcttctttcgtaccaaagattattcttagagatttccatttatggtggaaaaaatgttattctcagagactcatttctattctttcttccttagagaaattaatcaagacttgttgttctgtgcaagatactagcaaaaagatcaaagcgatacccattaagattccccatcaaggagaagcagagaattgggaagatgatgacgagacatgcacttccaaaaagacttctcgaaaaaggaaagtacccttgtttgtcaatactggaaataagtcgatgcatatttttgataaggctctaagaaaaacactagtgataagagtgataataagatcaaacttcctccaaaaccccccaaaaaccaaagatcataccaaggatgtaaatgtagaagaccattcttcctctcaagattattccaatctagaagatgacaaggatgaaggaaatcatgacactcttgttgttagttatactaccaaaagccttaataaagaatccaattcttga

SEQ ID NO: 109459 - DNA, 276 bp, Glycine max
  Peptide Sequence Number=SeqID_226237
atgggaaacggattggaagagaatgtggaagttggaggcgcctcaaaggataagagttttcatatggcaagtggagtggaggaaccccttttttgtcatcattgccggtgcaaggaggagtccattctccatgtgcttcgtgactgccttttagctatggagggagtggataggaaggctggttgtggagggcttataagaaaccatcatgctagctgggtgtgtggttttgccaagaatattaacacaaccactgccttcttggaggagttgtga

SEQ ID NO: 109460 - DNA, 174 bp, Glycine max
  Peptide Sequence Number=SeqID_226238
atggagattggaatggagaaggcaatggttcatgtgggagttacctatggtggaagcactcatggaggattttgggaggatttccaactatggataacttattgtctagaagaattgaagttcaaatgctgggatgttctagccccttttgtcatgagcttgatgagactctag

SEQ ID NO: 109461 - DNA, 990 bp, Glycine max
  Peptide Sequence Number=SeqID_226239
atgaccaattcctacacctccaatgaccttaacttttggttggacctcaattcaccatgtcttctctcttctccttctccttctccttccatcaatccaccattctattttccttcaaattatcataataataactacacaagtgtcatatcttctactcgtcatcagttccaaccctctcctcctcctgaaggaaaagcccttcccctccttcatccaagacatgaagtagaagaagaagatcttgaatcttcattcagtgccatggaagtggacaagaaaaagaaagagctgagttcatcatctagctgcttggatgaagaagatgctgcagtgactgtggccttacacttagggcttccaagcacgagtgatttagcttcttcaagcctatactcatcaacagaggcctcttcagacaaagaagaagaagaagaagaagtagtactcactgattcttcggggcttcttctgtcaaatagaattaacagaggacaatattggatccctacttcctcacagattctgattggtccaacacagttcccatgccccctttgtttcaagacgttcaacagatacaacaacatgcagggaccagagtctctaaggggaacacaaccaacagcaatgctaagactcccttgctattgctgtgcacctggatgcaagaacaacatagaccatccaagagcaaaaccactcaaagacttcagaacccttcaaactcactacaagagaaagcatgggacaaagcctttcgtgtgcagaaaatgttgcaaagcatttgctgtgaggggtgattggagaactcacgaaaagaactgtgggaaacgctggtattgctcttgtggatctgattttaaacacaaaagatctcttaaggatcatatcaaggcatttggatatggtcacacggcttgtggaaatgatcgctgcaaccttgatcaagatcatgatgatcaattagtgggctctgaaattgaataa

SEQ ID NO: 109462 - DNA, 483 bp, Glycine max
  Peptide Sequence Number=SeqID_226240
atggaggtccattacaataccattagttatccctataatacagcaggaagctttattgaatattttgaaggtctcacctatgaacatgtcaacttcattttttctggtgcatcacatgctcaggagagttcttacccttcaaattcaagcttttacaagtttggactatctgaaccagagaataattcatactatcgttatagtcatggttatgaggtaaatcatcatgaaccactggtggatgagtacaggagaccttcagagaactcattgacaatcaatgaacagtcaccagcagtaagcacagaatgggttgaaggtggaaacactgacacacaagacaattctattgaatgtcctcgaagacatcatagtaattcaaatgattatcaggttatttggcaagacaatattgatcccgacaacatgacctatgaggttggattgagtctcggatttcttctctttctaggcattatataa

SEQ ID NO: 109463 - DNA, 888 bp, Glycine max
  Peptide Sequence Number=SeqID_226241
atgaagggttttgctgctggtttgatgctgagtatatcattctttgatctgactcataatgccttgaactcacttggcttcctgagaggcaacctttggttttttgctggtgtcatattctttgctgttgttgccaaatttataccagaaccaacagttgctcctccaacttcagatgaaaagaaagttgggaaacaaggaaacaaagacatcatgaaaaggcgtcgccgtcaagttttaatcagtggagttgttacagccataggtataagtttgcataattttccagaaggaatggcagtgtaccttggatccatgaagggcattcgtgttggtcttaaccttgccctggccattgctctgcacaatatcccagagggcgttgctgttgcccttcctgtctattttgcgacacagagcaaatgggaggcattcaaattggcatcactttctggctttgctgagccactgggcgttgtaattgtagcctgtttattccctactagcctaaatcctgagattcttgaaggtatccttggatcagttggtggagttatggcttttctaacccttcatgagatgctgccacttgcttttgagtatgcgggacaaaaacaatctgttaaggccgtcttttgtggaatggctttcatgtctgcaaggtcgacggggaggtcaccgacatcgagtagttcttcttcaacaactgtggattacttggacaagccttattcaactcctccctcaaatggtttgccagcggtgatcgcaacccctccctttgcaccttcctctcccaaatctcgccgtgaatgtcattcacaatcaccttgggaaaatcatctcggcatacatttatctcttcgcgtaccacaaaagtttctctaa

SEQ ID NO: 109464 - DNA, 168 bp, Glycine max
  Peptide Sequence Number=SeqID_226242
atggtgaaacttgaatccttgagacaaaccatgagtgagatggtgggtacggatgtgtcatacctgaaacctcaagaatctaagtttagttattgtttgggtgggaataggccaggccggcctacaggggcctacgacctggtctacataaagtctagcctggactga

SEQ ID NO: 109465 - DNA, 655 bp, Glycine max
  Peptide Sequence Number=SeqID_226243
atggcattaagaggtcgggatattgttcaaattgtagtagcacaaaacaacatgttgtttgtttctatggaatcaccttggtatgtcccaagtgtacactatgttccctctaatgctgcgtatggtacaacctacaatatccctaatgcagccatggtggaaaggatgttcaaccatagtggttcctcccaaatacaatataaaggactgggaggcgaagcgttaggaagtatgggtgacccccattttgtgcaagatcagaacaagtattccttcccaccatatggcttgcctcccaactatacaccacccaatgttgcacaagctcctgatgagaatgcacatgaggcaccccgagaccataatctagtcgactttgagccttacctcggatgtaccgttgaggggcaggcattttgcgacgtacccctgccaaacacttcgggggaccctcaatatcacccacaaccacaacccttgcattttgtggtgggaagagtccctcccgctatagtggaaagggagaaattggatcatatagaggaaaggcttagggccattgaaggagacggagattatgcctttgctgatatggcagaactgtgcctagtgcctgacgtcgttgtccctctgaagttcaaggtatcggattttg

SEQ ID NO: 109466 - DNA, 237 bp, Glycine max
  Peptide Sequence Number=SeqID_226244
gaactacttgaattgggtgaagctgttggaactcaaagccgtggtcttacccaagaacagatctcctcgcttccagtgtcaaagtacaaatgtgggttcttcttgaggaagaagtcacgagatgagagatggaatatagaagaggggacaagcgtatcaccttaccatgtaaacatgtttatcatgctagttgtgggaacaagtggcttagcatcaataaggcaagatatttactaa

SEQ ID NO: 109467 - DNA, 288 bp, Glycine max
  Peptide Sequence Number=SeqID_226245
atgtctcttaaacctaaacgtccaaaaaaaggagcacctactcaacaatcacatcttcctcctcatacggctcctactcaacaaccatatattccttctcctatggctcccactcaacaaccatgtattccttctcatatggctcatactcaacaaccatatattccttttcctatgactcctactcagaagttatatattccttttcctccacatattcctcctcttatggctcccatggcttctaatcaacaaccatacattcctccttttatggctcctatctag

SEQ ID NO: 109468 - DNA, 810 bp, Glycine max
  Peptide Sequence Number=SeqID_226246
atgataaatgatgcatttgggaacaataaacaccatgatgtggagcctgatatgtatgaagaagcatatgagtttgtagacattgtgcctaatgaagtaaatgaagaaattgttgattttcttaaagatggtatcaaagagttgtatgaagggtgtcgaaagtactcaaagttgtcttttctattaaggttgtatcatataaaatgtttgtgtggtatgactgagaaagcaatgatgatgattttggagttattgaaagatgcatttgaatatgcaaagattcctacttcattttatgaggcaaagaaggtgatctacaagctctttcttaattataccaagatagatgtttgcccgaagaattgcatgttgtattggggagaagatgaaaatttggagatttgcaaacattgcaaaaaatctagatggaaagccaaaggtaaaaaaatgctagggaataagatagatgtgtacttacaacctctaatcaatgagttgaatgagctatggacaaaaggtgtggaaacttatgattcttctttgaaagaagtgtttagaatacgagtagctctcatgtggacaatcagtgatttccctggactttgtaatttatcgaggtggaatacttatattggatatgcttacccatcttgtaactttgatgctttcccttgtcgattattttctagtagcaaatggtgtttcatgggtcatcgacaattttggagagaggatcttttagccagatggtcagaaggagcaataaaggaagagtatcatattcttcaatcttacttattggaaggataa

SEQ ID NO: 109469 - DNA, 228 bp, Glycine max
  Peptide Sequence Number=SeqID_226247
atggttcataaactcccattcaaacaaacccctaagattgcatttatgtttttgacaaaaggtcctgtgctattggctcctctatggcagagattcttcaaaggaaatgaagggctgtattctatgtacgtccattcctatccttctttcaatgaaacagtgcctgaaagctctgtgtttcatggccgcaatatccccagccagggtgattactttaaaaatgagtaa

SEQ ID NO: 109470 - DNA, 165 bp, Glycine max
  Peptide Sequence Number=SeqID_226248
atgggtggtgtctttggtggcaatgcggcatgcatacggtggcttgcacacacagtgaaaggagctggtaacaattacttttcttctcagaagaaaaaagagaaaaaacctagtgtggacagttctacggaaattccacatatatctcaagatctaacggtataa

SEQ ID NO: 109471 - DNA, 282 bp, Glycine max
  Peptide Sequence Number=SeqID_226249
atggagaaaccactgccagtgcttgtatcgttggcgggaagaattcttgtttttgttgttgaagatggaaaactgcagctaattgtcgagaaagagacaaaaggagttgtttattgcttgaatgcatttaatggtgatggcatatgtgatggtgactgtagtggtggctgcaatgcaatttggtgtgcttggaaggacagggcaagcaaaacttcagtggatgaagatgtgcaacatgtatgggaaattctgcaaccaaatgggagaagggataacaagtga

SEQ ID NO: 109472 - DNA, 153 bp, Glycine max
  Peptide Sequence Number=SeqID_226250
atgctacgatgcgaaaggtatttctctcagttcaaatatgatattgaaattcccaacggtgagagttctcggaattgggttgcaaacttggtgcttaaattttacgacgatccaatgatgaatgaatccgatatcatcatttttctgagacag

SEQ ID NO: 109473 - DNA, 2094 bp, Glycine max
  Peptide Sequence Number=SeqID_226251
atggattccggcagcggcggtcaggtgggcaaccgcggcaccctcaatctgaatggctataacagcaccggcctgaaagtgatcgccacggcgggcaaccaggcgcacgccttctccagcggggcgatcaacgtggcgggtgacgccgaccgctttggcggcaccaacaatacggcggtgtgggtaactggcgaaccgggcggtcacgccagtgccgatatcaccggcccaatccggctcagcggtaaagcgggcattgggattcgtgctgaaggccaggcaacggtcaacgttagcgccggcggcattcccacctccagcggcagcgacagcatgctggatagcggacagatcagtttctaccgtatcggcccggatgcgcgcattaatctgccggccaacggccgctacagcgcctccgtgtggaacggcacgatttttcgcgtcgagcagggagcggattttgacgggcgcggcctgactctgtcgatgaatagcccgtttgcgaccggtgtgtacggcagcggtgccggcaccgacattgatacccacggcgcgacgctgaacatcgccagctttgccagcgggctgactatcactgatggcgcccgcgccaccattgatgccgcaacgcgtattcacctcaacgggtctgatgcccgcgtcgccatcgctgacggtaatcgctatacgctgcagggtaacgttgttaaccctaatacgcagttcgacccgaacactttattgatcaatcaggcagcgatagacggccgcgccaataaccagcagccgtttaccgtgatgaatcatgcgcggctggtgaatcgtggcgctatctccctgcggggtgaaggcgtaacgggtatctacgcgcagtatggcgccacagtcgacaaccgcggcgatatcaacattttgcgtaatggccgggcgctgttcgccgatggttatccaggcgccggcgacggcaaaaccctgacggagattaacaatagcggcacgcttaatctctacagcggtcagagcacccagcaaaccaccaccttcggtgcggtctcgtatcaccagctggggcggattaaccagaacggcacaattaatctgtacggcgataacgtggtcggcgcgaaagcctttgccggcggccgtattacgctgggcgtgaacagccgtgtggtgttccacgatgcgcagcagatcggctatcaggcttttgatcccggctcacgcctgatcgtcaacggcagcccggttgatgtcagcagtcgtaactcgacgctgtatgaaatccgcaacggcgcgtggctgtacaaccagggctttggcaacgttacgctgagcggcagggacagcaccggcatcgtggtcagcgggacggatgcgctggtatccagcaccgatgtttatcaggtcaccggtaagggtgccaccgtgctgcgcgccagcgatcgcgcgcaggggatcattaccagccttatcgcgctgaacggcaaaaacaccctcggcgcgcaggcgacgggcgatggcaccgaggtctacgccgcctcgctcatcaccggcaccgggcgcaacgccacggcgtttgatgtcagcggcgacgcgcgcctgtttaatcagcagcagggcgtagtggatttgcgtggccgcaacagtaccggggctcgggtgcatgatggcggtaactttatcaaccgcggcacggttagcgtcgccagcggcaccggcgtggacgtcagcagcggttatggccagtatgtaccgctcgatagcaccttacgcgtgaatgacggcaccgccgcgctgcgcgtgggctccggcggcgcgatgaaaatttacggcgacgggcagggggccagcacgctggcggcttacggcaaagccgatggtttgctgctcgacagcggtgcgcagcgctttgaagccaacgacatcattatcggcgcttacggcagcggcactgcgctgaacaatcgcgccggcatcagtgacatttcgctgagtaatgtgcgcttcgaggccaacggtggcactggcatccgctctgccacctcgttcgatccggcgggcagcgcgcagattcacgtcggcgcaggc

SEQ ID NO: 109474 - DNA, 372 bp, Glycine max
  Peptide Sequence Number=SeqID_226252
atgaaggtcgacatggaggccatgaaagagcaaatggtcacaatgatggaggccatgatgagcatgaagaagataatggaagccaatgaggttgcagttaccgctactagcgtttttgctaaggtgaacctgatgcccccatctggcctcaaccgaatgaatcatccaacttcagatatggtaggcaaagattcttcatcaatggagtcatttgcttctggaaaaattctttttgcgagaatcaaccgcatttttcattcttccttgctacaaggttgtgaaaacaaaacaacgatggatacctcagagccatacactggggcaatgaaaaacaccatgcataaacctcaagcgaacctaggggcagattag

SEQ ID NO: 109475 - DNA, 246 bp, Glycine max
  Peptide Sequence Number=SeqID_226253
atgacaaagggtgcagaatttgtctctgcgcatttatcactcatcttgctgctcctgaacgacaaagggcgtagaatttgtctatgcgcgtttatcagtcatcttgctgctcctgaacagcaaagggcgcagaatttatctctgcgcgtttatcactcatcgagcgtgcggatgaccgtaattggtctccgcatatcatcaggcccgccgcctctggatgacaaaaggcgcagaagacgacgttag

SEQ ID NO: 109476 - DNA, 588 bp, Glycine max
  Peptide Sequence Number=SeqID_226254
atgcaattgcagatgcaatcacaggaactcactatgcctcttgagcctgagggaagttgtgtcaatccctcgaggcagaacccatacacaggtgacttagagaaatgtgggttctatgtcaatgacaatcatcctcacctggttgcccttggaagagtttatgagggattgatgattgtacacaatgtccctttgggcaatgatcaagtcaatgtcagtgtagaggaagttcaagatgctaatgcttgcattcctgtacccattcaagaggataaacagggagttggtgggccagcaaaacctatatataggtcagatcctaatgtcagtcccttatacctaatgacattgatcatctcgcagcttttcctcgagcctttgcaagtgttgtgggatgctaccctatttggggttgctttgaaaggatttaacgatagtcaaggaagtaaatccaaggctgcgactaaatgtattttagttaaatattttactgatccaagaccattggaactaaagagaatgaagacaattcccattaagtgggcaagattttatctaaaagttaaaaatcaaacactaggtgtttaa

SEQ ID NO: 109477 - DNA, 291 bp, Glycine max
  Peptide Sequence Number=SeqID_226255
atgcaagttcttagtttcatgtacgttcgtccacccggctaccgcaatgagagtgccaaaactattgagatgaacgacgagaagaaaacagaggacatgagtaaggggcctagtgctgatgatggaccttccttttccatgtacctccttcatcaattgttttctaaagaggacaaaaggtgtgctttagaggaaattgatgatgatgaagaaaagaggaaacatgatttcaagtcaagaactgaaaatgccagggaagaaatattaaggaaacgtagagttgagaaatga

SEQ ID NO: 109478 - DNA, 393 bp, Glycine max
  Peptide Sequence Number=SeqID_226256
atgaatattctgtcctacaacattagagggctgggtagaggtctcaaatgggcttctatcaggaatttggtggggaagtttaatattgatcttctgtgtcttcaagaaaccaaaaaggaatttttggataaagcttcgtgtcaatttttgtgggggcaatctgacttggcttgggaatggcagcctgctgtgaatgctgctgggggtctgctctgtgtctgggataataataaattccaggttgattttcggttttctgataaagactacattatgctgggtggggtttggctgcctcaaatgcaaagggtggtagtcattaatatctatgccccttgtgatattgctgggaaaagacagttatggcagaatctcagcactagaaaatcttag

SEQ ID NO: 109479 - DNA, 1200 bp, Glycine max
  Peptide Sequence Number=SeqID_226257
atggtgttggagagaatgaaggattgcatatcgtgggagttagggtacaatattagtaccaaattcctcggtgacgatatggtcattctcactggcctgccaaacaatcgggtcgtttggctacaactatggggattttcgattgaagtgtgggatgttgaccacatgaagcaggttgtctccattattggagatgttattgaaactgacgaagataccgacgaccgtcaccggttggatcgtgctcgactactggttcggacacctctcccgccggcgatcatgaaggaggtcattgttcgtactggggacgccgactatagggtgtggttggtggaggaggtcggagacgacggagctgtgaggagaacgagaactcctttgtccgaagagtggacggaagagataacgtcggtggaggaggacgacgacgatgatgacacaaccttctcctactcggcggagctgtcatcgaccaagaaccagcttcgttcgagccatcagtctcacgctatacccagtggttactgctgccaaacacccaaccactctagtccgctggataataccccttctgctgatgaatacatagacaagtcaggagacagaggggagcatactcagggttctatttcggcaaaggttgaccctgtggtatgtttcacagagaaggctcagggaaatgctttaacagatatgataaccttggaccctgcaaaagctgggtctcgacagcctgttgaagaccagattggaaattttttgaattgtgaagatttagcagaaaaggagcaaaacatttacggggtaaacacgagacttgtaacggataggggatcacaaccaggcatgccttctttacagttccaaaaggctattgggccaagctctatttcgggcccaataatgaagatggaggggtgtaaaaaggaaaaccacccaacttcggctcagacatcaaaagggagctctgatttgttctctaaagtctatgttagacaaagacatggcccatctaaagctgcccctcttgagcctgtagtagaagaagatatctcgctaagggaggacaagggtctgggtggtttaaatgattcctcttgtaaaggcccaaacaacaggactctagaggcttttgaggggttcaagaatacagaagaaaactctcttgaagacttggaagaggctatgcagcaatga

SEQ ID NO: 109480 - DNA, 168 bp, Glycine max
  Peptide Sequence Number=SeqID_226258
atgcctgatcttcgattccaagttggggatttggcggagtcaggatgctttcaaggtggttattgtggtgcatggtttagatgcaagcatggcaacctaaataagaagagaatttttggattggcattggcttcttatgagacacttttatcaaatgtgcattactaa

SEQ ID NO: 109481 - DNA, 312 bp, Glycine max
  Peptide Sequence Number=SeqID_226259
atggacaaagatgggtatagtaggtggagaggttggcgggacctagggaaactagcgagtggtgattacccgatacttggtgcactcatttggagtggaaagctcataagtctcactttgctactcccgacgcgctccaaaactatgctttttgaattgggagttgtggatcaatatacgaaaaaagaggttacattaagcaaaaacaaccacagaaataaagagaaagaaggaattctgaagcaggcccaacccaacagtggcgctaagcgcgcatcaggcgctaagcgagcaaccaactgcaggcgctaa

SEQ ID NO: 109482 - DNA, 1101 bp, Glycine max
  Peptide Sequence Number=SeqID_226260
atggtgaatgaattgacgacaagtgttgattttgagaaattctcatggaaaattgaggatttctcaaaacaaaacgtcatgaaattgcgttcaaagcctttcaaaatccgcggttgtacatggaggatccttgtgtatccactgaggagggatgtgaaccatttttcagtgtatttgatggttgctgattctttaccaccgtacggatggagcagaaacacgtttttcaagttagctctaattaatcaggtggataggagcaagtccattgcaaaagagacacgccaaaagttcaatggaggatatcgttgctggggttcatttttcttgaatcttagtgatttcaacaacccaaaacaagggtatcttgtgaggaacaagtgcataatcgaagctcacatttgtgtctccgatttatcacctaagattcaagtccacccaaatagttctccaatatttcatgactctctaagatgtggtcaggcaacagaatcatcctcagatgatagagataccattagtccaagaacctcaggatctagtactggagcagaaggtgaaactcatcatcaaggcttaaatattaatttgatactaagagaagtactcgtagattttgagagtttaggagcagaagaagaagctttcattccactcttggaagaggtttgcatttggcaccctaatctgatacagtgccaaagggaaaggactagaaggtttagacaatgggcctttacttctttgggccatgttttgcattttctcaagaccaaaagggttaaagatatcaatgaagaggacataaagtaccttcatggtttgtggaaggaacttgtcaagtcctcagggtttgacctaacttggctggagccatatgttcaatcagcattgggtttgagggcttatatggaaagagcaaaccaattgaagaaacttaaggacaaggtggttgctttggagattaacatgaagaggctcagaggggaacttgctgctgctgaaggagagtttgaagtggcaaggagtggcttgtctgaagtgagaagaggcttcaatgagatggatgtaaatgctgcaattggttatgctatgttttaa

SEQ ID NO: 109483 - DNA, 267 bp, Glycine max
  Peptide Sequence Number=SeqID_226261
atggcgacaaagaagagtgaatccaaccttgacccatgggctcaaaaaatctaccctaagattaatgagaaccctaggaccttctttagtagttctaacccaatcctctttgagtcttctatccaatacccttggggggtaggattgcatcatcccctccaccttggaaaggatttgacctcaaatcccgagagtagggtaaggtctgaaaacccgttttatggagatcttcccatgagggaacatggttcctcaccaactcaatga

SEQ ID NO: 109484 - DNA, 438 bp, Glycine max
  Peptide Sequence Number=SeqID_226262
atggttgttgttgttgtgtctgctgctgctatggaccaggaccatacctcaagttgggatgatctcatcaaccaggattataggtgttggaataaggattgtattgatgttgctaggtctaaatggttgtccaggttgcatggcagaaacatcaacaacttattttgtttcttggtgtggaacagacatctattcaatgatcaaaagcacaacatataccacataaccttggttgattggctgccatcacattctactgttgaccaatggctagcaacctcacaagggatgtcaactctcaactctagtgtcaaattgctagtaatttgctgccatgatgggaatcaattgtttgcagcaacaagagttttgtccattaaagcccctccattggctgcatcaatcatacttctgtccattaacatcagctcttcataa

SEQ ID NO: 109485 - DNA, 1230 bp, Glycine max
  Peptide Sequence Number=SeqID_226263
atgctcaattcctctttcctctccctttctgaacacaccttttcccacacaccccatcatttcccaacaaggtctgcttctcaaaaccccaaccttcatccaaagtttcaatctttagcctttggaaaccgtggagggagtgaatttccatctgggtcttgctccaatacccccagaagaaaaggggtgttggttgtgcggtcaaagtcaacgctgggagtagaagaagtggtggtaaagggaggaggagtgaagggtaagggtgaagagtttgatgcaattgtgatagggtctgggattggagggttggttgcagggacacagctggcagtgaagggtgccagagttttggttttggagaagtatgtgattcctggtggaagctctgggttttaccagagagatggctatacttttgatgtggggtcttctgtcatgtttggtttcagtgataagggtaatctcaatttgataactcaagcgttggaagcagttggttgtcggatgcaagtggtgcctgatccaacaaccgttcatttccatctaccgaataacctttctgttcgagtgcacaaagaatatgataaattcattgaagaactgaccagttactttccccatgaaaaggagggtattcttaaattctacggtgaatgctggaagattttcaatgctctgaattcattggaattgaagtcactagaagagccactctacctttttggacagttttttcggaggccgcttgaatgcttgaccctagcctttctgacaatatttttggcagcctattatttgcctcagaatgctggagccatagctcggaagtacattcaagatccacagttgttgtctttcatagatgcagagtcgtgtggttgtgccgaaaaacctcggctgcagccaacgaagttccgtagtggcgacgggtgttgttcacccgtgaataaagcacgccctaaggcggaaggaggcagttccagtctgatgcttgtcggagatgtgtcacgcatcgtgtacttgaacttctcttgccggaaaagggccctgcatggggttgctgtggtggttgttgatgcagaacgacaagagggcagtgcactggttgccaaatatgcccaacagtgggcgtgcacagatgtgtttgtgcaagggacattggtgaacatcgttgcggaagccaattctgaaggagggttggttgacgccatgaaacacattgaaacgtga

SEQ ID NO: 109486 - DNA, 654 bp, Glycine max
  Peptide Sequence Number=SeqID_226264
atggttcctatacccattgatgaagcactgaagactaaggcaggattgctattctttattgcggttttctggggattttttcctgttttcactgcaatattcacattccctcaagagagagccatgctgagtaaggagagagcagcagatatgtacagattgagtgcatacttcctggctagaaccacaagtgaccttccactagacctcattttaccagtgctttttctgcttgttgtttatttcatggccggtctcagactcagtgttgcaccatttttcctcaccattcttactgttttcctctgcattgtggctgctcagggacttggacttgctattggagccacacttatggacttgaaaagagcaacaactttggcttcagtaactgtgatgaccttcatgctggctggaggattttttgtgcagagagtccccatatttttttcttggatccggtacatgtcattcaactaccacacctacaagcttctgctcaaggtgcaatatgaacacatctcaccagtcatcaatggaatgagaattgatagtggtgcaacagaggtagctgctctaatagccatggtttttggttaccgtttcttggcatatctttctctaaggcgaatgaaacttcaatctggagcttaa

SEQ ID NO: 109487 - DNA, 186 bp, Glycine max
  Peptide Sequence Number=SeqID_226265
atggcttgcgggagagcaccaacagcagcctcgcgagggagaagaaccagcagcagctcgcacgaaagaagggagaagaacagtgctcgcggaagaaggtactcacggaagaaggaaatgaagaaggaagcggaatggctgggtgcacaaggtaaaaaccacgagtcatctaaaccaaagaaataa

SEQ ID NO: 109488 - DNA, 1104 bp, Glycine max
  Peptide Sequence Number=SeqID_226266
atgtatgttgcagctgaggatattgaatctggacctaggacgaagtttcaaacagaacctactctaccaatatatctaaaggcatggatgaagcttactttggcaatcattgcaaccaatagaacacgatcatcaggttcagtcttggacaaagtttcatttcatttcacggatgtgacctacaagatagtgatcaagggcatgacaacaactgaggagaaggatatcttgaatgggatcactggttctgtaaatccaggggaagttctggcattgatgggtccctcaggaagtggaaagacaactcttttaaaccttcttggaggcaggttaagccatcctataagtggtggttctatcacatacaatgaccaaccatattctaagtttcttaagagcaggataggattcgtgacacaagatgatgttctgtttcctcacctaactgtgaaagagacattgacatacgcagccagactaagattaccaaagacatacacaaaggagcaaaaggagaaacgagctttagatgtaatctatgagcttggcttggagaggtgccaagacactatgattggtggttcctttgttcgcggagtatctggtggtgagaggaagagagtttgtattggcaatgagatcataatcaacccttctcttctttttcttgatgaaccaacatctggtttggattctacaacagccttgaggattgttcagatgctacaagacatagcagaggctggcaaaacagtggtgacaacaattcaccaaccatcaagcagactctttcacaaatttgataaattgatccttcttggaaaagggagtttgctttactttggaaaagcatcagaagcaatgacttacttccagtctataggatgttcaccccttatttccatgaacccagctgagtttttgctagaccttgctaatggaaacataaatgatgtttccctaccttcagagttggaagataaagtgcagatgggaaatgcagaagctgaaacactaaatgggaagccatcaccagcagttgtacatgagaaaagtgttgggaaacaccagcagtatctccctcactctgtggactcaaaatag

SEQ ID NO: 109489 - DNA, 438 bp, Glycine max
  Peptide Sequence Number=SeqID_226267
atggctatcagtgttggcgctgatgataagccttactatggccaaccatccaactactatccacaccccacaccaacaccatatcaccaagcaaacggtccaccttactattacaactcacctccatattactacaaatctccacctccaccctctccatcaccaccacctccttatatctaccactcacctccaccatattattacaagtcgccacctcctccatattattataagtcatcactacatccatcatcttcgcctcctccatcctatatttacaagtctccacctccaccatctccttcaccacctcctccatatgtttataactctcctcctcctccatcaccttcaccacctccaccttacgtctacaagtcaccacccctaccattactttcaccacctccaccatatgtttacaagtccccctga

SEQ ID NO: 109490 - DNA, 1467 bp, Glycine max
  Peptide Sequence Number=SeqID_226268
atggctgcaaaaaggtttttcaatgattctgatcaagaccctgataaccctggcgacaaacggatgaggaatactagaccttcttttgcttcggttattggagaagtggttatgataaaaaacatggaaaatcttttctcagccatggagcctttgctgagaagagtgattggcgaagaagttgaccgagttatgagacaatggccacactcctttgctaggtctccttcattgaggctccaagcattggatcaacaacaaccttcaactttacaactatggttcagcaaaaggctttcccttccaattttcacaggtagcagaattcttgaggttgatggaaaacccatcaacatagttctgatggacaaaagcagtggcaaagtggtacccacaagtctcccacatgccatcaagctagagattgtggttcttgatggagattttccccctgatgataatgacgaggattggactagtgaggaattcaacaggcacgtagtgaaggagagaattgggaagcgaccattgcttgcaggagaattgaatgtgatcatgcgtgatggaattgcaccaatcggggacattgagttcactgataattcatgctggattcgttgccggaagttccgagtggcggtgagggtggcaccggggactaatcaaggtggtgttcggattcgtgaagccatatctgaggcgtttgctgtcaaggatcaccgtggagaattgtacaaaaaacactaccctccaatgcttcacgacgaagtgtggcgcttagagaagataggtaaagatggagctttccacaggaaattgtcatcagaggggatcaaaacagtgcaagactttctcaaactagcagtcattgatactcttaagctaagaaatattttagggatcgggatgtcagacaaaatgtgggaagtcactatcaagcacgcaatgacttgtgatactgggagcaagatgcacatttatcgtggaccagattatactatttttctggatccagtgtgcaaattaattagagcagattttaatggacatacattttccaacagagatgcgatgagccctttgaataaggcctatatagacaaattggtgaaagaagcatatgcgagatggaataacttggaggagattgacggagttctgaatgataacattgctttgttaacccaaggtgatcaaactgtggaacaatttgcaaacaatcaacctgcagcagcatcagtagtcacatatgatcagaatcagtattacagtgacaaatctggcagctatgtagcaaacaacaatacacaaatgggatgctgtgagtggtcactgaatcaagcctatagcccagcaccgtttgctaatggctttccttttagtttctcagtgacacaatcagatggtgagataaccgcttctggttctagctctgtggatgttgatgtgatcacaaggcagaattaa

SEQ ID NO: 109491 - DNA, 522 bp, Glycine max
  Peptide Sequence Number=SeqID_226269
atggctcctgcctccttgatgggctgtgttgctttgttacgaaagtgtttagcgatcacaaaacagtatgttttccacattcttagttttccacatctgttaacggctgttgcaagtgtggtcgtaattgggggattcatgatgtgcatcgtaatttgctgtagtaaatataggccaacacgacaattctgccccaagatatgtggttttgggctagcaaagctctatcctagaaatgaaagcattgtttccatgttagatgccagagaaacaatagggtatatagctccagaagtgtggaacaaacatgttggtggaatttcacacaaatctgatgcttacagctacgaaataatgttgttagaattggtgggagtgaagaagcatattaatgtggaagcctgtcacaaaaaaacaccattctacgacgatggaaataagctttctacgacggtttccaaccgtcttaaaggtcacgtcgtggaaagtgttgactttccacggcggtcccctaacaactaa

SEQ ID NO: 109492 - DNA, 400 bp, Glycine max
  Peptide Sequence Number=SeqID_226270
atggtgtgcacggctcgtggtgatcactacgcacaccacacaacaatgttgattctggaacaactaaaagcatattcttgggatgcaaaagcacttattgttcaagcagcatttgctttggaatatgggaaattcttgtaccttcccttgaccacacaatatcagatgtctgaaaaatcattggctgatttgaatggacttctaatgattcaacacaacacacaacatctcactttcttcaacagtgtggtgaagaaggtaatgcaagtgattgaatgcatcactgagtggaagaggctaactagtgcaggatatgacataaaggatgtgcctaccttggcagaaactttgcatgagatccctgttgttgtgtattgggcaatcttcacctttgtcactt

SEQ ID NO: 109493 - DNA, 651 bp, Glycine max
  Peptide Sequence Number=SeqID_226271
atggtggaggagagaactttggagcatcaacctctcaaggttgcattgctagtacctcaaataatgtggatgtctagtgcagtgaatcaacaattagttctagagggtttgaagaagaatctattgtccattgggcgattggatgacctcgagtgcaagatccatactgaaggtgggatcttgaaggtagtgaagggaaatcttgtattgatgaaagctaagaaactcacagctaatttgtacatgcttttgggagatatgttgcaagaaccaaatgcatcaattgtagcaattagtcaagaagaagcaatgatgatatggcatcatagactggaaaatgaattggaaagtgagcagaaaaatgacaacatttccaaagatactactacaaagaagatagggaagaaatcgggagaaaaatactcttatgaagcagagcaggatcacgaagaacaagaaccaaaagatgaaccattaacctttcaagaggcaatgaatagttcagatgcttctttgtggatgacatcaatgcatgaagaaatggaaaccttgcataggaacaagacttgggaaattgttaaacttctagaaggttggaaagccatagggtgcaaatgggtctataagatcaagtgcgacaacaacgattaa

SEQ ID NO: 109494 - DNA, 384 bp, Glycine max
  Peptide Sequence Number=SeqID_226272
atgtgggatcgacacatacttaaagtagcactcaaatcgggtgcatttacccccaaggcctacactctgaagaatccgttagagtctttccctcctgattcagcgggctcacatgtgtattctggtagcgatagtggtatctctagtggtttccttaaacttctcgagcttttcctctggttgctctgctttccaagtgttagagagaaggagaagggattgaagccttcactccactgtctgcgtgcgatgagtatttatccctccacagatattaatttcgaaatcccaaaggtggagatgtgtggaaatgcatttctaacctggtgtccaaatttcaagacgatccaacggctaacaagttcaggatcatggttttactag

SEQ ID NO: 109495 - DNA, 1014 bp, Glycine max
  Peptide Sequence Number=SeqID_226273
atggtggcgacggcgatcgaggaagtgcgaaccctctggattggcgatttacagtactgggtggacgagtcctatctctctcagtgcttcgcccacaacggcgaagtggtttccattaaaatcatccgcaacaagctaacgggccagcccgagggctacggcttcgtcgagttcgtctcgcacgcctcggccgaagcctttctccgaacctacaatggagcccaaatgcccggcacggagcagaccttcaggctcaattgggcctcgttcggggactccgggcccgaccactccatcttcgtcggcgatctcgcccccgacgtcaccgattttctcctccaggaaacctttcgggcccattatccgtccgttaaaggggccaaagtcgtcaccgaccccgccactggccgctccaagggctatgggttcgttaagttcgccgatgaggcccagaggaaccgcgccatgactgaaatgaacggcgtttattgctccacgcgcccaatgcgtattagtgctgccacacctaagaagaacgcttcttttcaacaccaatatgctccacctaaagcaatgtatcaatttcctgcatacagtgctccagtgagtgctgttgcgccggagaatgatgtgaataataccactgtttgtattggtaatttggatcttaatgtgacggaggaggagcttaagcaaacctttatgcaatttggagatattgtgttggtgaaaatttatgcgggcaaaggatatggttatgttcaatttggaactagagtgtctgctgaagatgccattcagagaatgcaagggaaggtaataggtcaacaagttatccaaatttcttggggcagctccatgacagctagacagcctctttgcatatgtaagggtaaggctgcgtacaatatccctcccccataccttcgcatagcgaagagcctctgggcaatggggtacgaagtttttagtggtttggccgtttggttgttgaaagatatgtttggaagatga

SEQ ID NO: 109496 - DNA, 198 bp, Glycine max
  Peptide Sequence Number=SeqID_226274
atgtgtggcaaggagatagggagaatagaagactacaccaggcgtaagaacattgtgattcacactggtaaagatattgtaaaggttttgaaagcactcatcatttccggagagaacagggaatcaagacagagtgtttttaatattctcacgggagaacaggttagacacttggatagtgtgaaatcaacattttaa

SEQ ID NO: 109497 - DNA, 621 bp, Glycine max
  Peptide Sequence Number=SeqID_226275
atggcgactcaacttcttcatcgcgtcagtctctttgtctttttcttctcacactcacacctcactctcttttacgatctacttgcgatgtcggagtgtccttcgttatcggacatgatcttgatgccacaaccatcgtccgagctaaaggagatcgaagatttgccggcgtcaacgatactatcgcggcttcagctcgttcgtctaatgtcgtcgcaactagttccaaattctctaccgcttcctcctctgacggtgacggtgacgctgaacatgaaagttcgaaggtcgcaagatcgcatccctatcgaaatggagaaagtcgaaaccgacttgttcggaagcagtttgctggcgagccgaatcagaccagatttggatgaggctttggagagtgcggttggagacaaagtccttggtttggaggagttgcatggtgcggacaagagaatggggtgtttaaagatgaaatggggtagcgagagtcaatggtgggtgacagaagtagggaaagcagttgcaaagataatagcccttgcacttgatttggatgctaatttttttatcagccagaaatgcttggagagagcccattgcaactctgcatttgctacaccatga

SEQ ID NO: 109498 - DNA, 828 bp, Glycine max
  Peptide Sequence Number=SeqID_226276
atggatgagcataatcacatccatatgcatattcccatgcttcttacatccatagttatattgttaaccactttgccacagtcctactgtgatttcgattattctgtttgtaaggagaggccatacaactgcgggaacctgtccgacatcttctattctttctggggacagaaccgacctcttcaatgtggcggcggtggccaaacattcgaactcaaatgccatgatgacgataatactacaattctaattggctcacaaaatttcacagtgaaggagattaacaccaacgctcaaaccatgagagtggtacaaacagaccttgtcctcaatttttgttctccgcaatttgaggacacttacgtaaactccactcagttccggtactccccttcagtgtacaacatcaccatattctacgattgtctgcgcatgacagatttccctcatggttttggacagaactttacgtgcggggatgttttgtcttattttgtagtggaatatgatgaggtgctgtcaaatgaatttccgcgttgcaagcgacgttcacacgtgccggctgaggctcctctggattatactgctcctggtgccggatataataatttgatacaagttattgatagagggtttgagttcaggtatgatgtttctcaagattgcacaagatgcctgggaagtgaaggagaatgctggagcgattgtaatgatattgatcaaaatgtactttcatgttattattgtccagatggatctcatggcctgcactgttctccttccaaaagtatgccttctatcctcctctcttcttttacactttgttag

SEQ ID NO: 109499 - DNA, 1020 bp, Glycine max
  Peptide Sequence Number=SeqID_226277
attaaaattgaagagttcaagaagaagcatgtgttgttatttatttctggccttgatagcattgaagaggagaccttacttctaaaatcaatatacgagaaattgaaggagaaaccaagagaggttgagggttacaggaaggacgatttcaagattttgtggatccccattgtggatgaatggaacgaggaacgcatcaagcttattagagaggtgtttaactacaaggaaaggtctattatcccattgataagtcctgagggaagggtggagaacattgatacaaagcaaattatatctgtctggggcattgatgggtttccttttagaacctctgatcacactagacttactcaacaatggaattggttctggtctgaaatgacgaagcttaaccctagaataggggacttggaggatcgttatctcttcatctatggaggcacagacataatgtggatccaagaattcacaacagccgtggagaaattgaagaggaatgttgactcaatcagtttgcaaatagatatcacaatagaatcataccaactaggaagggaagacactaaggttgtgccacgcttttggatcgctattgatagcttgcttgcaagtaggaagcaacaaatgatgaagggtggtgatcaaggggtgcaagactttgcaacaagagagataaagaggttgctcttcctcaaacaagaccctaagggatgggtcattcttagcaaagggtacaatgtaaagctccttggtcaaggtgaggccatgtgtcgctcggttagagattttggtatatggtatgggaagttgcatgaagaagtgagctttgatgttgccttcaaagagtactatgaaagcatcaaggttaaggattgtcctaaaaaatgtgaacatagtgaaatttctaactacccaacggatatattggcccacataccgtgcccaaatatggaatgtgggcgttcaatggaggtaacttctgttaattacaggtgttgtcatggtcttgaaccatag

SEQ ID NO: 109500 - DNA, 1171 bp, Glycine max
  Peptide Sequence Number=SeqID_226278
atgaccaactccttcaaagttaaactgggtgaaggtggctttggtgctgtatacaaaggagagctactcagtggttgccctgtggccgtaaaaatattaaattcatctaaaggaaatggtgaaggctttatcaatgaggtttctagtattagtagaactgctcatgttaatgttgtcacactttttggattctgcttggaagacagcaagaaagctctcatctatgaatttatgcataatggttcccttgacaagtttatttacaacaagggacttgaagctactgcatcattgagttgggataatttgtggcaaatttccttagggatagcccgaggactagagtatttgcataggggatgcaacactcgtatcttacattttgatataaaaccacataacattcttctggacgagaacttttgccccaagatatcagattttgggcttgcaaagctttgtcctaggaaagagagcattatttccatgtcatatgctagagggacagtaggatatgttgctccagaagtgtgcaacaaacactttggtggaatttcacacaaatctgatgtctacagctatggaatgatgctgcttgaaatggtgggagtgaagaagaatattaatgcagaagtcagtcagacaagtgagtacttcccagattggatatatagcaggctagagcagggtggagatttgacaactgatggggagatagccacagaagaaaaagagatggcaaggagaatgactatagtgggcttatggtgtgttcaaacaattccacaagatagacctacaatgagtagagtaatagatatgctagaaggcaacatgaattccctagaaatgcctccaaaacctgttctttcttctccagctagatcgggtacatctacttgggttataatactgagaacaagagaggatacatctcttgtggatcagttcaagtggagggtacatccacttggttcttgtaaaggattttacaaggttaaaggaaatctcaaggaccgatgtggttgcttggggactggatgtaggcacgggttgttgtcgaacaaggaccgggattgtgccgaggagaaatgccatcttgtttttggagatgagggtcatacggatagtacgagaccaggactggtagttggttccgtcaaggacaggg

SEQ ID NO: 109501 - DNA, 443 bp, Glycine max
  Peptide Sequence Number=SeqID_226279
atgaggaagcccgaggtttctggaaaaaacaacaacattaataacaagcttagaaaggggttgtggtcacctgaagaagatgacaagctcatgaactacatgctaaacagtggacaaggttgttggagcgatgtagccagaaatgcgggccttcaaaggtgtggcaaaagttgtcgccttcgatggatcaattacttgaggcctgatcttaaacgaggtgcattctcaccacaagaagaggaaatcatcatccatttgcattcccttctcggaaacagatggtctcaaatagcagcgcgcttaccagggagaactgacaatgaaattaagaacttttggaattcaacaataaagaaaagactcaagaacttgtcctccaacacctcaccaaatggaagcgagtcatcatatgagcccaacaacaaagaccttaacatggcagg

SEQ ID NO: 109502 - DNA, 1002 bp, Glycine max
  misc_feature (954)..(954): n is a, c, g, or t
  Peptide Sequence Number=SeqID_226280
agggttgcatgccctcaccttcagagggctacacgtccttgcctttagagggctccacgtcctcgccttaagagggttgcacgccctcgcctttagaggactacatgtcctcaccttcagagggctacacgccctcgccttcagatggctacatgcccttgccttcagaggactacacatcctcacctttagagggttgcatgccctcgccttcagagagctacacgccctcgccttcagagggctacacgccctcgccttcagaggactacatgtcctccccttcaaaggactacacgtccttgccttcagagagctacatgtcctccctttcaaaggactacacgtcttcgccttcagagggctacacgccgtcgcgttcagagggctacacgcccttaccttcaaaggaggactacacatcctcgccttcagagggctactcgccctcgcctttagaggactacacgtcctcaccttcaaagggctgcacgccctagcctacgtagggctgcacgccctctccttcataggactctacatttgcgccttcaaagaattcaaggctagtagtttgcttttatcagttcctaggccaccccctgatattggagggcggccaactgtgcgagcacaaccagaaagggaggctattgtgcagctactatgcataccggggcaagatttcacccagcgatcacaatgtcaatctccccctgcggaagtatcagttggtctatgccatcatgacatagggatcgcgcccaagacacacccagtggacccggagaagtccaacaggccctggggtttccagctctggttatgggcctctgttagtcctaccgggatcgcgcccacaagacacccagcggactcggagaagtccaacagggtcatggggtttccagctctgagtacgagcctttgtcaattctatggagtgcccgtcgnccccatcaaggtcatcaagccccctattaaccgagtttacatcaagaa

SEQ ID NO: 109503 - DNA, 1503 bp, Glycine max
  Peptide Sequence Number=SeqID_226281
atggcatgggagcttatttggcgagagtctagaatacctggaagatttaatcgattgtggaattttgatgacattgatgaagcattgaaaaatgtcaaggctactgaagccattagaagcatacaaattgatgtgcaaaacattatgaagcagaagttaagccctcacatatttgctaagatgagcagatcacaatttctggaaatttctggggaatataatgatgatttgtttgatcaactttgtattcttgctgaagggctccaatttttggcaattgagctaagatttttttattgggattattaccctctaaaatcgttgccagaaaatttttctgccaaaaaacttgtagtattgaatttgccagacagcaaaatggaaaaactttgggatggagtgaagaatcttgtcaatttaaaacaagttgacttaagtttgtccaaggagttaatggagctgccagatttatcaaaagctacaaatcttgaagtactgaagctcaactgttgttataggttgactaatgtccatccatctattttctctcttcccaaacttgagaaattggaattttgttggtgtatatcccttaccatacttgcaagcgaatcccaactatgcagcctcagttatctcaacctggattattgttttcctcttaagaaattctctccgatatcagagaatatgaaagaagggagattagtaaaaacgatggtcaaagcattgccctcatccatcaacaatcctaggcaaagtctaccagagcttcccgtgtcacttgaaactctagatgccagacaatgcatatcattgaagactgtattgtttccttcaacgactgctgaacaattaaaggaaaacagaaaacaagttttgttattgaattgcttgaacttggatgaacatactctggtcgctattgggttgaaggcgcaaatcaacgtgatgaaatttgcaaaccacattctgtctactccaagtcaaaatcatgttgaaaattgcagtgattatcatcttaagtattgtacttatcaatgtgtttacctgtatccaggatgtagtgttccagagtggttggaatataagacaacaaatgatcatataaatattgatccctcttctgctccgccttcccccatcctcggctatattttctgctttgtctttggtaggaaccaatatccaggcatgtctgtgatggttagggtcaaggtaaaaggaacagtgtcagaatgttacaatgggggcactgcctcaacaatttggtgtcagcccaataaggcaataagcacatcagcatataacagtttcggtaaacaaatggaatcgggctgtgcttcaatatcatcccaggtagaggcgcaattcaacggggagctaacaagtgacattgatttgttgtgtcaaaaactttatgcaatgaatttctacacatgcagtgacgcaatcacttttggacaggctatgacagtgttgactgctttggacagcgcgtga

SEQ ID NO: 109504 - DNA, 1197 bp, Glycine max
  Peptide Sequence Number=SeqID_226282
atgtcaatcaacactgctcctcaaataaagtttgatgtatttgttagcttgaggggcaaggacatacgggacgggtttcttagccatttgactgaggcttttaaaagaaaccaagtacatgcttttgtagatgataaactagagaggggagaagaaatatggccatcacttgtgacagcaattgaacgttcattcattttgttaatcatattctcgcaagactatgcttcttctcgttggtgtttagaagtacttgtgacgatattagaatgcagagataaatatgagcggattgtaatcccggttttctacaaaatggaacccacaaatgtacaacatcaactagggagttatacgaaaatgcatttgctgagcatgaaagaggatacaaaagcaagaaatgatgctgaggtagttaaagaaattgtcaatcttgtgttgaagaggttggctaagcccaaaattaagtcaaaaggacttcacctgaccattaaggaatccccactaaggaaggagaaaaatgaaggaaattttctaccatgcttgttgactcccccaccccaaacaaaacctttcaaaataattgaattagtattaacggcattgattttaacatatacaatttctctaaatgatgctgcggtggttaaagagattgtcaatcttgtcctgaagacgttggttaaaccccatgttatctcaaaaggacttgttggaatcgaagaaaaaattacaactatcgaatcatggataagagaaaaggcaacagacattagtcttattggaatttggggtatgggcggtatcggcaagacaactcttgctgaacaagtatttaataaactacattcagaatacaaaggctcttattttttagcccgcgaaagagaagaatcaaagagacatgagataatttctttgaaggaaaaattcttttctggactattaggatatgatgtgaaaatttgcacacccagctccttgcccgaggatattgttaagagaattggttgtatgaaggttcttattgttattgatgatgtgaatgatttagatcacttggagaaattgttcggaactctagataattttggatcgggtagcaaaataattgtaacattaaggctaacaaagtctataagacataccatcttagacaattcaattatgttgaagcacttgaacttttcaatttga

SEQ ID NO: 109505 - DNA, 1683 bp, Glycine max
  Peptide Sequence Number=SeqID_226283
atggcctccgtagcactcaccaccaccgcactcccctacctccgcctccgccgcaacaccgccgccaccctcaaacccaaccgccactcttccatttcactctcctcactcaaaccaaccctcaacgcttcaatttcctccttcccaaatttctcactaaaaaaaccaagcctagttttcaatcaaaaaccctcctctctaaccgtcagagcctccgcagcctccatcactccggcgccggcgccttcatcggcgccggtacagccatggcaaggcgcttccataaagccgctaatagcctccatcgcgacgggagtaatcctctggttctcacccgttcccgccggcgtgaaccgcaacgcgtggcaactgctcgcgattttcttaggcacaatcgtcggcataataacacaacccttacctcttggagcggtagcaatattagggttaggtgtttccgttctcaccaaaacgctacccttcgccgccgcattctccggcttcggcgatcccatcccctggctcatcgccctcgctttcttcttcgccaagggttttatcaaaaccggcctcggaaaccgcgtcgcgtaccaattcgttaaactcttcggcagctcctcgttagggttaggttacagcttggtcttcagcgaggcgcttcttgcgccggcgattccctcggtgtcggcgagggcggggggaattttcctgccgctggtgaaggcgctgtgcgtggcttgcgggagcaacgccggcgacgggacggagcacaggttgggggcgtggctcatgctcacgtgctttcagacctccgtcattacgtcggcgatgttcttgacggcgatggcggcgaatccgctgtgcgcgactcttactctgaattccattaatcaaactattgggtggttggattgggctaaagccgcaattgttcctggcttggcgtcgttggtgttggtgccgttgattttgtatgttatatatccgccgacattgaagagtagtcctgatgctcctaagcttgcgaaggagaagttggagaagatggggcccatgacgaccaatgagaagatcatgactgctactttgtttctcacggtgggactttgggtatttggagggcttcttaatgttgatgctgtatctgctgcaattcttggattatctgtacttcttgtcactggggttgtaacatggaaggagtgcttagctgaaggagttgcctgggataccctcacatggtttgctgccctcatagcaatggctgggtatttgaacaaatatggtctcatttcttggttcagtcaaactgtagtcaagtttgtcggtggattgggtctatcatggcaattatcttttggaattctagtccttctctacttttactctcattacttctttgcaagtggagctgctcatattggtgccatgtttactgcatttttgtctgttgccactgctctggggactccgccattctttggagccatagtgctgtccttcctctccaaccttatgggtggccttacgcattatggaattggatcagctcctgtgtttttcggtgccaactatgttccccttgctaaatggtggggctacggattcctcattagtattgttaacattataatctggcttggacttggaggagtttggtggaaattcattggcttgtggtaa

SEQ ID NO: 109506 - DNA, 876 bp, Glycine max
  Peptide Sequence Number=SeqID_226284
atgagccacgcccccaacctgtgctccgtcccgtcgccggcgttgctcccgcaagccacgcacagcgccttcaccagcggcaggaaaattccccccgccctcgccgacaccgagggaatcgccggcgcaagaagcgcctcgctgaagaccaagctggcgatgagccaggggatgggatcgccgaagccggagaatgcggcggcgaagggtagcgttttggtgagaacggaaacacctaaccctaatattgctaccgctccaagaggtaagggttgtgttattatgccgacgattgtgcctaagaaaatcgcgagcagttgccacgcgttgcggttcacgccggcgggaacgggtgagaaccagaggattactcccgtcgcgatggaggctattagcggctttatggaagcgccttgccatggctgtaccggcgccgatgaaggcgccggcgccggagtgatggaggctgcggaggctctgacgggtggcggcggtgttgcggcggaggcggaggtaggggagtgcggtggtggtgagtgctacggaggccatggtgggagggagttggatctggtgatgtggcgtggacggtggagattgggtgtggaatatgcggctttgtttgttggtgaggaattggtggcttggggacacgtggcggggtgtgagtgggtcatggcccacgtcggatttatgcttttggatgaacacgtggggatggagattggagactatggcatggctccagaagagaacatcaagatcttccttgcgtgtgagttaacgctttgggcttttcgttcgtctaaaagggcaaaaagtttagaacaaaaaaacccaacaaccctcaaacgtcactataaatactactactaa

SEQ ID NO: 109507 - DNA, 183 bp, Glycine max
  Peptide Sequence Number=SeqID_226285
atggggagaggtggtggaggcagtgaggtaggcgttggggacggcaagaatggagagagacaagcggtccgagagatccacggcgagggacgtggtggaggcgaggaaggagggcctgttgccatgtcaaagttcaaaagcaaaactgcaattagccttggcaggaaagaaatcaggcattaa

SEQ ID NO: 109508 - DNA, 648 bp, Glycine max
  Peptide Sequence Number=SeqID_226286
atgtcatcaacaaatggaaaactttcgtttacgttaaagaatgaccaaggtatagaatcgttcttaaaacatcatggagccctagcacagaagagatataaattttccgaagttaagaaaatgaccaactccttcaaagttaaactgggtgaaggtggttttggtactgtatacaaaggagagctactcagtggttgccctgtggctgtaaagatattgaatgcatccaaaggaaatggcgaagagttcatcaatgaggttgctagcatcagtagaacttctcatgttaatgttgtcacacttcttggatacagtttggaaggacgcaaaaaagctctcatttatgagtttatgcccaatggttcccttgacaagtttattcacaataagggtcttgaaaccactgcagccttgagttgggataatttgtggcaaattgcaataggtatagcccgaggactagagtacttgcatagtggttgcaacactagaattttacattttgacataaaaccacataacattcttttggatgagaatctatgtcccaagatatcagatttcgggcttgcgaagctttttcccaggaaagatagcattgtttccctgtcatatgctaggggaacaataggatatgtagctccagaa

SEQ ID NO: 109509 - DNA, 420 bp, Glycine max
  Peptide Sequence Number=SeqID_226287
atgactttgttgttcccggaggaaaaaaaggtgcagaagactgtgccagcccctgcatgctatcaagcgttctgtcttacagatagcaaaagaatgggtgcgaataaccataaggtatctccgcgtatcatgggtatctccgcgtatcatgggtgcagaatgaccaaacttggtctctgcttgccaacggacacgactgtgtctgaatggcaaaggggtgcggataaccgtaaggtatctccgcgtatcataatgaccaaacttggtctctgcttgccaacggacacgactgtgtctgaatggcaaaggggtgcggataaccgtaaggtatctccgcgtatcataatgaccaaacttggtctctgcttgccaacggacacgactgtgtctgaatggcaaaggggtgcggataaccgtaag

SEQ ID NO: 109510 - DNA, 405 bp, Glycine max
  Peptide Sequence Number=SeqID_226288
atgtccagtgcggaaacgagaatgttgaaaatatttccttggcttgagaattgcgggtggcgtgtccaagtgtcggtagacgttattccttttgaaaatggtcgtcattttctgaggaagctttcggtcgcgggtttctcgtccactatttggttctcaacagaagatccacttttagagcagtgcgagcgacgtttgcacgtgccgactgacgttcctgaagtagattatggtggtggtaaaaattctgctgtcgaaaaagctcttggaaaagggtttgagtatgtcttctatcctatcctcgctcctcttttctctaaccaacttactgttgtagcaaaatcctcttcatactttgccatctctttgctcttaaatttgcatctggttcccgtaaggaagtag

SEQ ID NO: 109511 - DNA, 486 bp, Glycine max
  misc_feature (10)..(10): n is a, c, g, or t
  Peptide Sequence Number=SeqID_226289
atgaactatntggtgccagcattgatgaagatcaaggaaagaagcacttcatcagatcaacatagtggctattgtgatgacaatattcagaatgttgtcaagtatgaagtggacatggcaatggtgcactcagcccaaggttttgcatggagtaatgctctaagtgtgaagcttcaaagagatagagtcaatgtagattgtgacaccactagctttggtgaaggttcatcatcatcaagggtttgtggccaaaattgtgaaatggtgccgttggataatttcccttcaaaccctagtttgaaatctaataacaagtgcaaggaaatgcctgaaatgaaaaggggtttgagagaagatgatgatggtgatgaagatgaagtcatcaatggtcaattgaagagcctaagaaggttgatgccgggtggagaagagatgtgtagtgaacaaatggtgaacattcttcggtgcctcgcggagacacattga

SEQ ID NO: 109512 - DNA, 588 bp, Glycine max
  Peptide Sequence Number=SeqID_226290
atggtgtcaactacaatatcttccttgaattggcacaatgctaacccatctctgctatcactgctgactgttgcaggagaaattcattggacgatgaaactcattttaggtattacagctggagtaatgggaggattcatgatatgcatcataatttgctctactaaatgtatgtcatcaacaaaagtaaaactatggcttacgttaaagaatgaccaagttatagaatcattcttaaaacatcatggagcactagcacagaagagatataaattttccgaagttaagaaaatgaccaactccttcaaagttaaactgggtgaaggtggctttggtgctgtatacaaaggacagctactaagtggctgccctgtggctgtaaagatattgaatgcatccaaaggaaatggcgaatacttcatcaatgaggttgctagcatcagtagaacttctcatgttaatattgtcacacttcttggattcagttcggaaggacgcaaaaaagctctcatttatgagtttttccccatggttctcttgacaagtttatttacaataagggtctggaaacaactgcatccttgttga

SEQ ID NO: 109513 - DNA, 306 bp, Glycine max
  Peptide Sequence Number=SeqID_226291
atgaaggcgattcttggttatcaagaagtcgcaaaaattgtagaagaagggttctcggtgcacacaaccgatgccacagataagattgcaggtgttgcaacttcacgagaagtgtggcagattctggaaaaatgcaacaaaggtgtagagcaactgaagaaggtagaagaacttcaattttctcttgaggcgcatgagcaaagacttattgaaagaggttcaaagaggtctggtgatcatcaagcattggaggcttatacctcaaaaagaggaggccacaacttcaaaggacatttcagaggttga

SEQ ID NO: 109514 - DNA, 290 bp, Glycine max
  Peptide Sequence Number=SeqID_226292
atgtcctcaatacctccctcaaatccaaaggaagacaatccttttggttctgatttcaatgatccattgctcaacccttcaagtccttatttcatccatcctagtgatggtccttcatctgtatctattacccctgtccttgatggaaacaactaccagtcctggtctcgtactatccgtatggccctcatctccaaaaacaagatggcatttctcctcggcacaatcccggtcccttcagtcaaagaacctctttactctgtttgggagagatgcaacactgtcatcat

SEQ ID NO: 109515 - DNA, 924 bp, Glycine max
  Peptide Sequence Number=SeqID_226293
atgtcagccaatgaagaaacggtagctatcagcatctctcttgctgctactaatatcagaactgaactttatcatgaaaccaaaaacgagacaacattttatataaaccaaaataatttcagtttcaggctgttgatgttgggtggtgcacttttaaccccaacaactcaaagcctcaaggcaacaagaacaattgcaatgctttatccaactcatagattattgtctcttaagaacccagtatcaaatacgagaggattttcatcaaaagagaatatttttatcagaggtcaacaaatcaacattaaacaattttttggccttatctcgggtcattctccacgaaacaaagcaggaggagttgtttcccccaggtgtggcctgccactgacagaagagaatgtggagaaggttttagatgaggtaaggcctggcttgatggctgatggagggaatgtggcattacatgagatagatggtcttgttgttgtcctcaagctacaaggggcatgtggatcatgtcctagctcagctatgacattgaaaatgggaattgaaactcgcctccgggataagattccagaaatcttggaagtggagcagataatggacactgagaccggtctcgagttaaccgaagaaaatgttgaaaatgtagggggaacttcttgcatcgtttctagcatttccataatttcattggccttttggaattttgattttaagtatgaggttctttctgaaattagaccataccttgttggcactgggggaggaatattagagcttgttcagataaaggattatgttgtcaaagttcggctaagtggacctgcagctggggttacgacagttcgtgttgccttaacacagaagctgagagataagatacctgctattgcagctgtgcaactaatagactga

SEQ ID NO: 109516 - DNA, 573 bp, Glycine max
  Peptide Sequence Number=SeqID_226294
atgtggctctcgctacctggctgtctcgctctcttctttctctctctcgcaacaataactcatctcttcagagacctctcattgggccactccaagagagactccacgccgccgctgataatgcctcccaagctcgctgccgtcaccgccgccgacgaccttccctcttcgttcggccagctcgccgcctctctctccgattctgactttgcactaaccgcctacgagatcttcctcgccgcgtgccgcacctcctccggcaagcctctcagtttcgctgccaaccactcctccactatcgccagcaaggtcaagaaggcctttggccttaaatcgccaggtttggcctccagaaagagccctggctctgcttcgggccaaggaaagccgaaacggcctctcatcgtcggcgagctgatgcgcaaccagatgaaggtttccgaagccatggattcgcacgtgcgacgcgtgctgctcaggatttccgctggccaggtcgttaacactcttcgcttaaacaactcctcacgttttttcgcacgtgccgcaatgcatgttgcgagggaggcttga

SEQ ID NO: 109517 - DNA, 213 bp, Glycine max
  Peptide Sequence Number=SeqID_226295
atggtgcgcggtagacgacgtaagtctctgcgtgtcaacgggctcgcttgcctctggttgacaaaaggtgcggataaccataagagattgatggtgtgcgatagacgacgtaagtctccttgtgtcaacggtcttgctggcctttggttgacaaaaggtgcggataaccataaggtacccccgcatgtcatcggactcgctgtctctggatga

SEQ ID NO: 109518 - DNA, 304 bp, Glycine max
  Peptide Sequence Number=SeqID_226296
atgtccttttctggggagggttctatttgctctggtgacagccgaatgttgttgttggaggtccgccttataagagagagtttcaacgatgatcccgcccaccttcattgtggttctaactttgctagcgaccaatcctccgacattcgtgtaggtggcgccatcgttggtggtgtcgtggtccctctcagcgctggtgtcgtcgcccctacgggtggcattgccactggaataaggcctcatccctattttggtgtgcgttcgactcttatggaggatgaggctgaatccactcggccaaatt

SEQ ID NO: 109519 - DNA, 1200 bp, Glycine max
  Peptide Sequence Number=SeqID_226297
atgttatggcagtatgcacgtaggccatgggaatcagttcttaacctcaaagatagcccagtacaagagatatggcttaggcttcactcactgcatatccccccacacttccgcttcaagtacttagacaccttgattgtggacggctgccattttttatcagatgcggtcttacccttctctttacttcctttattacctaaattgaaaacattgaaagttcgaaactgtgattttgtgaaaatcatatttgatgtgacaactatgggaccactcccttttgccctcaagaatttgattttagatgggctgccaaatctggagaatgtttggaattcaaatgttgagcttacgttcccccaagtcaagtcattgtcactgtgtgatctgccaaagttaaagtatgacatgttgaagccatttacacatctagaaccacatcctctaaatcaagtctctattcaaaagcttacacccaacatagagcacctgacactcggtgaacatgaactcaacatgattttgagtggagaattccagggaaaccacttaaacgagttaaaagttcttgctctgtctattgaattcgacgcatttctacaacgggtgcccaatatagagaagcttgaggtgtgtgatggttccttcaaagagattttctgctttgatagtcataatgtggatgaggatggattggtttcacagctgaaagtgatatgctcggactcccttccagagcttgtttccattgggtcagagaactctgggattgtgccctttctcagaaatctagaaacattgcaagtaatcagctgtttgagttcaataaatctggtaccatgcacagtgtctttctccaatctgacatatttgaaagtaaaaagttgcaagagtctgttatatttgttcacatcctcaacagcaagaagtttgggtcaactcaaaacaatggagataagttggtgtgattcaattgaagagatagtgtcttcaacagaggaaggggatgaatcagatgagaatgagataatatttcagcagctcaattgtttggaacttgaaggattaggaaagctgagaaggttctacaaagggagtttaagtttcccgtccttggaggaattcacattaaaggattgcgagaggatggaaagtttgtgtgcaggcaatgactccaacattagagttagaggagattga

SEQ ID NO: 109520 - DNA, 477 bp, Glycine max
  Peptide Sequence Number=SeqID_226298
atgcatgtatgtgatttaggtagcgaatatgccttggaaatgcaaagatggcctcgagaaagcttcaatccaagaggtccaggagggacgccaccagagaaggctccagcattgccaagcccgctaacacagattttgacaggcactgattccagagcgccgaccatcagtagcgcttcgagaccatcaagggatagtcattcctcagagagaggcggacgttgggcaccacttgtgacccccatggctaaattcgacctagagatagtcatggaattttatgccaacacctggcctaccaaagagggagctcaggatatgtgctcatgggtgaggggccagcggatcccatttgatgcagacaccctcagccagttcttgggccacccgaggatgggcgaggatcatgcatatgagcatgaccaccctgacccgaatatggatgacattgctgctcagcaacatcctacccagtga

SEQ ID NO: 109521 - DNA, 219 bp, Glycine max
  Peptide Sequence Number=SeqID_226299
atggcaaacacatgcataccaaattgtttcataggttattccctacaaaaccatgcgcaaatgccattgaggcatttcaccgagcacttggtgggcgcatgtttaggcatgaatagcaagggaatgggggcaatgtggcatttcaccgagcacttggtgggcgcatgtttaagcgcttgtgacacccctatagatcgagcgagatggctcggaccctaa

SEQ ID NO: 109522 - DNA, 303 bp, Glycine max
  Peptide Sequence Number=SeqID_226300
atggcatgtccagaggggcaaaaagtttcttttggtacatatactctggcggaagaagttgtgtattggtgggagaatactcgccattgcttagaggctgaaggtcaagttgtgacctgggatgtcttccagatgctatttatggggaaatactttcctgaggatgttaggaacaagaagaagatggagttcttggagctgaagcaagggaacatgactgtggctgaatatgcagccaagtttgaagaactagtgagaaatggtttactggaaagtgcatcgagttgtcaagtatttaattaa

SEQ ID NO: 109523 - DNA, 129 bp, Glycine max
  Peptide Sequence Number=SeqID_226301
atgacgctcaaaatggataagtcagacttaagtattttattttccaactatattcttagagaagggaacagttgtggtgactgcaaagaattttgctttaatttgttcccaggaacaccgataaaatga

SEQ ID NO: 109524 - DNA, 297 bp, Glycine max
  Peptide Sequence Number=SeqID_226302
atggcacatcctaccagagcgttgtgtctcgacgtccttcagcacaagcaagcgcatgagacagttatgctaagactccctggggcgcttagcctatatgcaatgtggtaccatggagaccagtcagggtcacgatgttttgcgagaatgctccaaccatatgagatcagcataggcttaaaggagcactcaaacccggtgacccccaaggcctacactccgaagagtccatcagggcctcttcctcctgattcaggtccaacccctaaaatcattttagcacacagacactgctag

SEQ ID NO: 109525 - DNA, 453 bp, Glycine max
  Peptide Sequence Number=SeqID_226303
atgtccaaatggtcacctcgatcctctgtaactttcattgggtgtactcaatgcacgttctatccaatctatctgctagcactacgtggacttgagtatgataggtgtagtgtgcaatctatgttgcaatacagagccatacctactctctttgcaagctacattgagcctgcagacacctcgatatactcgacatcgtcaatactaaaaagagtaatcactacatacaaatacatcatacaccgatccctcatcttccaacttaaaaagcatagtctcaaagccatcaggagtagcaatgtgaggaaaatatctcaacacacaaattcaagacatgacaacaagctcaaaaatttcaaagcaacaccatgttcaaggaagttcaacaacaagcacatggttcaagagttggagagaccctccctacctcttgatgaactcaaaaaatcttaa

SEQ ID NO: 109526 - DNA, 486 bp, Glycine max
  Peptide Sequence Number=SeqID_226304
atgggggagtattatctcaattttcaaattaaccaacaaagagtaggtcgtggtggtgtgtggggggctggagtggccgtttgctatcttgccgatcagccaatcgcagaacgcggcgatttgcttgtgctttgtgcggaatttgtcgccggcggcaaagaggtcggagacggtggagtgcttggcggaggagagaacgacgacgtcgttgactttggttggtcgtcaccgctattcaggagagaacttgtctgcgtcaccgcgcggccaggtggagctcagtgtcgttgtgccgccccgtcacctgcttcaccgccttcacgtacttcttcttcctcgcctggtcgattcgcttccccgagttcgaccgcaccagcgccggcgatggagaaggagacggtgatatctcacaaaatgggaccttctctccttgcccttcagctccgggtcctgatacacgcaagcaaaagggtcatcgaaaaatga

SEQ ID NO: 109527 - DNA, 459 bp, Glycine max
  Peptide Sequence Number=SeqID_226305
atggaacttaaatttagtgcaaattcaatgaaactttatacctttaacaacacaaagtaccatttctgtaatcaatcagacaaggaagaagtatacgccaacaacgttaagctgccagttcctgtcattaatggttctgaggaagatcaagctatttggcgtccctctttagatggtaatctgacttttgaagaggctttctcgtttatatctcctcctggtcaagtgtgttcttgcttatgtggggtagcagctgaaaccatggaccaacttttcttcatatatttgtttgttaaagaaatttctagtgctagccaagcctccaaaacctgttgtagtcaagcaagtggattggagtccgccaactttgggctatatattaaatgcaatacaggtggggcttgtagaggttttgctggtcatgcaggagtgttgctaggtgtacccagcattctataa

SEQ ID NO: 109528 - DNA, 213 bp, Glycine max
  Peptide Sequence Number=SeqID_226306
atgctgggtgcacctagcagcactcgtcatgcagctagtgtaggccttttcaaggacagttttggcgcttttcgaggttgcttctcggtttatattgggatttcaacagctttacatgcaaaattgtatgcagtcatggtagctgtggagcatgctcattcagttggatggcttagaatgtggctagagtgtgattcagaatatcaaaactaa

SEQ ID NO: 109529 - DNA, 330 bp, Glycine max
  Peptide Sequence Number=SeqID_226307
atgggtttcccaagtgttagagagaaggagaagagattgcagcctttatttcactatcaaagtgcgagaccaatttatctcttcaaaaacattattttgaaaatcctaacggaaaagagaaagctcagtgtgagggacatttcttacaccacagacattatcccaaaaatcccaatgataaagttgttagcacttaatgttgtgctcaatgatgctgaggaaaaacagattattgatcttgcagtgaaggcatggcttgacgagttgaaagatgttgtctatgacgccaaagatttgttggatgaaatcaacatcaaatccttgagatga

SEQ ID NO: 109530 - DNA, 459 bp, Glycine max
  Peptide Sequence Number=SeqID_226308
atggttaggaccagaggattaggtcgtgccttaggtcaggttactggcagaggtgtgggcagaggaaatcgtgatgatttcgatgatattccgcagcgtcgacagcctactgcatccgcacggaggcagcgagtcgctgtgactgtggattacgtcgatgagccggtcatccctacgccagatgttcaggatgatccgatggaggcaccagttgatgttcaggacgacccgatggagccaggagcatcatcgacatctgcggaggagtccagacatgcagtggaagtttttgatgacattgctgagaggttggagcgccatctgagtctaggggtggtcacgcctagctcatcgacacatgaggtgatcgaagaatgcctcagattggtcaggagtgtgacacatgaccatctagtatacgttaggtgtagacgtaggcgacgcactgatcaggcgtag

SEQ ID NO: 109531 - DNA, 243 bp, Glycine max
  Peptide Sequence Number=SeqID_226309
atgtcagatgctagaggaacaatagagtatgtagctccagaagtatggaataggaattttggcggaatttcgcagaaatctgatgtttacagctttggaatgatgctactagaaatggtgggagtgaagaagaatattaatggagaagtcagtcagataagtgagtacttcccatattggatatacaacaggctagagcagggcatagatttgacaactgatggggtgatagccacacaataa

SEQ ID NO: 109532 - DNA, 276 bp, Glycine max
  Peptide Sequence Number=SeqID_226310
atgtctgacactcttccgccgaaaaccaccgtcaaggatgccgccattcaccagagctttgaccggtcaggtttcgcttccgcggctatcgagcgggggcagctatgcggggagcttgttttcagggacgacgattggattgcaatttctccaaccacattaaggagagggtcccgatcgagggagaaggagagttgcactactcctattgcgtgttgccacttgcgtacgacttctaagacgaaagagactcctaagacagctgctgcttcctag

SEQ ID NO: 109533 - DNA, 477 bp, Glycine max
  Peptide Sequence Number=SeqID_226311
atgaatctgcctttccaacttcccctacttttaatcatgactcagccttcacgttgttcgaatagtcacatcccacttctcaatcaatgcaaaacagttattgagccactccaacagccgtcaattaccacgcattcgaatcgcaagtcatcatcgtttcaatacctgcttcctgaatccttctcgccagaacaaaaaaacgcatttgacactctgagttcatctgcagcaattaacccactcaacgttatcgccatgagttcgcaatcctcgattgattctagcgttgtaccaccaaaattaatgggaactacaatcacataccaatttgtcactgcattccataatgacagagtactcccacccactgctctaccctatcttgatgcctcagctccgaatatgacaatcctcaaaaatcatggccatcctcttcaatggaagttgaccctcaacgatcctgactttggtcaataa

SEQ ID NO: 109534 - DNA, 1359 bp, Glycine max
  Peptide Sequence Number=SeqID_226312
atggaaactcaaaggcaccgcttggttctaataccaccaccatttcaaggacacttaactccaatgcttcaactagccaccatccttcatttaaaagggttctccataaccatatcacatgctcatttcaattcccccgatccttctaattaccctaactttagttttctacccttgttctatgatttatccgataccaacatcacctccaagaatgttgtggatgttactgcaaccttaaatactaccaagtgtgtatctccaattaaagagtcattagttgatcagattgagagagcaaatataaaccatgaaaaaattgtttgcgtcatctacgatggatcaatgtattccatcgattctgtggcgagagaactacaactacccagcatagtcctcagaaccaccagtgctactaatttgctcacttatcatgcgtttgttcagcgacaaagcaaaggtttccctcccttgcaagattctatgttgtcgttggacttggtgccagaacttgaaccgctccgattcaaagacctaccaatgctcaattctggtgttatgcagcagctaatagccaaaacaattgcagtaagaccttctctgggtgttatctgcaatacagtggattgccttgaagaagaatccttgtatcgtctacaccaggtgtacaaagtaagtatcttccccataggccctctacacatgattgccgaagaagattcctcgagtagtagctttgtggaagaagattatagctgcataggttggctcaacaacaaagcaagaaaatctgtgttgtatgtgagtttgggaagcatagctagttgggaagagaaagagctaactgaagtggcttgtggcttagccaatagcaaacagaatttcctttgggttattaggtctgagacaattagtgatgtttcagaatggctaaaatcattgcctaaggatgttaaggtggcaatagcagaaaggggctgcattgtgaaatgggcaccccagggtgaggttttggcacaccaagccgtgggaggattttggagccactgtggttggaattctacgttggagagtttgtgtgaaggagtgccaattatgtgtcaacctcattttggggatcagagggtgaatgctaggttgttgagccatgtatggaaggtggggatagagtggtcctatgtcatggaaaggggtgaaatagaaggtgcagtgagaagactaatggtgaatcaagaagggaaggagatgagccagagagcattggaattgaagaatgagattaggttagctgtgaaaggtggttcttcctatgatgccttgaataggttggtaaagagtatcttatcagtgaatatctaa

SEQ ID NO: 109535 - DNA, 411 bp, Glycine max
  Peptide Sequence Number=SeqID_226313
atgaaggcgattcttggttatcaagaagtcgcaaaaattgtagaagaagggttctcggtgcacacaaccgatgccacagatgtgcagaaggcactttgcaaagaatatgagaagaaagattataaagcgaccattttactgcaacaatgtgttgatgtggcacactttgagaagattacaggtgctgcaacttcgcgagaagtgtggcagattctggaaaaatgcaacaaaggtgcagagcaactgaagaagcttgaagatttgaaggtagaagaaattcaaggttctattgaggcgcatgagctaagacttattgaaagaggttcaaagaggtctggtgatcatcaagcattggaggcttatacctcaaaaagaggaggccacaacttcaaaggacatttcagaggttga

SEQ ID NO: 109536 - DNA, 561 bp, Glycine max
  Peptide Sequence Number=SeqID_226314
atgagactggtccgaacagaccttgcccgtgatgtttgctctccgcaatttggtgacacttatctgaaccctactctgttctcgtatccccctaaagtgtacaacgtcaccatattctacgattgtccccccatcacatatccaccgcctccacacagcattacgtgcgggtatgctatccctaatattggggagggatttcaggatccacttttagagcagtgcaagcgacgtttgcacgtgccgactgacgttcctgaagttgattatggtggtggtaaaaattctgctgtcgaaaaggctcttgataaagggtttgaggtcaagtatactgtttctcaagattgcacaacatgcctgggaagtgaaggaaattgctcgagacatgatgctcatttttaccaaaatttatgccattattgccctgatggatctcacgccctacactgttctaaaacaaaatcctcttcatactttgccatctctatgctcttaaatctgcatctggttcccgttaggaagtacgaatcctccaattcaacaaaatcatcacgtcaataa

SEQ ID NO: 109537 - DNA, 1041 bp, Glycine max
  Peptide Sequence Number=SeqID_226315
atggctattgacacatcgttgccttttccctatcagttcctccatgacgagcggggcgaacaaattctcccaccaataccatcaaatgactccaatcacaccaactgcaaaaacaacaacatacacggacatgatttaaagccacaggagctgctcattccccgtgaatttcgatcactctctcaagacaatcttgtctcagacatgcctcacttcatgcttcaagacaacaccaaattcgattccttaagcataggttccgatcctctggaatcgctatgggactcagttagttatccccagtcaacgccctcgtcaactttgagctcaattcaggggagttctgaaggttcttctcaggaaccatcgcctaacagctatgacttttgttgggacaacacctacgatgtggtggagatgttagagaagatgaagcttgacgaaagggacagttccaaataccatcatggttatgggaatcacaggttcgagacctcaaacgttggagtctgctctctccttcaagaacaaattcaagcaattcaattgtctcggctaagacaagagcagattctgtctcggaagcagaaactaaccaaatacagaggaaaaaatcatgggcagatatcacagcaatttcaaaagaaaggtaaaggtgttgatgatggttgtgataacgaatgtaggactcgtccaccgtggcacaatcgttggcaccagcaagctgaatcaaaaggcacgtcttgtgggactggcgttttcttgccacgtggcagaacaagtgcaccgttggagtcacgtgagagaccaggtaaaggttgttccacagttcttatacctgctagagtagtacaggctttgcaactccactttgagcaaatggctgccacgactgggcccaaacctggtggcttccctcccctacatgatgttttggtgagtaacagggatggcatgtattcactacaaaagcgccaatcacgggacaaaccagcacatatccagaatgagatgattctgcctcaagaatggacctattga

SEQ ID NO: 109538 - DNA, 393 bp, Glycine max
  Peptide Sequence Number=SeqID_226316
atggcagacacagcggctgcggagaagccagtttgcatatgtttggaaggccgcatgagagctctcatatatgaatttatgcccaatggttcccttgacaagctcatttatagaaaaggacctgaaaccattacacccttgagttgggacattatgtatgaaactgcaatgggggtttcactcaagtctgatgtttatagatttggaatgatgttgctggaaatggtgggaaggagaaagaacactatagatgaagcaagtcacagaagtgaaatatactttctgcattgggtatataaaagacttcagttgggcaatgatttgagactggatgaggtgatgacaccagaagaaaatgagatagctaagagattgaccatagttttatggtga

SEQ ID NO: 109539 - DNA, 159 bp, Glycine max
  Peptide Sequence Number=SeqID_226317
atgaccaaccccttcaaagttaaattgggagagctacacagtggttgcccagtggctgtaaagatattgaatgcatccaaaggaaatgacaaacactttgtcaatgaggttgctagtatgagtataacttctgatgttaatgttgccatacttctttga

SEQ ID NO: 109540 - DNA, 1902 bp, Glycine max
  Peptide Sequence Number=SeqID_226318
atgactggaatgatagatcgtttagaggtttcctttcagaggcagtttaactaccatgaccaagttcctcataagattggtggaggcaaaacagctgtgacatatgatataatggcaccatcacctgtggtggggtctagtttcaagcttgtatttcagcaaatcttagactcacaggcacaattattggaaggcaaagaatatcataagattcaaaatcctactgtagaaacaaatgatcatccacatgcccctgcagattctaatatttacacccaaccagaagatgtgagttctgattctgcagcaagagcactaagaccaccaaaagtgggatactgtaaaatttgtgaggttcatctaccctattgcaaaacattggaaatgcataaccaagaaaatagtcatcaaataatgttgaaactatatgaggaaatacagagactaaaaacttcaaacgtacagattccaaattctcaaaagaatttagtagttctacctaagacagttcatatatctgggaaaaatggtcacccacaaaagaatatgagttcagaagctagtattttgaagcacaagaattacctgaagaaaggtatggggctgacttgtgaaattccagctaaaggacctgaagtgaaacctagggataatagtggggcacagggtcatggtttcaagcagaatattaggggtctcaaaataggtaaatcaagtttcaagctacagtctcaacgcattttagcttcacagacacctgtatcagaacacaaagaacatgctatacatattggaccagaatcccaattatcaaaagacacagcagattgtgagaaccaaagttgtactgatgagaaaaacaatcagctgctgccatcaattgtagcagagttcaattccccttcagattccagtactaacacccaaactacagatgaatgttctaaagctgaacaaaggatagagattctcacccatcagtcagggacaactcagctgtctcaggtagctgtttgtcttcagtgtggcaatgcagggtttccagagacacttgtgttttgcaacaagtgtcaggtatatgcacgtcataggtattgtttagatggacctgtgatttttaccgatgatgttacttggttttgtgaggattgcgaagcaaaggtgacatcttttcatgatagttgtactcttctcccatctggaaaaaacatctctctaaattcaggaaatgatgcatctcaagccagaatagagccaaaaagctgcatagagagtgtaaaaaacaagcaagagccacaaaatattatagctaaaacaatggtgctgttatctgataatcacagtttgtctcatcatgggttgtctcaatgcattaacaacgctgaaaaagaaaataagtttgagaaagagtttcaaccagatccaaaagatgaagctaatactagtgagtctttaaatgctactgttccataccctattgctgatccagtctggaggggaagtttgcgcatctccgacccaagttttggtactgtcattggtcttctggcccatgtgtccactttagcaagccccaaagttctggaggagacaagatttttccctgatgtgctttgcccagacttgcgcccaagaactgcggtgtggccaaagtctttcatgaaatgtggaccaaatatggatagcattgctctttatttttttcctgatagtgaaagagttgagagggcctttcacaagctggtagaggacatgatgtactttgacctttccttaagaacagaggttgaaaatgctgagcttctaatttttccttctatattactccctattcaatgccgaagatttctagaaaagtactacttgtggggtgtcttcagagcaaagaaaccttcactgtaa

SEQ ID NO: 109541 - DNA, 360 bp, Glycine max
  Peptide Sequence Number=SeqID_226319
atgagtggcgaatgcgaaagggataacaaagatgtgtatcgcggtgttcatgtggcagactcatccaaagtaccccttgattctcttacacaacagggacgagttttattctcggtgatgttgaaacttgaaaggcctacggaaccattggcgtggtgggaaggggaaacgatcttgggtggtaaggatgcactgggcggtggaacatggttgggttcgacaagagacggtaggatagcgtttcttacaaattttagggaagttgagatgctttcgaatcccaagaccagaggggacttgccccttcgttttcttcagataaatgcatcgagtaaagttcacaagtttctaaaaagttag

SEQ ID NO: 109542 - DNA, 927 bp, Glycine max
  Peptide Sequence Number=SeqID_226320
atgaccaactccttcaaagttaaactgggtgaaggcggttttggtgccgtatacaaaggagagatacacagtggttgccctgtggctgtaaagatattgaatgcatccaaaggaaatggcgaagacttcatcaatgaggttgctagcatcagtagaacttctcatgttaatgttgtcacacttcttggattcagtttggaaggacgcaaaaaagctctcatttatgagtttatgcccaatggttccctagacaagtttatttacaataagggtcttgaaaccactgcatccttgagttgggataatttgtggcaaattgcaataggtatagcccgaggattagagtacttgcatagtggttgcaatactcgaattttacatcttgacataaaaccacaaaacattcttttggatgagaatctatgtcccaagatatcagatttcgggcttgcaaagctttttcccaggaaagatagcattgtttccctgtcatatgctaggggaacaataggatatgtagctccagaagtgtgcaacaaacactttggtggaatttcacacaaatctgatgtctacagctatggaatgatgctgctagaaatggtgggagtgaagaagaatattaatgcagaaaccagtcaaacaagtgagtacttcccagattggatatacaaaaggctagagcagggcagagatttgacaactgatggggtgatagccacacaagaaacagagatagcaaggaaaatgactatagtgggtttatggtgtgttcaaacaattccacaagatagaccaacaatgagcaaagtaatagatatgctagaaggcaacatgaattccctagaaatgcccccaaaacctattctttcttctccagctagattggttccagaatttaccactagttcattgcaatctgggtag

SEQ ID NO: 109543 - DNA, 357 bp, Glycine max
  Peptide Sequence Number=SeqID_226321
tgtgcatatttgcatactttgatgcctaactggttaatctatgccatgaaaagctcaacagtgggtcctggtgaggtagacgacgagctagaagatgaggtaggatctgaatgtgccaaatatggaactgtaacccgagttctgatatttgagataacagagccaaatttccccgttcatgaagcagtaagaatctttgtgcagtttgagagatctgaagaaacaactaaagcgcttgtcgaccttgatggtcggtactttgggggtagagtggtgcgtgcctcattttatgacgaggaaaagtttagcaagaatgagttagctccaatgccaggagaaattcccggctttacttga

SEQ ID NO: 109544 - DNA, 444 bp, Glycine max
  Peptide Sequence Number=SeqID_226322
atgtctcgtgagtttggactaattcaaatcaagcttcattctcaaatgaatcttgctgaacttagcctaaccaaacagcgttacgactacagcataataaaaaccaaattaccgcacttcatgataagagtttacatcaagtactcagcagaaatccccaacaatgggtttagccttccatcacaaggaagcaccttttacaagcaggagaaagggtttgagagcaactcacagatacacagtggggaggatgtctcctccacctctaaggaccaaaaaatcactcaaaaacctagaatctacctaaaagctaaggtttttgctcccttgctctattctgcacctctattctctatttttcactattctccaccaagctttctcttttctcttcatttcaggattaaaaagggctttctgacctcaaaggcgtgcttagcgtga

SEQ ID NO: 109545 - DNA, 2307 bp, Glycine max
  Peptide Sequence Number=SeqID_226323
atgcggcattggaaacaattgggagaggtgctggtggcagcttctatcaccaacacgctatcccactctcactctgcaactatcaacctccctcctaacctcgctctcggactcacccaacccctcattctaaaaatcctctcaaaccccgcgcatcacgcatcccacaagcttcgattcttcgagtggtctcgctcccaccactgcccttcccccgccgcgtactccgtcatcctccgcaccctctcccgcgagggtttctactccgacatcccctccctcctccattccatgacgcaagccggcgtcgttctcgatccccactccctcaaccacctcctccgctccttcatcatctcctccaacttcaatttagctctccaattactagattacgtacaacaccttcacctcgaccctagcccaatttacaactctctcctcgttgctctgcttgaaaaaaaccaactcactctcgcgttatccatcttcttcaagctccttggtgctgttgattcgaaatccatcaccgcgtgcaaccagttgttggttgctcttagaaaagcagacatgagggtggagtttgagcaagtgttccagaggttgagggagaagagagggttctcatttgacacatggggctacaatgtgtgtatccacgcctttggttgttggggtgatttggctacttgctttgcactttttaaggagatgaagggtggtaataaggggttcgttgctcctgatttgtgcacctacaacagcctcatcaccgcactttgcaggcttggcaaggtggatgatgcgatcactgtgtacgaggagctcaatggctcagcccaccaacccgatcgcttcacttacaccaaccttattcaagcctgttccaagacttacagaatggaggatgccatcaggatttttaaccagatgcagagcaatggattccgcccggatacacttgcttataactctctgctggatggacattttaaggccacaaaggttatggaagcctgccagctgtttgagaaaatggttcaagaaggtgtgagaccgtcatgctggacttataatattctcattcatggattgtttaggaatggcagggcggaagctgcttatactatgttttgtgacctcaagaagaaaggccaatttgtggatgggattacttacagcatcgttgtgttgcagctttgtaaggagggccaactggaggaggcgctgcagttggtggaagaaatggaaagcagaggttttgttgttgatcttgtcaccataacatcgctcctgattagcattcatagacacggtcgctgggattggacagaccggcttatgaagcatatcagggaaggtgatctggcactttccgttctcaagtggaaagctggaatggaagcttctatgaagaacccgcccggcaagaaaaaggattactcgcccttgttcccttccaaaggagattttattgacatcatcaacttcatgacctgtgcccaggataccaccaacattaatgacggggaggaaaattcctgcaatgaaattgacgagtggtcatcatcaccgcacatggataaattggccaatcaagtgagctccactggctattcttcccagatgtttactccttctcgtggacaaagagttcaagaaaaagggccggattcttttgatgttgatatggtgaatactttcttgtctatatttttggccaagggaaagttgagcttggcttgcaaattgtttgagattttcagtgatgcaggtgtggatcctgtgagctatacttataattctatcatgagctcttttgtcaaaaagggctatttcgctgaagcttgggctattctaactgaaatgggagaaaaattttgccccactgatatagccacatacaatatgataattcaaggtttaggaaagatgggaagagctgatctagccagtgctgttcttgataggctactgaggcagggtggttatcttgacatagttatgtataacactctcattaatgctttggggaaggcaagccgaattgatgaggtgaataagctttttgagcaaatgaggagcagtgggataaatcctgatgttgtcacttataatacattgattgaagttcacagtaaggcagggcgattgaaggatgcttataagttcttaaaaatgatgctggatgctggatgcagccctaaccatgttacagacaccactttagattatctagggagggaaattgataaattgaggtaccaaagggcatcgattttgagtgaaaaagatgatccttcttga

SEQ ID NO: 109546 - DNA, 810 bp, Glycine max
  Peptide Sequence Number=SeqID_226324
atggtgggactgttgtgcccccttccagtgcctcatcgtccctgggaggatctctcccttgacttcatcactggactgcccccttatcatggcaattcggtaacccttgtagttgtcgactgcttctccaaaggtatctatctgggcatgttaccttcctcacatacagctcatacaatggcttctctgttcatggacatcgttggaaagattcatgggttaccacgaagcttggtctccgacagggatcctctgttcgttagtaagttttggcaggagctattccaacttagtggcacacagttaagaatgagctctgcataccatccgcagagtgatggtcaaacggaggtgctgaacaagatcatcgagcaatatcttcgtgctttcgtgcaccgcaggatcaacccttatgagatcacctttgagcgcaaaccattcaattttccagaatatatcgcgggttcatctaaactagatgttgttgacgacatgtcaaaggacagagaggaaaccttccagggcattcgaaagaaactcctaaaggctcaaaccgctatgaaacattttgtggatgctaaacagcgcgaggtaacctatcaaacaggagattgggttatactcatactaagacctcaccgccaactctcggtcaaaggtccaaatgcggtgcatggaaaattggctaaacgattttatggaccctttcgaattgtggagcgcattggcttggtgacatatcgcctacaacttcttgacaaagttcgtatataccctgtcttccattgctcagtgttgaagtcattttga

SEQ ID NO: 109547 - DNA, 1032 bp, Glycine max
  Peptide Sequence Number=SeqID_226325
atggctgactatgagagaggagatgatctatcagataatgctatgatggtgacaaaagatgatcctgtgacttatgaagaagctgtcaagagtaagacatggagggatgcaatgaaaaaggagatggtagccatagagaagaacaaaacttgggaactaacgaatttgccaacaggtatgaaaccaattggagtcaaatggatatacaaaaccaaactcaaagaaaatggagaaattgataagttcaaagcaagattagttgctaaagggtatgcacaacagtatggagtggactacactgaggtatttgcacccgttgctaaaatggacacaatacgcattcttgtatccatatctgctcaacacggctggagtatttatcaactggatgtgaagagtgcgtttcttcatggagaactcaaggaagagggaggtaaaattctaattatgagtctatatgttgatgatctaatatacactggaaatgatgaaagcatgtgcaatgattttagatcatctatgatgctggaatttcatatgatggatctagggcggatgagatattttcttggtatagaaatcttgaagaataatcatggaatctttatgtgtcaaagaaagtatgcccatgatgttctgactcagtttggtatgcaagattgcaatgcaataaaaaatccaattgtgccaggaacaaagctatcaagaaatgatgcaggaactaaggtggatgccacacaattcatacaagtagttggaagcttaatgtatttgactgcaactaggccgaatttaatgtatggagtcagcctgattagcagatttatggccaatcctacaaagacacattggtttgcagccaaacggatactaagatacttgaaaggaacaacagagcttggtatatactacaagaaagaggagagcactaatgtagtagcatatacagacaatgactttgctggagacattgatgataggaagagtacctcaggttttgtgtttttcttagggaatgaagcagtaccatag

SEQ ID NO: 109548 - DNA, 1305 bp, Glycine max
  Peptide Sequence Number=SeqID_226326
atggaacacgagaaagcccctatcttggtggaagaaaggacaatgcaggaaattgagatacccattgcctctgaaagacttgatgttattcctatgaaggcagactcatcttgcagttctgtttgtcctttttcaggacacgaaaacagtgctgtggcatcaaaagagtcatcaaagaaactctctggactcattgttttctatgctattgttatggttgtggaacttattggtggaataaaagctcacagcctatctgtcatcagtgatgcagcacacttactttctgatattgctggattctctatctctctctttgcagtgtgggcttcaggttgggaggcaacgccgcaccaatcttttggatacaatcgtcttgaggttttgggggctcttgtatctgtgcagttaatttggttgatatccggttttttgatatatgaagcagtaggtagaattctcgtccgaaatggcagtgtgaatggaaagctcatgcttgcaattgcagcacttgggtttgttcttaacttcatcatggttgcatggattggtcatgatcatagtcatcaccatcattatcatcatcatcatcatcatcatcatcatcatcatcatgatggttgtgaaagctcgggtcatgatcatagtcatcatcaataccagacagatcatgatcatgggaaggaggaacaatctaaaataactgatgaggagaatgttaccctggtttcaagtagtcagacaaatactaatgtcttgaacataaatcttcagggggcatatttgcatgtcatggctgatatgattcaatctattggagtgatgattgctggagccataatatgggcaaaacctgagtggtttatggttgaccttgtgtgtactcttatattttctgttttgtcagtaagcactactcttcccttgcttaggaatatttatggcattctgatggaaaggacaccaagtgagatcgatattagtaagctggaaagtggcctcagaaatatcaagggagtgcaggatgttcatgacttgcacgtttgggctataactgttggaaaatgtgttctgtcttgccacgtagtggctgagcctggcataagttccattgatttactaggcacgattaaaaattacttgtgtcaagttttaggggagactagggccatgcgagggatggtcaactcagtgaaaggtacagagtacagacattggttgggtagtgggtacagagagaataattttggggatgggttattgataggagttagatacgctaggcattgtcaaacaaatgtgtaa

SEQ ID NO: 109549 - DNA, 2004 bp, Glycine max
  Peptide Sequence Number=SeqID_226327
atgaagcgtgctcatgcaattgatcattccgggacgaagaggcgggagataaaaacagcggcaagtgaccccaatgctactccgaccctgactcttgcttcatcgcctgggatccgcaattggtttgactccctctctgctacgccactgcaacaaccgtcatcctacaaagacaaaagcgacgatgtagatcttctgtccatgaaggttagatctggctggggagatgtgggcgcgaaggcggttttcgagggcataacattcagactgatggggcacaagtgcgagagaaatgcaacattgctcgccacaaatggcatcatcagccgccatttcttccgatcagaacccgaaagctatgctgaactcatcgatatgtacgctcgcgatcgagcgttgcacgctggcaagaagcttcacgcgcacctagtcaccaacggtttcgctcgtttcaacgtcgttgcttccaacctcgtatccttctacacatgctgtggccaactctcccacgcgcggaaactgttcgacaaaattcccaccacaaatgttcgccgctggattgctctcattggctcctgcgctcgctgcggcttctacgatcacgctctcgccgtgttctctgagatgcaagccgttcaagggcttacgcccaactacgtattcgtcatccccagcgttctcaaagcttgcggccacgtcggggatcgaattacaggagagaaaatacatggcttcattttgaagtgttcgttcgaacttgattcgtttgtgtccagttctttgattgttatgtactccaagtgtgcgaaagttgaggatgcgcgcaaggtgtttgatgggatgactgtcaaagacactgtggctctaaatgctgttgttgctgggtatgttcaacagggtgctgcaaacgaggcactgggtttggtggaaagtatgaagttgatgggtttgaagccaaatgtggtaacttggaactctttgatatctgggttttcacagaagggtgaccaaggaagggtgtctgagatttttaggttgatgattgcagatggagtggagcctgatgtggtatcatggacttctgttatatctggttttgtgcagaactttcgtaataaggaagcatttgacacgtttaagcaaatgttgagtcatgggttccacccaacttcagctactataagcgccctgttgcctgcttgtgctactgcagcaagagttagtgttgggagagagattcatggctacgctttggtgactggggtggagggagatatatatgtaaggagtgctctggttgacatgtatgcaaaatgtgggttcatttctgaagcgaggaatttgtttagtaggatgccagagaagaacacagttacgtggaactctatcatttttggttttgcgaatcacgggtattgcgaggaagccattgagctcttcaatcagatggaaaaggaaggggtagccaagctggatcatttaactttcacggcagctctcactgcatgtagtcatgttggagattttgaacttgggcagaggctattcaagattatgcaagaaaaatacagtattgaaccacggctagagcattatgcgtgcatggtggatcttcttggtcgagcagggaagctccacgaagcttattgcatgatcaagacaatgcctattgaacctgatttatttgtgtggggtgcattgctggctgcttgtagaaatcataggcatgtggagctcgcggaagtggctgctatgcatctaatggaattagagcctgagagtgctgcgaaccctcttctgctgtccagcgtatatgctgatgctggcaaatggggaaagtttgagagggtcaagaaaaggataaagaagggaaaactgagaaaacttcaagagaagggcacacctactggtataattttggatgtatcgttttgtgctcctctagatggggatgggatgagatggaaggaaaaggagaggaatagcacccatttcattgtctag

SEQ ID NO: 109550 - DNA, 1308 bp, Glycine max
  Peptide Sequence Number=SeqID_226328
atggctcaactcgaacgccctcaaagacaggttgagactccaaaaaccccccctaccatccacaccatggaacaactcctccgagaaggagaatccaagtctaagcagtcaccaacctactcctcctcctcctccatgaactcttctccatcctcccctttcttccaaaggttgaggcaccatgactcagaagaagaccatggccagaatcagaagaaatcagttctcaccaaggtgaaggagaaggccaagaaacttcgccacagcctcagcaagaggaaacacgaggacggcaaccccactagtccctcatcagctactggcgtagaaggcgatggagcagaagaagatgctgaatacctcggagctcctatgtacggttcggagaagtcacctgcaggatacgaagcatatgtaaggcagcagaattcaagtccaagaggaaatctagtattcccagagaagcatatgttatcaagcagtgacaaacacgtggttgaaccggatcatcaagaaaagacactaagccgctccatgtctaagaagacaacaacaacctcttctccaaatgctactacttctaacattaatactaatactctttctggtctaaacaagacaatcgtagcaaagaaaccaacaccagttcatgttgaaaaaccggatgcatcccatataacctccaaaatccaaggccttactgtgtcgaaacccacagaacatcatgatcacacttcaccatcatcaacaacagttcagacaattcgcaacacttctttgtcctatgctgctccattcactccccctgcaaagttaccctcccaagctccttcaattactccgcgaactacaccggctccggtgacaccagaaccttcatctgctcctgcatttagtgggaagagcacaagccccaccgcgcaaatacaggacaagggtgtgtcgatgaaagagtacttgctgaacaaattggagccaggggaagacgagaaggcgctgtctcagatgatatctgaagcaatgagtccaaggagaactcccggtgatgtaggcgtgatggagaaggtgagagaagctgtaacttctttgctccgaactgaggaaccaacaaaatatgcagacacgactactactactcctactcgcatgtcgtgtcaaagcccgaaggcttcttgcgcttcatctcaaatgccagcatctatcagcgcttctcgctcttcatctcaaatcccgctatctttcaacgctcaacaagactatgaagtggctgaggaagaaaaccatggccggattcttcaggcaaattga

SEQ ID NO: 109551 - DNA, 153 bp, Glycine max
  Peptide Sequence Number=SeqID_226329
atggaagatgaaaaggacaaggaaaacacaaattcaatttcttgtgttgggaagatatttcgtgagattcggcggagagaaaaagtgcaatatcttattccagatgggtgttggggtggtgccaacgtggacgacttggccagatatttttga

SEQ ID NO: 109552 - DNA, 1497 bp, Glycine max
  Peptide Sequence Number=SeqID_226330
atggcatcaactactctcttcagcttcagactctctttgaacccactgcaccatcaacagacaacgaggccaaaatctctgctctcctctcctcgcaccaatccacgcctcgtttcttccattaacaatcatttggccctcacacgtgtcacatacccgcttctccaatctcactctgctcctaagcgcagattccatgtgtattctgatggggaaagctccgagtcgcttgtttctgacgctacataccaagaggaattttcttggtcttctgtaattcttccgtttctgttccctgcgttgggtggcttattatttggctatgatattggagccacctctggcgctacaatttcactgcagtcacctgagcttagcggtatatcatggtttaaactttctgctattcagcttggactagtggttagtggttccctatatggggctcttcttggctcgcttgttgcatttgccatagctgatttccttgggaggaagaaacaactcattactgcagcactgttgtatttgtttggtggtgtgattactgcctatgcaccagaacttggtgttctcttagcaggaaggctgctttatggacttggtataggtttgctgggttattttgtgggaagctttctgattgagaccgttgggggatggcggttcatgtatggatttagtgctccagttgctgtattaatggggcttggaatgttgactctccccaattctccacggtggttgcttctcagagcagtgcaaggaaaaggttcttttcaagatttgaaggaaaaggccattttttccctgagcaaattaaggggccgaccacctggtgacaaagaatccgagagacaagtagaagaaacccttgtctcattgaagtctgcctatgcagataaggaatcggaggggaatttcttagaggtgtttcagggtccgaatctgaaagctttcataattggtgggggactagtcttatttcaacagataacaggtcaaccaagtgttctgtactatgcaggtccaattcttcagagtgctggattttctgctgcatccgatgctacaaaagtttcggttgttattggcctattcaagttgctaatgacttggattgctgtcctaaaagttgatgatttggggagaagacctctgctgattggaggtttcccacttgttgctgttggagctttacttctttatgttggttgctaccagatatcatttgggccgataagttggctaatggtatcagaggtcttcccacttcgcactagaggaaaggggattagtctggctgttcttaccaacttcgcttcaaatgctgttgtcacctttgcattctccccgctaaaggagtttctaggagcagaaaatctttttctcctttttggggctattgctattctatcacttttgttcattatcttttctgtcccagagacaaaaggcttgagtttagaagatatagaatccaaaatcttgaagtga

SEQ ID NO: 109553 - DNA, 480 bp, Glycine max
  Peptide Sequence Number=SeqID_226331
atgaaagatggtggtagaaagcagggtgcaccctcaccctgtgctgcatgcaagctccttaggagaaggtgtgctcaggactgtgtttttgctccttattttcctgctgatgagcctcagaagtttgcaaatgtgcacaaagtctttggtgccagcaatgtcaacaagatgcttcaggacttagcagagcatcagcgaggagatgcagtgagcagcatggtgtatgaagcaaatgcaagagtgagggaccctgtgtatggctgcgtaggggccatctcatctcttcagcaacagattgatgtgttgcagacccaattggccgtggcacaggctgaagctgtgcacctcagggtgcgccaaactgcatcactctacagccccactagcccaaccaacagtggctctccatcacaagccaagcctatttttgacatggacatggtggtggaccagaacagctatggtgattcaatgtggtga

SEQ ID NO: 109554 - DNA, 2745 bp, Glycine max
  Peptide Sequence Number=SeqID_226332
atgtcgggcggtttctttcgaggcacatcggcggatcaagacactcggttttcgaacaagcaagcgaagctgatgaaatcgcagaagtttgcaccggaactggagcatctggtggacatgacgaaggtgaatatggaagtaattaagccttggatcaccagaagggtgactgagcttcttgggtttgaagatgaagtgcttattaacttcatacacggtcttctggatgcgaaggaagtgaatgggaaagaagttcaaatacaaattactggatttatggaaaaaaacactggaaagttcatgaaagagctttggatgctgcttctcagtgcgcagaaaaatgcaagtggtgttcctcagcagttcttggatgccaaggaagaagaactcctgaagaagaaggctgaaagtgatctgattgcaagtgaaattcagaggaaaacagataatgaagatagagagatcatggaagagaggctgaagaaactggacggtggatttgattcgaaggataatgatactgcatcagatccaactttgaagctcagggattcagggtaccgggagtgggatgggaaggaaactgacaagaggaatggtgttagagcaaggagcaggctttctaggtctccacattcacctgcagtttccatttcacctcatcgaggctcaccttcaaggtcaatgagcaaatcattttcaaattctcgaagttattcaggacacaggtcaaggagtatatctaggtctccagaggctcaaggtccctctctttctgctgaaaggattcgccgttctccacgacgacgatctatttctcctcaaaggcattccccacgacgttctcctcataggaggataccttattcaagaagatctagatctccttctcctgaacgacgcagaatgcattctccagtccatcgtagatcaccatcttttcgacgacgtagatcaccttctcctgttcgacgacatagatcgccttctcctgtgcgacgacgtagatcgccttctcctgtgcgacgacgtagatcgccttctcctgtgcgacgacgtagatcgccttctcctgtgcgacgacgtagatcaccttctcctgtgcgacgacgtagatcaccttctccagtgcgtcggcgtagatcaccttctccagtgcgccgacgtagatcaccttcccctgggcgtcgacacagatcaccttctcctgggcgctgtcatagatcaccatcacctcttggacaacggaggtcactctcacctagacgacgaagatcacttgttactcggcataggtcaccttcaccagtacgccgaataccgccaaccaatgtgcagaatagatcagactcccccatgcaatccccctcccacatacgacaaaggtatggtagtagaactccttcactctctccatctccattgcaacgtagatcacctattcctagtaagcaaagatctcccaatatctccccacagaggtctcctcaagatgaacagagttctcaatctccaatacggtgtgtatctccatctccaattaggaaaaattctccaagacaccaaaaaagtcccttgcattcttctatggggagagtcagaacagaatccgtgactcgtcaaccctctagtcctctggggtcggcaataagagataaatgtggcaaagcttcacactataaatcacaagattcaatgtccacacctgagaagtctccaattcaatctgtatctcaagaagcaaggagtgagaccagcagtgaaggtcgaagtcctcatgagagccctatgaaacaaagaagagataagttgtccaatgaaataaacacgaatcctctgaagaaacaaagaacccaaagacctagccgtgacagcccagatacaagagatgaagcagaagaaacgcactattccagagaaagcagagatccaaaaatgaattcatcacaaaagatatcaaaacatttccctgttagtaagcgaaaaggttcacctgcaaaatatcgtcacgaggagttctctcctgaaagggtgtcaggtcatccagcttctgaacatcattatgataacaatgattggagtaagaaaggccaggagataatgcgtgataaatcttccggaaagggcaatgaatttcctgctcaaaagtcatcaatgaacaaagaaactttttccagggagaagcctcaagaatcttatgctgtagatattaaaaaatcagatgtcaaggaccaatcccattcaaactatgccaaaagcagttatcggcatcacaaatccgaaaccactcaagatttagttggaaaaggtgatcgtgtcaatcacaatgcttcacatgattctgtttctgaggatagtggtaagcatagacgggagggaaaggataggaaaaggcataaaaggtctgagaaaaagtatacatcttctgatgaggattatagtgatgattctgagttagaggacaggaaagaggctaagaggaggagaaaagaggagaagaagctgcagaaggaggagaagcgtcgaagatgtgaagagaagcgacgcagaagggaagaacggcgtgcggagaagctgaaaatgaagagtaaaacagatgatatttcaggtgatgaggaggctaaacgaatggattatcatcaaagtgatagtgtagttacaccatctgagcaaaagaagcttgagattgaattgcggaacaaggctcttgaatccctcaaagcaaagaagggcatgaataactaa

SEQ ID NO: 109555 - DNA, 525 bp, Glycine max
  Peptide Sequence Number=SeqID_226333
atggaacgcgccgatacagtgatatatataagggatagaagatggatgggttctgaacttcttattctcgacactgagttggagaagagaagccagctccagaggtcgactgcggaactgtgttggagttcagaacctactggaagcgaccaacacaatgacacgttgaagcacactaaactcgatcgtgttgaagaaatcaaggtctctggtgacattgtcgtatttgacaaaatagttgtcaagttgcaatgcgtcgtcgtaggagatgaagtagaggttgtcgaactaagtgatcgcaggcgacacgcagcgagagcattggtcgttgatgaggttgttgcgacattggaagtggttgtagacgacatcgaaggaggtggagacagtgaagttgttgtggttggcgaaggcgacggagttgacaagggaggcgaggatcgagttgacgatgttttcatagacgaaacccaacatggacttgagttgggtacagacttgcatgaaagtgataggagttcttaa

SEQ ID NO: 109556 - DNA, 315 bp, Glycine max
  Peptide Sequence Number=SeqID_226334
atgtcaaaacccttttgcaccctctttgcactgtccatcatccttgtgacatgtcatgctcaaaccctcaatacatcaacaacatgtgaaccttctaaatgtggtaacctcaacatcagctaccctttttggaagaaatccaacaccaacgttcaagaattttgcggttaccctgaatttggccttgaatgtttggatgaccaagccatcttgattttgccaactaacagataccaaatgtgttgggacaaccatgtccaagggctcgacacaatgtttccctacacaatctccctttatctttcagctcattag

SEQ ID NO: 109557 - DNA, 354 bp, Glycine max
  Peptide Sequence Number=SeqID_226335
atggattaccaggctttgactatgaagtttgcccaaggtcctcactatattgaactaaaaggagaaacatccactgacccaactcagttgagttacaaccatttgtgcaagcttctcacgagagatcaggtcgcaaagttacgtatcactaaccctgatttgggtgattatacccctctccatcatgcacatgtgcttaatctaacctttcgcccgttattccatgaccatgcattcctattggaggaatcttctcatcatttgttgttggtgaggcctacaaatcattctattccactactccaaaatgttgttcccatcactgtttgcctttacaggaatacaagactataa

SEQ ID NO: 109558 - DNA, 222 bp, Glycine max
  Peptide Sequence Number=SeqID_226336
atgcagaaaggattcgtgcttgattggatgagagctcaggattgtgcagtgtgcgaggagtctaatggctattgcagattcgaccaagccactaagcaatcgaggtgtttatgctcagaaggcagaactgaagccaaaagttgcaaaaaagatttttatattattgaaatctttgctcatattcacaactctactcaattcattgcttttattaagatttag

SEQ ID NO: 109559 - DNA, 144 bp, Glycine max
  Peptide Sequence Number=SeqID_226337
atggatattggtattgggatcccttggtggtgggtccaagcagcatgtctctcagatggaacgacagtgcaagtatcgaaagagaggctatcatatggaagagactcacacttgaaagggaaattattagagtacaagtgtgag

SEQ ID NO: 109560 - DNA, 1140 bp, Glycine max
  Peptide Sequence Number=SeqID_226338
atgaccaactccttcaaagttaaactgggtgaaggtggttttggtgctgtatacaaaggagagctactcagtggttgccctgtggctgtaaagatattgaatgcatccaaaggaaatggcgaagacttcatcaatgaggttgctagcatcagtagaacatctcatgttaatattgtcacacttcttggattcagtttggaaggacgcaaaaaagctctcatttatgagtttatgcccaatggttcccttgacaagtttatttacaataagggtctggaaaccactgcatccttgagttgggataatttgtggcaaattgcaataggtatagcccgaggactagagtacttgcatagtggttgcaacactcgaattttacattttgacataaaaccacataacattcttttggatgagaatctatgtcccaagatatcagatttcgggcttgcaaagctttttcccaggaaagatagcattgtttccctgtcatatgctaggggaacaataggatatgtagctccagaagtgtgcaacaaacacttcggtggaatttcacacaaatctgatgtctacagctatggaatgatgctgctagaaatggtgggagtgaagaagaatattaatgcagaaaccagtcaaacaagtgagtacttcccagattggatatacaaaaggctagagcagggcagagatttgacaactgatggggtgatagccacacaagaaacagagatagcaaggaaaatgactatagtgggtttatggtgtgttcaaacaattccacaagagagaccaacaatgagcaaagtaatagagatgctggaaggcaacatgaattcccttgaaatgcccccaaaatctgttctttcttctccagctagatcggttccagaatttaccactagttcattgcaatctggatcactcaacatgattatgttgtacttttcattcattttgaaacaaagtggatgtcaagcaagcgcaaacaaattgaattcaaatgctagaccaaactgtgtgctatgcttagtgctatgtgagatcaaagttgttgactctgatgaaatctgttacaaaggatggacaagtggcagcaaatgtgtcttcctctttcttgatagtctctcgtcttga

SEQ ID NO: 109561 - DNA, 639 bp, Glycine max
  Peptide Sequence Number=SeqID_226339
atgaatgcatgggtcacaactaaccatattgggctgaggttgttgccttctgtttgggccttatacttcatgcaaacccttagcttcatgcaatactatccctatcattcccgccctcatcgaaaacaccttgtcctcaaggtgttgggggatcagcgcattggttccaaacgtgatactgggatcccaagtcccacaaggaggaacaatgctgaagagcttggtgaagggaatggtggcggaagtggtggcagaggtggcggcggaggcgttgtgactagcagaggtggcggcggaggcgttgtggctggcgaaggtggcctggtcgttaatgcagtgagcgtggatgatggagttggcttgagcagtagaggcgacgatggagtctgcagcggagtcggcatgatggttgccgatggtggtggccaaggtgtcaatggaagtggagaggttgtgttggctgaggggtttcgtatgacgagtagggtgggtggtggtaggcagccatggaagcttcgtatggtgagtggaagccatggaaggcggccatgggaggtcaatgaaagcaccaatgttacgtgcgacggcttggttgctgaacttcgagggtcaacacctccagaagaagaagaaagctaa

SEQ ID NO: 109562 - DNA, 687 bp, Glycine max
  Peptide Sequence Number=SeqID_226340
atgactcttcaaatcttcttccattacaatacacctcaacaatgttgtctttgcattattactactatcttcttcttagctaccagagttctatcttccaatccaaaatttgagccctgtacaccaagaaattgtggaaatggtccacccattaagtatcctttctggattccttatgaacaagaatcattttgtggctactctaacttctcatttactgtggccaacatagatgtctatgaggacaagtgtcctgttcccttagataattacaccttttatcaaactccatttacctaccgttcagaaaattggaatctctccttcttctacaactgttccatagaacctaaaaattaccccactttcgaagtagattgtgctaaaaatgctacacattattctttggcggtttttcataaggaggcactggagcacaaaacctattccttgaatgagtgccagtttatggttaatgtgccattgaacatgaatgctgctattaatttcacaagcttattgagaatgaattaccctgagattttgaagatggggtctcttttgaattggattgcacctgattgccaggaccgtgagaaaagtggtggacgttgtggatctgatggcaatcagttcctctgcaactgcaaggataagtcatacttaaaaagttgtggtagtggctaa

SEQ ID NO: 109563 - DNA, 161 bp, Glycine max
  Peptide Sequence Number=SeqID_226341
ttacggctgttacagagattatgttgaaagtgtgcatagaagaggtgaaggagaatgctggaaataaacctcacaaccacttcactaagcttgcttattggaaagacacaggtcttggcttggatggggagaagaaaaccattgctggtagtgatgaatga

SEQ ID NO: 109564 - DNA, 684 bp, Glycine max
  Peptide Sequence Number=SeqID_226342
atggatgttggttccttacacttttgtagtgcaccagataacaaccccattcacgcatccacaccttactttggagtcattgaagaaatctgggagcttgattatagtaaattcagagtactcatttttaagtgtaagtggattaatggaaatatcagcgtgcgacaaaatgaaataggatttactttggtagaccttgataaggtcgtttataaggatgagcctttcatcatgagtctacgtctaggaggcctaaacagtccacacgactcaagcttgacagctagacagttagataaggccaaggccacattggatattccagaatcatccaatgctaagaagaaggactccttacaagatcagatgacacaaggaagctttgtaccccatggttatcaggatatagagactattggcattagaggagttgagggaggtcctgacgagcaacttgagctagaagtggaagagcctgacttagatatcatgcccacaatggggttgtacgttaatgatgaccattatacccgcctggtagcattgggaaaagtgtatgaaggggcgtcaaccatacaccacatgcatttgaccaatgatgtggtcaaggtggatgttgaagaagttcaagatgttgacgttcaagtcccttttaccactttagagattcaatgtgtggggtag

SEQ ID NO: 109565 - DNA, 237 bp, Glycine max
  Peptide Sequence Number=SeqID_226343
atgaggctaagtcttgaagtgcaaaaggagcagtcatgctcagcagaccattgggctcagcgcgcatccactgctaagcgcagcttcagcgcgcttagtgtgacaagggaatttggtagagcacaagaatcaaggttgtgtgctaagcgcgagatcagcttgctaagcgaaacgtttgtctttagccaggctcagcgcacgactggctccaagcccaaatccacttactcgcactaa

SEQ ID NO: 109566 - DNA, 1544 bp, Glycine max
  Peptide Sequence Number=SeqID_226344
ggcgtgtgtctcgtggcatgaaagttgtgatggcaaccacaaccaaaaacgccaacaccatcaccacatctcaaagtgtgaaggcccttgtgactgtgaagcaaagtgggggtgggattataagaaatcttgtcaatggaggtcttgatgggatcagagaattggttgggaaaactcttgttttggagcttgtgagcgatgagattgattcaaaatcgaactcggagagaaagacaaagaaaagtaatgtgcacaaaacagagacaaaggaggatgaagttctatatgaggccacatttgacttaccagaagctttcgggaatgtgggtgctgttttagtacagaatgaggaccacaatgaggtgtttctaaagagcatagtccttgatggcttccctaatggtcctctgcactttacctgcgattcatggattcagccaaagagtgatagtcctgtgaagagagtcttcttttctgacaagtcatacttgccatcacaaacaccaagtggattgagaaagttgagggaagaggaattgaagcaaaaaagaggaaatggagaaggagaacgcaaaagcactgataggatatacgactatgatgtatacaatgatcttggtgatcctgatagcaacattgacctcaaaaggcctgttcttggcggcaccagacaatatccatatccaagacggtgtcgtactggtcgaaaacactcagaagcagacccttcttctgagaagaaagcatcgaatttctatgttcctcgcgatgagattttttctgagataaagcaaacacagttcacaacaactacaatatcctcagcagtaagtttagttttggaatctttagatgcaattctcactgaccaaagccttggatttgtgagcttcgaagacatagacacgctctataaagaaggatttcacgtgccagcgcttcaagccaatgggaatgcacttcaaagagtaattcccaagttactcagtgttgttaatgataaacagaaccttttgcgtttcgatactccggatgcatttaagagggacagattcttttggttgtcagatgagcaatttgctagggaaactttggcaggtgtcaacccatatagcatccaattggtcaaggaatggcccttgagaagtaaattagatccccaaatctatggtccacccgaatcagctatcactaaagaagtcattgaaccacaaataattggctattgcacagttgaagaggccattaaggagaagaagttgtttatgttagactaccatgatttattcttaccatatgtaagaaaagtgagagaaatcaagggaaccacattatatggatcacgaactctattctttctaactgaacaaagcacattaaaaccattagctattgagctcacaagaccagatatggaaggtaagccacaatggaagcaagtcttcacacctgctactcattcaagttctcatgcaaccaaactctggctttggaggcttgccaaagctcatgttcttgctcatgattctggttatcatgaacta

SEQ ID NO: 109567 - DNA, 170 bp, Glycine max
  Peptide Sequence Number=SeqID_226345
gtgtacacatggctcaggaggaggagacttctacagaccagatcccagagccatccccagcaccaatacctaatgatgccataccatctgcaccagtcacagagcaagagcagcctatccaagattcatcagcagctccagcactggatcttaatgaacatcaaccatag

SEQ ID NO: 109568 - DNA, 1434 bp, Glycine max
  Peptide Sequence Number=SeqID_226346
atggagccacagaacatagacaccgacctcccgagtcttagattcgatttcactgccatcttgttccacatcgacaacacatctttgcaaccgatgaacaccatgaagtcaccaccaacagatgactcccgaaggtcacctaaggcttccgcaatgccaacgacaccaatggcgcggcaacgcatatcaaccatgccaactcttcctcccatggatgtcatatttttgccttcttttgtggcaataccagttcgtccaagacctggtgtttgggaatatcttcaagaagaacttgtcgatggaaagattaatgacaattttgtattggagcttgactttgagccatttaatgccacatttccttgcccattccactccgcatccattggcaatggtgtccaatttcttaatcgccacctctcaccaattatgtttcgcaccaaagattccttgcaacctttgcttgattccctccaagctcacaaatacaagggtcatactctaatgataaatgatagagtacaaaccttttccaatcttcagtctgcattagccatgaccaaggattatctttctaaacttgctagtgatacactctattcagagtttgaatatgtattacaaggaatggattttgagagaggttggggtgatactattgaacaggctcctgatcattatgcactagagacttttcttgggagagagccaatggtattcaacgttgctatattatctcctcatggctactttggacaagccaatgtcttgggtttgcctgacattggtggccaagttgtttatatactagatcaagtgtgtgcccttgaaaatgagatgctccttcagatcaagaaacaagggcttgatttcactcctagaattctaatttttaccaggttaatagccaatgcaaaggggacaacatgcaaccagcggttagaaagagttagtggtactgaccatactcatattttgcgagttcaattcagatcagagttaggaactctcagtaaatggaactcaaggtttcttgtgtggacttatctagagacttatgtagaagctgttgcaagtgaaattgttgctgagttacaagggcatcctacttctatcattggaaattacagtgatgggaatcttgttgcatctttattggcttataaaatgggagttactcggtgcacaatcacacatgcacttgagaagacaaaatatctaaagtcatatttatattggaagaaatttgaggatatatcccacttttcatgccaatttacttttgacctaatagccggatataatgttgattttacaatcaccagtacataccaggagattacaggaacaaaaaatactgtcaggcagtatgagagccacactagttttatcttcccgggctctatagggttatccatggcattgatgttttaa

SEQ ID NO: 109569 - DNA, 1091 bp, Glycine max
  Peptide Sequence Number=SeqID_226347
atgcagactgaagattggaaaaggtttgtactctatcatttatcattagagtatgacccttgtatttgtgagcttggagggaatcaagcaaaggtggcgattaagaaattggacaccattgccaatggatgcggagtggaatgggcaaggaaatgtggcattaaatggctcaaagtcaagctccaatacaaaattgtcattaatctttccatcgacaagttcttcttgaagctgagatattcagaaatgcttaattgctccaggctgaggtcagagacattaacacaaacatattcccaaacaccaggtcttggacgaactgtaaaggaagaagatgagtctctagattcggttgaaaaccatcctggttccctgtgtggtagagatgaaaggctagtgtggaaaatgcagaatcatgaaatgatacaggatgatgttgggtcacaattagcattgaacaagtgtgagcacggtaacgattatggtgaccaccagaggggaaggtgggaaaaaaccatgggaggaagagttggcatggttgatatgcgttgccgcgccattggtgtcgttggcattgcggaagccttaggtgaccttcgggagtcatctgttggtggtgacttcatggtgttcatcggttgcaaagatgtgttgtcgatgtggaacaagatggcagtgaaatcgaatctaagactcgggaggtcggtgtctatgttctgtggctccatcgttatggtctccacaagtggtacacagcctcttcaacgcgtccatggtggtttggtggctgtaatgaacgggcatggtcaaagacagggggcagtcgtcatgggcggcaggaaaactgtgcgtaaaggaggggataaaggttttggtgcaagtgaatccgctaaaattgtgggaagattaggagtggattcagtttttaaaaaagtagggtcagcatgtgctgtggaggaacaagccaaagtactgaagagtgtgaagttagatgcgaaagggaacgctcatgaggcctcgaaaaataataaaggctttgttgttaacaaaaaatggggtgttaagttagtttatggagaaggcaacaagtg

SEQ ID NO: 109570 - DNA, 684 bp, Glycine max
  Peptide Sequence Number=SeqID_226348
atggctgtggcggatccaaatgcaccacatggcctaaagctaacaattgaagattaccctttcgccaatgatggtctccttatatgggatgccatcaaagaatgggtatctgagtatgttaaccattactatccaagctcaagcacaatagagtttgaccaagagctccaagcatggtggacagaaattagaacagttggtcatggagacaaatctgaagaaccatggtggccaaatcttaaaacaccaaaggaccttattgaaatcattacaactatagcatgggtatcatctgctcatcatgcagctgttaactttgcccaatatacttatggaggctatttccctaataggccaacaattgttagaaataacattcctacagaggacccctcgaaggaagagttggaaaaactcataaacaacccggagaaaacatttttggagtctttaccatcacaaattcaagcaactttggtgatggtagttttgaatttattatcgaatcattcgccagatgaagagtacattgggcaatatgtggaacaatcgtgggttgagaatcaaactataaaggcagcctttgaaaggaatggagctggggtggtgccttatgaactaatgaagccattctcagggcctggagtcactggaaagggtgttccatatagcatatctatttaa

SEQ ID NO: 109571 - DNA, 318 bp, Glycine max
  Peptide Sequence Number=SeqID_226349
atggttacctcggaggaaaatgaaagttggaagattccgcttcggtcgaagggttcatctcagtgtggggttgcaacagagaacaacggtggtttatggttgctaacggtggctgtgggtgatggagaaagtacttgggacgttagaaatggctttggaagaaagaaaggaaaagaaatgatatttttcctaagttacacaaaagcaaaggctgaaaacgctcaagtgaggaatggtctgagacacggaaatgtcgcgcacacatcatacatcttctcgaagatcccaacggtcagatcatggaaaagtatcttgtga

SEQ ID NO: 109572 - DNA, 1440 bp, Glycine max
  Peptide Sequence Number=SeqID_226350
atggcgtggatgggggctgaggaaggggttagcactttggatattcagttttcacttaaaattattgaggaaaaaatccaagccgaggcacttccaaatcctgggatgcccactgggaggaaggaagccaaacttttctttgggttttatccctccatgactagagttgccaaggtagtgaaaatctcgacacaagagttggactgggcaaaacaaaacaggaatgaagtagttggagtaccaaggaagtgtttggaggaaaaagcgaaggccttggtaaatcaaggcgaatgggcctctttcattgacatcttggtacttttgatcttcagagtttccctctttccaaatgtggaagggttagtggacctagcagcgattgacgctttcctcgcctttcactatagcaaggaaagctcgatagtttccattttggccgacatgtatgacacgttcgaccggagatgtgaaaagagcagtgccagaattgtttgttgtacgccagctctctacgtatggttgctctcacacctctttcgccaagaaggtaggcccgcctgcccactacaaggtcaccgctcaagtgccgagaaaagaaaggcaaattgggaccaactcttggctagcatggagggggcgtctgttaattggttcccttgctggctaaatcttgaagtgctaaaagtggtagttgcgctcaactcaccatttgggctcagcgcgcatccatcgctaagcgcagcttcagcgctcagcgcacaactggcgctaagctcaaatccacttacacttgctaagcgcgaggcacaaggattggattggctcccaaagctaagtgctgcaagagacaaagaggctgaagctttggaagaaagtgaggaggtacaagccctaaaggtggagcttgaaagagcccgagcagtcaaagagaagttcaaggagtacgatgaactaagggatgtcaatatggccaccaccgaagccttcgaacgagaaaccaagagggcccgaaaggaggaacatggccgaaacaagttccgaggggctttatggggcagcaatagtgagctcaagctccaaagagacgaaagggatcagtcacgggtcgaaggcatgatcttgaaggacaagttaaaggcttaccttaggtcgaaaagaaatttgtcccaacagttaagtgagattgaagggaatatgtgggccatcatcgatgacggaaagggaagcaagggaaaggataatcaactcattgcacaaagaggcaatgatgtggatagaaaaattgcctttactttaaatggaagtcaagagcttccccgactgctagctaaggctaaagcaatggcggatgtgtactcggcccccgaagaaattcatgggctcctcaactattgccagcacatgattgatctaatggctcacataattaggatccgctaa

SEQ ID NO: 109573 - DNA, 228 bp, Glycine max
  Peptide Sequence Number=SeqID_226351
atgttattgatgttccacgctttggaatcggtgtttgtcaaagcctgtgtcagcttatggggccatattggaatcctcttcgatggtgcctgtcataccctaatttcgtctggggatcatccattgttgggatgcgaccctcgtttgaccactttgaggtacttcgcacccatcgttaggcaattcgtgaagttccgtgatatgccggaagtcaaaagaaagcattga

SEQ ID NO: 109574 - DNA, 261 bp, Glycine max
  Peptide Sequence Number=SeqID_226352
atgtttaaaactataatgctcaaaaataggatgttcaaaattaccaaccacaaattgctcaaactcaccaataacagaatgctcaagatgctcaaaaggatcaaagggttgtcagcaaaagtggtcgctaaatcggtcgcaaagcactattcacagcaaaacacaaaaactgaaacaggggaagcgctgaacagaaaaactaaagcaaaacaccacactaaacaaaataacaagacactaaacacactaacacaacactaa

SEQ ID NO: 109575 - DNA, 3204 bp, Glycine max
  Peptide Sequence Number=SeqID_226353
atgttgtctgaattggaaagaagaccaatgcttgggagtaacgagggttcttttggtgatgaactggagaaggagttagggatgttgcttcgtgagcaacgaagacaggaggctgatgatcgcgagcaagagcttaatatttataggagtggatcagcgcctccaactgtggagggttctttgagtgctgttggagggttgtttggtggtgccgctggtgctcctgtcgccttttcggggtttcaagggactaaggatgtgaatttgattgcttctgaggaagagcttaggtctgatccagcgtatctttcatactattactccaatgtgaatttgaatcctaggctgccaccacctttgctgtcaaaggaggattggaggtttcaacaaagacttagaggtggggcctcagttctaggtggaattggagataggaggaaagtgagcaggactgatgacaacagtggaagatcacctttttctaccccaccaggttttaatatgaggaaacaagagggtgaggtggataatgaagaaacaagaggttcctccgagtggggtggtgatggactgattggtttgcctggactagggctgagcaaacaaaagagctttgctgaaatttttcaggtttctttaattccatatcctttttcttctgcacatcatttacaaccagtaattgtgcaggaagatttagggcatattacctctatcgcatgccttccttctcatccagccagtcgagatgcatttgatgacaatgatatcactagttctgctgaagcagagttggctcatgcatgccgcgagtccatggccactgatgcactaaggtctggatcaaatgttcaaggatcatctgcagcccaaaatgttgtcccaccagcttcatattcctatgctgctgcagtaggatcttccttgtcaagaagcactactcctgatccacaacttgttgctagggctcccagtccctgcatcacgcctatgggtggtggcagagccattgcttctgacaagagagctattgtcagtccagatgcatttaatggtgtttcatctggcgtcaatgagtcagcagatcttgtggctgcattgtcagtgatgaacttgtcagcagatgatgtgttagatggtgaaaaccattttccatcacaggttgaatcagatgttgataatcaccagagatatctttttggtaggcaaggtagtcaagatcatgggaagcaacatgcttatttaaagaaatctgaatcagcacacttgcaaaattcaagtaagaacaacaggagtgggtcagatctcaacaatctatccttggataggcaggttgagctacaaaagtctactgttccttccaataactcatatttcaaaggattgtctacctcccattttagtagaggaggaagtatgccaccccagtaccagcctttagatagtacaaattcatcatttggtaactatggtcttagtggctatgctggaaatccagcgttggcatccttgatgactaaccaacttggcactggtaatctgccacccttgtttgaaaatgttgctgcagcatcagcaatggcatcccctggaatgcgctcgagaattcttggaggtggtttggcttctggagctgctgctccatctgatgtgcataatattggtaggatgggaaatcaaattccaggcagtgctcttcaggctccttttgttgatccaatgtatcttcagtacctgaggacatctgagtttgctgcagcacaacttgctgctctcaatgacccctctgtggacaggaactacttaggcaattcatacatgaatttacttgagcttcagaaagcttatcttgggtctatcctctcgcctcagaaatcccaatacaatgtaccgctgggtggtaaatcaggcagctccactcctcatggttattatggaaatcctgcatatggtgttggaatgtcttacccaggaactccaattgcaaactctgttgtgtccacttcgccagttggatctggaagtcctgttaggcacaatgagctgaatatgcgttttgcttctggattgaggaatttagctggggtcatgggaccttggcatgtagatactgggaatattgatgaaagttttgcttcttctctgttggaagagtttaaaagcaataaaacaaagtgttttgagctttctgaaattgttggtcatgttgttgaattcagtgcggatcaatacgggagtcgatttattcaacaaaagcttgaaacagctactacagaagaaaaaaagatggtttatcaggaaatcatgccacatgcccttgctttgatgactgatgtctttggtaattatgtggttcaaaagttttttgagcatggacttgcatcccaaagaagagaattagccaacaaacttcttggccatgttctgacacttagccttcaaatgtatggttgccgtgtcatccagaaggccatcgaagttgttgatctggatcagaagatagagatggttcaagagcttgatggtaacgtcatgcgctgtgtacgtgatcagaatggtaatcacgtcattcaaaagtgtattgaatgtgtccctgaagatgcaatcgactttattgtctcgacattttttgatcaagttgtgacactatcaacccatccatatggttgccgggtgatacagagagtgctggaacattgcgaagaccctacaacacagcagaaagttatggatgaaattttaggagcagttagcatgctagctcaggatcagtatggaaactacgttgttcagcatgtgctggaacatgggaagtctcatgagcgttcttctataataaaggaattagcaggcaagatagttcaaatgagtcaacagaagtttgcctccaatgtagtagagaaatgtttgacctttggaggtccttctgagcgccaattactagtgaatgagatgcttggcaccaccgatgaaaatgagcctcttcaggcgatgatgaaagatcaatttgcaaattacgttgtacaaaaggtgctggaaacttgtgatgatcaacaacgtgagctgattctttcccgaattaaggttcatttgaatgcattgaaaaagtacacctatggaaagcacatcgtcacgcgtgtagaaaaacttgttgctgctggagaaaggagaatagctgctcaggctcctcctcaacctgcttag

SEQ ID NO: 109576 - DNA, 271 bp, Glycine max
  Peptide Sequence Number=SeqID_226354
atggactacggaaggttgggaccctctgatcttggtggctcctcgcgcctcaactctctaagatcttccgggaggaaaaagattgtgttgctgtcactctttgctgtcttaataatagtcgcgtccactgttactgcagttgtcgtccgctctcacactaaaaataccagagcggatggaactagtctcgagaagttcacaaaggcgatttcaagtgagatcgatcgtttcttagcattgtctctttcaagtgggcatctggaaaaggagg

SEQ ID NO: 109577 - DNA, 321 bp, Glycine max
  Peptide Sequence Number=SeqID_226355
atggcggatagcaaaacatggtggaaggccgaaattccaccatataaacacacgccattgtgccttattgcgccgccatggtgggcctcccttcacatattgtctacggtggttggcaaaaaatcagccaagccattccactgtgacagtgccatggctgcttttttttcaacactgacctacatatgtcttccaaagacccctccattcttgagcggtgtctttgcatgtaaacccccacaattcactctaccaccatcacaaccgcaaaggagaaattcttcgccacaaggtatcctaccgaaggaacaaacccaatga

SEQ ID NO: 109578 - DNA, 1611 bp, Glycine max
  Peptide Sequence Number=SeqID_226356
atggttgttaactttggtttccagtggttgaggtggctttgcgattataaacttatggcacgtgttcctgataaaattaagttgatagatggatcaagggaagctcttaagttttctataaggatcactgatctttggttcattgggattcctgaaaagtcagaacaagctaaaatggtggttgttgattctaatggagatgaaatccatgttgtttgcaaacacgatcagctaaagtctcgcaaggctgatttgaaggaaaatttgacttatgtgatgcataattttaaagttatgaagaatgatgggaaattcaaagtttgtgatcatgaatataatttatgttttactggaattactattgttaggcaatctgatatggaacacttaccttttagaaaatttagatttgttgatttttccaatgtcattgctggtcattttcaaactggactcttggttgatgttattgccatggttgatgaagtggtattccgatatgtctcatcgaaaaatatgagggttgttttcaaattaaaggatttgattcgacaagtactatcctacacactttgggaaaattactgcttacagtttttgtcttatttgaatgaggttgaagatgaaaggtcgatcgttattcttttgacacatggcaggatcaaggaagcgcaaggatcatatccgccgtcagtcagtaattctttcaaggcgtctaaactcatgatcaacgagcttgtgctggaaattcaagaatttagagagagccttttagatttagggattgaggttagatcagttttgactcctattggacaagggagttcacaggttttagggtcatctcaattatcatcaaaagatgcatttctgtcaaaggctgaagtaaaaaatatctctcagattaatgccatttgcgaggaaattatttatgttactgtcgccaagattacaactatagtggtggacaactattcatggtgctatccagcttgcggtcaatgttacaaaaaaactgacatagaaactgtgcggttcacatgtccgtgtggcaaagagaacgatcaacctgtactaaggtatagagttgaagtgatggttaatcacaagggtgaacagacgaaatttttgctctgggaccatgaatgtgcagagttaattggtcaatcagcggatgaagatgacgatgttgatttaaatgcctctcctcaagcactagataggctattgggttgtttccttgcattcaaagtgaaggtgcaaccaaggttcaggaattctgttgttcttaaatattcagatgaatcagacttgatcaatgttgtactggatatgctttcgccatgttgcaagatcgagaattcaatacttgagtcaaccgatcctacagagcttgaatctcaatctgtctttgttaacgctgatcatgaccgttcaatgcttgactcaactgagcctacagagcttgaatttcaatctgtgtctgttaccggagatcatgaccctcttctcaggattccattaacaccaactaagcgtgtatctcatgatgagttggatgatgagccaaaaaaactttcagatttcgcctgtccaagtttcctcaaataa

SEQ ID NO: 109579 - DNA, 1146 bp, Glycine max
  Peptide Sequence Number=SeqID_226357
atgacacaaggcaataaatggaaaaaaagtcggaggagactcgttataggcgttacaggtggagcaattgcaggatttttgatatgtattacgattctctgtttgtacaagttaccaacctggaaaggacattttgggttgaacacaaatagtaacaaaaatattgaagctttgctgaaagttcatggtgctataactctaaaaagatataaattgtcaaatgtcaagaaaatgacaaataacttcaaagtaaaactggggcaaggtggttttggctctgtctataaaggaaagctacccaatggcgctcctgtggctgtaaaaatattgaatgcatcaaaaaaagatggtgaagaatttatgaacgaggttgctagcattagtagaacttctcatattaatgttgtcactcttcttgggttcagtttggaaggccgcaagagagttctcatctatgaatttatgcccaatggttcccttgacaagctcatttatagaaaaggacctgaaaccattgcacccttgagttgggacattatatatgaaattgcaattggtatagctagaggcttagaatacttgcatataggatgcaacactcgaattttgcattttgacataaaaccacataacattcttttggatgagaagttctgccccaagatatcagattttgggctagccaagctctgtcctagaaatgaaagcattatttctttgtcagatgctagaggaacaatggggtatgttgctccagaagtgttgaatagacattttgcaggagtttcacttaagtctgatgtttatagctacggaatgatgcttctagaaatggtaggagggaggaagaacactaatgctgaagccagtaacatgagtgagatatacttcccgcattggatatttaagaggctgaagttgggtagtgatttgagactagaagaagagattgcgccagaagaaaatgagatagcaaagagattggccatagtaggtctatggtgcatccaaacctttccaaatgatagacctacaatgagtagagtgatagatatgttggaagtcaacatcaattcccttgaaatcccaccaaaacctttgctttcttctcctaccacatccctaccagaatcttctatttcttga

SEQ ID NO: 109580 - DNA, 729 bp, Glycine max
  Peptide Sequence Number=SeqID_226358
atgagtcccaattcaataatctcttggcacagaattctcataaggagaggccacaacacaaacatcaacataatgctcattttatattcgcaccatggtcaacaacaatcctcaaatgttgttgttgaggtccttgttttttttgctgctgcggtgaaggatatgctctgctgggcttcattgagcagaggatctggccatgaccaacgggggctgttcaagtgtggcaacgacaatattggcaaggtgttggaggttcttggcaatgacgagctcgagggtgatggcattacaaatgtcaagggatttgatgaagtgattgacgagttatgggaggagtttgtcaaggagcttgtgaagccacgcgatggaaagaacgtgccagcgaagtggtcctctgtcgtggaggagaggaggttggagaattggtcactgatgtacttgttaaagagctccaggcctcccatagttctaggtcacgacttccatccatggacatcacttggtttcatattaggcttatttggcccaagaatgaactctggaaaagcaggaaaaatgaatctgctggccagtaagtttcaaaaatcaaaagtgaaacctaggtcatgccatgcgcagcaccacaccctcatgtggatgtctcaaccagatgcttatatgcttccctttataaagataatagggaatgaagaagacaaaacacaattttggactgaatacaactag

SEQ ID NO: 109581 - DNA, 246 bp, Glycine max
  Peptide Sequence Number=SeqID_226359
atggtgggaggaaggaagaatattaatattgaagctagtaaggcaagtgaaatatactttgcacattggatatacggcaggctagagcatggtagagatttaagacctgatgaggtgatagccgtagaagaaaatgagatatatagcaaggagaatgacggtagtgggtctattgatacgaatgtgcaagcatacaaacaagtgcagaagcaggaggcacaacagcaaaacaggaggtgcgggtag

SEQ ID NO: 109582 - DNA, 981 bp, Glycine max
  Peptide Sequence Number=SeqID_226360
atggattaccataatcatatccatatgcatatttctatgctccttatgtccttactcaccgtgtgttgcttattgttaaccactttgccacactctcagtgtcaaccaaccgcttttgattattcaatttgtaagaagcaatcatacaactgcggaaatctgtccaacatatcctatcctttctggggacagaaccgatctcctcaatgtggcagtggcgacccttttgaactcagctgcaatggtgatgataataccacttcaattcgaattggctcactaaattacacagtgaaggagatcaacatcacagctcaaaccatgagactggtgccaacaaacatagttgtcaatgtttgttttccacagtatgaggagacctatgagagccgcattctgttccgttattccccttcagtgtacaacgttaccatattctacaactgttcccgcatccaatattttccttatggatacttcaggtgtgggaatgcaatctcttattttgcgcgcgcatatgatcggctgttcaccgattatccacagcttcagaagtgcaagagaagtttaaatgtgtcggctgttgctcaattggattttaagggtggtggagattttgctttgaaaaagagtctcaatgaagggtttgaggtcaactataatgtttctcaacattgtcaaagatgcctgggaagtgaaggacattgctggagatatggtattgaaaaacatgtactttcatgctactattgcccaaatggaactcatgccctacactgttctcctcgtcctcccaaaaccatggccagcactaacagtacgtcttctattctctctcctctttcttcaatttctctcgtctcatcacctcgatccaaacttgttagtgtgtgtttgtgtctccgttggcttcaatgcaatggaagttgctttggaaattttgcagtagaaagtttagtttgccctttcaacacgatttga

SEQ ID NO: 109583 - DNA, 318 bp, Glycine max
  Peptide Sequence Number=SeqID_226361
atggtgttgctcttttacctactagtgtggattattgattgtgttgatggtgatgaaaatgttggtacccgtgccggtgatagagttggcgataaagaagttgatggtggtggtgataaaaatgttgatggtgttggttgtattgatatagatggcggcgatgttgattgtcgtggtcttgattgtgatgatggtgagacaactgttacatttgcagttgccgttgccgttgctgttcctggtcctgttgttgttactgttgctcttgctcttgctgttgctggtggttgtattaaaaaattagtaatacatgggtaa

SEQ ID NO: 109584 - DNA, 849 bp, Glycine max
  Peptide Sequence Number=SeqID_226362
atggagggagtgttgcttcccgtgtgtccttcaccttcttcttgctctgcaactcctaaacccagaatccccattccgctacgctcttctttcccttctccattattacacaaccgtttcttctcccaaaacgcagcgttttcccttcgcaactctctccgcacttccaccttcgcactcgcgcaacacgaagctcccgttctgggcaaacccgataacaacaacaactcttcaccctatcttcccaaaatcgataagacgggacgcttctgcagccccagagccgccagagaactcgcactgtcgataatctatgctgcgtgcttggagggaatggacccggttcggctctttgagaaacggatgaatgcgcggcgagaagccggatataaatttaatgaggaaaagttgttggagtataatcatatgagtttcggagggccgcctgttactgttggatcggacgaagaagcaaatgagctactgcggcacattgaagaagagtctgccattgttgttggggatgaaagtcaatcgtgtctttattttgtgtttctcttgctacccaggatggaaaaagcagaagtccttacagctcctccaaagctggtatacaacaaactgattttaagattcaccaagaaactattggttgcagtcagggatacatgggacagtcatgtcctggtcattaacaaaattgccccacaaaattggaagtcaaacctccctgtaaaagggcaaatagataaagtcaatgttgaaacttatttgtcccctgatatatttgtcatccttaggaacaacccaatagttgaatataaagacagaaaatgcctatatgagtag

SEQ ID NO: 109585 - DNA, 1773 bp, Glycine max
  Peptide Sequence Number=SeqID_226363
tttcgagacggcaacgtgttgcagcagggcctcgaccgacacgtgcatcacgtcggtgaagggcttgggatagatccccatgtacagcacggcgatcgccatcacgccaagaatcacgaattcgcggcggttgatatcggtcagctcgcggacgtggtcgttggcgacgtcgcccaggaccacgcgcttgaccatccacagcgaatacgaagcgcccaggatcagcgcggtggccgccagcaggccgatccagaagttgtgctcgaccgcgcccatgatcaccatgaactcgccgacgaaaccgctggtggccggcaggccgctgttggccatcgagaacaggatgaagaaggtggcgaagcgcggcatcacgttgaccacgccgccgtagtcggcgatgcggcgcgagtgcatgcggtcatagagcacgccgatacacatgaacatggcgcccgagacgaagccgtgggagatcatctgcacgatggcgccttcgacgcctgccgtgttgaagatgaagaaacccagggtgacgaagcccatgtgggcgaccgacgaataggccaccagcttcttcatgtcgtcctgcacgatcgccaccaggccgatgtagatcacggcgatcagcgacagcgtgatcatcaggcccggccaggctgtgcgaggcgtcgagcgcgatcggcagcgagaagcgcaggaaccgtaggcgcccagcttcagcatgatcgccgccagcacgatggagccgccggtgggcgcctcgacgtgggcgtccggcagccaggtgtgcaccggccacatcggcaccttgaccgcgaaggccgccagcagcgccacgaagatcaggatctgcggggtgtagcccagcttggtctgctgccaggtcaggatgtcgaacgaaccgcccgaggcattccacaggtagacgaacgccacaagcgtcagcagcgagcccatcagggtgtagaggaagaacttgaaggccgcgtacacccggttcggtccgccccagacgccgatgatgatgtacatcgggatcagcgtggcttcgaagaacacgtagaacagcatgccgtccagcgcgcagaacacgcccaccatcagacccgacaggatcaggaaggcggccatgtactgcgacacgcggctggtgatgacttcccagccggccagcaccacgatgatggtgatgaacgcggtcaggagcacgaaccacagcgaaatgccgtccacgcccaggtggtagttgacgttgaaggcttcgatccaggaggtcttctcgacgaactgcatggcagccgtcttggagtcgaacccggtgtacagcgggatcgtgacgaggaagccggcgatcgagccgatcagcgacaggccgcgcgtcaggccgggacggtcgtcacggcccaccgccagcaccagcaggccgaatacgatcgggacaaagatcgcaagcgtgagccaggggaaagtcacaaagaaagtcaccagcgccatgatgccgatgatcatcgcgaacgcgtagtgatagatgaagccggactgcaggtggcggctgatcgccgacacccagcccaccacgcgggcgctgccgttgatcagcaggccgtcgatgatgccgcggtcgccggtctgccacaggccacgacccaggcagcgcaggccgcgggcgatgatctgctcgttgacccagtcgacgtagtacttgttctcaagcaccttgttgacgcccgacaggctcgacttgatcgcggccgggaccttcgggttgatcag

SEQ ID NO: 109586 - DNA, 2574 bp, Glycine max
  Peptide Sequence Number=SeqID_226364
atggttagatttttcgctgtatctgctgcagggaaattttccactgcaaaggattcatgccatcagtttgatgatttggggcataatacctctatcagacgacttccttctcgtccagccagtcgtaatgcatttgatgacaatgatatcattagttctgccgaagcagatttggctcatgtacaccgcgagtccgcacccactgatgtgttaagatcaggatcaaatgttaaaggatcatctgcagcccaaaatgttggcctaccagcttcatattcttatgctgctgcagtaggatcttccttgtcaagaagcgctacgcctgatccacaacttgttgctagggctcccagtccctgcatcacacctattggtggcggcagagccattgcttctgacaagagagctattgcgagtacagatgcttttaatggtgtttcatctggcatcaatgagtcagcagatcttgtggctgcattgtcagtgatgaacttgtcaacagatgatgtgctagatggtgaaaaccatttgccatcacagattgaatcaggtgttgataatcaccagagatatctttttggtaagcaagatcatgggaagcaacatgctttttcaaagaaatctgaatcagcacacttacaaaattcaagtaagaagagcaggagtgggtcagatctcaacaatccatccttggataggcaggttgagttacaaaaatctactgttccttcgaataactcatatttcaaaggatcgcctacctcccattttagtagaggaggaagtatgccaccccagtaccagcctttagatagtacaaattcatcatttggtaactatggtctgagtggctatgctggaaatccagcattggcatccttgatgactaaccaacttggcactggtaatctgccacccttgtttgaaaatgttgctgcagcatcagcaatggcagcccctggaatggactcgagaattcttggaggtggtttggcttctggagctgctgctccatctgatgtgcataatcttggtaggatgggaaatcaaattccaggcagtgctcttcaggctccttttgttgatcccatgtatcttcagtacctgaggacatctgagtttgctgcagcacaacttgctgctctcaatgaccctgctgtggacaggaactacttaggcaattcatacatgaatttacttgagcttcagaaagcttatcttgggtctatcctctctcctcagaaatcccaatacaatgtaccgctgggtggtaaatcaggcagctccactcctcatggttattatggaaatcctgcatatggtgtcggattgtcttatccaggaactgcaatggcaaactctgttgtatccacttctccagttggatctggaagtcctattaggcacaatgagctgaatatgcaatttgcctctggaatgagaaatttagctggggccatgggaccttggcatgtagatactgggaatattgatgaaagttttgcttcttctctgttggaagaatttaaaagcaataaaacaaagtgttttgagctttctgaaattgctggtcatgttgttgaattcagtgcggatcaatacgggagtcgatttattcaacaaaagcttgaaacagctactacagaagaaaaaaacttggtttatcaggaaatcatgccacatgcccttgctttgatgactgatgtctttggtaattatgtggttcaaaagttttttgagcatggacttgcatcccagagaagagaattagccaacaaacttcatgggcatgttctgacacttagccttcaaatgtatggttgccgtgtcatccagaaggccatcgaagttgttgatctggatcagaagatagagatggttcaagagcttgatggtaacgtcatgcgctgtgtacgcgatcagaatggtaatcatgtcattcagaagtgtattgaatgtgtccctgaagatgcgatccactttattgtctcaacattttttgatcaagttgtcacgctctcaacccatccatatggttgccgggtgatacagagagtgctggaacactgcaaagaccctacaacacaacagaaagttatggatgaaattttaggagcagttagcatgttggctcaggatcaatatggcaactacgttgttcagcatgttctggaacatgggaagcctcatgagcgttcttctataataaaggaattagcagacaagatagttcaaatgagtcaacagaagtttgcctccaatgttgtggagaaatgtttgacctttggaggtccttctgagcgccaattactagtgagtgagatgcttggctccacagatgaaaatgaacctcttcaggcaatgatgaaagatcaatttgcaaattatgttgtacaaaaggtgctggaaacttgtgatgatcaacaacgtgagctgattctgtacagaattaaggttcatttgaatgcattgaaaaagtacacctatggaaagcacatcgttgcacgtgtagaaaaacttgtagctgctggagaaaggagaatagctgctcaggctcctcctcaacctgcttag

SEQ ID NO: 109587 - DNA, 2562 bp, Glycine max
  Peptide Sequence Number=SeqID_226365
atggtttatttattttcctatcattttccttctgcccatcatttacaacgagcaattgtgcaggatgatttggggcataatacctctattgcacgccttccttctcgtccatccagtcgtaatgcatttgatgaaaatgatatcagtagttctgctgatgcagagttggctcatgtacaccgtgagtccacacccgctgatgtgctcaggtcaggatcatctgcggcccaaaatgttggcccaccagcttcatattcctatgctgctgcagttggatcttccttgtcgagaagcactactcctgatccacaacttgttgctagggctcccagtccctgcatcacgccaattggtggtggcagagccattgcttctgacaagagagctattgccagtcaagatgcatttaatggtgtttcatctggcattaatgagtcagcggatcttgtggctgcattgtcagtaatgaacttgtcagctgatgatgtgcttgatggtgaaaaccatttgccatcacaggttgaatcagatgttgataatcaccagagatatctttttggtaggcaaggtggtcaagaacatgggaagcaacatgcctatttaaagaaatctgaatcagcacacctgcaaaattcaagagcaagcagcaggagtgggtcagatctcaacaatccatccttggataggcaggttgagctacaaaagtctactgttccttccaataactcatatttcaaaggatcacctacctcccattttagtagaggaggaagtatgccaccccagtaccagcctttagatagtacaaattcctcatttggtaactatggtctgagtggctatgctggaaatccagcattggcatccttgatgactaaccaacttggcactggtaatctgccacccttgtttgaaaatgttgctgcagcatcagcaatggcatcccctggaatggacttgagaattcttggaggtggtttggcttctggagctgctgctccatctgatgtgcataatcttggtaggatgggaaatcaaattccaggcagtgctcttcaggctccttttgtcgatccaatgtatcttcagtacctgaggacgtctgagtttgctgcggcacaacttgctgctctcaatgacccctctgtggacaggaactacttaggcaattcatacatgaatttacttgagcttcagaaagcttatcttgggtctatcctctcgcctcaaaaatcccaatacaatgtaccgctgggtggtaaatcaggcagctccactcctcatggttattatggaaatcctgcatatggtgtcgggatgtcttacccaggaagtccaatggcaaactctgttgtatccacttccccagttggatctgcaagtcctgttaggcacaatgaactgaatatgcgttttgcttctggaatgaggaatttggccggggtcatgggaccttggcatgcagatactgggaacattgatgaaagttttgcttcttctctgttggaagagtttaaaaccaataaaacaaagtgttttgagctctctgaaattgcgggtcatgttgttgaattcagtgcggatcaatatgggagtcgatttattcaacaaaagcttgaaacagctactacagaagaaaaaaacatggtttatcaggaaatcatgccacattcccttgctttgatgactgatgtctttggtaattatgtggttcaaaagttttttgagcatggacttgcatcccagagaagagaattagccaacaaacttcttggtcatgttctgacacttagccttcaaatgtatggttgccgtgtcatccagaaggccattgaagttgttgatctggatcagaagatagagatggttcaagagcttgatggtaatgtcatgcgctgtgtacgcgatcagaatggtaatcatgtcattcagaagtgtattgaatgtgtccctgaagatgctatccactttattgtctcaacattttttgatcaagttgtgaccctatcaacacatccgtatggttgccgggtgatacagagagtgctggaacattgcaaagaccctacaacacagcagaaagttatggatgaaattttaggtgcagttagcatgttagctcaggatcagtatggcaactacgttgttcagcatgtgctggaacatgggaagcctcatgagcgttcttgtataataaaggaattagcaggcaagatagttcaaatgagtcaacagaagtttgcctccaatgttgtagagaaatgtttgacctttggaggtccttctgagcgccaattactagtgagtgagatgcttgggaccaccgatgaaaatgagcctcttcaggcgatgatgaaagatcaatttgcaaattacgttgtacaaaaggtgctggaaacttgtgatgatcaacaacgtgagctgattctttcccgaattaaggttcatttgaatgcattgaaaaagtacacctatggaaaacacatcgtcacgcgtgtagaaaaacttgttgctgctggagaaaggagaatagctgctcaggctcctcctcaacctgcttag

SEQ ID NO: 109588 - DNA, 711 bp, Glycine max
  Peptide Sequence Number=SeqID_226366
atgaccaaccaagatataatagtagctaaagttttcaaagtcaaatatttcccaacggtggatttcttggaggctcaacttgggcacaatccaagctttatatggcgtagtatccatgcttcatgggtagtggtggaagaggggttgcaatggaggattggagatgataattctattattgcttggacccaaccttggctaaagtatggtgagaattcttgggtgtcatctaactatcatgatgggcagggggcagagggagtggggtggcctaaggggctcatggccacccccacgggacatgatgaaagtgtgggatctggaaaccgtggtaactttcttgaaatgataaagctcttagcttcttataataaggaaatagatgaaattatctcggaaaacgtccctcaaaatgtaagatacatttcactcactatccaaaaagatattctatatgtctttgctagaaaggtgcaagatgaaattcaagaagagattggtaatgcaaaattttgtttcattgttgatgaagcccatgatgaatctaaaagagaacaaacaactctagttcttagatttgttgataagaatggatatgttaaggagcattttttggatatgatacatatgcaagatactacatcatccattcttaagcatgggatatgttcaatattgtctcatcataatctcaacattcaaaatatatga

SEQ ID NO: 109589 - DNA, 228 bp, Glycine max
  Peptide Sequence Number=SeqID_226367
atgaagagcaattactgcttacacaggaagggggatccctcctcctcttcctggcacctcacaatcactcaaacactctcaaatggctccttgctgttgcttcctcctctgagctctaaaatcgcgtcatcgcgcttagcgccattgtcgcgcttagcgcaagtaagtggatttgggcttggcgccaatgcttcactgagcctagcaagagacggacgactcgcttag

SEQ ID NO: 109590 - DNA, 234 bp, Glycine max
  Peptide Sequence Number=SeqID_226368
atggcaggggaagaaatggtcaagagattatatgaaacatctgcggtgaacaacaacgatagtgaaacttgttcaaccaatgcaacaatagctacaatctcatttcggggtgtcattcccagtgaggtcgagtgtgatagcgaagatgaggacacacaatggcaagggaatggagttgaaggagttggtgaggaggaggtgggagaggttgggtgtgacaacgagggcacgtga

SEQ ID NO: 109591 - DNA, 1320 bp, Glycine max
  Peptide Sequence Number=SeqID_226369
atggaagccgtccaactcatgtccaccacaacaatcaaggcgtcgagtaacaattacaacgataactcagttcagaaaatcgatttaactccgtgggatctccaattcttccatattggaagcatccaaagaggacttctttttcgcaaagaaaaaaacacagaatattgtcaaatcgagcatctccaacactcactttcatccactctcgcattctttccactcctcgctggccgtcttgccattctcgaacatcacgacaacactgtctcctctcacatcgtatgcgacaacaaaggtgtcccttttgtccacgccgctgcacacaacaccactgtggccgacatccttcaacccaaatacgttcctcccattctccgatcgttcttcgcacttaacggagttaagaactacgaagccacgtcacaaccagtgctggcagtgcaagtgacagagctatttgatggcatcttcattgccctctcaatcaaccacgtcgttgcagacggcaagtcgttttggcttttcgtcaattcctgggctgaaatttcacgtggttccctcaaaatatccaaattcccttctctaaaacgttgctttttggatggcgttgaccgccccataaggtttctgttcacaaaggaattagaaaaagaaccgtccaaaaaccttcaaccacaaactcgacctgtgagggtcttccacttcacgaaggaaaaaatcgcggatctgaaatcaaaagctaacgcagaggccaacacggacaaaatatcttctctgcaagcgctattagctaacctttggcgttctgtgattcgctgccaacatgttgagccacatgaagagattcagtttacaatgcccgttggcgttagaccaagggtagttccgccactgccagaagattatttcggaaacgcagcactgattggtcgtgttaccatgaaagcgggagaactattacaaggtgagcttggaaagattgctttggagattaacaagatgatttcttcgcaatctgatgagaaggtaaagaaccactatgagtcttgggcgagaacaccacggcagcgtggcgtggcttatagtaataccttaaacgttggcagttccccaaggttcaatatttacggcaatgattttgggtggggaaagcccatggcggttcgaagtggcggtgattttatgtcgtattccattgtttttttgtttgctggctttgaagaaggttctattgacattgaagtgttccttccttatgagattttagaggccatgggaaacgaccctgagttcatgcatatatgtcattctgaatga

SEQ ID NO: 109592 - DNA, 3066 bp, Glycine max
  Peptide Sequence Number=SeqID_226370
atgggctctagtaagcagtctgctggtattcttgatacgctgaaaatggagagggttagaactattctaacccacacttatccttaccctcacgaacattcccgccatgctgtaattgctgttgttgtgggttgcctctttttcatctcatctgacaatatacatacccttgtagaaaaattagacaaaaatgttaaatggtggtctatgtatgcctgcttgtttgggttcttttatttcttttcatcaccatttataggaaagactttcaaaccaagctattcaaatttcagtcgatggtacatagcttggattttagtggcagctgtgtatcatcttcctagctttcagtcaatgggagtggatatgaggatgaatctatctttatttttgactatatatctatcttccatcttgtttcttcttgtttttcacatcatatttcttggtctctggtatatcggctttgtttcacgtgtggcgggaaagagaccagaaatcttgaccattcttcaaaactgtgcggtacttagcgtggcatgctgtgtattttatagtcattgtggtaaccgtgccatgttaagagagagaccacttgaccgaagaaattctaactggttttctttctggaaaaaagaggagaggaacacatggcttgcaaagtttcttcggatgaacgaattgaaagaccaggtttgctcatcttggtttgcaccagttggatctgcaagtgattatcctctcttgtcgaagtgggttatttatggcgagatagcttgcaatggatcatgtcctggttcatcagatgaaatttctcccatctactcactttgggctacatttattgggctttacattgcaaattatgtggtggagaggtcaacaggatgggctctcactcacccattatctgttaaagaatatgagaagttgaagaagaaacaaatgaagcctgattttttagacatggttccttggtactctggaacatctgctgatttattcaaaacagtttttgacctcctggtatcagtgactgtcttcgttgggcgttttgacatgcgtatgatgcaggctgcaatgagtagggttagtgatggaaatcatcaagatgatcttctatatgatcattttagtgagaaggatgatttttggtttgactttatggctgataccggtgatggtgggaactcatcttatgctgttgcacggctacttgctaagccttttattcggacactgaaagatgattctgagcttaccttgccacgtggaaacttgctaattattgggggtgatcttgcgtatccaaatccatcagcattcacatatgaaaggcgtctttttgttccttttgaatatgctcttcaacctcctccttggtataaagcagagcagattgctgtgaacaagccggaggtaccctttggggctcaattaaaacagtacaatggacctcaatgttttgttattcctggaaaccatgactggtttgatggactccagacctttatgaggtatatatgtcatagaagctggttaggtggatggctcatgccccagaagaagagttattttgctttgcaactcccaaaacggtggtgggtttttgggcttgatctagctcttcatggtgatattgatgtgtaccaattcaagttcttttcggaactgataacagagaaagttcaagacgatgactctgtgatcattattactcatgaacctaattggctcactgactggtattggaatgatgttactggaaagaatatttcacaccttatttctgattatttaagaggaagatgtaagcttcgaatggctggggacttgcatcattacatgcgtcactctcatgtaaagtcagatgggcctgtacatattcaccatcttcttgttaatggttgtggtggtgcatttctacatcctacccatgttttcagtaaattcaacaaacttgatgaagtttcctatgaatgcaaagctgcatatccttcctttgaggattcgagcaggattgcattgggaaatatcctaaaatttcggaaaaagaactggcaatttgattttattggtggcattatatattttgtattagtcttttcaatgtttccacaatgtgagctgaatcacatcctccaagatgatacattttctggtcacataaagagtttccttggtactgtgtggaatggatttatatatattctgcagcactcttgtgtgtcactagcgggagctatactattactaattgcggcatattcttttgttccacccaaattgtcacggaagaaacgagcaataattggagttcttcatgtttctgctcaccttgcagcagcactgatacttatgttgcttcttgaaataggtgttgaaatatgcatccagcataagttgctagcaacttcagggtatcacactttatatcagtggtatagatcagtggaaagtgagcactttcctgatccaactggactcagagctcgtatcgaacaatggacatttggactttatccggcatgtatcaagtatttaatgtctgcttttgatgtgccagaggtcatggcagtctcccggaacaatatttgccagaatggattagaatctatttcccgagggggtgctgtaatatattatgcttctgtcttcctttatttttgggtcttctcgacccctgttgtttccttggtgtttgggagctacttatacatttgcatcaactggcttcacttacactttgatgaagccttttcgtctcttcgaatagctaattacaaatcattcacacggtttcacatcaattcggatggtgatcttgaagtttatactttggctgttgataaggttccaaaggagtggaagcttgatcctgattgggatggagagacaaaacatccacatgagttgagtcatttaagaaggtttcccagcaaatggagggcagccattgcccacctggatccagttcatacggttaaaattgttgaccatttcgttattggacgcacagataagaatgactgtgctactactgcacctaacgggccagttcaatga

SEQ ID NO: 109593 - DNA, 1091 bp, Glycine max
  Peptide Sequence Number=SeqID_226371
cgaggaagcggaagagcgcccaatacgcaaaccgcctctccccgcgcgttggccgattcattaatgcagctggcacgacagcggataacaatttcacacaggaaacagctatgaccatgattacgaattcgagctcggtaccctcttgtgatgtttcttgtctaggcaaactgcgggatgggcgttctgttgcagtgaagaggttgtatgagaacaactttaagagagttgcacagttcatgaatgaaattaaaatcctagcaaatttggatcatccaaatcttgtgacattatttggatgcacctctcgccacacccgtgaacttctgcttgtatacgagtacattcctaatggaaccattgccgatcatcttcatggtcaacgatccaaacctggaaaactctcttggcatattagaatgaatattgctgtggagaccgcaagtgcattgaaatttcttcatcaaaaagacataatccaccgagatgtgaaaaccaacaatattcttcttgacaataacttttgtgtaaaagtggccgattttggactctcacgtcttttcccagatcatgtcactcatgtttcaacagctccacaagggactccaggttatgtggatcccgagtaccaccagtgctatcagcttactaaacaaagcgatgtctatagctttggagtggtgctggttgagctgatatcgtccttgcctgctgtagatattacaaggcatagacaagaaatcaaattgtccgacatggccatcaacaagattcatagtgaggcactgcatgagctagtggaccctagccttgggtttgaatcgaatttcaaggtcaggaaaatgataaatgctgtggcagagttagcatttcagtgcttgcagagttccaaagagatgaggccttctatggaagaagtggcagacactctcaaggatatacagagtgatggcaaacataaaagccagcctgaggtaatggatatcacaagcacagctgatgatgttgtgttgctgaaggatgaccctcctccaccatcacctgattctaatgcggtgagcaagttgacaacaccaaatgctagcggataa

SEQ ID NO: 109594 - DNA, 1242 bp, Glycine max
  Peptide Sequence Number=SeqID_226372
atgaaatacattgttgttgtcattggccaatcagaacatgacacgtgcaacaacacagacacaacaagtaaaaatactaccaagattgggacgatcaacaacactgccaccattatcgccaccaccaacttttttatcgccaactgggtcaccagcacaagtaacaacattttcgtcaccatcaatactaatacgagtgtcagatacaagttattaatccaaccaatcaaactttgttcgaccacaaagagtgatcaagacattgaagcattcttaaaaaataaaggagctgtagcacaaaaaagatacaaattttcagaagtcaagaaaatgaccaattcctttaaagttaaactgggtcaagggggttttggtgccgtatacaaaggacagctacccactggttgtcctgtggctgtaaaattattgaactcatccaaaggaaatggtgaagaatttaccaatgaggttgctagcatcagtagaacctctcatgttaacattgtgacccttcttggattttgtttgaaaggccgcaaaaaagctcttatctatgagtttatggccaatggttcgttggacaagtttatctacaacagaggaccagaaaccattgcatctttgagatggcagaatttgtatcaaatctcaatagggatagcgcgaggattggagtacttgcataggggatgcaacactcgaattctacattttgacataaaaccacataatattcttttggatgagaatttttgccccaagatatcagattttgggctagcaaagctctgtcccagaaaagagagcattatttccatgtcaaatactagagggacactggggtatgtagctccagaaatgtggaatagacatttcggtggagtttcacataagtctgatgtttatagctatgggatgatgttgctagaaatggtaggagggaggaagaacattgatgctgaagccagtcgcacaagtgagatatacttcccgcatttggcatacaagaggctagagttggacaatgatttaagaccagatgaggttatgaccacagaagaaaatgagattgcaaagagaatgaccatagtgggtttatggtgcattcaaacatttccaaatgatcgacctataatgagtagagtgatagaaatgttggaaggcagcatgaattccttggaaatgccaccaaaacctatgctttcttctcctactagatcggcaacagagtcttcctcttga

SEQ ID NO: 109595 - DNA, 1113 bp, Glycine max
  Peptide Sequence Number=SeqID_226373
atgacgttcctagaagactttagtcatgatagtttaatgatcgactccctctttgcacttgctacttctttatgcagatataggtcattaaccggactattcaaattttgtttgaccacaaagagcaaactagatattgaagcattcttaaaaattcatgttgtatcattgcaaagatacaaattttcagaagtcaagaagatgaccaattccttcaaagttaaacttggtcaaggtggttttggtgcagtataccaaggaaagctacacactggttgccctgtggctgtaaaattattgaatgcatccaaaggaaatggtgaagattttatcaatgaggtttctagcattagtaaaacgtctcacattaatattgtcacacttctgggattttgtttgaaaggccgcaagaaagctctcatctatgagtttatggccaatggttcgttggacaagtttatctacaacagagggccagaaaccattgcatctttgagatggcagaatttgtatcaaatctcaatagggatagcgcgaggattggagtacttgcataggggatgcaacactcgaattctacattttgacataaaaccacataatattcttttggatgagaatttttgccccaagatatcagattttgggctagcaaagctctgtcccagaaaagacagcattatatctatgtcagatactagagggacactggggtatgtagctccagaaatgtgcaatagacattttggtggtgtttcgcacaaatctgatgtttatagctatgggatgctgctgctagaaatggtaggagggaggaagaatattaatgctgaagctagtcatacaagtgagatatacttcccgcatttggtatacgggagacttgagttggacaatgatgtaaggccagatgagctaatgaccgcagaagaaaatgagattgcaaagagaatgaccatagtgggtttatggtgcattcaaacatttccaaatgatagaccaactatgagtagagtggtagatatgttggaaggcaacatggattccttggaaatgccaccaaaacctttgctttcttctcctactagatcagaaacagaatcttcctcttga

SEQ ID NO: 109596 - DNA, 729 bp, Glycine max
  Peptide Sequence Number=SeqID_226374
atgaaagttatttctctggtaccctctattacggaggctctatttgatttgggtttaactgaagatgagattatcggaagaacaaaattctgtattcatcccaaagacaaaatcaaaaacgttcccgttatcggtggaacaaaaaatctgaatatcgaaaagattaaaggcctgcaaccagaccttatccttgccaataaagaagaaaacatcaaagaacaggtagaagctttgatggaagatttcaaagtggttgtaaccaacgttgaaactattgaagacaattattatctactgaaaactctgggcaatatctttcaaaaagaagaaagggctaaagcctataatctaaagatctacgaggttttaaatcagactaaaatcagctctaagatcaaggctgcctatctcatctggaaaaacccttatatgacagtaggtgcggatacttttattcactggatcttgacggaaataggttttgaaaacagctttaaagataaaacccgctatccggaggtaaccattcaggacctggcagatacagacctgatcatgctttcttcagaacctttcccttttaaagaaaaacatattgcagaattaaaggaatattaccctgataaaaaaataatcatcgtagatggagaagctttctcctggtatgggacccatattgcaaaatgtggaaactactttaaggaactggtggctgaaattgatttataa

SEQ ID NO: 109597 - DNA, 460 bp, Glycine max
  Peptide Sequence Number=SeqID_226375
tatacagttattggtaattcccattgtgcctctcttcagatatcatgccatagccattagagtgtacttgcttcatgaggccttcggtgaaagaaaaattaattggaaggtgaaactcattataggtgttgtttctggagtggtgggggcacttgctgtgggcattatcggctatctctgttatcgtaaaaagaagaatcgttatacaatgtcatatacacaatctcggagcctctcttctgatccatcttcaaaagacactgagaagggaattcaacgctttactcaaagctttgtacctggagtgcacctcttcacatatgatgaacttgaagaggccacaaattactttgactcatctaaagaactaggagaagggggctttggaacagtgtattttggtaaaagcaaaaaccctttgttgtatctctgtcgtttttgtgctttcgatgaccattaa

SEQ ID NO: 109598 - DNA, 840 bp, Glycine max
  Peptide Sequence Number=SeqID_226376
ggcaggagactgttcggcatttttttagagcaggaggcgcttcgggtacaatcgctaaggcgatgtctgcttatgacaaagattttagtgatgcgatctatggaaaagaagctaaaaacaggtatgtaactcagaacagacttcgtaaaatgcttcgctatgaagttgccttgatcgaagaaaggatttccagggaaaacagcccgaacagaaaatttttttcctatgccaatacggtaacaaccatcaattttgataaaacgcttaaaggtcacggttgggtaggaatccgttttcaggtaaaagaaaacgaaggttataacgaaatcgttatccacgtaaagtttaaagagaatgatgctacattacagcaggagactcttggaaatttaggagtaaatctgatctttggagcttttacatattatgataatccacgaaccttaatcgagtcattatatgatgacatagcgaccgacaatctggaaattgatatgatagatttcagcgggccggcgtttgattatgtggataacaggctgatgtctttacagttggtgaaaaacaatatgacggatgccgttatttttaatagccagggtaataacatgcttcctgcagatattttatacaagaagaatatctttgcggtaagaggaagtttcaggccggtgaccaaagtgaatattgatatgctgcaaaacggtattgatctatttatgaaggatgctgcctgtacggaagaacaaacggaaatcctgattgaaattaccatttccaaccttcgtgctgatggtgatatcgatgaaagagactttatggacagggtggatatcctcg

SEQ ID NO: 109599 - DNA, 3555 bp, Glycine max
  Peptide Sequence Number=SeqID_226377
atgtatcggttctgtttcagaacccgaccccttcttcgcaacttttcttcttcaagaaaacctatcgccaattcaactttagaaaattcccaaattgcccctccgccaatcctcgataaccgccgcacgctctctcccgttcattccaaatctctctctcgcacctctgtcgtcgctctctccgctgccgctatctccgccgtagtcgcctccgccgcgctcctctccgattccgatcgcggcggaggaggcacgaatcctctgcacgagggcgcggagcgcgccgcgcgcaaggcggcggactccttcgaccggattttccaccacgcgaagcgcaccggcgtcgccgccgcggtcctctggcagtcgctgcgctcggtgctatcctcggcgaaccacgaggtccgctccggcttcgagattcgcgtcgcggcgcttctcgctgacatcgccgccgcgaactccgcccgcagggccgcgatcgtcggggcaggaggcggcgccgtcgtggactggctgctggagtcggtggcggcggcgaaggacggcggcggcacccaggcggagtacgcgagggcgctggcgtatctgattgcggaccctaacgtgtctgcggcggttcttgggagacctcacgcggttccgagtcttctgaggttcatcttctcgtgccagcctcggcgttctaagaatacgaagcagcattcaagacgtggtgcatttgatatttcggattctttgaaaggcaggagcatgcttgttgctgccattatggatatcgttacgtccagctgtgaaaatgcagaagaggtatcttttaagccatcattgcctgaaaatgctgaaaccagagacattgctgcagccctagaagttattgaggaaggaggtttgcacttggatgagccacctgaaggtgaagatgatggtggtgggtcgggaaggaaagggattggaatcaagatacttgatggtaaacctgttttagggctttcaaggaccagcaatgatgcctgtcacgaagaactaaagcaccaatctcctaaaactctcatatatcaaaataagtatgacaattcgctggaacaaaagaatgtgtctgctgctgttgttcctggtctctgggatgatttgcactgtgaacatgttgctgttccttttgccacctgggcattggcaaattgggcaacggcatcacagttgaatagatctcatattcaggaactggatcgagatggaaatgctatcatgtctgctttaatagcacctgagaggtctgtaaaatggcatgcaagtttggtggtgcggttgctattagaagatcgcaatacacctttgaatgaatctgtttctgattgggcttccagtcttctttctactatatctcaagcatgcaagcatgaagatatttctttggctcaggtagccttgtctgcctttctcttatctgttgaaaggagccctggagtccagaaggtagtgatggagaagggtctcaatccaatgagagacatcgccaagcagatgacaaagcataagcaggtgcaagaaccaatggcaaaggcattggagctactttgtactggggagctgcatttgtcacttgaagagagtcaaaaatggtcaggcattcttcttccttgggtttttggaacattttcctccgatactatacgatcttcagccataaagattctttctcggatcttggaagactatggaccaacatgtgtaccactttctcaaggatggttagccatgatgctgtctgaagtacaaagttctataaagaaatcaaatgataaaggaaccagtcaacctaagagtgataatgtaaagacattgatcaataatgcaaatattgcttctgctgcacaagttgccaatcaactctctagtgccgttgttaatctggcagctaaacaattgagaaatgcatctaattctggggatgcatccccactggcagattttctgtctatggaacctttagcaggaccatttaaaagtttaaaaagagataatcttcctaaattggatgctgcagattctgccttggcaaccctgaaaggaattaaagctttgactgaagtttgtgctgaagattctgtgtgtcaggacatgatagttgactttgggattttatgtttgctgaggcgctttttgctgagtgatgattatgagaaactggctgctattgaggcttatgatgcatcatctagagcacatgaggggaaggaacggatatcaaatgtagatggggaaccggctacaccaaatgtaaatgatccagccagtgtccgagttcctcctactgctcatatccgcaagcatgcagctcggttgttgaccatcctctcactgcttcccagagtcaagaaggtaatcacagctgatgaaacttggtgcaaatggcttgatgattgtgctaatgggcggattccaggttgcagtgaccttaaaatgcaaagctatgccagggcagcacttttaaatatgttttgcaatgaccagcctaatcgaaaatctgaaagtggaagtggaggcccttctgatggtggtgtaccaaattataggaactcttgtcctcgttatgatgacatgatattcttgataaattctcatcttccccactggaaatgtcccaaagaaacagatcaacaagaagctttctcagaggagatatctctgtttacttctactgaaatgggggatggaacagaatctgtgaatgacagcaacggttctatttctaatgattcaactaaaagcagcccagatgcagattgtcctccactagacatagtttttgtccatggactacgaggtgggccttacaaaacttggcgtatagctgaggagaaatcctcaactttatcacctttggtggagaagattgatgaggaagcaggaaagcttggaaccttttggcctggtgaatggctttccggtgattttcctgaggctcggatgtttaccctaaaatacaagactaatctcacacaatggtctggagctagcttgcctcttcaggaagttagctctatgctgttggagaagcttcttgctgcaggaattgggaatcgacctgttgtttttgttactcacagtatgggtggcctggttgtgaagcagattcttcataaagcaaaggaagaaagatttgataatctcgtgaaaaatacaataggaattattttttatagctgcccacattttggtagcaaacttgcagatatgccttggcgaatgggctttgttcttcgtcctgctccaacaataggagagctaagaagtggatcttcaagactgatagagcttaatgactatattcgtcaccttcataagaaagggttgcttgatgtcctcagcttttgtgagaccaaggtaactccaatagttgaaggttatggtggatgggcctttcgaactgaaattgtaccaattgagtcagcatatcctggatttggggaattagttggaggtcctttaccctattgtcctattggacagagtatgtggggatcgtacccttgggctcctgatttactgtga

SEQ ID NO: 109600 - DNA, 300 bp, Glycine max
  Peptide Sequence Number=SeqID_226378
atgtcgggctatattgaagatgtgaactctgaatgtaatcaaaggttcatggctaagtcgattgaaagaaccttgcctttctttagaattctaaaaaaggataacaggttcacctggacagaagagtgtgaaaccacctttcaacaatttaaagaaacattattcgccccaccaacattgacaaagtggaatctaggagaaacattgtacctatatcttgctataacagaagaggcaatcaatgtggcactgtttaaaaataacaacaaaactcagaagctagtatacttcgttagttaa

SEQ ID NO: 109601 - DNA, 309 bp, Glycine max
  Peptide Sequence Number=SeqID_226379
atgaagaaaggagatcctttcgttacaccgtcctttgctagcataaacattactccggactataggttattcacggctactacctccttgttgaacgacaaaatgtactctcttaacagctcctcaagtccttgtcagattagctttaagtcaacccccatttttggcctctctttgttggttgtgaaggaaaatctaaatgttcctcttaaatcaagccacaaatcaatggatctcaacaggaaagatttaaactacttcaacgaagtggactttaatgatagtggaaacgcacgacacaaagtgtga

SEQ ID NO: 109602 - DNA, 345 bp, Glycine max
  Peptide Sequence Number=SeqID_226380
atgacatgcaagagagttacgcatagtgcaagaaaccacaagtcggtcaaaaggcgaccttcacccttgatatttgacgataaatacacaaacatgtcgattgtcccaaaccatgatgatcccctattggtgaaggttttcaccaataacaaggaggaatctcaaaatcatttgtcagagttacttccttacaatgaggatctcataggtttctttggtcaacatataactccaataggatatgtgaagctacacataacatttgagttagattgcaaagaagatattaaaaagggggtgtgggcacctagaccagagcctagaggaagttgtcaggatctctag

SEQ ID NO: 109603 - DNA, 522 bp, Glycine max
  Peptide Sequence Number=SeqID_226381
atgtcaagtctacagttgtgtcatgtggtggatttggagcaagggagtctcagtcaccaccgttctgtgagtggcagtgacatgagcatgtgcttttctgatgctgagaatggttcatgctattcccatttctattcaacaaatggtgacccttatgatgattacaccattggttgtgtttctgatgctgaggattcaaggaaggcttcttctgtcactgattgttcagtggaggtggaaattgaaagtggggttcctgaaattaaggtgcatttggccaaagtggagagggattgcagaatttgccatcttggtttggagagtgatagtcaagaagagtctggagttcccattgaattgggctgttcttgtaaggatgatttgggtgctgctcacaagaactgtgctgaggcctggttcaagattaaggggaatagaaaaactgaaaatagagacccaaatttcattgatttgttgcattgggaatttgagcttattaactactcatatcatgccatgtaa

SEQ ID NO: 109604 - DNA, 477 bp, Glycine max
  Peptide Sequence Number=SeqID_226382
atgtcagtcatctctcataaggggagttcatcaacagtaggacacgagtgtggattatggtgttgtgacaccataatagcaatgcctcttgggaaatgcatccctaacacaaaagctacaccttcgagagggaatccaaatgttgatacgaaagaagttcagaaacaacttccatacttgttaagtcgacattgcctctctgagacaatatcgactcagggtcatctactcggcagaaaatattatcttctacacttgttaagttggcattgtctctccaagacaatatcggctcgggggcaactgtttaagggtaaatatcgacttccacacttgttaaatcgagattgcctttttgagacaatattgactcgagggaaactattccgaggaaaatataaactttacacgtcatgggcatgtggcacaaaacatagacacatcaagaccgacttaaggattacaagtcggctatag

SEQ ID NO: 109605 - DNA, 732 bp, Glycine max
  Peptide Sequence Number=SeqID_226383
atgaccgaaaggatacttgccggttcattggctcttgaaagccgcatccttcactatcttattgttcgtatcttactcccaagatcttcaaaccttgcacaggtttctgaagaagatcttatagtcatgtgggcctttcatatcggccgacaaattgattgggcacatttagtccggtatcgcatgcataaggcactgcgattaaatgctcctttaccatatccacatttagtcactcttttccttcaacattttaacatccctattgattctgaaccttatgttccaatcaagagatctttcttgatcggtgttgctgtggttgcgtcctttggttaccgcaaagagcatgatggctcttgggtaaaaaagggtgttcaaccaaatgatgatgaaggacaattactggttgaaggggactcttctctccttcaaagtattttggacaggtttgatggactccaaacctatgttggtgaaaggtttgttgctttggaacaacaagtggacatgcgatttgatgcaatggactcaaggatcacaaaggttgaagaagatgtcaccatcattcgcgactgccttgatttacctctaccaccaccagattgtcatcatcaaaaaggaggagattgtggaaacaaagccttccaaggttattttgatgatgccaaagaatcaagagttaagcaaattccaaagattcaagattcaagaatcaagattcaagaataa

SEQ ID NO: 109606 - DNA, 495 bp, Glycine max
  Peptide Sequence Number=SeqID_226384
atggtggaggagatcagtcaaaaatattgttgctatcaccgcacaacggggcatgacactaacgattgttttcaattgaaaaatgccattgaaatcatcatacatcgaggcaaactagacatatatgtgcgagacagaggagagggatttgccgatgaaggaccatcaaacaaagcttggaaacgacatgcaagagaactcttgaccgttgcatatagtggaagaaaccacaagttagtcaaaagacaacctccacccttgatattcgacaataaagacatggacatgttgattgtcccaaaccatgatgatcccctattagtgaagtatttcatcaataacaaggaggtacataagttattagtggatataggcagctctgtggccataatgttttatgatttctttaggaatctcaaaatatcacagtcaaacttgcttccttacaatgacgacctcatagctttctctggtcactatataaatccaatgtga

SEQ ID NO: 109607 - DNA, 201 bp, Glycine max
  Peptide Sequence Number=SeqID_226385
atgggtttgttctgtagtgaagaccccagatacttagtacctgctaacacaatcaatataagagaagtctcagtctctcagtgtaactgcagatacccttcctattgggaaggagttgtatcattatcttttgaaaactcctctggtgtagtcaaaaagtcattggacggggagaataaaagaagctttcagtgcagctaa

SEQ ID NO: 109608 - DNA, 594 bp, Glycine max
  Peptide Sequence Number=SeqID_226386
atggctgggaatcaattgacattcgctaagggtgcatccattagtaaaccaccattgttttgtggcatgaactaccctttttggaaggttcagatgaaaatcttcatggagtctattaatagaggcattttgagtgtactggaaatgaacattatacattcctcattaaaccctaatgaggttttcagggtgtctgttggcacaattgccaaagagatatgggatttaatccaagtcatagatgaaggaacacaagaacgagcgtccgctaagtacaacactcctaggctaagcgcgaggaagactctggaagaagatgagctgtacaggaagctgaggggatatgaaatgggcttgacaagaatggctgaagaagaagctatagataagaaaaatagaggtttagcatcgaagactagcattccatcaagtgacaaaagtgagtatgacaatgcaaaagggttgaaggctaaaaatttgaacttgctcatgggaaagttcaacaaattccttaagaaagggaagaactacggaaacaaaacctttctgcctaagaagaatctcaagaaaggagaaccatttttctctaattga

SEQ ID NO: 109609 - DNA, 1470 bp, Glycine max
  Peptide Sequence Number=SeqID_226387
atgggggctcgttgctctaaattctctttctgctggttccactctcacctcaaaccttctgtccttgaatcctctgaccaagaaaatggtgagaagggtgagagaaaattgtggccaagttttggtgagttcagtttggagcaactgaaggctgccacaaatgggttctcctcagaaaacatagtatctgagcatggtgagaaagctcccaatgttgtttacaaaggaaaacttgataatggacagtggatcgccatcaacgtttcaacaagtttgcttggcctgattctcgccaattcctcatctccgaatgcagctcatgtagccacaattgtggttgggatgctgttgtggagatctccatgctttagccacaattgtggtcgtgatgcagtcacggagatctccaaaacctcaatattgaggctacaaatacccagacaagtgggaagccttagaagtgaacgtctagcaaatttggttggggaggcacagccaatgaaatgggccatgaggttgagggtggctttctacttagctcaagctctagaatattgcactagtaaaggaaggggtttgtatcatgatctcaatgcctacagaatcttgtttgatcaggatgctaatcccaggttgtcttgctttggactcatgaagaagagcagagatggcaagagttacagcacaaacctggctttcacccctcctgagtacttaaggactggcaaaatttttaggatgtttgcacttgacctgattcgtggcaaaaactttttgatgttgatggattctgccttagagggtcacttttcaaaggatgacggaactgagttggttcgtttggcttctcgttgtttacaatatgaagctcgtgagaggccaaatgcaaagtctcttgttgcatctctcatgtcacttcagaatgaaacagagcagcatgctgatgaagtacatccatactttctatattcttttctagttggtcccctcatatgttctaatgggtctccggcaagaaactgcatccttaacaaagcaattacattgacaccttttggtgaagcatgtttgagactggatcttactgcaatacatgaaatattagagaagactggttacaaggatgatgaaggaattgccaatgaggagaccttgaatttgaagaagcatggagatactgcttttagagctaaggactttatcactgccattgactgctacactcaattcatagatggagggaccatggtgtcacccacagtgtatgcaatacgctgcttatctttattgatgaatgacatggcacaagaagctcttggggatgcaatgcaagcccaagtggtatctccagagtggcctactgctttgtatcttcatgcagcttgtcttttcagcctcggaatggaaaatgatgcacaagagactctcaaagatgggactaacatggaaggcagaaaaaacaaaaactga

SEQ ID NO: 109610 - DNA, 318 bp, Glycine max
  Peptide Sequence Number=SeqID_226388
atgccggttttggcaggtgaccagcccagacatgcacctgccccagaccatgaggactacatgcagccggatatcccacaggttccagtggcatttgacccccctcgacatgcagtggatgattacgaaggctatgaggcgatcgcagaaaggttggagcgtgtgctcaaccttaggatggtcactgcagggacagagttacatgatatcatgcaagattgcctgaggatagccaggggggtgccagcacagatggaagtgttagggctcgacaaaggcggcgcacagagcattgatgatgttttttatgttttgtag

SEQ ID NO: 109611 - DNA, 243 bp, Glycine max
  Peptide Sequence Number=SeqID_226389
atggtggtccaaatggaatattttgagttgttgactgaaagttcatacataaaggttctttggccagaatgtggttggcagccagtgtctctgacagatatgattacctcttctgcagttaaaaaagtgtatagaaaagcaaatttatgtattcacccagataaagttcaacagaaaggtgctactcttgaacagaaatacacagcggagaaggtttttgacattcttaaggtaccttattaa

SEQ ID NO: 109612 - DNA, 921 bp, Glycine max
  Peptide Sequence Number=SeqID_226390
atggcaatgagccaatcggcatgcaaagagactggaatgaagagctgcagtcttgtagagaatttcctcgtacatctcctcaggaggattttgcgggatagggcactttataaagtgacatcagactttgttgatgcagctattaatggtgctattggagtgatcagtggttgcattcctccgataaacctgactgaccctgaatgctttcacatgtatgtgcacaacaatatattctttagttttgctattgatgctgaccttgagaagctgtcaaagaaacttgtggatgctaattcaaaatcttggagctccagctctttgcaaagttcttctgataaagattccattccagttcatggagaaagtcaggttcctaatgggggtaaagatgatggttcaagttctgaagatcttaatagcacagaaattactcaagatgtttctccagaagctcagctggctgagaatgagcaagccacatatgcttctgcaaacaatgatttgaagggcacaaaggcttaccaagaagctgatgttcctggactttataatcttaccaagaagctgatgttcctggcacaaagattcctcctacgaagtttagagcaagtcaaagactgtctttatgcacctgccacaatacctatcacctttcacattaaattgaattggattatgtgttggcttccttcgttgcatacttgtcccaacattcttaatgtgaaccttagaatacttctaaaagttattggcaaaaaactattggtgcaacagttttcgcatattgaggtagagaacaacttcaagaaggttcatttgctactccaaatgcatttgtacctgcttggaaaaattctggagacccaagaaggaaggattctgagagtgcctgaatttgggattctgagcttaaattga

SEQ ID NO: 109613 - DNA, 282 bp, Glycine max
  Peptide Sequence Number=SeqID_226391
atgggaagtgtgctggttgttgtggctaaaatttttttctataatcggaaatttcaattgaaaattagcccccgacaagtgccaaagctacagggaaaaagaatctgctgccaaacgatgccacgaaacatttatgcagttatcttcaacggcacaaaaacaaatatgaggcaccagctaggcaagcaaacaggccgatgccgaaaccgtgcaagtgctaatagatctattgattttgcaaaggcattagcagtgggatctaagaaagctcttccgcattga

SEQ ID NO: 109614 - DNA, 315 bp, Glycine max
  Peptide Sequence Number=SeqID_226392
atggttgacatcctcatgaagctaggtggttgcattggcatgaaagttcatgtactacttctcatgatgtcgagattgttagagcggctgcacctatggctcttcgagttgctcactagcaagttcttcgatggtagcaaacacttccaaatcaagtcatgcgaggtgaaattgtcaaaggtgcctcgttcgttcttgtgcaaggtgaaggacgatcttgtgcctcctaatccaacggtgaaggtcttcgcggtggccgcccctgaagcaactgactccataagaggagaagacggagttcaacttggtgattaa

SEQ ID NO: 109615 - DNA, 1584 bp, Glycine max
  Peptide Sequence Number=SeqID_226393
atggttaccgtgaacggaaagttccctgggcctagagttgttgcaagagaaggtgacagaatagtggtaaaggtggttaatcatgttcccaacaatgtcagcatacactggcatggagtgagacagcttcaaagtggatgggcagatggtccatcttacataactcaatgcccgattcaaactggccagaattatgtgtacaacttcaccattgttggacaaagaggaaccttattctggcatgctcacttttcatggttaagagccactctctatggacccctaatcctcctacctaggcgcaacgaatcttacccatttgagaaaccctacaaggaagttcccatcatctttggtgagtggtggaacgctgatccagaggctgttattgcacaagcccttcagacaggggctggcccaaatgtctctgatgcctacacttttaacggacttcctggacccttttacaattgctccaataacgagacagacacggacactttcaggttaaaggtgaaaccagggaagacatatcttcttcgtttgatcaatgctgcactcaatgatgaactctttttcagcattgcaaaccacaccttggtaactgttgaagctgatgctacttacgttaaacctttcgagtcagacatcatagtcctggggccaggacaaacctcaaacgttctgttaaagacaaaagctgagtacccaaatgccaatttcttgatgctagcaagaccatatttcactggcatgggaactttcgacaattccacagttgctggctttctagagtataagaataaaccacttgctgctcccaaaaatattaatattcccactttgaaaccatttcttccagccatcaatgacacttccttcgttgccaactttagtaacaaattcttcagtttgaaccctgcaaaggtgcctcaaatagttgacaagagcttcttcttcacaattggacttggaacaagtccttgtcccaaaaaccaaacatgccaaggaccgaacaacagttcaaagtttgcagcctcaatgaacaacatatctttcactcttccttccatagcacttcttgagcaacatttctttgggcaagctaataatggcatttacaccactgatttccctgccatgccactcatgccattcaactacacggggactccaccgaacaacactttggtcggtaatggaacaaagactgtggtgataccctttaacacaagcgtgcaagtggtgcttcaggacactagcattttgggagctgagagccaccccttgcaccttcatggctttaatttctatgttgtgggtcaaggctttgggaactttaatcctaacactgaccctcaaatattcaatctttttgaccccgttgaaaggaacactgttggtgtgccctctggtggttgggttgcaatccgattccttgctgacaatccaggtgtttggctgatgcattgccactttgatgtccaccttagttgggggttgaggatggcttggattgttgaggatgggaagctacctaatcagaagttgcctcctccaccagctgatctccccaagtgttga

SEQ ID NO: 109616 - DNA, 309 bp, Glycine max
  Peptide Sequence Number=SeqID_226394
atgacatttgggattcccgtaatctcgaccattgatgtggactatgtcacaattccaagccatttctatcatcggtggaggcacgagctggagcaacaagtttacgttaaaggagatgataagacaactgttttgttcaagttcccctatattcgtaacaactatttcaagattgtcatcaagaaagagttggatgactcagatgaggatgacaacaacctccaagaccagctactttggcaaacaattgtctttaaagcaatgacaaactcaagagacttacttgtaaggatcattcttttattataa

SEQ ID NO: 109617 - DNA, 444 bp, Glycine max
  Peptide Sequence Number=SeqID_226395
atggaaaaatgcaaggagatcggaggaagagtttatacaacaacaacaacaacaacaacaacaacgccttatcccactaggtggggtcggctacatggatcaacttccgccataatgttctatcaaaaaaacttggaggaattagcgagtagtgactacccaacatttggtgcacttatttggcacaaggaactcataggcctcattttgctactcttgacaggctctaagactacacattgcactcatttggcttggtggcattgttgggccctgttatgtgtcaagtgtggcaaccagttgtatctaggttgtatgctttgtgtgttgtttgtggtgtttgaggagcagaggacttacccctacaaccaacaactttctagaactgacatcagaggagaccatgatgatctcacgcctatggagatggaggagtacaaatag

SEQ ID NO: 109618 - DNA, 606 bp, Glycine max
  Peptide Sequence Number=SeqID_226396
atgattttttcaaggattgcgcgctccgtttcgcgttcgcctcgcgctagaaattttttgcacggtgatgggagattgggaacccatgtcggagtgccacggacgaatgcgtattctgaaggagccgagagggtattaggatttgctaggggctacgtgtcttctgccagagctcttagtaatggcttcgtttccaatttgcctgattttaaatctgttgcagcaaaccctaggattcgccgattgttttgcagcgaagctccgaagaagaagaattataagaacttctatcccaaggaaaagaaggaagttccgaagggaaacgacaagaaacatgagtccaaagtgtcgagctattgttttattgcgtttaatttgatgcctgaacttcctttatgttgggaagttggagaatctgataattcacatgcaaacaccgagaatagtggaaattttaaggaagctttcatgaagcaagttcaaaatctaatcacgccattattattggggatggggctatttcttacatccttttcgtttggtcatcgtgaacaagaggaggggaaaaatggaaatataagagagattacaagaaataagatttga

SEQ ID NO: 109619 - DNA, 372 bp, Glycine max
  Peptide Sequence Number=SeqID_226397
atggagctgatagagactatagcagccagtgatcacgccatccttcatggtcgagcctacacacccacaaagaagagccttattgagcttatttctcaagatgctatgttagctcaaaacaagcttctggccattagagaccctcacataaactctgaatcctaccccgggaataacttcaatcaaggagttccatctaatcggtctctcaatcaaggacttgatttgtataagagaaccactaagctggaagacacgctgactcagttcatgcaagtttctctatcaaatcacaaaagcactgagttcatcattaggaatttggaggggcagacccaggattcaatggttgcaggggccaaaatcaaataa

SEQ ID NO: 109620 - DNA, 339 bp, Glycine max
  Peptide Sequence Number=SeqID_226398
atggaggggttcttctgtgagaagctcctaggaatattagtggttttggagctagtggaggaactcttttgggataagctcctgatcaagagaggggagtttgaagaagaattagaagaagagcctcttgttgagcaactccttgagaacaatgatgatttgcttgaacctgcttccttcttccacaccttccccttttcatccatgaaaaacaaaggaactgtaatatctagaattagctatgggacaaaaatgtgcacatggatggatgaacattcaaccttgacactgatgagcaatacccatattatagtcgaagacataaggagagtatcttaa

SEQ ID NO: 109621 - DNA, 291 bp, Glycine max
  Peptide Sequence Number=SeqID_226399
atgtgcagtgcggtgttgaattttgggcacatgagttctgatctacttgcttatggggcatcagatggaaccttgactgtgtgcagtgtatctaagaatccttcagtcatcaaacaattaaacgagcattccaaagatgtaacagatgaatggtcattgagagaactacgcagagcgtgggcaaagaaaagagacatgtcttctagtgatttgttggtggagatgaagcagtggtttgaagaaacaaatttgaacgtgattttgaagaaggttgctggaaagcgatactag

SEQ ID NO: 109622 - DNA, 810 bp, Glycine max
  Peptide Sequence Number=SeqID_226400
atgtcaaaacccttttgcgccctctttgcactgtccatcatccttgtgacatgtcatgctcaaacccttaatacatcaacaacatgtgaaccttctaaatgtggtaacctcaacattagctaccctttttggaagaaatccaacaccaacgttcaagaattttgcggttaccctgaatttggccttgaatgtttggatgaccaagccatcatgatttttccaactgacagataccaagtcacggatataaactatgatattcattcaatcacacttcttgacatagatgtgttgggacaaccatgtcctagggctcgacacaacgtttccctacacaatctccctttatctttcagctcattagattttaacctcagtttctatttcaactgcagttcttacccttcatctattcagcacatagggtgcatggaacatgataagtatcagtcttacgtgtttaagaccggggatgaagctgaaagtaatggctttgattggcttaggcactgtgaggagcatgttgtggtgacagtgaagcaggatgagattgaaattagtagtttgatcactggttttggtgatgctatgcagaaaggattcgtgcttgattggatgagagctcaggattgtgcagtgtgcgaggagtctaatggctattgcagattcgaccaagccactaagcaatcgaggtgcttatgctcagatggcagaactgaagccaaaagttgcaaaaaagatttttctattattgaaatctttgctcatattcacaactctgctcaattcattgcttttattaagatttag

SEQ ID NO: 109623 - DNA, 1807 bp, Glycine max
  Peptide Sequence Number=SeqID_226401
gaccctacctgctaagggatctggaggccagtataaatattatttcaatattggaagtgttgagtcttttgaggggaagctagaggaagcgcaagaagctctgggcattgactctcatgattttgtgcctgtaacagattctgagaggtctacattcgaggaaatgacgaaggctgctctaacactgttgtttttgttatctatcgggcttatcgataccgtcgacccaggtcaacttggttttggtggcagtggcggcagtaagggtgcacgtggaatattcaacataggaaaagcccatactaaagtagacaaaaatgccaaaaacaaggtctattttaaagatgttgctggttgtgatgaggcgaagcaagaaattatggagtttgtccacttcctcaagaacccaaagaaatatgaagaactcggtgcaaagattccaaaaggtgctctcttggccggtcctccaggcacaggaaaaacccttttagcaaaagctacagcaggggagtctggtgtaccctttctttgtttatctggttctgatttcatggaaatgtttgttggtgttggaccatctagggtgagaaacttgtttcaggaagcaagacagtgttcacctagtatcatatttattgatgagattgatgcaattggtcgatcaagggggcgtggtggtttttctggtgcaaatgatgaacgtgaaagtactttaaatcagctgttggtggagatggatggttttggaaccacttctggagttgttgtgttggcaggaacaaataggcctgatatcttagacaaagctcttcttaggcctgggcgatttgaccgccagataacaattgacaaacctgatattaaaggtcgtgaccagatatttcagatctacttgaagaaaatcaaacttgatcacgagccttcatattattctcaaaggcttgcagcccttacacctggatttgctggagcagacattgctaatgtctgcaatgaagctgctctgattgctgcaagaggtgaaggaacacaagtgacaaaggaacattttgaggcagccattgataggatcattggtggcttggaaaagaggaacagggtaataagcaagctggaaaggcgtactgttgcctaccatgaagcaggccatgctgttgcaggttggttcttggaacatgccgagcccttgttgaaagtaactattgttccacgtggcaccgcctctcttgggtttgctcaatatgttcccagtgagaaccttctcatgacaaaggagcagctttttgatatgacttgtatggcacttggtggtcgggcttctgagcaggttcttatagggagaatctcaacaggagcacaaaatgacttggaaaaagtgaccaagatgacgtatgcccaagtagcagtttatggttttagcgacaaagtggggctcctctccttccctccaactgagggctcatatgagatttccaaaccatacagcagcaaaactgctgcaatcatcgataacgaagtgcgtgattgggtgaacaaagcatatgaacatacggttcagctaatcaaggaacacaaggagcaagtggctcaaattgcagagttgctgcttgaaaaagaagtacttcaccaggacgacttgcttcgagttttgggcgagcggccgttcaaggtcactgaacccaccaattatgatagatttaagcaaggttttatagaggaagaggaaaaggttgcagaaagcaccatagatacgccggagaaaggtggtgggtcttcacctttagagccccaggttgttcccgcatag

SEQ ID NO: 109624 - DNA, 435 bp, Glycine max
  Peptide Sequence Number=SeqID_226402
atggctggcaagatggagggcacgacaatggaaatggatgactttgcaaaggtggttgttgacttagaggcccgattaaaggagttggagtctaggatggaagagtttgaagaggagttgttgatgtataagaaggaagttgtggagcagcatgaaaagggctttcacaaggtcgttaggcaagccgggttcttcaccaaggaccttgacttgggtctttttgacccattcaaggacgagaaggatgatgttctgcttgaagaagaagatatttctactgaggaggagcaagacattgaagagcaaggcgatgaagctaatgtttgggaagaaagaccttggtgctgtaggaatgatgtgatcctgactaggagcggatcgcttgatacaggctacgaagatttggatgacgccacttccagtgaaggaagataa

SEQ ID NO: 109625 - DNA, 732 bp, Glycine max
  Peptide Sequence Number=SeqID_226403
atgggacttggtctctttgagtgctgcttcactagctcttcttctgacacgttttcaaagcagagtaagtggcgaatcttgccctacaagaaacttgcaaaagtcacaaataattttaaccaatctcattgtcttggaaagagaggatttgccactgaatattatggaaaacttgaggatgggcgtgagataacgatccagtgctttaatgaagacaagcaccacatgttgcaacagtttatcaatgaaactgctatcctaaactacttgcctcacaaaaatattgtgtcaatttacgggtgtgcttctcatcacaaggagtcactactagtgcatgaatacctatccaatggcaatcttgcttctcatcttcaaagtgaaataaccaaaaacagcacactaccttggctgactcgattggatatagccattgatattgcaaattcattggactatcttcactattatggcatcatccaccgcaatgtgaagtccagtaatattctcctagatgtgaacttttgtgctaagcttgctaaccttcatctatcccggaaacttccagatggagttcctgtctatgctacccatgttactggtgatataattgggacatgtagttatatagacccagagtatttgacaaaaggccggcttagcgtaaaaaatgatgtttatagctttggagtggtgttgtgtgagctcttctcatcaaagctggcaaagaattgg

SEQ ID NO: 109626 - DNA, 264 bp, Glycine max
  Peptide Sequence Number=SeqID_226404
atggctaacaaaacaatctttgacaatataatttctgatacacttagagaaaaaagaacaaaaatcgatttgagtgttatgatggaggcaaactttcccgaagaggagagcataatgtatgtctcagattctcttggttttgcagcgatggaaccttcattgagggacccttcgctggaagataatgatttctctgaaacttccaagttcataagccagatactaatggaagaaaacgttcaagagaggccattctatgactga

SEQ ID NO: 109627 - DNA, 912 bp, Glycine max
  Peptide Sequence Number=SeqID_226405
atggtggtaaaacttttcatgcctataaaactgctaatgcaaactctttttttgccttcagttatcatgcccccttcagccctgcgtcggcttgcatatttggacatagagtatcctatggtatttgaactgagaaattcttctgctgaaattgttactcactgtggagtcctagaatttactgctgatgaggggattatacatatgccagaatggatgatgaaaaatatgaaactacaagagggaaacactgtgattctgaaaaacacccaagttccaagagcaacatatgtgaagctgcagcctcacaccaaggactttttggacatctccaatccaaaatccatcttagagatttcactgaggagctactcttgtttaacaaccggtgacactataatgattccttacaacaacaagaaatattacattgacatagtggaaactaagccctctaatgcaatcagtgtaattgaaacagactgtgaagttgattttgctcaacctcttgattacatagaacctgagaaactgttgccatctgcttcatctgataaaggatgcactgaagttcatgacgattcggcaacacagactgcccagatcgttccattcactggttttggaagacgtgtggatggcaaaccttgtacacaatcagttgaagaaacttgttcaatgctaaatctgctaaagactgaaaaagaaaccaagaattgcaattctaaaatatcaaatactgcttcacgtagagcttctggaaagcttgtgtttgggtcaaatgcaaatacacccaaaattcagacacccccaaaggcttctctgaaaataaaaactcaagagtcatctaagaaggaggaagagtcaaaatttcaagctttcacgggaaagaagtattccttaattgattga

SEQ ID NO: 109628 - DNA, 1845 bp, Glycine max
  Peptide Sequence Number=SeqID_226406
atggagccgaacattcccagaggagctgaagaacagagcacggcatatctcatggaagatagtgatttttcagaaactgctaagttcataagccagatcctcatggaagaaaacattgaccagaggccactctatgacacacttaccttgcaagttacagagaagtccttctacgacgctctcactggcaacatacctctttcccccaaccccaatcaacacccccttcttctcagtccccaagctcaaaccaccatcaccgaacatggactctcagatttggattcttccttgcaacagaacctgttcaatgatgctgattcggtttcccactttaagagagggttagaggaagctaccaagtttcttcctccggtgtctaaccttgtaactggtcaatatccaaacggggaacaaccaatcaatacgtttgaagggaattcctatggatttcagagtaggaagaatcacgagcgtgaagagatagacaccagagaagaagagcatgaagggagaggtcacaagcaatcagcacttagtcttgttgatgagactgacttgtcagatgctattgatcgggtgtttctaagtgtggaaaacgtgtgtattgaacacagttctttgcagaatggagcactgaaacctaaggcaccagaggtagggaagggtcgttcaaagaaacaaggaaggaagaaggaaacagtggatttgagaaatcttctgttgatgtgttcacaatctgtgtatgccaatgacatcaggactgccaatgaattgctaaagcagattaggcaacactcttctcccgttggggatgcatcacagaggttggctcattacttcgccaatggcctcgaggcacgcttgattggggctggttcaggtgcaataggaacattttcttttgtgagttctaagaggatcactgctgcagagttcctgaaggcataccaagtttttctatctgccacccctttcaagaagtttacatatttctttgcaaatcaaatgattgtgaaagcagccgcaaaggcagaaatcatccatattattgattatggcatcctatatggtttccagtggccaattcttatcaagtttttatcaaatagagaggggggtcctcccaagctgaggatcacaggaatagagtttccccaatctggcttccgccccacagaaagaattgaggagactggtcaccggctggctaactattgcaagcgttacaatgttccctttgaatatcatgctatagcatcacggaactgggaaaccattaagcttgaagcccttaaaattgagagaaatgagctagttgctgtaaactgtcacatgagatttgaacatctactggatgagagtactattgaagtgaacagtcccagaaatgctttcctgcatctgatcaggaagataaatccggatatttttactcagatcattattaatggatcatatgatgcccctttctttgccacacggtttagggaggcactcttccattattctgctatttatgacatgtttgacactgtcataactagtgaaaatgaatggaggatgacgattgagagtgagcttttgggccgggaggttatgaatgttatagcatgtgaaggttctgagagggttcagagacctgagacatacaaacaatggcaggttaggaatacgagggctggtttcaagcagctcccactgaatgaggaattaatggctaaattcaggagtaagttaaaggaataccacagagattttgtcttagatgaaaataacaactggatgcttcaaggttggaagggccgcatttttaatgcttccacttgttggtttccggcataa

SEQ ID NO: 109629 - DNA, 1602 bp, Glycine max
  Peptide Sequence Number=SeqID_226407
atgagttataggtttgtcaggcttgtcaagccctccagcctgaacaagtgtgtccgggatgcttctattaagttgtctaggatggacatgcttttggttttgcaagcgaggtttgatatgttaggcgagtgcagtgcacacgcaatactcttgcaacgtgtcactcatggagtggcatgtactggagacatgatcatcaccatttttagacttctgttatctttctctcaaaattgcttcgctcttttgcttgtgatttctctttcttcttcctttgtcttcttcgatttccaaggtacatctctttcgacaatgtcctccctactttttgacttcgccattggcatgggtggtagtgacttcgggggtttgattaagcaaaccctggtggaccgagagcacatctccattgacggttcatccttagaggagacttgccatagtgcttgtgacaatgagtcttcttcctcggagaggcacttcttgccttccgctgcttccccggttgtggaacctatcccggtcactatgattctccctcattctatttttggaggagcaatgagaagtggtgttggggatgttagggcgtctccccgtgtgcaacatagccatggtgatgggtcgtcatcctccatccccgtcgttgctggatttgattgggtcttgggtctagttctccccttgaccacattccagtgtgctctgcttgagcacataaatatggccccttctcaaatctacctcaatagttgtgccatggtgagggcctttaaggtcatgtgccctttcttcaacattctgcctaatgtgctagtgttttttgtatttttccgaatgaagttgatgggcaagatcgattgggtctctttgaataatgtctccaagaagctatttgagtttgaattaaatgtatttcactattttaaggatcatttgtttaaggtcttggctactgacgccatggatttgttgaccttcatggagagggtcgataaagctatattggaggaactatcggccttgttggatgcgtgggacattttgtctcttccttcagtggatgatcctttcattgccttggatggtattatgggggttcaacctattgttaaggtttgccctattgctagtattgctgaggagagaagagactatgccactatcagttcactgaggcaggttgcagggttgacacctccattgatcgttgaggcttttgctcctgctcctccacctccttctactgtgcttgttcaggaggttgcttttggagctaaatgctcccaagatgtcgcctcctctttcttcaactctcctggttcctccccagtcgtgttggtgtcaccatcgccttccacctcttctcacccccataccccagttagctttgtgtcagcctttgataaaaatctcattcgatcagtcggggttcaaaaagctactaattctaccaaggtcttcctccagagaagtttggcacttttggagaagaatggacaacgacaccaggaggctttgagtaaggtggcctccttggaggcgaaagtagccaaatggagggtcattgctcgcataatttggagagttgagcgccttaag

SEQ ID NO: 109630 - DNA, 645 bp, Glycine max
  Peptide Sequence Number=SeqID_226408
atggaggtcaactttcccataactgacctatttggtgaagaagaggagagtatatttttagccgcaactccctctctcaaccaccttcacttactgttaatcatggactctcaaatttggattcttccactgctaaactcttggcaaacaatattttcaatgatgcttattctgtttcccagtttaggagaggcttggaggaagctaccaagtttcttccaccggggcttaagttgtaactggtctgcattccaatgggttgaaggtttgcagagtgaaacaatgaaagctgtagaggcaagtggagggaagagtcttcctaagaaacaagggacaaaggacgaaacaattaggcagcactcttctccctctggggatgcattacagaggttggctcattactttgtcaatggcctcgaggctcgcttggttggggaaggaatgttttcttttttgagctctaagaggagccctgctgcagagtttctgaaggcacaccaagtttttctatctgccagtcctttcaagaagttaacatatttctttgcaaataaaatgattatgaaagcaggtgccaaggcagaaaccgtccatattattgatttgaggcatccaatatggttttcaatggccaatgcttattaa

SEQ ID NO: 109631 - DNA, 387 bp, Glycine max
  Peptide Sequence Number=SeqID_226409
atggagcgagaagtaaagaacaagtgcagcaaaacacgaaaaaacggaagacaaggaatgagttatccgacagatgaagtcatggtgcatggtggaatagtgtatgatggagtactggacaatacggagaagaagaataagaactcgtacaagaaatgtttgatggaaacgacagacttcccttgtcaagatgatgatcactcagggaagaagaaaatgctctcaacgaaaggagaaaaaccctttgatccttatcctagaatcaaggtttcgaaggaggaatatgagtcatggcgtaacgcatggaaatgcactctagtttcgctcttgtgcaaaatcaaacttcagaagtttgggtctaaaaaggtcatattaaagtacacttga

SEQ ID NO: 109632 - DNA, 558 bp, Glycine max
  Peptide Sequence Number=SeqID_226410
atgtcgtcactcgtcggtaaactctacatcacatcacaaaaagagtgtattttaacaaataaaaagaaggtgactggtctcgtggttggtccttggagtgccctaaaaaaatggagatatttctatggagattgctgtgaaattgcctaccgactagttactaagggtgttgattgccccatcactagttcgaaatggccaaatgatccagaatccaggtgtcatggactaggagaaacgaacaaatatgggaaaacattgagaagccaattcctctatccttgcaagcagcgaaaaattcaatcactcactagtggaagcaggctcgcaaacgtccattatgctcatccacacatgctcaaatgcaaagtggatgcctctatattgtcgaatagttcgcagtatggcatggatgtgattggatccacaactctgagggagaattcctggctgccacaacatctgttcacgttgggaagctatctccagctgaagcagaagcatcagctctccttgctgctttttcttgggtatttaattcaggctacaacaacatga

SEQ ID NO: 109633 - DNA, 2043 bp, Glycine max
  Peptide Sequence Number=SeqID_226411
atgctctccacggattcccttttggaaaatttcccttttgtaaacggtcctatctcggtgttttcgaatcagaatccggaaagtgggttcaaggtggatgattcatgttccccttcagaatctgtcactgattctggtccttcttctgggacaagctcgaatggagaacatgcagagagtactaagcactccaatcccattctcagatacattagtgacatcctcatggatgaagaagttgatttggagcgaaaaccctgcatgttgcaggattgtttgagacttcaggctgctgaaaaatcattctatgatgcattggttcgtagttacccttcatcaactggtcaatttaatgataatcctgacccagatgataattttggtggaactactagttctgagagttttagcagttataccactgataattcatgcgagtctgattggtttaacggtgctagtgacttggattcctctttcctacaaagatctctaattgattctctggaacacacatatgtagctcctgatctgtttagagagacacaagctggggtccatttttcaaatggagcctggaatttgattcacttgcagaacaagccacgtgctattgaggatggtgtgatgcggggttctgtaacagccacaggattgagggagaagaggagctatcaaatgaatgatatctcacatgaagaagaggagaaaagcaacaagctttcagctgtctacttggatgattcggagccatctagcatgtttgatgatgtgctgctgtgtaaggatggtaagagtccatctattttttatgctggccgtgaaccgtcaccatcgcagattgctgactcaggaggatctaatgggaagaaaacacgatcgaagaaaggttccaacaagaggacaagtgcaagcgcaacggtggatttatggactttgctaactcaatgtgcacaggctgtggctagctttgaccaaaggactgcaaatgaaacactcaagcagattaggcagcactcttcaccttatggcgatggacttcagcgtttggctcattactttgccgatggccttgagaaacggttagctgctgggacaccaaagttcatttcctttcaatcagcatctgccgcagatatgttgaaagcctacagagtgtatatctcagcatcaccatttctcaggatgtcaaatttcttggctaacagcactattctgaagctagcacaaaatgaaagcagtattcacattattgactttgggattagctatggtttccagtggccttgcctcatccaacggctttcagagaggccgggcgggcctccaaagcttcgtatgatgggaattgatcttccccagccgggatttaggccggcggaaagggttgaggagacagggcggtggctggagaagtactgcaagaggtttggagtcccatttgagtacaattgccttgcacaaaaatgggaaactataagacttgaagacctcaaaattgataggagtgaagtaactgtggttaactgtttgtacagattgaagaacctatccgatgaaaccgtgactgccaactgtccaagagatgctttgctgaggttgatcaggaggatcaatccaaacatcttcatgcacgggatcgtcaacggcacttacaatgcaccgtttttcgtgacaaggttcagggaagcactcttccacttctcatcattgtttgacatgtttgaagccaatgtgcctcgtgaagatccatctaggcttatgattgagaaagggttgtttggaagggatgcaatcaatgtgatagcatgtgagggggcagagagggttgaaaggccagaaacctacaagcagtggcaagtcaggaaccagagagcagggttcaagcaacttccattggcccaagagcatgtgaatagagtgaaggaaatggtgaagaaggaataccataaagattttgtagttggtgaggatggcaagtgggttttgcaaggatggaaagggcgaattctttttgctgtttcttcttggactcctgcttga

SEQ ID NO: 109634 - DNA, 375 bp, Glycine max
  Peptide Sequence Number=SeqID_226412
atgtgtttgtgctatgctaggaaggggatggaagaggctgaaatcttagaggagagtgagatgaagctagaggtaataatatccgccatgtctgaatgttttgaagaaggtgatgggctcgaggaccaaaatatgttggaagaagatttcatgtccaacgcaaggaaacccatttggttgattaagagaatggcagaggaaagcaagggaccggtagaggaaagggagatcgtacctatttggttctctggccactgtcgtcccccatacatccccgcaaaggtcagccatacccaagaaattgacatcgtccccaaggtgttcccttgccgtcctcgtccccgtgcagtaccagaaatgggggacaccttctag

SEQ ID NO: 109635 - DNA, 771 bp, Glycine max
  Peptide Sequence Number=SeqID_226413
atgtggctttgtctttttcatgaaattgatattctcttatgtgatgtgatctcacagctgaaaaagagacccgatttgaatgcatctttgtcggatatatgcatttcaacttcagctgctccaacatatcttccagctcattcctttgaaaccaagactcaccacggtgtcagcaaattcgaccttatagacggtggcgtcgctgcaaataatccggctttggtagccatggcggaagtgacgaatcgaattagccatgaagggcaatgtaatagcttaaatgtgaaaccaatgcaatacgatcgatttttggtgatatcgttgggaacaggttctcagcaaaaggaaatgaaatacagtgcagatgaggcagctcaatggggcatctttagttgggtaactacaaccaatggtggcacccctttaattgatgcctttagccatgcaagttcagacatggttgactttcacatcacctcccttttccaagcactcaattctgaacataactatctccgtatccaggacgattcattaaatggggacatgtcttcggtagacttggccacggagaagaatttgaatgatctcgtgaaagttggggagtcattgttaaagaaaccagtttcaaagattaacttgcagactggcgttcacgaacctgttaactctcatgaaacaaatggagaagccttgaagaggtttgcggaacgactatccaaacagaggagatttcgtaaatctcaaatgtctgccaatgggaatctttag

SEQ ID NO: 109636 - DNA, 1107 bp, Glycine max
  Peptide Sequence Number=SeqID_226414
atggaagcaacgaaagcacttgtatcttcaactccatgcgatgatggacacctagttaccgtgcttagtattgatggtggcggcattcgaggaatcattccaggaattatacttggtttcctcgaatcagagcttcagaagttagatgggaatcatgtaagattggcagattattttgatgtgattgcgggaacaagtactggaggattagtgactgcaatacttactgctccaaatgaaaataaccgacccttgtatgcagccaaagatattaagaatttctaccttgaccataccccaaaaatcttcccacaaaataagtgctggaatttattgtcatctatggtgaagttgacaagaactctgtttggaccacaatacaacggcaagtatttgcacaaccttattagggaaaaactaggagaaacaaaattgcaccaaacattgaccaatgtcgtcatcccaggatttgacatcaagcgccttcaacctaccatcttttccagcttccagctcgatccaacatatcttccagctcattcctttgaaaccaaaacccaccatggtcatgtcattgggaaattcgacctcatagacggtggcattgctgcaaataacccggcattggtggtcatggcagaagtgacgaaccaaatattccatgaagggccgtgtgattgcttaaatgtggaaccaatgcaatacgacaggtttttggtgttatcattgggaacaggttctcaaaaacaagaaatgaaatataggctgatgaagcagctcaatggccccttgagttgggtaagcacaaccaatggtggcacccctttgattgatgcatttagtcaagccagtgctgacatggttgactttcacatctcctccgtcgttcgagctctcaattctgagcacaactaccttcgaattcaagacgatacattaactggggttgacaaggccacgatgaagaatttggatgatctcgtcaaagttggggaatcattgttaaagaaaccagtttcaaagattaacttgaagactggcgtttacgaacctgttaaatcttatcaaactaacgaagaagccttgaagaggggggaaatgatataa

SEQ ID NO: 109637 - DNA, 1575 bp, Glycine max
  Peptide Sequence Number=SeqID_226415
atggaagacaacgacttctcagaaactgcaaagttcattagccagatcctcatggaagaaaacgttgaacttgaacagagcccattctacgactcactcactctgcaagttactgagaaatccttctacgacgctctcgccggtaacctacttctcagtccccaagctagcaacaccaatttttcagttgaaaattctcgtgagttgaacctcccttccccagattctctttctgtttctgctcttcagtttaacccccacgcactctctcaaccaccacctttggttaatgttagtgaaggagtctctgatttggactcttctattgcaagactcttagcacataatattttcaatgatgttgattctgtttcccactttaggagaggcttcgaggaagctagtagatttcttcctccagggcctaaccttgtaactgctctacattcaaacgcgcaagaaccaatcaattcttttcgagagaattcctatgggttgttgaagggtagaaagaatcttgagcgccaagagataaacactagagaagaagaaagaggagggagaagtaacaagcaatcagcattttcctttgttgatgagagtgacctgtcagatgctattgatagggtgtttcttagtgtggaaaacgtgtgtagtgaacacagttctttgcagagtggaccactgagagcggaggagcaagatcgagggaagggtctttcaaagaaacaagagaggaggaagcaggaaacagtggatttgaggaatcttctgttgatgtgttcacaatctgtgtatgccaatgacaacaggactgccaatgaattgctaaaacagattaggcaacactcttctcccgttggggatgcatcacagaggttggctcattacttcgccaatggcctcgaggcacgcttggttggggatggtacaagttcgcaaggaatgtatacttttctgagctctaagaacatcactgctgcagagtttctgaagacacaccaagattttatgtccgccagccctttcaagaagtttacatatttctttgctaataaaatgattatgaaagcagctgccaaggtagaaaccgtccatattattgattttggtatcctatatggtttccagtggccaattcttatcaagtttttgtcaaatagggagggtggacctcccaagcttagaataacggggatagagtttccccaacccggctttcgtcccacagaaaaaattgatgagactggtcgccgtctggctaactattgtaagcgttatagtgttccctttgagtacaatgccatagcatcaaagaactgggaaaccattcggattgaagccctaaaaattgagagcaacgagctagttgctgtcaactgtcaccagaggtttgagaatttactggatgactctattgaagtgaacagtcctagaaatgcagtcctgcatttgatcaggaagataaatccaaatatttttactcagtccatcactaatggatcatataatgccccgttctttgccccgcggtttagggaggctctctttcatattctgctatttatgatctga

SEQ ID NO: 109638 - DNA, 327 bp, Glycine max
  Peptide Sequence Number=SeqID_226416
atggagaacaacgcattcagagatcgaatcttggaggacaatgaacacgaagaaatccctgattcctttgtttgctgcgtttgtctggatctattatacaagcccattgtgctatcttgtggtcacatatgctgtttctggtgtgtctataattcaatgaattgtctgcgggagtctcaatgtccagtatgtaggaatcaatattatcacttcccaacagtctgccaattgcttcactttttacttctcaagatctataccgctgcttacaagagaagggaaaaccaaactcttggtatatctctttttctaatgacttatgcatga

SEQ ID NO: 109639 - DNA, 897 bp, Glycine max
  Peptide Sequence Number=SeqID_226417
atggacaaaaatattacactaccttggcttaaacgattggatatggctattgatattgcaaatcctttggaccatcttaacaattatggcatcatccaccgcaataaacttccggatggagttcctgtggatgccacccatgttactagtgatagagcagggtcaagtggttatatggacccagagtatttgacaaagggccagcttagcgtaaaaaatgatgtttatagctttggggtggtgttgtgtgagcttctatcatcaaagctagcgaaagactgggttctgaatgaagtggataatcttgtttccattttaagcagaaaaattgaaaaccaagctttggtggagctgttagatccaagacttggcttcgaatcaaaccttaagatcaaacaggttatgactgttacagctaaacttgcacttaagcgcatgaaattaatgtccacaagaattaaggccagcttctgtttgtgtgtttttgtcaacatacccaggggtcgcacttctcgcaattgcaacaaacacatgctagtttacgagtacatctccaatggcactcttactaacatcttcacgaatcttctggtgattttggattctcacggtctctttccaggtcatgctactcatgtttcaactattccagtaggaactcgtgcttacatagatcctgactactatgaatctggaagggtcagtgacaaaagtgatgtctatagttttgggatggtcttgttcaaactcatatcatccatccgcccaagtttaatggaaggcacaaatgatgatactctcacacagtatgcaaagagaaaaattttaaacaagcaattcaacgaggtagtggatccaagtttttggttaggttctaataaaatcatttctgtataa

SEQ ID NO: 109640 - DNA, 492 bp, Glycine max
  Peptide Sequence Number=SeqID_226418
atgaaagaaggtaaatcagttaaactcaaccatcaacaaccgcaccagaacggtcacctctcgccttcaaaattcgccaaattgtttgatccagaagcatcctgggacaaggatcaattgggagacgtattgcattggattagacaagtgctcggccttgcgtgtggattcctttggggttccatacctttggttggaggcatatggtttatcctaaaatgctgttctagttacaaaactaaggagattgcctgtatgcgtaaattttgttgtgctaaagcaacattaactctagaaatagagaagatggcctcgccaatgtgctttttagcgttatccactggaattatatatagttactatgcagtaatactaaaggttgatgaggaagagtttggcggtcatggagccctccttcaagaggggctatttgcttccataactcttttcctgctttcctggattttagtttacagtttagcacacttctga

SEQ ID NO: 109641 - DNA, 2214 bp, Glycine max
  Peptide Sequence Number=SeqID_226419
atgtccaatttcatcaatggtgttaaacccagccaagtgcccaacactgtcgatgtagaggatcactcctttgaccctgttaatgggatgatgaaaccctttgattttggattcatggataaccggtttcttatttcgcctgatccaaatgctgctcaaaatcccttttcctcgtccactgatgaagactatccattggatgagattgatttttctgccactgtcctacgctacataaaccaaatgcttatggaagaggacttggaggcaaagccgtgtatgttccatgataccttggctctccaagctgctgagaaatcattctatgaggtcattggtgagacataccattcttcttccatccaaaactatcacaacatggacagccccgatgagagtagcttcagtggtgcaacaactagcactagtaactcgtttgagtcgcaatggaataatgttgatcttgctgactataagccttccatactgcaaaccacttttcctgctgactttgttttccaggccagttcgatccaatcttcaatgaataccacaagcaactttgctgtaaccaatagtcaattcttggcaagttccgtggctggatttttggatccaggttcaacaaacttgtttagcaagagtgagtctgtactgcaatttgagaggggtgtggaggaagccaataagttcctgcctaaatggaatcctttggtttttgacttggagaacccatcttttagaatggttccccctcagcaggtgaaaattaaggcggagacagagagagatgaaatttctgctgagtcaagaggaaggaagaatcatgagcgggaagatgaagaagcagatttacaagatgggagaagcaacaagcagtcagctgtgtacattgatgacagtgagatatcagaattgcttgataaggtcctgctgggcacagggtgcagaaatgagcaagctccttcgtgtattggtcacgcagaccttcctaatgggccatccttgggtaaattagaagaaacaaacaagtctggtggtgggaagagccatgttaagaaacaaggcagcaagaaggaaattgtggatctgaggacattgttgattctatgcgcacaagctgtttcttctgatgatcgcatgtctgctaatgagttattgaagcagataaagcaacatgcttctccactgggggatgggactcagaggctggcccaatgctttgcaagtgcccttgaagcacgcttggttggcaccggaactcagatttatactgctttatctcacaaaagaacctctgctgcagacatggtgaaagcttaccaaatgtatatttcagcctgtccattcaagaagctttcaatgatttttgcaaaccatacaattttgcatttagccaaggaagttgaaactcttcatattatagattttggcatccgttatggcttccagtggccagctcttatttatcgtctatcaaaacaacccggtgggcctcccaagctgcgcattacagggatagagctcccacaacctggtttcaggccagcagagagagtccaggagacggggcttcgacttacaaggtattgtgatcgctttaatgttccatttgagttcaatgccattgcacagaaatgggaaactatcaaaattgaggacttgaagataaaggaaaatgaacttcttgttgcgaatgctatgtttcgatttcaaaatctacttgatgagacagttgtggtgaatagtccccgggatgctgttttaaagttaataaggaaggcaaatcctgctatctttttacatgctaatgtcaatgggagctataatgctccattctttgtgacacggttccgggaggcccttttccattattctactttgtttgatgtgcttgataccaatgttgcttgtgaagatccaatgaggttgatgtttgagagagagttctttgggcggcaggtaatgaatattgtagcttgtgagggttgtgagagggttgagaggcctgagacatacaagcaatggcaggttaggaacatgagagctggatttaaacaattgcccttggataaacatctcattaacaaattaagatgcaagttgaaagatgcgtaccacagtgatttcatgcttcttgaagatgacaactacatgctgcaaggttggaagggccgagtagtttatgcttcctcctgttgggtgcctgcatag

SEQ ID NO: 109642 - DNA, 2720 bp, Glycine max
  Peptide Sequence Number=SeqID_226420
atggactccaacttccccggtgcttcggaagaccagggcacaccgtatctctcagactcgcttggttttgcaaccatggaagacaacgacttctcagaaactgcaaagttcattagccagatcctcatggaagaaaacgttgaccagaagccattctatgactcactcaccttgcaagttaccgagaaatccttctacgatgctctcgccggcaacctacctctttctcccgatcaacaccccgttcttctcagtcccgaagctgaaaccaccaccaccaccaccaccagcagcagcagcagcagtagcaacaacaatttttcagatgaatattctcgtgagttgaagctccgttctccggattctatttctgtttctgcttttcagtttaaatctcaaccaccgccttcagttactgttagtgacgcagtctcagatttggattcttctattgccaaactcttagcccacaatattttcaatcatgttgattctgtttcccagtttagaagaggcttcgaggaagctagtaaatttcttcctccggggcctaaccttgtaactgctctacattcaaagagagaagaaccaatcaattcttttggagacaattcctatgggttgttgaagggtagaaagaatcaccagcgccaagagatagaaactagagaagaaggagaaggagagagaagtaacaagcaatcagcactttcccttgttgatgagagtgacctgtcagatgcttttgatcggctgttgcttcatgaaggaaacctgtgtgacgaacacattcgtttgacgagtggatcagtgaacgttgaggaacgagatggaggtaagggtcgttcaaagaaacaagggaggaggaagaaggaaacggtggatttgaggaatcttctattgatgtgttcacaatctgtgtatgccaatgacaacaggactgccaatgaattgctaaaacagattaggcaacactcttctcccgttggggatgcatcacagaggttggctcattacttcaccaatggcctcgaagcacgcttggttggggatggcacaagtgcacaaggaatgtatacttttctgagctctaagaacatcactgttgctgagtttctcaaggcataccaggttttcacttcctccagccctttcaagaagtttatacatttctttgcaaataaaatgattatgaaagcagctgcaaaggcagaaaccgttcatattattgattttgggatcctatacggtttccagtggccaatactcattaagtttttctcaaatagggagggtggacctcccaagcttaggatcacagggatagagtttccccaacctggctttcgccccgcagaaagaattgaggaaacaggtcaccgtctggctaactattgtaagcgttacaatgttccctttgagtacaatgccatagcatcgaagaactgggaaaacattcaggttgaagccctcaaaattcagagcaacgagctagttgctgtcaattgtcacttgaggtttgagaatttactggatgagtctattgaagtgaacagtcctagaaatggagtccttcatttgatcaggaagataaatccggatatttttactcagtccatcactaatggatcatataatgcccctttctttgccacgcggtttagggaggctctctttcattattctgctatttatgatttgattgacacagtcatacctcgtgaaaacgaatggaggttgatgcttgagagagagcttttgggcagagagattatgaatgttatagcatgtgaaggttctgagaggattgagaggcctgagacatacaaacagtggtatgttaggaatacgagggctggtttcaagcagctcccgctaaatgaggaattaatggccaaattcaggactaagttaaaggaatggtaccacagagattttgtcttcgatgaagataacaagtggatgcttcaagttcttattttccctgttagagcttcgagttatactcctactggcgcacttgctgattacttgagtcttgagatatttcagcttgttgcaatggtgaagctcattttgctggttacattgtttcaggttctggtatcctgtgtttggctacctacttgcttaactttcgggctgattgagtacaatgccatagcatcaaagaactgggaaaccattcaggttgaagccctcaaaatagagagcaatgagctagttgctgtcaactgtcaccagaggaagataaatccggatatctttactcagtccatcactagtggatcatataatgcccctttcttgtccacgcggtatagggaggctctctttcattattctggcatttctgataagattgacactgtcatacctcgtaaaaacgataggaggttgatggttgagagagagcttttgggcagggagattatgaattttatagcatgtgaaggttctgagaggattgagaggcctgagacatacaaacagtggcaggttaggaatatgaaggctggtttcaagcagttaccactggatgaagaattaatggccaaattcaggagtaagttaaaggaataccacagagattttgtcttagatgaaaataacaactggatgcttcaagcatgctgcaatggtgaagcttattttgctggttacaatgtttcaagttctgatatccttggtctctggctacctactttcttaaccttcag

SEQ ID NO: 109643 - DNA, 2208 bp, Glycine max
  Peptide Sequence Number=SeqID_226421
atggagtccaactttaccggtgccgatgacctgtttgctgaagacaagggtatgccgtatctctcagactcgcttggttttgcaaccatggatccttcacctgaagacaacaacgacttcttagaaactgccaacttcataagccacatactgacggaagagaacgttgaacagaggccattctatgactcactcaccttgaacagaaatccttctacaatgctctcgccagcaacctacctctttcacccattcaacaccctctcgttctcagtcctgaagatgaaaccaccaccagcagtagcaacgacagcaacaacaatttttcagatgaaaattctcttcaaccccaacaccctttctcaaccaccgccttcagttactgttagtgacggagtctcagatttggactcttctattgcaaacctcttagcacataatattttcaatcatgttgattctgtttcccagtttagaagagggttggaggaagctagcaaatttcttcctccggggcctaaccttggtagaaagaatcatgagcacgaagagatagacactagagaagaaggaaggagaagtaacaagcaatcagcactttcccttgttgatgagactgacctgtcagatgcttttgatcgggtgttgattcatgagggaaaacagtgtgacaaacacaattgtttgcagggtggatcagttaacgttgaggaacgagatagaggtaaggttcgttcaaagaatcaagaagggaggaagaaggaaacagtggatttaaggaatcttctgttgatgtgtgcacagtctgtgtatgccaatgacagcaggactgccaatgaattactaaagcagattaggcaacactcttctgccattggggatgcatcacagaggttggttcattacttcgccaatggtctcaagacttgcttgattggggacggtacaggtgcacaaggaatgtatttttttctgacctctaagaagatcactgctgctgagtttctcacgacataccttgttttcctttccgccagccctttcaagaagtttatacatttctttgcaaataaaatgattatgaaagcagctgccaaggcagaaaccgttcatgttattgattttggcatcctatatggtttccagtgtccaagtcttattaagtttttgtctaatagggagagtggacctcccaagcttaggatcacagggatagagtttccccaacctggctttcgccccacagaaagaattgaggaaacaggtcactgtctggctaactattgtaagcattacaatgttccctttgagtacaatgccatagcatcgaagaaccgggaaagcattcaggttgaagccctcaaaattcagagcaacgagctagttgctgtcaattgtcacttgaggtttgagaatttactgaatgaatctattgaagtgaacagtcctagaaatgcagtccttcatttgatcaggaaaataaatcaggatatttttactcagtccatcactaatggatcttataatgctcctttctttgccacgcggtttagggaggctctctttcattattctgctacttatgaattgattgacacagtcatacctcgtgaaaacgaatggaggttgatgatcgagagagagcttttgggccgggagattatgaatgttatagcatgtgaaggttctcagaggattgagaggcctgagacatacaaacagtggcaggttaggaatacgagggctggtttcaagaagctccctctgaatgaggaattaatggccaaattgaggactgcgttaaaggaatgggccacattttgtatgcttccacttgttgggtgccagcataatgagatgctactggactgggttcagaactcatactatactgaaggttttggtatccttggtttggctacctctacttgcttaaccttcaggtgctgtgatgaagattgcaacaagctttgcacgaagttacttgcttgtgagaggaggcccgagacatacaagcaatggcaggttaggaacatgagggctggatttaagcaattgcccttggatgagcatctcattaacaaattaagatgcaagttgaaagatgtgtaccacagtgatttagtgcttcttgaagatggcaactacatgctgcaagtttggaagggccgagtagtttatgcttcctcctgttgggtgcctgcatag

SEQ ID NO: 109644 - DNA, 232 bp, Glycine max
  Peptide Sequence Number=SeqID_226422
tgcttttgaaaaatcacttcgagctcgattagtaaagggaacgataattgagttcaaacgaacagttgatggacgtctgatcactaaaattagtggcaatcagataggaagtgtccactgcaaagatttgtgccgggctttctttgacatgtacattggagatgtccctgtgtgtgaacaaactaaaaaggagattggcatgaatgctgcgaatattattaggaagtgctaa

SEQ ID NO: 109645 - DNA, 816 bp, Glycine max
  Peptide Sequence Number=SeqID_226423
gaaaatttgaggatggatgtgagattacagtccagcgctttaaggaagacaagcgctacattttgcaacagtttatcaatgaaactgttatcctaaattacttgcctcacaaaaatattgtatcaatttacggttatgcttctcatcatgaggaatccctgctagtgcatgaatacctatccaatggtaatcttgctgctcatcttcaaagtgaaatagccaaaagcagcaaaattccttggcttacacgattggatatagccattgatactgcaaatgcgttggactatcttcattatcatggcatcatccaccgcaatgtaaagtctagcaacattctcctagatgcaaacttttctgctaaagttgctaaccttcatttatcacggaaacttcctgatggagttcctgtccatgccacccatgttactactgatataatagggtcaggtggttatgtagacccagagtatatgacaaaaggctggcttagcgtaaaaaatgatgtttatagctttggggtggtgttgtgtgagcttctatcatcgaagctggcaaaatattgggttctgaatgaagaggaaaatcttgctacccttttaaacagaaaaattgaaaaccaagctttggtggaattgttggatccaagacttggcttccaatcaaaccttaagatcaagagtatgatgactgctacagctgagcttgcagctttgtgcatgcaatgtccacaagatctaaggccaaacatggaacatgtgctagagattctcaatggcataaagcaagggagatatgaaacaaactcgataaaag

SEQ ID NO: 109646 - DNA, 1050 bp, Glycine max
  Peptide Sequence Number=SeqID_226424
atggataatgtttctgatatgcatgaagaatctaacattctcgatcctagtccttgtgttgatgaagtttatgtcagtggagaggggactatgcttgttggttttgataatggtttgtttgggagtgaatataagctagtggatggagatgacaatgaagattatgaaagtgaagacattagtgactttgaggaaacaatagatgccattgaaaatgagcattcggatgatgatattgaagaaatttatgtggagaaggggattaagggccaaccacttgagaatgggccaaatggaaagatcaagcttgccaagaatcaattattttttaatttagatcatttcagggaaatcctgaaggactatgctatccaaaaaggatttcaattgtatagagttaaaaatggaagaaggagggttacttgtgagtgtaacactcatggttgcacctggaggatccatggatcccctactccagaaaagattgcaaagaaattagagagcttaattgtggttgatccaaacataagttatcctgcagtgaagcaaactcttcttgaaaaatacaatgttgaatcaagtagtaagatgcaattttatcgagctaagagaaaggtccaacaaaccacaaagggtgtacatgatgtctattacaatgacttgcgaccatggattgttttagtagagaatgaaaataaaggaagcattgttaagctgaatgtggaattggtacctaaacctaatatgaatcctcaatttaaaaggctttttctttgccttgatgctcaaaagaagaggtttgtcaggggatgtaggccttggcttggaatagatgggtgccatttgaaaggcccatatggggggattcttttgtctattgttgctttagataccaataggggaatattccttatagcagttggggtggttgaaattgagtgcaaggaatcttggatgttttttctcacttatcttcctgaatctctacaaagtgtgcccgggtggaaggataattgtttgacaattatgtcatatatacaaaaggtttag

SEQ ID NO: 109647 - DNA, 558 bp, Glycine max
  Peptide Sequence Number=SeqID_226425
atggaacattttgaggcagccattgataggatcattggtggcttggaaaagaggaacaagatacatgaaaattcagttgaaggacggatattgcatgggaactcaccttgtgaactgattgaacgttccacagaaagcattggaaggctacctgagcttccagagtggataatatcaagtgctatagttggaatgcagggtcgcaaagatgttgtacgtcacatttgggatgtgttgaagcttggaatgaatgttcatcattcccagcttgaaacagaaaccttggaaaatagccagagacaaagcttttgtgaagatatcagcaagttgcatggaagaagagatgagaaggagcttgatgaggccatcgttaaccttttgtcgcacgatatgacagtcgatttctatgtgtttggtgcgttcgtggaagacaggattagaagcgatttgaatggtggaatgattatcgcaataaagagtagctggttgaatgaaggacacgcggaaatcttgaagaagaaacatgagccattgcagttcacaggcagtggaagctaa

SEQ ID NO: 109648 - DNA, 663 bp, Glycine max
  Peptide Sequence Number=SeqID_226426
atggcacttagcaaaaaatatgaaattatgagagcattgcaagagaccaattatattactttgcctaatgataaaatacagtttattgaagagaacaacgagaatccaaccattgctctcgtctctccagttttggattcaaccaactatcattcatggaacaaatccatgatcatagcgttaagcgccaagaacaaggtagaatttgtagatggaagtgcaccagagccattgaagactgatagaactggaagaaatctagcgcaatttgaagtccagatactcgcaaggagatctcttgcgaattttcgatctccagtaggaagcatcatcgatgaagggtgcactctcaccttctccattatcgcacagaaaaagctcgaggatcaagctatgcagtttttgcatggactgaatgaacattatgctaatgttcgatctcatgtgctgctcatggatccaatgcctgcaattttgaagatattttcatatgtggcgcaacaggaacgacaactgctaggtaatacttctttgaatctcaatctcaaatccaaagacatttctatcaacgttgtgaaagttgtttgtgatttctgtggacgagttggccacatgggaaatgtttgctataagaagcatggcatgccttccaattatgattga

SEQ ID NO: 109649 - DNA, 492 bp, Glycine max
  Peptide Sequence Number=SeqID_226427
atgagaacctcgaagccctttactgacaatggtcaccctctcatagttgatgacatgtttgatagagtagagttaaggctgagatggtttggttcaaagtcagttgtcaagtctcctcggtgcagtataaggaggcaatccacatttgctgatgctgaggaagatctgtctatgatttttgcattagcaagcacatgggccatgttccatgcatttggcagtttagcctgtgttggtcccatatcatacactattggaatggcttatcaaaatgcattcgattcaggcttatcacttggtagccaaacatctggactaggttttctggccttggtgaacagccttattttcgttgggctgtgttttgtcatcggctaccctgttgcttcagctttttccccttcatcatcttatgccttaatcttcaaatgtgtacttcaaacaatatctcaaatgcccccttattttagttcaattgggaaatccttatag

SEQ ID NO: 109650 - DNA, 387 bp, Glycine max
  Peptide Sequence Number=SeqID_226428
atggggtgtagtgtaaatcacatagacacacgcacacagagggaaaggaagaagaaacgaaataacagagcgatacctaagaaagtactcgatgaaggtaatcgtaaggtagtcctaaatagaagaaaagaaaaggaaggtgagagattaagatttggaagtaagaaagaagaagtgagtagtgcctttgaggttgaaagcaaatcggactcggaaggaacaagagcttatccaatacgaagaacttatccatgctggtggacttccgcctgtgctgttgcagaagagggacccaccgcagtcaccggtggcacagcgcccgtgctcgctgatgtcgaaggtgcagctgtggcggccccagaaacgcccggatcagagggcggatag

SEQ ID NO: 109651 - DNA, 627 bp, Glycine max
  Peptide Sequence Number=SeqID_226429
atgcctcttcctcctcacaaaactgccattggttgtcgttgggtatataaaatcaagcaccgtgctgatgggtctatagaaagatacaaggcacgtttagtcgtgaaaggatacactcaaacagagggtttggattatctcgataccttctcgccagttgcaaagctcaccacccttgatgtgaataatgccttccttcatggtgagcttaatgaagaggtttacatgcatgttccttcgggacttccagtcacaagcccaaaccagcttcaacccccgtggattattccactcggttacagccttcctcgggcaccccattatccgatgtatcttcattcttctatcgtcacctggtcggacgtcttatttacctcaccaatgcgcgccctgacatttccttcgctgtctagcaacttagtcagtacatgtccactccgacaaccactcatcatcaggcaggttttcgcgtgttacgttatcttaaaggatcaccaggcatgggtctcttcttcgctgctcatggcactcctcaactttgtgctttcagtgactcagactgggctaggtgtcgtgatactagacgttccatcaccggcttctccgtttacttcggttcttcactaa

SEQ ID NO: 109652 - DNA, 216 bp, Glycine max
  Peptide Sequence Number=SeqID_226430
atgaaccaattacagcaatcaaatgtcaggacaatgcctagaacaagaactgtaaagagttataggtttaggattaggaaagaaaggaaacttaggcggctcaaatttaagcattgggatagtgggttcatgacaaagaaaaattgggaaagtcttgtaatacctgtttttctagatggcgaaaaccacgagatggctcttgctcctagactttga

SEQ ID NO: 109653 - DNA, 690 bp, Glycine max
  Peptide Sequence Number=SeqID_226431
atggcgaacaattccagaagcttcgcgctcgaggaggcgttcggacacgtgtcgcggttcgccggcgcgttgctgttctggctctcgcgcgcgtcgagttccaatttggcgcgttcgctgcgcggttcttctccgccgcttcggttcggtagcgtgcaggttaaggctgtgtcgacgaatgtgcgcgtgttcgggtttccgttcggattgaagaggaaatcgtcgtttgcgagtgtgaggttggggaagatttctagtttggcgatgaggatgatttggagagaagcgaagaggcttcgctcgttccctgttctgtcgctggcggctgcgttggttccaccgtttcaaaacttgtcatcaaatgtactatctagcccgttgcagaatcctgatgtgcaaatgtttggagccatggaccaagtgcctaaggaggttgaatgccaaggatgtgcattcctaccgtgtcttgagttgaaccaggcaaaacctgcagtggagcctaagactggtattgaatttcctttggttctagacaatatattcactggagagaagaattatgacttcaactctgagatctactgccagagttatcattggtcagtggtcaccaatcacttggcattggggctccatagaccaccaaatgatactaaacaatcccaaatgcaagtcatgaatcagaaatag

SEQ ID NO: 109654 - DNA, 731 bp, Glycine max
  Peptide Sequence Number=SeqID_226432
atgggcttactctgtagcagaaatcgccgttataatgatgctgatgctgaagaaaatgcacagactgcagagattgaaagaagaatagagttagaaacgaaggctgaaaagcatattcagaaacttctactacttggagctggagagtcagggaagtccacaatatttaagcagataaaacttttgtttcaaactggctttgacgaggcagaactaaaaagctacttaccagtcattcatgcaaatgtgtatcagacaataaaattactgcatgatggatcaaaggaatttgcccagaatgatgttgattcttcaaagtatgttatatccaatgaaaataagttggttcatgacatgatatcaaagtctatatggtcaagtggtttagagtttgatccttgttatccccattcttcagataaaaagttgaatttttggcacaaggaaatcggggaaaagttattggaaattggaggcaggctggattacccatatctcagcaaggagcttgcacaggaaattgagaatctgtggaaggatcctgcaattcaggtggctagatggcacactttggagacatatgcccgaggtagtgagcttcaaattccagattgtactgattatttcatggaaaatttgcaaaggctgtctgatgcaaattatgttccaacaaaggaggatgttttgtatgcaagagtgcgtaccactggtgttgtagagatccagttcag

SEQ ID NO: 109655 - DNA, 531 bp, Glycine max
  Peptide Sequence Number=SeqID_226433
atgtacgaaactgatgatggtatcacatttgaaggccctaaaaaagctattcaaataaagtgtggaaagaggaaagtgcctggctgcccaccactagtggacgcgcctgacaggctaccactagtggtcgcgcctggcaggccaacactactggtcacgcctagtaggccaccactagtggtcatgcctggcagaccaccacttcccccccccccctctgtcccatcgtcccctgtcaacttgtcacgtcacgccacgtgtcgtcttcttatggaacgcgcccctcacagacttggttacaacctggtcagggtaaaggaggcgcagggccatgcaggtggtatatgggcgctgtgtatgaaaggagctgccttctcgttcactatgatagagtctatgccacagtgcattactttacaattgatgaaagagaggcaggtctggtgttgttttggggtgtacgcgagcccaagagtagccacaagaagattattgtggaagtaccttgaggaggttacgggaagagtgtag

SEQ ID NO: 109656 - DNA, 324 bp, Glycine max
  Peptide Sequence Number=SeqID_226434
atgttggggactgctctgcaatttggaggtgttcgtggtgatgatcggttgtacattccggtgaaggcaaggaagaaccagaatcagcgtaaaccggttcagagagagaagagtggtggtgaaactgagagcactgattccgtttcaaagagggaacttgctgcttctgagaatgggaatcccaatgagtcttcatactcgttgaacaaaccatcttcttgcccttctgtagagcctgctagtaacattgataggtttttggagtccacaactctttcagtcacagctcaatatttggctaagggtacaacatgctccatttag

SEQ ID NO: 109657 - DNA, 1749 bp, Glycine max
  Peptide Sequence Number=SeqID_226435
atggagatctccccaatgttttattctcttgcattccctcacaaatctgttagtgtgaatatttctggtaagtcacatgaagacttcaaggaatcccatgttagtgcttttgtctcggatttgacagctgatgatctgtgcaatgagattcttccatcttcagttgatattgttacaatgatatttatgttgtctacagtgtccccagaaaagatgcctctagttttgcaaaatattagaaaagttatcaaggaaaggttctctggcaaggatcaaaagattagtgataacttttatgttagaggtgatggcactcgtgcttactatttttcaaatgagttcttgaaaaatttattcaaagaaaatggttttgatgttgacaaacttcatgtatactgcaaacaagttgagaatcgctcaagggagttgataatgaatcggcgttgggtccaagctgtatttcgcgtatcagatagttccaactcttcttcatgcatagaagctgaggccaatcatcttgacaatgataatgccaatatggaaatcaagcaaaatagtttgaatggtggtttaaatgattctgcagttgacttgtctgagggtgtggcagttgacatgtttggagtcttaccttccaacgaatatgaggtaagcttgtcgatgagctcagcaactacatcagacctgaaattgggtccaacaagacctgtcagacactctgaagcagatggcaataataatgctgacaaaccagacggtgacagtgcccaatctgacagcgagggtccaagcaatgggtggatgatgagggtctcaaacaacgtggacaaccaggtggtcctggcagaggacactatgtactaccccactgctgaagaggtgcacagcaaagacgaaccccttgaacatccatcattaagctggagtcttccacattccatctgtgtcctctcagttcctccttggcctcacgtcaaaccactccaggttgaagctcagggactcctggaaagcaccagacaaggaagaaaaattattgagatcaaccttagaagctggaatttcaagattagtttactttcaaaagagtaccagcatacctgcaagtcaacaggtttgatgctgtgggaatcagctcggttgatggcttctgtccttgcagaaaatcccaacattgttgctggaaaaagggtcttggagttggggtgcggcagtgggggaatctgctccatgattgctgttagagatgctgatctagtagttgcaactgatggagatggctttgcacttgatctcctgaccaaaaatgttgcatccaacattgagccatcattactgactaaactcaccacaaaaaaactggagtggggaaacaaggaacacattgaatgcataaaggaagtagtgagcaatagagggtttgatgtcatcattggcacagacgtgacatatattcctgatgctatattgccattgtttgcaactgctaaagaactgattgctcccagaggaagcaaggaagatgataatgtccccagacttattctttgccacatctttcgccgagtagatgaaccaaccttactttcggccgcagtgcatttcgggtttagattagtagacaagtggcctgctggtacttcaagtaatttgtctcaaagcattattgacaattggtttgttgacaatgatttaaaggatgatcttcctagtacagcattaaacatcttgctcttctgcaaggagtga

SEQ ID NO: 109658 - DNA, 312 bp, Glycine max
  Peptide Sequence Number=SeqID_226436
atgggcctgaagctggtggaaaatgttgagtacagtgaatctggtcgtggggtataccctgatggcttataccgcaggctgcttcagtaccatgaaagatacaaacatctaaatattccattcatcattactaaaaatgggtgggctgatggatatgattccaagtttggagttgttgatgttgactgggcaaataagcttgcacggatccctcgcccctcttaccatgtattttctaagattgtgaatacaggcaaagttacacatgaagatggtgaaagagcatgggatgaacttcaaagagctgcgtaa

SEQ ID NO: 109659 - DNA, 267 bp, Glycine max
  Peptide Sequence Number=SeqID_226437
atggctagacatggcagcggaatccgacctcgtgggaatcgaatcgaacccgtcccgactttgacggataaaaaccgtgttgatcgggttcggggtcggattcgggttttccccgataacccaaaatgggggcgagggcagctccttagtcctcattctacctacctctctctgtctctcacaagttcactcgtcgctgtagctcctcagtcctcactctaccactcctgtacttcgatctcctctccgatctcgattccgccatag

SEQ ID NO: 109660 - DNA, 270 bp, Glycine max
  Peptide Sequence Number=SeqID_226438
atgaaccaagcaaaaactggtaggcatataacacctcgaatgaatcatattagaatgagagggatccagaggttgtacagttatgagatggatgacattttgagaaggtttcccaaaaagcatgtgagtgaggacaaaacacaccgaaaagtctcatgttggtttgtggggatagtcgatgatcttgagaacattcgagcagtgactgagctggttgtcgaggtctcgaaacctacaaagaggattctgaccaacaaggatgttgagtaa

SEQ ID NO: 109661 - DNA, 546 bp, Glycine max
  Peptide Sequence Number=SeqID_226439
atggaaagacatataaatctcaagaatatttttggatttggccacaaactaagtgacaccaaaatagtggcttaccttatccaaacctttgcacgaaccaaagagttaaacaaaggaaagcagttgcatgctaggctgatccgaggagggtttttgccatgcacctttctgagcaataacttcctcaatttgtattccaaatgtggagagcttgattacaccatcaagctgtttgacagagtgtcaaagagaaatatgatttcttggacagccatgattaatgggtttgttcataatttgaggtttcagaaggctttgagttcattttttcaaatgagggttgaaggagaaatagccacccaatttgcacttgcaagtgtgcttcaagctcgtgcctcacttggggcaattcagtttggtacgcagaagtgtgtggaggtgtctgatgcttgtaaagtttttgaggaaatgccttgtaaggatgcagtgttgtggacgtcagtgattgatggctttgtgaaaaatggaggttttaagaagctttaa

SEQ ID NO: 109662 - DNA, 312 bp, Glycine max
  Peptide Sequence Number=SeqID_226440
atggttgctatatcacttaaagttatgttccttgttttctcatactccgttgcttttgttcttgcagggtggaacaactttgtcctttcccttatgaccttgaccaatgaaagcttaaacgatcgatatccaaatgctgaggttgtttggtgtcaagaagagccaatgaacatgggtggatcttatgttttaccccgacttatatcttcaatgaaagctgtgaataggaaaggttatgacgatgtcaaatatattggtggtgctccattcgcggccacaaccactggtttccttaagattcaccaaaagtag

SEQ ID NO: 109663 - DNA, 120 bp, Glycine max
  Peptide Sequence Number=SeqID_226441
atgtggtgttacgagtggaaaaagagtgaggctttgagagttggaaggacttatgagaaagcttgggctgtgctagagagaaaaacaaatgaccaaagtgaacaaagagtcatttctaag

SEQ ID NO: 109664 - DNA, 369 bp, Glycine max
  Peptide Sequence Number=SeqID_226442
gcgcagtggattaagcaagtctcttggcatctcccgcgtgttggcattgttaagtgtaatatggacgaatcagccaaaggttctcttggacatgctgctgctggagttgttattattgccttggaagtggcaaagtgcagaggttggaacaatctttggattgaatgtgaatcatctttgatcattcaggcttttggcaacccgttgctggtcccttggcgcctccacgataaacttgctaagcttgacacttcgactcatgatagtacacttggtggcactctatccctagctttcttaggacagaaattccttaggaacataatttatcttccttcttataggcgtatttgggtttttggggtgtga

SEQ ID NO: 109665 - DNA, 369 bp, Glycine max
  Peptide Sequence Number=SeqID_226443
atggcaatgttactctgtatgtgcatgcttgtaattttttggtgtcttgatatgttcaatgacaatgttactaaccctgcagcttcaattgggttatatcttgactgtggttccatctatgagacgccattttcaagcggggcttcacacttgctagagcgaatggctttcaaaagcacaacaaaccgtagtcactttcgcattgtaagggaagtagaagcaattggtggtaatgtaggagcctcagcctctcgggagcaaatgggttatacatttgatgccttaaagacctatgttccacaaatggttgaattactggttgactgtgtaaggcacccagccttcttggattgggaagtcaatgaagag

SEQ ID NO: 109666 - DNA, 354 bp, Glycine max
  Peptide Sequence Number=SeqID_226444
atgactaaagcacgtccaaaggggtttgatttcgggaacttaccggttgaagaccgaagaacgacgaagaacgacgaagaacaaatgaagaacgacgaagaacggttgaaaatctttgcgaaatcacccacggaaacgtcacggaagcgcctcgggaaggagaagcttgccacccagctcgcccaggcgagctcagcttgccctggtgagctaggttgcttcctccagaaggcaccgccttctggagaacttcctggatggcccaagaatttccttacgatgggtgccaagtacctcgaagtggtcaaacaagggtcgcatcccaacaacggatggtccccggacgaaattagg

SEQ ID NO: 109667 - DNA, 891 bp, Glycine max
  Peptide Sequence Number=SeqID_226445
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttcacggtgctcatgattgcgcaaatgtatctcctaagtatccctgcaattcgtgtcaagctaggactctctaaagttgttccagcagctgtgatggctcctcccggcatgctcgttgttagcccaattggtctgactcatgcagctaaagccattcaagaagcacgcagaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaaa

SEQ ID NO: 109668 - DNA, 2228 bp, Glycine max
  Peptide Sequence Number=SeqID_226446
ctgcgacgggtaccgatgtcgaaagtggtttgcaggaagttgaccgcctgacgcttttcattcgtagtgaagaagtttttcagcacgctttgcagcatctccttgtcggagctcagggtctgcagctcgcgcaaggtggcctcggaaatgcccagctcctcacaaatctccctgactttcactcccaagatcgtctcggtattcggcgtcatatttgtgacctcctacgtggcaaaatcctttggcccaacggtgtttggtcaaatggcgttttcgacctcgctgttctccatggtgcaaaccgtggcgatttttggtaccgaaaccatcctgttcaagcgcatcagcaaaagtgcgccgaaaggcctgcggctgatgaccgtggcgcggaccatgcgcctggtgctactgttgctgacatcaatcccggtgttgatttgggtctggacacgttcagcgtttataacaatgcgcgactggcgtcgcggctcaataccattgctaactcggccggcttgctgctgggctttgccatgagcttcaccatcgcctggctgcatctcaatccactgtggctcaccgcctcgattgtggccgtcacactggtgccgtacgccatcaagcgcgtcaatttctatcgcgaacatcaggatctggcaccgccgcaggacaagcgcaccacctacctgcgctacctgatgtatgccggcctgccgctggccatctccagcatctttatctcggtgcaggtgaaagccgcacagatgttcctcgcgggcatcgcctcagcgcgcgaccttggcctgttcgccgccgcgaataccatttcggcttcctggatttttatcccggttgccatcatcacttcctgcttctcggagattttccgcgagcgtggagcagccgcgatcaagctcaccgcgcggctgaacggctatgtcatgggagtttcattgctgttattagcggtgatcgccttatacggcgaaaaaatcatcatcgctttatatggtcacgagtacacacagtccggaagtctcattacgttactgtcgttagcaacctgcttttcggcaatggggaccgtcgcttatcgctacatgcctgccgctgtcgtggtggctgatccagggctacggcatcatgggtgccgcctggagcgtcttcatcacggagttactgtccctgaccgtaatgaattacttcttcaaaaacggcgtcatccaaaaaattcaggtttcctcactcaactacaaaacctacaaatgaggtcagatatgatcaggttgaaagacgaactcagaagaagcgtacagtatttcatcaaaaagatgccctgggcttaccaggatcgcatctactactttcacaaattccgtaagctgccgaacctgcgtcagccgaaggtgttcaacgagaaagtgctgtatcgcaaattcgtctacggcgactaccagtgctatggccgcctgtcggacaaattttcggtgcgtgagtacattgccgaaaaggtgggcagtgagtatctgattccgctggtttatgagaccagcgatccgcactcactgcatacgctgccgagctggaagaacacggttatcaagccgaatcacggctccaacatggttgagatcctgctggaagaaccggatgcgctgaaaaaacagcagattatcagcgactgccagcgctggctgaagaccgacttcgccaacgaggcgcgcgagattcactatcgctatatcaagccgcgcattctggtggagaagtacatcggcgatggcaaaaccgcgccgatcgattacaagtttcacatgttcaacaagcgcgacggcaattttgaatatgtgctgcaggtgatctacaaccgctgtaatccgctgctgtcgatgaacttttacgtcaacaatcttaacgaggcgtatcacaaaatccgtgataccgggctggatgtgtcaccgttgctgccacagctgcagcacgcgctggcactgagtaaaacgctggccagcgacttcgattatgtgcgcgtggactggtatatcgatggcgaacagatctacttcggtgagctgacgttcacgccaggcgccgggctggtcaccgggttggatcgggggcttaatcagatgatgggtgatatgtggattcaggatcgtcgcgatacgcagagatcggacgtcacggtgccggaagtaccacttccagccgtattgaagaaaatttga

SEQ ID NO: 109669 - DNA, 1555 bp, Glycine max
  Peptide Sequence Number=SeqID_226447
cgtgaaccggcaaaaaagcgctgctggctcagatgctgctcaatcacgcgcccgtggagcgccagctgcttgttcagccacgctttctgaatgcctttactcagcgccacgccggccgggcgcagcagccatggcaccggctttttgcccagttgcgcaaacaccagcttcatcaccagtagcggcatcagcgaaccttcagcatagtgcagccagtaacgcgcctgaatttgctcctcttcctcatgcagcgccagcagatgctcgctgtccgtttgatttgatacggcaccgccagctcttccagcagccacagcacccgatgagaacgggagttttccagatggtgaacggtaatcatgcgcgattccttgctgctaagggttggcatctagaccgctccggagccctgctgccccaggcggtcacccggattgcgcagtggacagtcgcgcatcgacaggcagccgcaaccaatgcagccgtcaagatcgttgcgcagacgcgtcagggtttcgatgcgtttatccagctcttcgcgccagtgctgcgtcagcgcgtcccactcctgcgtcgacatgcgcttattcgccggcacgtgcatcaggctgtcgctgaccgtcgccagcggaatcccgatgcgctgggcaattttgatgattgccacacggcgcagcacatcacggctgtagcggcgctgattaccgccattgcgcgtgctgctgatcaagcctttgctttcataaaagtgcagtgccgataccgccacgccgctgcgtttcgccacttcgcccggcgtcagcaccggtttcgggcgataaccttgcagaaggaacaggctatgatgcaacaggaaatcatccattcactgactaactggatcgatcagaatctggataaaacattgtcgattgatgaagtggcggcaaaatcgggttactcgaaatggcacctgcagcgtatgttccgtacggttacgaaacaaacgctgggtggttatattcgtgaacgccgtctcacgctggccgccgaagccttgcgtcagacgcagcgtccggttttcgacattgcgatgcagtacggctacgactcgcagcagacgttttcacgcgtgttccgccgtcagttctcgcaaacccctaccgcttatcgtcacagcatgcgtcgccaggcgatggtgcagcgtccgcgtctggtcaacttcgactgcagcgaaggcatgaacagctttgcccagcgcaccaccggcgagtgctgcccgattcaagctgtattaagacgacagaagggcttccctgacctcccttttctgccgccagtgatcgcgctaatgatgttcttcgccagcaccatgaaaattaaattgcgtcagaacagccaccacgtgatggcgctgatgtgcggcggcgtgggcgtagcgatgtcatgctggttcgttaccggtctgctcggcattacgctgagcatggaaaacgtgcataactttatgtccatcaccaaagaagcgtttattcaggtgatgagccagacaccagccgactggccaatgccgtaa

SEQ ID NO: 109670 - DNA, 1338 bp, Glycine max
  Peptide Sequence Number=SeqID_226448
atggtagtggatatgcaaaatggcgtgctggcaacgccgcgttacgaccgcgccggacgctgcgcgcgcattaatcagctgatggccgccgccgatcaggtcatttttattcagcatagcgggccggatttagccgctgactccgcagactggcaaatagtcgccgaactggaacgacccgccgacgcgctttacatcaccaaaaccgcctgcgacagcttctggcaaaccgggctcgcggcgcagcttgaacagcatcagattgaaagctttgtcatttgcggctgcgccaccgattattgtgtcgataccaccatcaaagtcggggccagccttggctatcacatcaccgtggcggccgacgcccacaccaccgccgatcgcacttatgtgtcggcgcagcaacttattaatcagcacaacgaagtgtgggcggatttgatcatgccgggcaatccggtgcggatgcgagcttatattcctcagcatggagccaatgacaacgcgctgtggcgggttgctggcctgcctccacgtggtattgagttaacgcgtatgctggaagccggtttgccggtggccgtcattgatgatatccgtcactggtcggccatgacgcgcgccgaaatcatgaaggtcacagggattaatgaacgcaacattgcccgtcgtaaaagcacgggtaaaagtctgtcacccgacgagagtgaacgtgtcgcccgcttcgtccgcgtgatggatgccgccgttcagctttttgctggtaataaagaagaggccacccagtggctgagccgaccggtgaaagggttaggcaatgttgcgcccatcaccttactgacgacggagagcggtgcgctggatgttctcgatctgatcggtcgtctggagcacggtagccagtatgcggctgaagcctggtccggttatggggcaaaacagtatggtggacgctggaatcataaaggctatcccaccatttatgttgccacgtcggtgtcactcgcagcactggaagtgctggtccatatcggaagagagtcggtgctggatgagtacaccttattcagtatcgacatcccggatgctgaagttgcctatcttgctgaagcatttttaccgccggactggcgtcatgatccagcgccactgtcgacaatggatctcggcaccggctggctgcaatccgctgaaggcgccgcgctgatgctaccttcaacgattatcccgatggaaaacaaagcaatattaaatccgcttcatcattcttttaaaagcgctcttaccagagtgaaagaattaccttttgtctttgatcaacgccttataaagggatga

SEQ ID NO: 109671 - DNA, 889 bp, Glycine max
  Peptide Sequence Number=SeqID_226449
atggaatccatgtgcacaaactaccagaaaataaaggcacatgccagggcagttgcggaagagatacatagtgcttttgattataatgaggttccattagatactgcatccccagaaaatttgactttgatagatctggcaattgatggtgaagaacatgatgaatgtgaagactggacatctaaactaggcattaacctacggaattgtgtccatgcaagaaataactctccatctaaacaagttccttggatactagggacgctgttgtatgataaatgccttgcttcaaaatctttagctttaaattggcaatcacggagatctcgatcaaaaaggtcaagttgtttggctcagactaaaccgtgtgacagtattgagagaaagaaggaggatcggttttatggaagaatagatgactcccctgctgaaaagaagctacttcaatattcaagaaggaagttcaagtcaaagcaaaggtgtttccctgtagcaagcatggtcagtgaattccaagagaagtccaaaaatttgtcagctactttgaatggggatcataataattgtttttctaaaactgatcttgaagctaagaatttcaggagtgattatgcattgtcatgtgtctctgcttctaccaaaatgtctccaatacatcctgaaatccagattgctgaaatgcctgctagcacgagattaaacgatgctaaaccgcaaccttccaattccattcctgatcatactttaatgactgaagaagttggagcagagattgagaagcaaaccatacaggaatcagatgtagacagaaataatgatttaacactcggtcattctaagatgcattgcaataccagtgtctcagaaatatgtggcaaggagagccaag

SEQ ID NO: 109672 - DNA, 1423 bp, Glycine max
  Peptide Sequence Number=SeqID_226450
ggcatcaagaatatcagtctacctgcaaagcaacaatgaggaagctgctttatcacctgcttcattggtaaatcaatctaccctggcatctgtggttggaagttttggaagtccaaataataattatactgcagaaaaaattagcagtcctattttcctagaaaagacaactgaggaagaaattgattctttaagcgaaagggacaaggaacctctaattgatgacagaccaattagcgaacatactctaaaagaagtttgtgaagttcaaagagagctttatgcttctgcagacttgcataataccatagtcttggattatgagatgcaacatgaaactcagggtggaaaagatagcagaaaagaaataaatcagtcaactcttgtttcaacaattacaagaggggaatatgctgaagggttgaatgatgaagtgattccaaagtctgtggagcagtgccagattgaaaatatgaataaaattaatgtggaacctgtttctagctatgttgcaaaaggtgaaaataaatgtgtaacttcatcagaattaggatgttctgaagttttagtggaaacctatcctaaagactcctgtattcaattgatttcagataaagaaaaagaaacggaaatccagtcagtgagtataattgatgaggaattttgctctggcacagatacatcgatagatgactcttcatcaatccaggaatgttctaaaattgagaaagagagctgtgttacagaaaacataaatggaatcaaagccaatttgtcaaaagataatagggagctggaaagctgcgagttgactacagcagttcccagatcaaatgccaggaagaataaaaagagaaaagtgaaaaatacaacgaagaatcaatccaatattgacaactttattagaagtccgtgtgaggggttgaggccaagagctgggaagattgccactgacaaaagtggggtggaaatcaaccaagttgacaaggaaaatcaggtggctaaaagggcaaggagatcttctgaaggtttggttcctcacaaaaataaaaaggatgatgttaaaaagccccataagtgtgaccttgatggttgccaaatgagtttcaagactaaggctgagttactactgcataaacgaaacctttgcccacatgaagggtgtggtaagaagttcagctcccacaaatatgctttacttcaccagcgtgttcatgatgatgagaggccccttaagtgcccatggaaaggttgttccatgtcattcaagtgggcttgggcaaggacagagcatattcgcgtacatactggggagaagccttatcactgcaaggtcgagggatgtggcctttctttcaggtttgtatcagattttagcaggcacagacggaaaacggggcaccatgtgaaacctcctgcttga

SEQ ID NO: 109673 - DNA, 430 bp, Glycine max
  Peptide Sequence Number=SeqID_226451
atgtccaaatcttgtggatttgggatgaccggccctctcgatgagtcgatctcttgctttctcataagggtggacccttgggtacttgtacctatcaccttgagaggactacacgtcctcgccttgagaggactacatgtcctcaccatcagaggactgcacgccctcacctccaaaggactacacgtcctcgccttgagagggctacccgccctcgccttgggtactagttaccctcaccttcagagggctacacgccctcgccatcagaggactgcatgtcctcaccttcagagggctacacgccctcgccatcagaggactgcatgtcctcaccttcagaggactgcacgccctcaccttgagaggactacacgtcctcgccatcagagggctgcacaccctcacctccagaggactacacatcctc

SEQ ID NO: 109674 - DNA, 1536 bp, Glycine max
  Peptide Sequence Number=SeqID_226452
atgagcgctacggcatcgcctcgacccaggcggaaacggaacgacagatccccgaccactgctcccctactttcatcaacggctggattactatcgccagacgcgattttgagcagcaaggcaacggccacattttatattcacgattacgaaaccttcggcaaaagcccgtcgctggaccgcccggcgcagtttgccggcgtgcgcaccgatatggatttcaacattatcgaagagccgctggtcatctactgcgccccggccgacgactacctgccggaacccgaggcggtgatgatcaccggcatcacgccgcaggtggcgcgcgccaaaggcgttaacgaagccgaattcacccgccaaatccaccaggccttcagcgtggccggcacctgcattctcggttacaacaacatccgtttcgatgacgaagtgagccgcaatatcttctatcgcaacttctacgatccctatgcctacagctggcaaaacggcaactcgcgctgggatctgctggatgtgatgcgcgcctgctacgccctgcgcccggacggcatcgtctggccggaaaacgaagacggcttccccagcttccgcctggagcatctcacgcgcgccaacggcgtcgagcacacgcaggctcacgacgcaatgtcggacgtttacgccaccatcgccatggccaagctggtcaagcaggcgcagccgcggctgttcgatttcctgttgcagcaccgcaacaagcacaagctgaacgccctgatcgacgtcgccgaaatgacgccgctggtgcacgtctccggcatgttcggcgcggcgcgcggcaacaccagctgggtgtcgccgttggcctggcacccggacaacaaaaacgcggtgatcatgtgcgatctcgccggcgacatgacgccgttgctgacgctgagcgccgagcagctgcgtgaacggctgtacacccgccgcgacgacctggcgccggatcaggcgccggtgccgatcaagctggtgcacatcaacaaatgcccggtgctggcgccggccaaaaccctgctgccggagaacgccgagcggctgggcatcgatcgccaggcctgcctgcaaaacctgcagctgctgaaacagcacccggaagtgcgtgagaaagtggtggcgctgttcgccgaagccgagctgttcaaaggctccgacgacgtcgacgcccggctgtatgacggcttcttcagcgacgccgacaaggcggcgatgaggattatccagcagaccaagccgcagaacctgccggcgctggatctggccttcagcgacggccgcatgaaagagctgctgttccgcttccgcgcgcgcaactacccgaatacgctggacgatgccgaacagcgccgctggctgcagcaccgccaggaagcgctgagcgcggagcgcgtgcagagttacctgctgcagctcgaatcgctgtataacctgcacgaaagcgacaaagagaaaaccgccctgctgaaagcgctgttcgattacggcaaagagttggtggggtaa

SEQ ID NO: 109675 - DNA, 557 bp, Glycine max
  Peptide Sequence Number=SeqID_226453
acgccccggcgcggctggtggcgcataagggcagcagcctgcagcctaccgccgcctcgctgaagggcaaatcggtcggcgtacagcaaggctccagccaggaggcctatgccaacgcgctgtggcgcccggccggcgttaacgtggtcgcctaccaaagccagcaggaggtgaacgaagatctggccaacggccggctggatgcgtcgctgctggccagcgtcagcgccagcgagttcttcaaaacgcccggcggcaaagatttcgcctttatcggcgccgaactgaacgacagcaaatacttcggcgtcggcgacggcatcggggtgcgcaaagaggataccgcgctgcttaacgccttcaacaccgcgctgcaggcgatccgcgccaacggcacttacaagaaaatcaacgacaagtatttcgacttcgacatgtacggatggggaggcgccttcggccgccggggaacgccccaacggaaacggcagcgtcggcaagaacggaaaatcaggcgggataaggatgcgggccaggcaggacgcccggcccgctaa

SEQ ID NO: 109676 - DNA, 721 bp, Glycine max
  Peptide Sequence Number=SeqID_226454
ggctttacatggcttcctcaagtgcatggaccacctttccgccaaggtgcttatcgatcccgtcaaccacagccgcaatctgcacccagctgctgacgctgagttcgctggaatcgctggcggtgctgatgcgcgaagggccgcaggaacagcggcaggcggcggcggggcagctggcggagatcgccggcgagctgaaaacgctgatgcaggaggtcagcctcggccagcacggcgaagcgccgatttacggctatgtctggctcagtatggagctggcgcagcaactggaagagctgggggatctgctccaggtctgcaccgccgccgggcgcgaataaggggtcagatcatgaaggcggcgctttgggttttggccgccggggcaaagtggggtataaagatggataatgcaaataagccgagtttccaggacgtgctggagtttgtgcgtatgttccgccgcaaaaacaaactgcaacgcgagatcgtcgacaacgaaaagaaaattcgtgataaccagaagcgcgtgctgctgctcgacaacctgagtgagtacatcaagcccggcatgagcatcgaagacattcagggcatcatcgccaacatgcgcagcgactacgaagatcgcgttgatgactacatcatcaaaaatgccgatctgtccaaagagcgccgcgagctgtccaaaaagctgaaagcgatgggcgaagtgaagtaa

SEQ ID NO: 109677 - DNA, 315 bp, Glycine max
  Peptide Sequence Number=SeqID_226455
atgaagcttaaacaactctttgcttgccatcatattagcgaagagagaaaagttccattggctaccattagctttcaagggattcatggggatcatacaatagagtattggaatgatcttaagagtgcccttaggaagaggcacattccctcctactatgaaagggagcttatgtacaagctccaaaggcttagacaagggagtatgagtgttgaagaatatagacaacagatggaactactccttttaagagctagaattagggaggaggaaagaacaagcatagctaggttccttagtgggcttaatatggaa

SEQ ID NO: 109678 - DNA, 234 bp, Glycine max
  Peptide Sequence Number=SeqID_226456
atggggtttagaataggtagcaaaatacctttggcaatttacactttgggtgtggtagcaaaatacttggatatagccaagattcggctgcccatcacccgggcttttattgagaagtactgcacccagagacaagctcagggggatgctccacaggccgcgggcgcgccaccaccacctcatcaggctggcccgactgggtcattcgacatggagcagtatttacatcatttg

SEQ ID NO: 109679 - DNA, 169 bp, Glycine max
  Peptide Sequence Number=SeqID_226457
atgggtaaatttgacatctttgtccctcatcctctcgtaattacatctttgcttccactagaatatgggtgcaagccattggtttgtttgctcaagcgacctgcgctcttgagtttggacttccaagaccgttcaatcagaaattacccgtgctacacatttggtgagg

SEQ ID NO: 109680 - DNA, 204 bp, Glycine max
  Peptide Sequence Number=SeqID_226458
atggtaagaattgagtatcgaactctcggggaacttgtgttattttgtaagctatttcagcaaataagtgtctggatctcacagtcactcacaaactcatctcaagctctcaaatcggctcctgcttcaagctctggtctttgcagatcttcacacagcaaaatctctcaaaactctctagaacttggacctttttctctctag

SEQ ID NO: 109681 - DNA, 422 bp, Glycine max
  Peptide Sequence Number=SeqID_226459
atgaaagataagagggatgagggaaaaaaactagaaaaacaaaagaaaaagaaaaacagtaaaactttgtcttcaaaggccaagggaaaggaaaaagagaaaaatgatttctccaagaaaattgttaagaaggaaaaccatgttgcaacaaaaggttatatcaaaatagcacttctttttaaacaatcattttatcttctcttatcaagggaaacattccttagcactgtcatacctcttgagcttgaggttattcctcaagtatatgagttgttggatgagggtttggtttgtattatgagacaccaaattcctatgataggtcgtatgatgaatgtgttgagtggtgcaaccctcttttgcaaaatcattcatgcatcaaacatcttcatgattcacatatatagggactcattaggtag

SEQ ID NO: 109682 - DNA, 2424 bp, Glycine max
  Peptide Sequence Number=SeqID_226460
atggtatcagacttcagcgatggcaaactgggtggattcctttctttgacctggtgcatatgcttcaacggccaaaagctgatggatgacgcgatatttttctgctggacatggcttaaaaatatggaaaaaggattattccttttcattcatggtctagctagcaatatcatcagggatctcaaggctttgaagttgaaaattaagaaagagtttgaagagatgcagtcacagtttcaaggattttttaatgatattgcatttgcctcagaaaactctgttgatattgatagtctggagttgtgttgcttcatgaattcagggagtcaaatacaggagatgtcaactaaagctcttggatatcacaaagtagtagaagagaataggaaactatacaacatggttcaagatttgaaaggtaatattcgagtttactgcagaatcaggccctcattccgggctgaatccaagaatgttgttgatttcattggggaagatggttatctattcattttagatccaacaaaaacactaaaagatggaaggaaagtatttcagtttaatcgggtttttggtccaacagctgaccaagatgaggtttataaggatactcaaccattaattagatctgtgatggatgggtacaatgtttgtatttttgcttatggtcaaactggatcggggaagacttacaccatgagtggtccttcaggtggagtgacatcaaaggatatgggaatcaattatctggcactacatgatttgtttcaaatgtctaatgaaaggaaggacatcataagctatgatatttatgtccaaatggttgagatttacaatgaacaagttagagacttacttgcagaggacaaaacagacaacaaatatccttttcatagggtcaaacattttcacactactcataagagattaggaagagaaaaaatccggagctgcaatgatgacgggttgagccttcctgatgctagattgcatttggtgaagtctccaactgatgttctgaccctcatgaaacttggtgaggttaatcgtgccgtcagttcgacttcaatgaacaataggagtagtcgatctcacagtgtacttactgtgcatgttaatggtaaagatacatctgggagctccattcgcagctgcttgcacttagtagacctagctggaagtgaacgagttgacaagtctgaagttacaggggaaagactaaaggaagcacaatttattaacaagtctctttcctgtttgggagatgtgatcacagccctggctcaaaagaattctcacatcccttataggaacagcaaactcacacttcttttgcaggactccttaggtggacatgctaaaacattgatgtttgctcatgtgagtccggaagcagattcatttggtgaaacagtgagtactctaaagtttgctcagcgggtttccactgtggaactgggggcagcccgtatgaacaaagaaagcagcgaggttatgcatcttaaagaacaggttgagaaccttaagattgcattggcaaccaaggaagctcagagagtaatgctccaaagaattaaagaaccacacactccattagagaagccaacactggtgtctgagaaaactccattgcgcccacgaagacttagcattgagaactgcagcgctgtaaagactgataaatctgtgaatcatgaggatagaagtggagccaaatcaccacttttgttacctcgttcgagaagattaagtttggaaggaggttcaaaaactatcaagaaagatagtctactaccaaaagtatcagatgatacagtaagcaaagctttacagtacgagtcagtgtctcgacagaaatatcacccaatgcaagatccagaatcagtatcaaaactaaacggccatttcagcagtggcaattccaggtcagagttgcataccagaacccctcgaagtcctacaagcatttcctatcaaacgagattgataaaagtaaaaggtgggatgcaagttcatcctcttaaactgcctcaaacacctgaaccaccagtgctggatggaaatgatgcacatggcacgaaggtgatgggtagcacaaatggaaaaggatcccagataagaaaatccttgagaacaattgggaaactgataaatggccctgataagaggagccaacaaaataatatggttgaagtcaagtcacccatcaagggcactggtcatacaaatcatgtaaaatcaccaatttcagctgctgagaaaactaaaaagaggcaatctctaacggggactcaaccaccactgtcaaataactcccgtagatcttcacttggagggaagccagtagtagcatatgacaaggacggaaatgctagaactcctccttcccattcagacaccaagactgcaaaacggtggctgtag

SEQ ID NO: 109683 - DNA, 1008 bp, Glycine max
  Peptide Sequence Number=SeqID_226461
atggaggatggttcaagaaataggactcatttcaacatgacttcacgaaaagccgaagaagcggcttggagacgctatgaggccactcagtggctagaaagtcaagtgggtcctcttggtatatcaaaccagcctactgagagagaactgatttcttgcttgagaaatggtctgattctttgcaatgccattaacaagattcatccaggagcagtgcctaaggttgtggttgtggacaatcaagtgccttcacaatcacttacctgggattcacagcctttgcctgcctatcagtattttgaaaatgtacgcaattttctgtttgcgatggaagaattaaagcttccagcttttgaagctgctgatcttgaaaaggataatctcgagatgggatcggcagcaaaagtggttgattgcattttggcacttaaatcgtttcaagagttgaagcagatgaacaatcagaatggatacatcaaacacataaaatctcctttgcctatgagaatgcatacaagagcagctgcgttctcctctgatgcttgtaggcacttggatttgtcttccaaattggaaaaaatgcctcccgctgagtgtaattttccgaaaagagaagaaattgtggaattacttgccaagcaactggttgaccgtatgtttgatgccaaagaaaatatcgatggaaacattattgcttctctccgtaaagaacacctggtagcggatccaataaaggtatttaatcagataatggcatgttgtaatggggaacagccacctacaaagttcaatgagttgccattgcttccaaaggattctgcaaaagaaaaggataacttaccacctcattccacttcaacacctatgcaatcagatgctttatctgctcctgacagttctaagcattgccaagcttgccccagaaagtgcaagtgcaatcaggtgcatcttttagacaggcaggaaaaagaactactgttgaggacgggagggggggcagttttataa

SEQ ID NO: 109684 - DNA, 814 bp, Glycine max
  Peptide Sequence Number=SeqID_226462
atgatgaggaaagaacaagtagatatgttttgcttacaagagactaagaaggaagtgatagacaaagccctatgtcaagctctgtggggtgatgctgaagaaactttcaaaatggataaggtgactggtaatgatttggaagggacatgggctggtgatggtgaaaaattgacaatagtaaatatatattcaccatgtgatacagctgccaaaagaattctatgggatcaagtcaggaagctcaaagctacaagcagagggggcaggggtagcatgaagaaatttaatgattggattgttgagttagaggttgaggatgtgcctttcggtgtcgggcttaaagataaactttgccaaaagcagatttggggcgattgggaagtcttatcaacggatgtgagagaaaactatccaaatggaaacaaagatacctctcttttggggatcccgaagaaggtggtcgagagattcatgaggctgcgcgttggttcttgtggggggaaactccgaccagcaaaagattgtctaggtgaactaggagacagtttgtctcccaaaagaaaaaggtggattgggcatccaggatttggtgaaattcaattatgctctacttggaaaatggcggtggaacctcttccatcaccaaggagaattggtggttggttcaaaagtgggacaaaatggaagatcggatgtgggtcaaagatgaagttttgggaagatgggatgggaatggcagttctagtggaggagactatttatggagggggagatagaaataactacaaaatctatggaggacatagaaagcgtg

SEQ ID NO: 109685 - DNA, 297 bp, Glycine max
  Peptide Sequence Number=SeqID_226463
atgagagtgaaaaccaatgatcacacaaaacaaggcataacccaagttaggatttttgttcaagaaaccaaaacacatacccaagttgaagaaccagagaagaataacagcgagtggggcttagctttgggctccgaacctcagctacggaatcgtaacgccacatcttttgggtccgcaaagcgattacgctccgtcggttttgcataccgagtcaacttatcgaacggcgaagattctctgattggaaatactcgaaatcaggtcagattttgtgcggtgtatatatggaaataa

SEQ ID NO: 109686 - DNA, 627 bp, Glycine max
  Peptide Sequence Number=SeqID_226464
atgtcagggctgaaggaattgctgaagaaagggttaggtttaggcgacatggcgttcaacgccggcggcggagccatcacctggttccccggccacatggccgccgccacacgcgccatccgccaccgcctcaaactcgccgacctcgtcatcgaagtccgcgacgctcgcattcccttctcctccgccaacgccgatctccagccccacctctccgccaaacgacgcgtcgtcgcactcaataaaaaagacctcgccaaccctaacatcatgcataaatggacgcattattttgagagttgtaatcagaattgcgttgcgataaacgcgcacagcatgagttccgtgaagaagcttctggaggtggtggagttcaagttgaaggaagtgatttgcagggaacccacgctgcttgtgatggtggtcggtgttcccaacgttggcaagtctgctttgattaactccattcatcaaattgcaaagtctcggtttcctgtgcaggagaagatgaagcgtgctgctgtgggtccgctacctggtgttactcaagacattgctggattcaaggtctggttaacagacgttaatgtgaaatatagaattaaactaagatactatgtaatttaa

SEQ ID NO: 109687 - DNA, 469 bp, Glycine max
  Peptide Sequence Number=SeqID_226465
ctcatgacatcgtttcagccagatgcagtcccagtttcagtcctagatgcaatctcagagactagcactgccttcggagcctctggaaacaatcctgagacgggtgactcagataggtgcggcttgtatatcgaagcaaatcctgcccgcctggttgcccaagggagagtttatgagagatccactattgttcataaaactcctttgttgcctggccaagtaaaggtgggcaattcacaccttccttgcttgaccgacacatctggtcaagtctttatcacaacagcaaaaccacctcaaaagccggatccagaggttgatgatccgctttatctgatgacattgaccatcccagtgcttttcttgaggccttaccaggttacatgggatgccaccgtgtttggggtctttaatctagacttcccgctctacataaagcacgaagacctctccgaaatcgcacacagcg

SEQ ID NO: 109688 - DNA, 336 bp, Glycine max
  Peptide Sequence Number=SeqID_226466
atgtggggcatctgcatctgttgggtttctaatcatgatatcctttgtagcacatgtcctgagtctgtcaaagattcagtagtaggtgaggaacgtattgctcaatacttattggcagttttggatacccgggggactccacttcactggaatcacctaaataacaggagaatagatgggattgaatatgaagctgaggaaaatcctgaatatagtctgaaaaatcttaagccaaagagaagaaatctgccaaatagatctgatttggtctatgttgagaatatggtgcttttaagttttaactaccaatgctggaaatttttgcaccttggttga

SEQ ID NO: 109689 - DNA, 1767 bp, Glycine max
  Peptide Sequence Number=SeqID_226467
atggtgatattatgggaagatataaccgtccagcaccgttttttggaagacaagaagaagttgcttagtggaatcactggttttgctgaagctggtaggatcatggctgtcatgggtccttctggctctggcaaaaccaccctcctcgactcattggctggaagacttcctgtaaatgttgttgtaaccgggaacattctaatcaatgggaagagaagcttatattccaaggaagtgtcctacgttgcacaagaggaacttttcttgggtactttgactgtaaaagagaccctaacttactctgcaaacacgaggcttccttctaaaatgagcaaagaagagataaacaaagtggtggaagaaacaataatggaaatgggtctggaagattgtgcagatactaggattggaaattggcattgtaggggtattagtaatggtgaaaagaagagacttagcattggccttgagattctgacacaaccccatgtcttacttcttgatgaacctactactggacttgatagtgcctcagctttctatgtcattcaatctctatgccacattgctctcaatggaaagatagttatctgctccattcaccaacccagtagtgaaacttttgatctatttgatgatttgcttttgctctcaattggggaaactgtttattttggggaagccaacatggctctaaagccatcttcatcaaattcagcactgggaacaaaaaaagccgagattagagagacactcattcgaagttataaaggttcagggataatgatcaatgcgagaagaagaattcaacaactgaaacctaatgaggagcaaaaaattaagcccaacataggtagcagtgccacatggtggaagcaattgtgcacattgaccaagcgatctttcgtaaacatgactagggatattggttactactggctgaggatggtattctacatattggtaggaatcactgttggcaccctctattttcatattggcacagccaacaactcaatattggatagaggaaagtgtgtatcattcatctatgggttcaatatttgtttgtcatgtggaggattaccatttttcattgaagaattgaaggtgttctatggtgaaaggtccaaagggcattatggagaggctgcatttgtagtttcaaacatcatatcatcattccctttccttgttctaacatctctctcgtctggaataatcatttacttcatggtgcaacttcatccgggtttaactaattttgcatttttctgtatcgacttattctgctgcatatccgttgttgagtgctgcatgatgattgtagcctcagtggtccccaatgtgctgatgggcttaggaacaggaactggtgtaattgttttcatgatgatgccctctctattattcagaccactgcaagacattccaaagttcttttggcgctaccccatgtcatacctcagttttactacatgggcagtgcagggacagtacaagaatgacatgctggggcttgaatttgatcctctgctacctgggaacccaaaactcactggggagcaagtcctaacattgttatttggtgtcccgttgaatcatggcaaatggtgggacttaacagcattgattattttgttaatagttcacagattgcttcttttcttggcgcttcggtatagcaaaagatcatcgacatcccccatgttgtggtttcatagatgccggggaaagtctacaatttgcagaaagatgtctatttag

SEQ ID NO: 109690 - DNA, 288 bp, Glycine max
  Peptide Sequence Number=SeqID_226468
atgggagttcagcgtgcactctattcaactttaacagaattcgatgggaacgtagaagatgagagtgacctggagagccttattgacctgcaatttagtgcactccagaaggcattgaagatacctcacaaggcttcagaagcgcggttaatggtatccaagaagttcctcactctattcaggaccggtaagcttggacctttcattctcgatgatgtcccgaatgtcaagcctaaagagattgagcttcctgaggatgcgggtgatttgcaagcatttcagttctag

SEQ ID NO: 109691 - DNA, 840 bp, Glycine max
  Peptide Sequence Number=SeqID_226469
atgactaaaaatgagattgacaaggtggtaaccaagatactagctgaaatgggtctgcaagatagtacagatagcagacttgggaattggcatttgagaggcataagtagtggagagaaaagaaggccaagaggtgaagttttcaacctttttgacgatctggtcctcctttcaggaggtgaagctgtatattttggagaagcaactatgactgtaaagttctttgcagatgcagggttcccttgtccaactagaataagtcctcctgagcatttccttggttgtgttagctcagagttcaatggtgttgcagccttaatgcagtccaaaaatgaagaacctttagttgggaagatatatgataccagcaggctgaagcagctatgcacattgacaaatagatcaatcctaaatatgaccagagacattggttactattgtttaaggattgtattctatatctttatatcagttagggctggtttccttcttttcaacataggaacaagtactgaagcaatcttaactagaggcaagtgtgatggattcatcgttggcttaatgatctacatatgtttaggcggcgtacccttttaccatgaggaattaaaggtattcatgatggtgccatctaatatattcagaagtctagcagaccttccaaaattcttttggcgctatcctatgtcctatatcagctacattacatggtcaatacagggtcagttcaagaatgacctgattggtcttgaatttgaaccagaggtgcctggggataccaagataaagggtgaagagatacttaacaatatgtttggaattcgaaatggtgggacttag

SEQ ID NO: 109692 - DNA, 591 bp, Glycine max
  Peptide Sequence Number=SeqID_226470
atgattgcatgcgcaacgttacgtgcagagatctgtgaaaaatgtgatggttgtcggagagaagaagaacgggatggagggtgttcacctttagaatgcaagtgcaacggcggagggccatcgtcgacctttgaaacttttcttgatctgaggatacttcccaccaatgttggcatgaccggaaatgtactactcaaggggactaccagaagtacaggctgcatagatatttctttgagatcctcacaagatcaaagaaacaagaacgagtacagcaaagtacaaagtcaagatctacaacaagattttatgtggttcagcaatgtgcctacatccatgggaaaattacaaggtttaagccctatttttaattggagagcatctatgaagcacgggacacctactaggtggtgtttcccgtctctggtactgcatggggacgaggatgggatgggtatgccagaagacagccaggaaatgtcgtggacttattgggtacgactgaccaaaacggggatgacgacttcattttgtggagacatattggggacgatagtggcctacatgcacatcaccgcaagccagaattaa

SEQ ID NO: 109693 - DNA, 321 bp, Glycine max
  Peptide Sequence Number=SeqID_226471
atgattggagcacattttttcagtactctggcaggaacagtagatggctgcattgtgcttcgcaacaagcaaggagaactatctcagcaagggaagatgaaaatgactctgccgaactctccctattttcaaccattgggtgttggaaagaaacaaaataaattgaagataatcctaatatggattatcctcaacaaagctgaagtttctagagcagttagattgattaaggaatctcgccgaaggtcgtctttaattctagccggggaagtgaaagaatgtcatcattttgatacacttcatggattagctgcaaaatga

SEQ ID NO: 109694 - DNA, 1539 bp, Glycine max
  Peptide Sequence Number=SeqID_226472
atggcttcgtcttcctccgatccaggaaagtccgcggagacgtcggaggcggcggtggtggtggcgaacgaccagctcttgctctacagaggattgaagaaggccaagaaggagagaggttgcacggccaaagagcgcatcagcaaaatgcctccgtgcgccgccggcaaacgcagttccatataccgcggcgtcacgaggtggactggtcgttatgaagcgcatctttgggataagagtacgtggaaccaaaatcagaataagaagggaaagcaagaagtttatccaaacagggtcttattctttcttattatcgttatcattgaacttgctggagctgcatcttttcttaagataatgatttttgttgttgatggattctggacaggggcgtatgatgacgaggaagcagcggctagagcatatgatcttgctgctctcaaatattggggtcctgggactctcattaactttcctgtgacggattatacaagagatcttgaagaaatgcagaatgtgtcaagagaagagtaccttgcatctttacggcggaagagcagtggtttttcaagaggactagcaaaatatcgtggactctccagtcgatgggatccatcgtatggccgtatgtctggatctgattacttcaatagcatgcattatggtgcaggggatgattctgcagcagaaagtgaatatgtaagtggtttctgcatagaaagaaagattgatttaacaagtcacatcaaatggtggggatctaataagagtagacattctgatgctgggacaagattatcagaagaaaagaaacttggttctgctggagatatttgcattgaaattaagcaattggagcagaaagttcaacctacagcaccttaccagatgccacagttaggaaggccccaaaatgagaaaaagcatagaagttcttcagtttctgccttaagtatcttgtcacaatctgctgcttacaagagcttgcaagagaaagcgtcgaagacactggaaaatatcatagataatgatgagaatgaaaacaaaaatacaatcaacaagttggatcatggcaaggcagttgagaaaccatcaaatcatgacggaggcaatgaccggcttgacattgcaacgggaatgagtggaacaatgtctcttcaaagaaatgtttacccattgacaccattcttgtctgcaccacttttaacagcctacaatactgttgatccattggtagatcctgttctctggacatctcttgttcccatgcttcctgctggcctttctcatacagctgaggttggttacaaagacagagaccagttcaacgtacacgatgtttcggccagaggaatgaatggttgggcatttggatttccaattgaagaagaaaggctcaaaggcaagcatctgaaagctgagcttgtatcgaacaaagaacagaatataggcagcaaggccttggtgcatgaagaggaagctggtatcaacggagtttcaggggttctcctttgggcaaggaagcaatcccagatttga

SEQ ID NO: 109695 - DNA, 126 bp, Glycine max
  Peptide Sequence Number=SeqID_226473
atgtctaggttgtgctctgtttttagcataaaagaacaagggttaggacatgtagagaagataattaggtaccctacaggtttgaaacaagcggaaagggtgaaagtaacttgtaataaacgttaa

SEQ ID NO: 109696 - DNA, 669 bp, Glycine max
  Peptide Sequence Number=SeqID_226474
atgtccgaaagcgcagttatccttaactcactcttccaaccgcgctactccatccccgttctcttcaatggggccagcaccgcatctcactatctccaactcgccggcaccaccgagtcaactcgtcgctggagaatctccatttcatgcacgaagaagtctaacaagttggcattccaggaaacgaaggaaggattcgtggactacgaccgaggccagcacgaggtctccacgaaaatctccggcctccgcaaggacgacattgccgcccgctaccgcctccgcgtctccggtaaccgcttccagatggactgtacagtatcggaggtcgtcgacctcgtcctctcccttgacgtctccgacgacgacgtcgacggcctactcaagcgctggataggccgcttcgcgcgcaagaatttccccttcctcatcaaggagttgacgcagcgagggtccattgaacactgtaaccgcgtgttccggtggatgaagaaccagaagaagtactgcgcgcgtaatgatatgtacaatatgatgattaggttgcacgcgaggcataaccgaacggaccaggcgcgtggattgttcttcgagatgcaagagtggaggtgtaaacctgatgttgagacttacaatgctcttatcagtgcacatggtcgagccggatag

SEQ ID NO: 109697 - DNA, 189 bp, Glycine max
  Peptide Sequence Number=SeqID_226475
atgtcgaaatacggtgaagccctatcttttatggaagaaatgatgcatctaaaacttcctttgtccaaagaggtctactcatctgtgatatgtgcctatagcaaacacgcaaaggcagagtctgcattcaacttgatgaaatcatcatgtgttgatagattgacaagtgcaccaatgtgtttcaagtag

SEQ ID NO: 109698 - DNA, 618 bp, Glycine max
  Peptide Sequence Number=SeqID_226476
atgagtcaactcccaaaggagaatttggcgaaagcttatgcactctttgaagaaatagaagcaagtggcatcaagctagatactattgcccgtgcagctctaatgagatcttttaataaaggcggccaaccaggaagggttcttagtcttgcagaaattacgagagaaaagaaattcctttcagtgataccatattttttgaaatggtatctgcctgtagcatttaatgtttctaattgttatattcctgtcaaactgaatgtgtcttttgccattagattacaagattggaggacagctgttgatatgatcaagtattcttcaaaatgttggttggcatcaggtgctgatgttaacttaaacacttactctatattattgaagaaccttttatcatctggaaattggaggaagtatttagagctaaacggatttagcaatacttgcaaaaaagagcaaaaaacatcaaacaagaaaaaggtagagaattccttagccatcttcgagacattgaagtcttcaagagaaatcttccaagaccttcttcaagctagttttgatctaaaaagtattacagtgtattttttctgctacaatcatagaggatcttttatttaa

SEQ ID NO: 109699 - DNA, 690 bp, Glycine max
  Peptide Sequence Number=SeqID_226477
gtgtggagtgttctgtcatactccaacctggcccctacatcacatacctctaatctgatagtggacagagctaggctgatctttggtctagtctctcgcatggacatgaatgtaggagctcttatttcttgccagataacttctatagcccagtctaacttttctagacttgggtttcctgctctaatcaccgccctatgtagagccagaggggttgtctctgacagccttacttttgagcacctgagcccagtcattaacttggcctacatcaggaggaactattggaatcctaatgatctgacaggacagatcattttattgcagagtttacaagtagtggcgcctccaggatccattcctttcgttgaacagtttctagagagggtagcctggcctggggcccaaccttctcttcacatggaagatgaaggtcccacagcccaggatagacaggtagttgctgctactcctgagaggtctcttgagggtactccagagcctcctgcattagtggtggacctatcctcgcctcagtatgcagcagacccctccactcctatcctagagataccagaggacccgaccacaccagtcctaactctaagcacttctcttccagctactctagtacttcatctgacagatgaggaggatgttcagacacaagatactcaggaccagtcatag

SEQ ID NO: 109700 - DNA, 357 bp, Glycine max
  Peptide Sequence Number=SeqID_226478
atgacaccttcgaccgaagatgtgaagaaagcaatgcaaggattgtttgctgtactccagctctctatgtggggctggtttcacacctctttctccaagaaggtaggcccgtctatccgctacaagaaggaaggaagaatcaagattctatcttcatgcgaaggatgtccaaatgttcccttgatgggaacaaggggttgtattaactataatcccgttctcgccataagacagcttggctaccccatgagaggagcgccgttagacgaaagcatcacgcctttcatcgcacggggttttagtgaccacaacgcgagggtactccaaggagttcgcaaggcatgggatgcggcgtga

SEQ ID NO: 109701 - DNA, 229 bp, Glycine max
  Peptide Sequence Number=SeqID_226479
atgaagaagattcaagacctacaagctccacatggagctacattagacactgccactaagtcaaaagctctggttgaagcaagaagggaacccacaccctctacagaaaaagaggtagactttcatccatggcctctcaccattgtaaccttgtgcttgcaatccaatcatgctcaagactctgaaaattactacaaggagcagcgaacaagccagcaaggtatcgaag

SEQ ID NO: 109702 - DNA, 530 bp, Glycine max
  Peptide Sequence Number=SeqID_226480
atggagaggcataactttcacaagcgcttcaccaacttagctgatagtagcattgacctcacattggtgaaggagttctacgccaacctctacagtcccgaggggcctttacctaaacaagtcataatctgggtccacttaataaggattgatgcagacaacctcaatgcctttttagaaacacttatggtgcttgctgagggtgaatctttgcccgcctactcaagatactgcaggatgcctactgacattagagaaattgaggctgcactgtgcatacccgatcgagggtttattttaaatgctgaaggtcacccagggaagatcctcagaaaagatctaaccacccttgctcaggtctggagtgttctatcctactccaacctggctctgacctcccacacatcggatctgactgtggatcaagctaggttaatctttggcctagttactcaactggacatgaatgtcggagtcctcatttctgggcagattacttctatggcccagtctaactcctcaagactcgg

SEQ ID NO: 109703 - DNA, 216 bp, Glycine max
  Peptide Sequence Number=SeqID_226481
atggaaaaagataacttaggaaaatttgatgctaagtcaaatgaagattccttagaagatacacatattcatggaaatgactctaaagaaaaagatgaaggaagcaatgaagattctcaagataatggagttagagcaaataatgaacttccaagagaatggaaagcctcaagagatcatcccctcgacaacattattggtgatatctcaaaaggg

SEQ ID NO: 109704 - DNA, 240 bp, Glycine max
  Peptide Sequence Number=SeqID_226482
atgtgtatatcggggaaggagagaagcactgggttcaatagaagaaaatcactcaaagtgtatcaatctcacacagggcaaggattgacattctcaccctgggtcaaggtttatgataagttgggattttggctcaaggcttgtagaacggctggtcatgatatacgtcagggtttggccagcggttcggggataaaggggatgtcctacattatttccatgatacacatgcaacaatga

SEQ ID NO: 109705 - DNA, 213 bp, Glycine max
  Peptide Sequence Number=SeqID_226483
atggttagggttttcaaaacttggcatggaatgagagtgagagtgagagtgagagggatagaaccattgtcttatggagagaagggtgttgtgacctcatgttggatgccacatttctcgcagaaatcttcaaattccttagagcctatccctcttaagattattgaggccacaaggtctaaaaagtggtatcagagcgggattcttgtataa

SEQ ID NO: 109706 - DNA, 189 bp, Glycine max
  Peptide Sequence Number=SeqID_226484
atgactgtgagttgggctaagcgcgcatccaccgctaagcgcagcatcagcgcgatagaagaatctagcagagcatcaatatcaaggccgcccactaagcgcgtgatcagtgtgctaagcgcaacaactatctttagccaagctcagcgcacgactggtgctaagctcaaatccacttactcgcgctaa

SEQ ID NO: 109707 - DNA, 516 bp, Glycine max
  Peptide Sequence Number=SeqID_226485
atggattctgtaggaataagatcggctaacccttatttggcgactcctggagcaacggttcatggccattatggggaaatactttctgaaggagatatattagttacatttatctatgaaaaatcgagatcgggtgatataacacaaggtcttccaaaagtagaacaggtattagaagttcgttcgattgattcaatatcgatgaacctagaaaagagagttgatacttggaatgggcgtataacaaaaattcttggcattccttggggattcttgattggtgctgagctaacgatagcgcaaagtcatggaatgtctaatgtttttttgcccggtgaactaattggattgttgcgagccgaacgagcagggcgttccttagaagaggcgatttgctatcgagttctattattggggataacaaaaacatctctgaatactcaaatttcatatctgaagcaagttttcaagaaactgctagagttttatcaaaagccgctctccgggggcgcatag

SEQ ID NO: 109708 - DNA, 755 bp, Glycine max
  Peptide Sequence Number=SeqID_226486
atgcacacccgtaccttgcttgtcgcttcactctcaatgctcgccaccgccgctgtcgcccagaagcaatatgcctgggtgggtacctataatccgaacggtgaagggttgtaccgttttactgttaacccgcaaaccggcgcgctgaacgataaaacgctggtgagcaaactgcccaatgcggcgcagctgaccctttcacaggacggcaaaacgctgtatctggcaagtgaagtggagcagggcgtggtgcaggcgctgcgcgtcggcgataacggtgagctgcgcgagctcaatcaggttgcctccggcggtgccgggccggtctatctctccctgacgccgaacggccagcatctgctggtggcgaactatgtcagcggctcaattgccgttttacccatcaacgcagacggtagcctgggtgaagccacggacaaacatcaggatcaaggcgaaccgggcgtggcgaagcccgaagctgctgcggagggcagtttcgcgatcagcgatcataacggcccccatgcgcacatgatcgccgccgatccgagcgggaaatacgtgttttccaccgatcttgggctggatcgcatctatcagtaccgttttgacgatcggacaggaaagctgacgccgaacgatccgccgtttattagcgcctcctcgaaaggtgccgggccacgccactttgtctttacgccaaagggcgatgccctgtggttgagtaacgaagaggcatcgacgctcacccg

SEQ ID NO: 109709 - DNA, 642 bp, Glycine max
  Peptide Sequence Number=SeqID_226487
atgcatgagactctccaacatcgccttcgcaaggtccaggagttaatgaaacttatggtggaaaaacatcgctgggatctttcctttactgttggtgactgggtttacgtgcacctccggccatatcgtcaaacctcgctagccccttcatatagcaagctgggtaaacgtttctacgggccctttgaagtgattgaacatattgggccggtggcatacaagttgcttttgcccgagtcttcacgcatccatcttgtcttccatatttccctcctcaaactccacaggggtcccctacctgtgactccagcaactcttccggctgcgtccacggataatcacccactccctacaccacttcacgttctggactggaaactcgatcattcagtatcgccgccagtcacacaggtgctcgttcaatgggaaggtctcgctcctgaagaatccacatgggaacattgggacgagctacgccgtatccacaaccttgaggacaaggttgctttcggggatgggtgtgttcatagcaatgctaggctagatgatgatcagaaaatgggaaacagggcattagctagcagcagtaacagaccaaggagagtcataagaaaacccacatacctgcaggagtatgtgtga

SEQ ID NO: 109710 - DNA, 210 bp, Glycine max
  Peptide Sequence Number=SeqID_226488
atgaaaccaatgggaggggtgctgatgaacatacgcacgaaggtattgctccaaggttcgattaagtacctccgtctgaccgttggtctatggatggtaagcggtgctcattctgagcttggtgtcggtcaatttgaacaactcgcgctaaaaattgctaacaaaaatcgggtcacgatccgaaacaaggctacgaggaaagccatgtag

SEQ ID NO: 109711 - DNA, 409 bp, Glycine max
  Peptide Sequence Number=SeqID_226489
ctgggttgcttctggaggaagcaacccagctcgcctgggcgagctaaggtcgcctgggcgagctgggcggcaacctcctccccctttttcctataaaaaggctgaagggggctgttctaaggatccctcagccccctggctatgtatttcagctgttttgggtgaaaaaaattgtttccgtgaagaaaatcctagccgaggtgcttccgtaacgcttccgagatgtttccgtaagcaaatccgtgaaggttttcgtccgttcttcatcgttcttcatccgttcttcgttcttcaacgggagcaaaagccccgcttttgtcgaccaccccaagagatcgttaatggtccaaatgccttaacgtttctctcctttcaaaaacaagagatcgttaatggtccaacgcattaa

SEQ ID NO: 109712 - DNA, 194 bp, Glycine max
  Peptide Sequence Number=SeqID_226490
ggtggtgtttggtatcagatgtgcagcaagcgggttctgtggctgatttaggggtggcctttgtggatgattgggtgttcctagctaataggatgatgggtagtgagaagggctggcttcccattcatcaaagcaggataatcaaatttgcctcttctcagacccacttcgatccttttgccggtgaaaactaa

SEQ ID NO: 109713 - DNA, 627 bp, Glycine max
  Peptide Sequence Number=SeqID_226491
atggcttcatccaatccttcagcacttgaggatttgctcaatcctcatagtccatattatgtgcattcgagtgagaatccatcaatctcccttgtttctcctctccttgatcccacaaattataactcatggtgcagatcaatgtctactacactcagtgcgaaaaataagctggagtttatcgatggttctttgtcgcaactagcgcctaatcatgctcttcatactacatggaaacgttccaacaatatggtggtttcatggttgatacattcagtatcaccttcaatcaaacagggtatattatggttggataatgctgttgatatttggagagatctaaaatcaagatattcacaaggtgatttgttgagaatctcagaattacagcaggaagttgcttccgtcaaacaagctattgagggaagaatggacatgttgttgaagattgttggaaaaagaatggctatccaagtaatttttcatcgaatagaggaagaggagatcgaacttttcatggtaatggtagaggctcaaatgctgatagaagcggcaaagtgtgcaattactgtggtatcactggccacattgagacataatgcttcaagaaacatggatatccactag

SEQ ID NO: 109714 - DNA, 690 bp, Glycine max
  Peptide Sequence Number=SeqID_226492
atggctctattgaacggtataaggctcgcttggttgctaaggttaatataccttacaaataccagacctaatatcacctttgtcgttcaccacctaagtcaattcattgcttctcctactactgctcattacacggctctttatcatattcttcgatacattaaagttgctcctggtttgggtattttctttccttctaccaatgagcttcaactcaaagcctttagcgattctaattgggctagatgtattgatactagaaaatccattactggtttttctgtttatcttggttcatcacttatatcctggaaatctaagaagcaagccacagtctcaagaagttcttctgaagctaaatatcgtgcccttgctattgtaacttgtgaaattcaatggctcacatatttgcttcatgactttggtattattcataagcctgctttggtgttctgtgacaataaatcgactctccacattgcagctaatcctgtcttccatgaaagaaccaagcatattgagattgattgtcacttggttcgtgacaagctgctttcgggtttgatcaagctcttgcctattgcttcagcacaacaacttgttggtgattacacaaaggctttagctcctggtgcttttcattttatctgttccaagctgggtatgaatgacattcattccccaacttga

SEQ ID NO: 109715 - DNA, 684 bp, Glycine max
  Peptide Sequence Number=SeqID_226493
atgacatggtgccactctccgatttcaaagttcaatggtactttagtagaaactaaggtgcatggcaaacggcagttgaagctccagaatcatggagagacttacgaaatgagttctcctaatttggttatcagaattcttccaatccctgggactgattgggttggcaatgtcagcatccggtgccaagaaacaggccttgtggcagaattaaactacataggccaatctttctttggattcagggcaggtcgaagacttattaaagggaaaatctttgactcattgtctatgaagattctatacaaaattgaaggccattgggatagtactgtaacagtgaggaatactactaatacagaagcaagagtgatatatgatgcaaaagaagttctttctggacttcaagctcctattgtccaggatccagagagtgtgtggccaacagaaacagcccttgtttggggtgagttgagccaagccattttgagcaaagactgggaaaaagcaagagaagcaaagaaaactgtggaggaaagacagagggagctcttcaaagaaagagagtcaaaggggggaaattgggttccaaaacacttcttggtgtcttatagcaaagaagggggttgggaatgttcaccaattcaaaagtcagtcccaaaagccccaatcgccaccttgtaa

SEQ ID NO: 109716 - DNA, 840 bp, Glycine max
  Peptide Sequence Number=SeqID_226494
atggcgagctccatgaatgctcaggcacagctgggtctcattgctgggttcagtaggaacgggagaaggccagtgctccggcggcgtcgagtggaggaggcccttctggttcagcttcggaagggttcagtctgtggtggtgttgaggttaaggggaaggatgtgacaatttttagggatttgggtgggatgaagaatgttaaggaggaactgaatatgttgctcttgccgatctaccatccccatctaggtgaatctcaagaaaatattagagaccttttctctaaagcatacaggactgctccatcgatcatatttattgatgaggttgatgcaattgctttgaaaagagagaatctatcacagatggagctactaataggccccatgccattgaccccgcccttagaagacctggaatatttgattggtccgactgatctacctaagatagctaaatctacaaaagcatttactggctctgatttgaaaagtttgatcgagcatgctggtaaattggcgatgaggagaataacatatccagaggactgctttagggaacctttcttgccagaagaagtggacaaggctgccatcaaaatgtctgatttggaggacagatttattcaaaaagtagaagaggaatttttaaacaatactaatgttgaacttggtgtcattccttctaggatgtggcttggtgatgaatgtgcagagttagagggtcttgggatggatcttacgacaagatttttgctttatggacctccaggttgtggaaaaacactgattgccaaagctgttgccaatgctgcagttgctagtttttgtcatattaag

SEQ ID NO: 109717 - DNA, 264 bp, Glycine max
  Peptide Sequence Number=SeqID_226495
atgatggcttctaggaaaagaaaggcaccatctacacccacccaagttagatttgacagatcaagatttacttcccaagaggcttgggaaagatacacagacattattgtgcctaggaagcttctgccagagaggaacatggtggtttactatacagagttcgatgagttcaacgaggaactcgaaagatgccactgggacgaggagttgactgactttggggatggcaacattgatgttgccattgtgaaggaagattgttag

SEQ ID NO: 109718 - DNA, 141 bp, Glycine max
  Peptide Sequence Number=SeqID_226496
atgttgtgtagctataacctcaaaagtcttatacctacgattgttggtgtagggagatctatacgatcaccaaagtttggtgagtgcgataaagcaggtcgatgtggtaatttctactgtaggacacctacagctagctga

SEQ ID NO: 109719 - DNA, 267 bp, Glycine max
  Peptide Sequence Number=SeqID_226497
atggaaaagaaaacccttggtcacaaatttacaaagcaaggttcattggtaatcaacagaactttcgttttgagatattatccatccaaggagaatagaagtcaaaaccattcaattaagctaatgagaaggtacggggaagggtcatttacgcacccttatccttgcatatacaaagaggttgtttccatattcaaacccatgaccaaccagtcatcaaggcccaactcagaaacattcccatgcagcaagatgtacatccaatag

SEQ ID NO: 109720 - DNA, 192 bp, Glycine max
  Peptide Sequence Number=SeqID_226498
atgagtagatattgtttaaaacatcagaggaaacgtaggtgccaaataaggtgtgttggaggggcgaggggttgggttgttgttgccataggaggagatagagacaaggttagtgtaactgatgttaataagggcaaaggttatgttttgagcgatgcagtagtcattggtgggggagaacattggatttaa

SEQ ID NO: 109721 - DNA, 144 bp, Glycine max
  Peptide Sequence Number=SeqID_226499
atggctctctccttcaacttagaacttattaacacaaagactttaagtattactgattccaagggtatatatcttaatttgcacgagaaagtacagaccacatggggactaagtatgcaaggaagaatctccctgaagccataa

SEQ ID NO: 109722 - DNA, 342 bp, Glycine max
  Peptide Sequence Number=SeqID_226500
atggttgttgggcatatgcagaggaagaagaaaggaaaagagatgaaacacgggcccttaatcggtagtaccagctctttggcttcaggaaaccaaactggtgtcccatgtataaataatgatgagtcaagtgtcacagtttgtgatattaatgacaagagtcagaaccaaagagaccaacaggttgacaaatgtgatactaatcttgattcttcattaagcactccactaaaagatcatgaacatgcgtttttgaaagagttcgagagctttgatgagggaacttttctattgacaaagcgatgtcaatgtggattttcagtccaagtagaagaattatag

SEQ ID NO: 109723 - DNA, 261 bp, Glycine max
  Peptide Sequence Number=SeqID_226501
atggttgcctcctttggttacgacaaagagcgtgatgactcttgggtaaaaaagggtgctcaaccaaatgatgatgaagcacacttaccggttgaaggagactcttctctccttaagagtattttgatttctagccgtgtatttggctatgttttgaaacacttattagtttgtcatcatcaaaaagggggagattgtagaaacaagcttcatgatgatgaatcaatcaattttgatgatgccaaatgcccaagtgattga

SEQ ID NO: 109724 - DNA, 978 bp, Glycine max
  Peptide Sequence Number=SeqID_226502
atggggcgcggtgttcgccatggcgtttggcgtcttcggcctgatcaccgcagaatttctgccggtgagcttgctgacaccgattgccgactcgctgcgcgtcagcgaagggcaggcgggccagacggtcacagttaccgcgctggtggcgctgctgaccagcctggtatggcgattggcggcttctggacgctgtcgaccgccattaccatgcggctggtgcccgccgatcaggtgccgcgcgcgctgtcgattgtgttcagcgttcttcaccctgccgtcgatgccgccggagaacaaaacgcgcagcgacggcgtgctggacctgctgcgtcagagcgtgatgcgctggggcatgctggcggttatcatgatgtttaccggccatttcgccttctttacctatctgcgtccgttcctggaaaccagcgcgcagctgaatgtgaatcagctgtcgctggtgctgctggcgttcggcgtggcgaacttcttcggcacctcgctggccgcgtggctggtgacgcgcagcgtgtcgctgacgctgaccggcatggcgctggtgatgagcgtgacggcggtgctgctggtgagctttggccacgtctcctggctggtggcgagcggcgtcgcgctgtgggggctggcgtttggttcaatgccgactggctggtcaacctggctgtcgcgcgcggtgccagacgacgccgaatcgggcggcggtctgctggtggcaactattcagctagcgatcaccgccggtgcggcagccggtggctggatgttcgatctgcagggcgcgggcggcgtattccttgccagcggcgtgctgatgctgctggccgccatcaccatctttacccgcgtgcggcatcacggttaaatccgtttaccgccatcaggcgcgccgcgacacgcttcagggtgtgtcgcggcgccgcttttgccgcgtatgcctggtctcaccaatcacagcaataa

SEQ ID NO: 109725 - DNA, 582 bp, Glycine max
  Peptide Sequence Number=SeqID_226503
atgggcatgcgcctgtacggcgtcaaatatcagcgcatcgcgctgcatgcgccgtttggcctgcaatatgatgacgcgccgggcaaggcacagctgcattttgttggccgcggctcgctgctgattcgctccgcttccggcaccgtctatccgctgcaggcgggcgatgcactgctgattccgcacggtaagccgcacgcgctgatctccggcgaagatgcggtgtgcgtgccaatcgctacctttaacagcaaacccatctgcgacagcgtgtgcgccatcaacgatgcgccggacgcggatgcctgcccggacgacagcgatgtgattttattcagcgcctgcatggcgtttgagctgggcggcatgcagccgctggtgcacaccatgccggacgtgatgctggtcagcacgctgctggcgcaatacccggagatccagccgattctggatgccatggagcgtgaaacacgtcagcgcaaagcgggctttgccggcattttgtcgaggctggccgatgtggtggcggcgcaaattgtgcggggctgggtggagaatggctgtggtcagggcagcgggctg

SEQ ID NO: 109726 - DNA, 418 bp, Glycine max
  Peptide Sequence Number=SeqID_226504
atgaccatgaaaaccatcaaaacttttgctgctgttattgctctctctgttctgccatttgccagcttcgcgcaaagcgtgaccgctaccgcctctacgcttgacggtgctgaagcgcaaatcgctgctaaagcgcaggaacttggtgcttcctacaaaggtgccttcgggcgccctggcggcgttgctaacgccataaaatccttgggcgctgcgtccgctactggtggccacggcgctgctgtcctgcagcgcgctgcaggcggcggaaacgcagccgctcaatcagccgatcgccaaaggcgcctacgaactggccttcagcaacagcgacaacgcgctgttcctcgccacggcgcaaaacgccggcaacccgcagggcggtaccgtttaccgtctcgatccgcagaatctggcg

SEQ ID NO: 109727 - DNA, 504 bp, Glycine max
  Peptide Sequence Number=SeqID_226505
atgaacgatttcacggatgaggacaataaccaggtgcgctatggcgattatcaccagacgattggccgtctcggcgcgcgtctcgaccgcagctggaccgatgacagcaaccgccagtacacgccttatctgcgcgcgaattattacaaaggctggggcggcacggcgcaggcatcggtgtcggcagccgataacccggcgctcggggccagcttcagcagcggtaattttggccagatgtgggaagtgggcgctggcggcacggtgacgctgcagcaggatgtgtcgctgtacgccgaagcggattaccgcaaggagatcgacggtaacggcgccagaggctggcgttacaacctcggcgtgcgctggcaggatgcggtcgccatgaacggcgaccctacaaaatggggcatgctgcgggatgcgcagggatgcgttcgccgtgaacggcgaccctacgagaatgggcatgttgcgggatgtgcagggatgcggtcgccgtga

SEQ ID NO: 109728 - DNA, 285 bp, Glycine max
  Peptide Sequence Number=SeqID_226506
atgaaggcacactggcagcagccgcccgcaaaaatatggacgccttcaccgcggaagtggaacggaaaagtgccggaggtggggtatccggagggggtgaagctgtacaaagtcggtgaaaaaggcgacctgaggctgaacgggcggaccttcctgagcgcagcgttacggggcgagtacgtgcggttcctggaagtggacgacggcattgacgtcatcctcttcgacaggctcatccttgcgtattatgaccgggcagaaaagcgtattatccggatcgactga

SEQ ID NO: 109729 - DNA, 315 bp, Glycine max
  Peptide Sequence Number=SeqID_226507
atgcgtagagatttcttagtgcaattctccattctcaacctttttcggagccccatgaattgcgttttcgttcatgtgtcctccaccttcgagtttggagctatgcgtagtgattgcttagtgcaattctccattttcaacctttttcggagccccaggaatggggttttcgttcatgagtcctccaccttcgagtttggggctatgcgtagtgattgcttagtgcaattctccattttcaaccttttttcggagccccatgaatttcgttttcgttcatgtgtcctccaccatcgagttgggagccatgcgtag

SEQ ID NO: 109730 - DNA, 507 bp, Glycine max
  Peptide Sequence Number=SeqID_226508
atgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcgggactagagtcaagctcaacagggtcttctttcccccgctgattcctgccaagcccgttccctttggctgtggtttcgctggatag

SEQ ID NO: 109731 - DNA, 1581 bp, Glycine max
  Peptide Sequence Number=SeqID_226509
aaatttccagaaatcctaacaattgctaagaaacaaaatgaaccacaagttgttcaagccatacctaacttcaaaaaaaacccttcatctgcttcctccgagaacatatcccttgttcgtatcacaagacatgcacccatgactatccttgttgtggaagtcacaatgaaggacaaggaacccaaagttcatgtcgaacacttctttgacattgaatctttggagaatgatggctacttgatcaaagcccacttcatgctatgtggcatccatcacttcttcaaagaccccacggtggtggctcctaaactcatcccccacttttggaagactaccaaggacaagagcattgggaaagacatctaccatagtgttgtcctcactaaggtatttgaagctcatgtacaagacaatatctacctagacagggtgtttctaccaaagcataaaaccttcggccaagagaacatctcgtgccatggctcattgtccaaatggccaacacctaagaagcaaaagccattgtccactattaaatgcctaagggcactcagtgagactaatagtgacgatgatcaggctttggtcttcaagaaacataaatctgcaccaccttcagatgaaatctcattgcctcaagtgaagaagagtgagcaatcctccattgttgctgatgctaccaataatcctccaccatctgagattccaccgatacatgaatttacttcaactattcaccagtttgaacagagtttacaaaggactaagactatcaatattaggaaaaagaaaagaactgagtccactaccaataaggatgacaaagttcagaatgaagcacctctatctccaatacaccttgatcgcttccaccatcaaggaccactcgcaacaaccttattgtttccattagatattgaagaagaagaggttacatgtcttccagccacccatcttgattatcaagctgcttctacttcaattgagttggatccaccaacatggaagcgacttcgccttaagatagatgaccaacagatcaatccatcctctgatgatttcctggcactttttctgcatccaaagcacattcaactattcactcccctatccaagtttgttcctttaatctatggccatcaagcgcttcctttgactaaggatgacatatataatccaagctatccttttgacattcacatcaaacccaccactaccataaagttcatgtctgatcccgttgctccaaggttgcaaccatcagacctaagtaagaaaagaggcaaggtccctcctcacacaaagccaatgcctcatccaagcccaaaggacattgttgcgtttcgtcctgttccttgtgattggaacaagtacttcacaagggatattactatgaagattgttgctttgaaaccagatgctgagtttgataaaagtgatgcctttctcttttattttaaagacatgtttgaaaactctcatcttgtatccacctcaaaatatgacaaggaagataactccaatcatatgcgcatggtgcagatcttgcatccaaccaagatttacatattcaatgattga

SEQ ID NO: 109732 - DNA, 204 bp, Glycine max
  Peptide Sequence Number=SeqID_226510
atgggagagaagacgtttgtggtgagcttgacatgtagcaaaaggacagacacaatggtaaaactgtgtgcggtgttcgaatctttaaagctgaaagtcattacggccaatatcacttctttttcaggcacgcttctgaagacagtcttcatccagctgatgaggcaattaacaaggaaggaccacgtgaatcttgtgctttaa

SEQ ID NO: 109733 - DNA, 399 bp, Glycine max
  Peptide Sequence Number=SeqID_226511
atggaatcccagaggccagagggtcaccctctagggtatacaaatgacggaagaagagaccaaggtgaaagtcacatccctcattgccgatgcttttgtaacctcttctctcctcgtggcaaagaacctcaacgttccttgatttcatacgttaacagtttccaaacaatgctggaaacacaacctttgatttcagccttaatgttggatccaagttgccctcatgtggccgccgtagctgcacatgaggcggagcttggtcgacgccggcgcgaagggctcgtcccaagagtcggggtagctgagattaatattcagattgatgtggataaggatttagtttttgaatggaatcttgaaagatacgtagcagtatacttattcaaacttaaaaagtga

SEQ ID NO: 109734 - DNA, 477 bp, Glycine max
  Peptide Sequence Number=SeqID_226512
gtagaaaatataaagggccatatgaaagactcgacagaaagtatcgaaaatgatgaagccaataaattcaccaaggatatttctgttgaagaagatcctatcaatatacgacgaagagataaagtaaaagatgccatgcttcatgcttggacatcttatgaaaaatatgcatggggaaaggatgaacttaagccacaatctatgaatggtgttgacagttttggcggtatgggggcaactttagtagattcactcgacacattatttataatgggtcttgatgcccaattcaaaagagctacagaagttctaggtggccttctcagtgcttatgatctctctggtgacaaagttttccttgagaaggctaaagatcttgcagataagttattacctgcttggaatacaccttcaggaatcccctataacagaattaacttggcatatggcaatacaaataaccctacatgggcgcgg

SEQ ID NO: 109735 - DNA, 678 bp, Glycine max
  Peptide Sequence Number=SeqID_226513
atgtgggagaaatcaatgaaaggccttcaaagcatgattaggaggtcaacaccttcatcttttacatacctaattgagaggcttggaaatgcagactttgacaagatggatgaattagcatgttttgttcctggaatgttggctttgggatcttctaactatggccctggagaagctgaaaaatttctagcacttggagaggagcttgcatggacttgttacaatttctaccaattaacaccaactaaattggcaggagagaactattactttcgcaatggacaggatatgagtgttggtacctcgtggaatatccaaaggcctgaaacaattgagtctctattctacctttggcgtttcactggaaacaaaacataccaagaatggggttggaatatttttcaagcatttgaaaacaattctcggattgagacaggatatgttggactcaaagatgtgaatactggtgcaaaagataatatgatgcagagctacttcctttcagaaacacttaagtacctctatctcttgttttctcctccatcagtcatttctcttaacgaatgggtgttcaacacagaggcacaccccttaagaattatgactagaagtgctcatgaagagagtggtgaccaagaagaggggactgctggttttgctttatcaacagagttatag

SEQ ID NO: 109736 - DNA, 702 bp, Glycine max
  Peptide Sequence Number=SeqID_226514
atggatcatgtggcaatgtgggaggaattgattctgactgatttacgtcttgctgacttccgtgctaagcaacgtgcaatggaagatgcccttatggccttggagcttatcaaaaacatccatgacaggatggtgagcaagatgtataactttccacttcgcagagataaaggatctctttcagaaaataatgtaagaggtcgaataatgcttgaaaagaatggaaaaaccacaaattcctttcctggggatgtgaccacagaaaggattgctgctcttcaggaagcatactggagtatggcgtcagcactttctgaagcagatggaatcgattacactgatcctgaagagcttgagttgttggtcagaactcttatagatctggatgcaatggatggtaaacaaagtgtttctttattggcagagtgttctagttcccctgatgtcagcactagacgagctttagcaaatgcattggcagcagcaccatccatgtggactcttggaaatgcagggatgggggcattacagagactggcagaagatagcaacccagccattgctaccgcggcatccaaagctatttatgaactgaaaaaacaatgggaaatagaggaaggcgatagctggaggttcatgatggatgaaaacaccatggaagaaaaaggaagcatagaatctgataatgaagataccaaatga

SEQ ID NO: 109737 - DNA, 3204 bp, Glycine max
  Peptide Sequence Number=SeqID_226515
atggctaccaacaagtttgctaccatgttgcatagaaacaccaacagaatggttgtgattctagtctatgcagtgcttgaatggcttttgatagcactccttcttctaaactctttgttcagttacctcatcacaatatttgccaaatgtgttggcctccaaccaccgtgtctttggtgttcaagggttgatcacgtattgcagaaagacattgccacgcatttgcacaaggatctcgtgtgtgaggctcacgcagcagagatttccaagctcggttactgctcaaatcatcagagactcgcggagacacacagcatgtgtgaggattgtttggcctctcggccaaaccatcccgagaactcgttcggaatgaggcaaagaatcgctttcatctcgtgggtgagtagtcatggcaaacatgaaaatggagatgatgacataatgggattgagaaggtgctcttgctgcaatgagagcttgagctgcagcagcagcagcagccagctttactctccttatttgctgttgaagccttcttggggccatgagaattacaatagcaaagggtcttcttttattgtggaagaggcaatagatgatgaaaaagaagatgataaggaccttgagtttgattttgagtttgagagaaacaatggagaagaagaggtggcagatgagcatcagatactttctgatatcgagagttttatcctcatagaggcggccgaggatcgtttgagttctgtttccaacttgcattcggatgaaaaggatgcggaaaaagatgagaaggaagatgatgatgatcttatcatcatcactgagctggatccaagtggtgatcacaattttgtttgtcaattcacttccactatgcagggttcactgtatggagatcaatcacttgaagtcatcaatgtgcattttgagaatcatatggcttgtgatagccaccgtttggtgcctgtcaagttaattgactctattacctctttgaatcttgaaacatacaaattggatgagtcaccaattgaagcacaatcaagtatcttagaaaggggaggattactcacagtggatgagagtgcagagaaaacaagtgtgagagaacttgaaagcttggaaaattgtataaatttggaacttgaagggttaaaacagaattcagttgatgaggtacatccacaggggactactgctggagaagctcagactttgctgaatgatgacaacagtgttgaagcagctactgaagaactagatgatacacaagttgatttgcctcaatctcaaaaaccagaaagctctaatgaatgcacagaagaagatgaatcttcatcaagtgatgatgatgttggagtccaaaatgcctttgataagttcattgctcagaataatctaagtaagtctcaaagtttatctaatggtgacaacagtatggaagcagagatgcaagaaccagaaaatccacaagctaatctgcctccatctgaagaaccagcctgctcttgtcaatgcatatcagaagatgaatcttcatcaagtgatgatgatgctgaagttcaaaatgcctttgatgaatttattgctcagaatcgtctaagtcagtctcaaagtttatccaatgatgataaaagtataaaatcagatacggaagaaccagagaataaacaagataaccattctccatctgaagaacctgcttgcttatctaacatacaagaagatcaatcttccacaagtgaagatgatactgaagctccaaatgcctttgatgaattcattacccagaataatctctgtccagataaaacaggtgcaaatgacaccgagtatgctaagaacattgagaaaacaatagcagttgagaaaaatcatgaagaaacaagccatgaatcatccaagtgcccagagccatacgaagtagaagaagagaaacttcctgagactcctagatctgtagatggcctgcattacctgcataaaagagaatcagtagcaaatgactctgtggatggcagtgttgcaagtgaggcagaatgtggcgacccggtattaacaatcgaccggctaaaaacagctttacaaactgaaagaagggctctaagtgttgtatatcaagaactagaagaagagagaagtgcatcagcagtagctgccaaccagacaatggcaatgattacaagactacaggaagaaaaggcagcaatgcagatggaagcattgcaataccagaggatgatggaagaacaatcagagtatgaccaggaagctttgcagcttttgaatgagttgatgatgaaaagggagaaagagaagcaagaacttgagaaggagttggaagagtatagacagaaggtaatggaatatgaagcaaaagagaaactaagggtgttgcaaagaatgaaagatggaagtgtaagaagtagaggatcctcttcttcttgcagcaacatgaactacactgatgagctatccattgatcttaaccgcgaggtgcatgacgaagataatgtcttgttcaaccatgaggagatcagccacaataatgcaactgatgacacagtttctaatatggaggagatggcactagactgtgtaaagcatgtaagtgctcttgatgatacattggctgaatttgaggaagagagggcttccattctagaacagctcaaagcattagaggaaaagattatttcacttgcagataatgaggaatttcttgatgacatcaaattgattgagcattcatcaatgtatggtgacaaagacttgaatgaaaactgcaactttagcagtgttgaagaggagaatggatattctaatgggttttcagatgataaacactctccaataggttccttggccaagaagctacttccatatttagatgcagctgagaatgagactgaggaaacatacacacttgagggacaattggaatctgaatcatctgacatgcaaaactcagttcctatacttgaaatggatagcatgaagacatgcattgaagaggaggttgatcgtgtttacgagaggttacaagctcttgaaacagataaggagtttctacaacactgcatgggttccatacagaatggtggagagaaaggagtggatctgcttcaagaaatcttgcaacatcttcgtgatcttaaggatgtggaaattcgcctgaagaccttgggaaatgatccactatag

SEQ ID NO: 109738 - DNA, 403 bp, Glycine max
  Peptide Sequence Number=SeqID_226516
tccattgccaccaggcactgttgtgtcccctccaaggccaaggggtcgtcccccaaaagaccctaatgcccctcctaagtctcccaaggctaaggccacccctggaagtggcaggccaagaggaaggcctaagaaggttcctcggtctccggccgtcgccgctccgaccgccgtctccagtggcaggcctcgaggtaggcctcccaaggtgaagcctcagttgacagaaatagggaaaggagaagctgaagtagatgatgtattaaatttgactctttgcttgatatttggacatcaaccgtacgatgcaatctctattcctgtgtttccgttgataagaccttttcagtatgccaagaagtctttgtttccttggtgggggaaattctctgcccttgtttga

SEQ ID NO: 109739 - DNA, 220 bp, Glycine max
  Peptide Sequence Number=SeqID_226517
gccacaaggtccaacagaaaaatggaagctatttagcaattcaaatggtcataacttttcactcggaggtccgattcaggcgcataatatttcaagacgctcgaaattgaacaacggaagctctcgagaagttcaaatggtcataacttttcactcggaggcgcatgatatatcgagacgctcgaaattgagcaatggaaactctcgagaaattcaaatg

SEQ ID NO: 109740 - DNA, 795 bp, Glycine max
  Peptide Sequence Number=SeqID_226518
atggcacaggaatcggaggttcaccctaatttctggggccacacccccgaagaggaatactacacctcccaaggcgtccgcaacaccaagtcccacttcgaaacccctaatggcaaaatcttcacccagtccttcttccctctcaacctagaaccccatgaagtcaaagccaccgtctttatgacccacggctacggctccgacactggctggctcttccagaaaatatgcatcaacttctccacctggggctacgccgtcttcgccgcggacctcctcggccatggccgctccgacggcctccgctgctacctcggcgacatggacaaaatcgccgccacctccctctccttcttcctccacgtccgcaatagcgaaccctacaaaaacctccccgcgttcctcttgggcgaatccatgggaggcttagccaccttactcatgtacttcaaatcagaaccgaacacgtggacgggcctgatgttctccgcgccactcttcgtgatccccgatgacatgaaacccagcagggataatttctctaaagtgacggcgccgtttttcactgctcacggaacctctgacggcgttacctgcccttcgtcgtcgaggctactgtatgagaagggttccagtgaggataagtcgttgaagctctacgatggaatgtatcactctttgattcagggagagcccgatgagtccgccaaccttgtgttgggggacatgagggagtggattgatgagagggttcgtaggtatgggcctaacaaaaatccccagtcaaacaattaa

SEQ ID NO: 109741 - DNA, 3033 bp, Glycine max
  Peptide Sequence Number=SeqID_226519
atgcgctcaggagtttgtacattacagcagaccctcacagctgaggctgcttcagtgttgaagcactctctggggttggctcggaggaggggccatgcacaggtcactccactgcatgtggctgccactttgctaagcttaagaggaagttccttgagaagggcttgtctgaagtcatctcaagcttctcatcatcctcttcaatgcagggctcttgagttgtgcttcaatgttgccctcaacaggctcccaacaacaccttctcctttgatccacactcagccttctctctccaatgctctcattgctgcattgaagagagctcaggctcaccagagaaggggatgcattgagcaacagcaacaacagcctcttctcaccatcaaggttgagcttgaacacctcatcatatcaatccttgatgaccctagtgttagcagggtcatgagagaggctggtttctccagcactgctgttaagaaccacatagaggactctaattcacctcaatattctgttttccagtgttacaatagctcgggtggtgtgttctcttctccttgttcaccttctgccagtgagaacaacaaccatagggaaacagccaccaacaacaaccctaccaatttcaggcacactactcgtcatttcttaacttcttacgcttctgagttccacccttcacttgtcttttctccaccaaagaatgcaccagtgtgttccatcactggtgcagcttcttcttctagtaaggatgatgatgtcaggcttgttctggatatcctcttgaggaagaagaaaaagaacaccgtgattgttggtgactcactgtcattaactgaaggccttgtgggagagataatgggaaggcttgaaaggtcggaagtgcctgatgagttaaagtcaattcattttatcaaattccaaatttcacatgtttctttgagttgcatgaagagagatgaagttgaaatgaaactcttggagctggaaagaaaggtgaattccattgcttcaggaggagggggtggcattttttatattggagacctgaagtggacagtggaggaggcaagtttaagtgaaaaagaggaagggtccccaaatggagaagtttctggttataatcctgttgatcatttagtttcagaaataggaaagttattctgtgactgtggaacctcaaataatgctaaggtgtggctcatggccactgctagctatcaaacatacatgaggtgtcaaatgaggcaaccccctcttgagaagcaatgggctcttcaggctgttcctgttccatcaggtggactgggcttgagtcttcatgctcccagtgtccttgattcaaagatgaccatctcgcataaccaatctcaagtgctggaaacaaagccctttggtaatatggagcaggaggataaactcaattgttgtgaagaatgtgcctccaattatgaaaaagaagcccaatttatcaggccagaccaaaagaaaaggttgcctttctggcttcagtctcatatcacagaagaccataagaaggatgaattagtccaattgaaaagaaaatggaatagactatgccactgtctccaccaaagcaaacagcctcagaaccaatggaactggaaccacaacagttataattcaccaagctccatatcctttgccagcaatgccacacatggctccacttccaaactcgtccctcgattccgacgccaacaatcatgcatcattgaattcaatttcggcaagaaaagagaagcaacagagccagtcttggattcccttgagagcatggaaggtaaagaagtaaagactactcttgctcttggcaatggaggttcaggtgagtcggcggtgggggatataactgatacaacactgcaacgagctcatatttgtaaactattgcaggagaatgtgccatggcagtctgaaacttttccttcaatagcagaagccttgattgattccaaatcagcaaaggaaagtaacaacattacttggttacttatgcaaggcaatgacaccattgggaaaagaaggttggcacttgcaattgcagaatcagtttttggctcaactaatctgctccttcaatttgacatgctaaagagagagacatcaatagccccattttctgaaatgctggaaggagcactgaaaacacatcaccagcttgtgatgctaatagaaaatgttgactttgctgatgcccagttcaagaaattcctctgtgatggattcgaaacaggaaactttggaaatttcactgaagagaactcaagccaagtaatattcatattgacaaatggtggaagtggatccactaacattgagcagcagaatgaggactcggttatgaggttgttgtggcaagtcagtgaaaccaagcctaacttggagacgccatctgtcacaaccacgatcgcggagccatgttttggccacaaaagaagagctgaacttgatatgttttctaacaccaacagttttcaagggagcaagaagaaagagttttcaagacaaacaagctttaacactcttgatctgaacatgaaagctgatgaaggggataaagcaggagaaagtagccccatttcaagtgatcagaccggagaaactatagctgatccactgaaccaaaacggatttcttgactcaattgtgaaccggtttgagttcaacacaaatccagttaaggacagagagatggcagagttgtttttgtgtaagttcaaagagtcttttgaagaggtttatgggaagaaatgtttggagaatctaagtgtagatgagagggtgattgaggatgtgggtgttgggtgtggttattttaccaacagcttgtttgagaaatggctgaaagacgtttttcaaagcagtttagaaacggttaactttggagggaaggagggtatactttttagactttcttggggtggtaaaggagatagaaaatcggatagtgggttcatgagttcttctttgcccaagagtatccaagttaattacttcatagagtga

SEQ ID NO: 109742 - DNA, 711 bp, Glycine max
  Peptide Sequence Number=SeqID_226520
atgcccttgcggggtaggattgcattagaaacactttgtgcatattccagatttcgactcctaaggcctgaccctcaggagttagctgctaagctcagtatcccagggaggggatttgagcttaatgatgatggatatctattgaagatattgtggaagaacatgaccaccctagctcagatatggagtgttatttccttctctaacctgattcctacctcccatacttctgatgtcaccctagacagagccaaactcatttatggcatcattatgaagatggacatgaatgtggggtacctcgtctcccaccagatctccctcactactcaacatgacacatccagacttggattcccggccttgattacagctctatgtaaggctaggggagttcagtctgactcgaggtccctggagagcctaagtcctgccattaatttgggttatattaagaagaactgttggaatcttgatgatccaacagtaactttcagaggacccaggaaggctagaggaaagagatctaaggccccttccactttagcatcagaggcaccagcacttgcttcttctacacttcctccctcttcctccacagagatcccaatgattcctcctgcacccacacagataccacttccagctcctctctctgcaggtccagcagattttattttcactcctcagatgttgcactccatgctctag

SEQ ID NO: 109743 - DNA, 1084 bp, Glycine max
  Peptide Sequence Number=SeqID_226521
atgaagtatctggataactatgataagcatgaaaatgggagaatctggtttatttgggatgatagcaaagttatgatcaagcacatttgtagtacttctcagctgattcactgtggtgtctataatcccaatggtgatttcttgcattggtgcacggctatttatgctcttaatcacttagatgatagaaggaagctttggaaagatattgaagatctcagagttcagcaggctgatccttggtgtcttttgggcgatttcaacaatgttctaaaggctgaagatagaattggtggcagagatgtaactgagtctgaatatgttgatttgagagagatgatgtctagagttggtttgtatgaaatggatacttgtggagatttctttacttggaccaacaaacaagctgataataccatatactctaggattgacagatttttgggtaatctcaattggctgcaaatgcatattgattccactttaaaaattttggctcctagtgtttcagaccatgcccttatgtttctcagttgtaaagatcaaagtagcaggctcaggggtagatttaagtacagaaacagtctggctaggttgaatggtttccatgatgaagttaagaagaattggaacttgggtgtacatggtaatcctatgtataaactttggactaagctcagtagacttcaatctgttctgaaaaacctcagcagtcctctaaatggcctaagggagaaaattgatgaagctagaagaaacttgcagcaagctcatgaagatctatgcagagatagattcaatgtggataacattaacagggtaaaggacaggacttctgagcttcttcaacttaatgagttggaggacagtgatttgagacaaaaggctaagattaattggattcgtcagggggatggtaataacagctactttcatgctactatcaaaggtagatataagcataatgctatcagatctctgattaaagaggatgggagctgcataacttctcatgaggatatcgaggaagaagttttaaagttctacagtgctcttttgggttctagagagagcaatctggctg

SEQ ID NO: 109744 - DNA, 1395 bp, Glycine max
  Peptide Sequence Number=SeqID_226522
atggtgggggagaaggtgaatctgcctaaagtcattttctactactggatgccagccttcaaagacaaattcaaccccaaagtgaataagaaccttgttccttatggtatgcttttcacccaaattatgagggatgttagtgttgacatgtttggtatggcactgtctggaggggcaacacaacttaaagggattgaagtgataagaatgtcacaagaagaatggttgaattgtcttgacacaaagattcaagcacttagagagttcaactttctaagtgaaggtgtccttgcatgtaacaaagctttatcatctaaggagcggaaaaggaagctggctgaagatgcaatgattgctgcattggtgggcaagttatttgaagaaatttccgatgaagttattctagaatctctaaagacattgtctgttgcagaagtttataggcaaaatgctgaaaaggctaccatgatgaacatagatggtgaactggtttttgaatttgttgttgatttaatacaagcacggtcagaacaagggatgaagaaagttgagatgaatgaattggagagagttcaatctatagcagaatatgcaactaagatcttgtctttggatgttgctcaaagacaagcagagatggaatatgtcattgttcttgaagacatagatcctgtagaaaaggaagctcttaaggaggccatgcttcagactattattgaagcatctcttacaaatattattgaaatagactctataactgaacctgatacaaagttcttgaatgagaaaagtggagttggttcttacattctttatccaaaaatccaagaggtagagcttgctaagcttagcctattgaacctatggaaacaagacttccttgagatagatcccttccattatccctacagctacactagggaagtaaatcctaatgaagaagttgatgctttaaggtgttatggggcaaaggaactagcttttcaagagtttcccatcaggcagactactgcttccaattccaaaaaatttatacttgagcataggctaacaataagaaagaccttgaaccattcaagcttcactcaagaaactcttttcaacatggtttgcccatggacaagggagttctctattgtgtctaattgtaccttctcctttatgttgcttttgccctactctagattcactttcactcatcatgtacaacttatcattgaagaagtagattctgatgttgaagttgaagctgctcttgatgtcatggttgctgaagctcaactattaaagtcaaaggaattacttgctcaagctttggaagattgtgctcatggtgagaaagaggctaaaaaagggtttgttattggggactactttacaaaaatcattggatga

SEQ ID NO: 109745 - DNA, 344 bp, Glycine max
  Peptide Sequence Number=SeqID_226523
atgaatctaagagggagacaagtagagataagtgacccaatgtgcccgttatgcaacaattcggaggaggttgcagcacaccttttcttcaattgcagtaaggtcctccccttgtggtggaagtcactctcatgggttaattcagtgggtgctttcccgaaagaacagaaagatcatttcatgcagcacagcagaaggaatgctacacgaacaaaagatataagatggagctattggtggatagccctcacaaggaccatatggcaacatagaaataaggtggtctttgataaccaaacttttaatgcaagcaagctgatggatgaagcgcttcttctagtctg

SEQ ID NO: 109746 - DNA, 339 bp, Glycine max
  Peptide Sequence Number=SeqID_226524
atggaagggttagtggacctagcagtgattgacgctttcctcgcctttcatcatggcaaggaaagcccggtcgtcgccattttggccatgggttgtattaactataatcccgtcctcgccataagacaacttggctaccctatgagaggggcgccactagaggatgggcttgcgcctaaagacaaagagctcagaggcagtgggcccattggtggctaccgtgagtggttgaaagcccacgtgcaagcccttggacagaactcgagcaagctcaaacagtcaaagaaaggttctgatggaagcttgcttgtggggcttctatggaggctggatcattga

SEQ ID NO: 109747 - DNA, 246 bp, Glycine max
  Peptide Sequence Number=SeqID_226525
atgtcggagctgagagaaataccattcgaattagactcaatttcgcacatcttcaccattgggatttcggaaataatattcatggaggtagataatggaatttcacgaagacagtacaaatggaggcttcaatctcttctcgttctctctaacgtttggaaaccctatcaaagcaatcataggaaaaacttgaggaatctcaagaaattgctagaaatgccgttatcattgccagaacatacgtga

SEQ ID NO: 109748 - DNA, 585 bp, Glycine max
  Peptide Sequence Number=SeqID_226526
atggcagagggaaaaaggctgaagcataaaaggatggactcaaacagtgaaagaaagtgggatgaaagcactgtattgaaggaagaggtagataccttttgcacaagcaagagagaaagaacaaaagaatactcatttaaccacagatgggtagatacacaactttcaaagagtaaagagcttgaagatttagactcagtttttagctcacattctagagctggggaggaatatggaggaaggaaacttaagctgagaagtaatattcagagacaagaagatttttttcctcataggaggcagtgttcagtgggagaggaccactcatttttaagctctcctgcaactttagcatacatggctgcaacagaatcaacaaaagcaaaagcaagatcaacaagctccccaaaaataaggactggggggaatgtggacatgaactctgataactattcaccatgcaagaaaagctatccattgcatcttctattaacagtgaagtgcttagtaatggtaggatgggcaagctcagtgttaaccaacagcaaagatcaccaagctttaagggactttcaatgcctataa

SEQ ID NO: 109749 - DNA, 213 bp, Glycine max
  Peptide Sequence Number=SeqID_226527
atggcgggttcactgcggagagcacatgtggcgagtaaatcgctagtagggttggcgacttcgcccaaggtggatcttgccaccactgctggcgagtcagccagtggccgtaggctcggtttttcagtgataggcttgctttttcagagaaaggagagttgcaactgccattggcgagttaagggcaagttgcaactcccattggcgagttag

SEQ ID NO: 109750 - DNA, 798 bp, Glycine max
  Peptide Sequence Number=SeqID_226528
atgggtatggagtaccagaagattcatgcatgccctaataattgcatattgtacagaaatgagtttgaagaaatgcacaactgccccaggttcaagcgtatgtttgctaatgcaaatgacgcaaaagaccttacatggcatgcagatgagagaaattgcgatggaatgctccgccatccggctgattcctctcagtggaagaagattaatagtctgtatctagaattcggaaaagagacaagaaatcttaggattggactttctaaggatggaatgcatccttatggcaatttaagcactcaacatacttttagtggaagtcaagagcatgatagtgcacggatactgttaactagtgaacaggttcttgagcgggttgacgacatcgatactgtatttggaaagacccaaaagaaagaaaaaaaaagtaaaacttccatatggaagaagagcaaagtcattgatcatgtcaagttagatgagttggaaaacgaggatattattatcttgtgccagttggagatgtattttcctccttcatttttcgacatcatggttcacttaattgttcatctggtgaggaaaattaaatgttgtggtcctatttatttgtggtggatgtacccaattgagcgatacatgaagatcttaaaagggtatacaaagaatctacatcatcctgaagcatctattgttgaaaggtacatttcagaagaagctattgagttttgttccgagtacatggaaaaggaaaaacctgttggagttttagagtctcagcatgacgagagagtgtga

SEQ ID NO: 109751 - DNA, 618 bp, Glycine max
  Peptide Sequence Number=SeqID_226529
atgcaaaaagtaaatacatcacctcaatatgatgtacctgtctcagcacatggtagtgagggtacaaatcctgctgatgctgctatgtgtggaataaaaatcgtctctgttggaactgaggccaagggaaagattgatatagaagagttgaggaagcatatccttcaagtcacagtgtttatgaggaagaattattaccccgttcttttccgtggagtcaatggaacagttgctcatgaattcatcattgacctgagaggctttaagaatactgctggaattgagcctgaagatgttgcaaagcgcctcatggactacggttttcatgcaccaacaatgtcatggcctgtgcctggcacactcatgattgagccaactgagagtgaaagcaaggctgaactagacaggttctgtgatgctcttatttccattagacatgaaattgctgagattgagaaaggaaatgctgacattaacaacaatgtacttaagagcgcccctcatccaccatcactgctcatggctgatgcatggacaaaaccatactccagggaatatgcagccttcccagctccttggctccgtgcttcaaagttctggcctaccacagtgggctag

SEQ ID NO: 109752 - DNA, 210 bp, Glycine max
  Peptide Sequence Number=SeqID_226530
atgtccatgtgcccatactcagttgcaacaaaatgtgcacaagaaggtttgcactcgttgaagaactccttatggattttgggacatgccagtgagaatttgaggaaatgtgaggacgatttagatgtgccagacacagtgtctacgcctacaagtgcagaaagcagaaaacttgaggttggttttagcatgaccaagtgccacagctaa

SEQ ID NO: 109753 - DNA, 264 bp, Glycine max
  Peptide Sequence Number=SeqID_226531
aaggctaattttgttagtccaccatgtgctcctgatggggagaaccataaggagttcttcaacgagtgcaaaccttcttgtgcacattttgttgcaactgagtatgggcacatggacatgttgaatgatgatggaatcggtcctagggactccatgagaagggctgtgggagggttggttgtggccttcttaagggcacagttgaacaacctatggaaggattttaatgctattttggcggatccttatcttgctctcccttga

SEQ ID NO: 109754 - DNA, 1038 bp, Glycine max
  Peptide Sequence Number=SeqID_226532
atgaaggggaaaatgaaagcaatgatgaaagtgatgatgagcatgaggaagatgatggaggtcaattttgctacagctgttgctgcaaggactactactgagagggactcgattcattcaccctgtctagagcaagccttttttccaccatatggtttgccttccaattatacatcgcccactgttgtatatgctcctagtgagaatattgttaattctgcacccatattcattgagagtagaaaaccccaacccgatcatacacatgcacatgtctctcaacccatgggggaaacacataaagctccccaagaccacactctaactggtttcaaggcttattcgggatataccactgaaggacatgcattttctggtgtccccgtgccaaatgctcctgggggccctctgtatcgaccactatcacaacccttacattttgtaatgggaggaggatcctttgctatagttgaaaaggaaaaatttgatcatatagaggagacactgagggccattgaaggagggggaaattatggttttgctgacatgttagaattgtgcttggtacccgatgtagttattcctccgaagttcaaggtgccaaattttgataaatacaagggcaccacttgcccaaagaatcacttgaagatgtattgtaggaagatgggggatccaatgaatgccttcattaggcaatattcgtataactctgatatggatccaaatagaatgcaactacaaaacatgtgcaagagagatattgaatctttcaaagaatacgctcaaaggtggagagatccgacggctcaagtagtaccctctatgacgaagagagaaatgataaccatgataatgaacacattgttggtgttctactatgagaaaatggtaggttacatgtcttccagttttgcagatctagtgtttgctagcgagagaattgaaccaggggattcaggaggagtggcgagaggaagaaggagggaaaacctcatgttgtggctatacttcccacgtggccaaactttccactag

SEQ ID NO: 109755 - DNA, 261 bp, Glycine max
  Peptide Sequence Number=SeqID_226533
atggcgcagagagctcaatcagtattggccaccaaagatgttttccaaaagggagatttccattggaaacaattcaacgttgaaacttccagtgcttcatcctcaactccaaaaccattgctaatctttacaccaatcgtgcctggctcataccctgtcatattgttctgccatggatttttcattcacaatagcttctactctgagttcctaggccacatagctttacatggattcatacttgttgctcctcagctgtga

SEQ ID NO: 109756 - DNA, 156 bp, Glycine max
  Peptide Sequence Number=SeqID_226534
atggggtgcatgtatgaaagatggggtggttgggttggaactgggtcagggcgacccagcctaacctacgattatgcaacagggttggaaaaccgtagttgccttgcacagaaaacgccgcgaccaacacggaaaccaccacggagggtggcatga

SEQ ID NO: 109757 - DNA, 345 bp, Glycine max
  Peptide Sequence Number=SeqID_226535
atgtttatctcacaagaaaatgggttgggcccaaaattaaagcagggtaacccggcgcaaaccgcaattgcacaacagggttggaaaaccttagttgtctcacgcagaaaacagcgcagccaatgcggaaaccaccatagagagtggcacattgcccatggcaccactagtgcaaggtccagcggcgcaaggccgccacatggccgatggcggcacgacatcgacgacaatagatgtatcatggtggtgcaaacaaaaaagagagaaaaagaaccaaaagaaaacaaatgtgatagggcccttaacgccattggcgaagggcccacaagtgtgaagctaccatag

SEQ ID NO: 109758 - DNA, 669 bp, Glycine max
  Peptide Sequence Number=SeqID_226536
atgaggcactttttagtactagtaccactgatcttgcttgtttttgctggttttccatccaaagcaaaaggctctctgctaccattcacaaatcatccaaataccctcttggctgatctatggtctaatcatttccctgatccatttcgcgtgttagagcaaatcccatttggggttgacaaagatgaaacattcacagctctatcatcacatgcaagagtggattggaaggagacaccagaagggcatgtcataatgctagatgtgccagggttgaagagagatgagatcaagatagaagtggaagggaatagagtgctgagagtgagtggagaaaggaagagggaagaggagaaggaaggggatcactggcatagagtggagagatcctatggcaaattctggaggcatttcaaggtgccagacaatgtggactctcaagatgttattccttatggttcgagtaataataacgatttttttttgcataaaacaaagaggggaacgagcaacaatttgaaggttgtacattcaggaactaaagaattcaaaatagctagtaataagagggatttgtttttgggattttctgatcaccaagagcggatacgcaagaagcttgcacttgacgagggaaggatatttgcagctaatgaacaactttcttaa

SEQ ID NO: 109759 - DNA, 435 bp, Glycine max
  Peptide Sequence Number=SeqID_226537
atgacgggattctttggtgcaataaagcctccctttggtggagagatttggcaaaagtatgaggtggcgaggatccaactttcaaacgtagaatattggaggctagggagttgtagggatgctaaattctggctggacaaccggaatggtgatacagtttttgggctttggctgacaagtatagcaggttattcacaaattcttgtaatccgaatgccctggtggctgaaatgggatattaggtaccctcccaaaaaaacaatgttatttttagaggggccaatgggaattgggaagctgtgttgtgtggccgcatgggatctggcaaaacatagagcttgggcatggattaatgcgaaagggaaaggaagaaaattctcttattgtgaatgggagatgaatcccagggcttgtttgaattgtttaacgttatga

SEQ ID NO: 109760 - DNA, 365 bp, Glycine max
  Peptide Sequence Number=SeqID_226538
atggttaaggaggagtgtaaggaggtatgtgtctcctccaagaggttagctaagaaggaaagtcattttgtaataaggacaaacattaaagaaacttcccctcttagacaacctccacatcttctcctttgtaaaaagacacttgttagcactgccacacctcttgggcttgagattattcctcaactaaagaagttgttggatgatagtttggttcgtgagagcttaaatccttatgctttgttagtgcccaaaataggggttcccatgaaccctaagagaataaaggtcattcctgagtggcccactccaccaagtataaggaaaatttggggcttccatgacttaacaaaattttacaaaag

SEQ ID NO: 109761 - DNA, 495 bp, Glycine max
  Peptide Sequence Number=SeqID_226539
atggtattgttccagaaaaaaccagttaatgcagcatttcagcgagtacaagttgacaagatacaatttgctgatgagaggcttcaggataactcttattgggcaaaggatggtgccgagaatggttatggtgctaaagcagcagaaattctcgatcaagttagaggaaggggttttcgtcatgagaagactaagaagaaacgtggaagctaccggggaggacagattgatttacaatcccactcaacacaaagcgaatcatgctgcggatatgaaatttgtgatgggggagaatgttacatccaaaagacattgctaggttctggtaaacaagttgactttcacctattaactaatgtgaccgaagcaactttgcaaaattatgaggggacgggttccaaactagcagtgaagcggcaaaaatatgggttttataactgtgttagttacatggtagagttgctagctagtattgcatttacggaaactaaatga

SEQ ID NO: 109762 - DNA, 294 bp, Glycine max
  Peptide Sequence Number=SeqID_226540
atgagtttctccaagggttctcctggcagccagacgccgcgtgatttagaagctgggtctcctgctagcttctctgctgattttgatgatggagacgtttctgctgatccatttgacgttaccagaacaaagaatgctccggttcaacgcctcaggcgttggagggctattggtgccttgtcttgtaggattttgggtgccatccccttcctatcacttctgtatagagacatagacaaggagaaaatagggcctcaactggggtgttgtttagggtctcttgaactcaaatga

SEQ ID NO: 109763 - DNA, 681 bp, Glycine max
  Peptide Sequence Number=SeqID_226541
atggaattagccatactaggtagcatagatattatcatactggagaacctaattgatcgtgctcgaaggactgtgcgtggatctgccgatgatataggatggcttcaacgtgatcctggaatgccgtcagttgaagatggaacagtgaggttcctggaaattctggacaacatcaagcatggtgttcacaggttaccaaattcggtggtttatttgttaattccaggtcttttcagtaatcatggtccactttactttgtcagtacaaaagtcagtttttcaaaaatgggtttggcctgtcatatcgcaaagattcatagtgaggcttcagttgagaaaaatgccaaagagctaaaagagtacattgaggaaatttattggggttcaaataaacgtgttatgcttcttggacacagcaaaggaggagtagatgcagcagctgctttatcattgtattggtctgatttgaaagataaagttgctgggttggcattagcacaaagtccctatggtggaactcctatagcttcagatcttctacgagaaggacaacttggtgattatgtaaatttacggaaacttacagagattcttatctgtaaagtaattaagaaaaacagtggaaagagttcagagtcttgcggcatgctgggtatgcagagttgtggtttaagggaatag

SEQ ID NO: 109764 - DNA, 495 bp, Glycine max
  Peptide Sequence Number=SeqID_226542
atgagtccgacacaacctagggatcctcctagacatccacctgtggtgcacgatgatacgtttattgaaccaaatcctcctcagcagtcagtcgtcgcagcggctatggtagaaccacctgcagctgcacctgttgatgaggcttaccaagcaatagcagaaaggttggaacgcttgatcaacttgaaggtagtcactaaaggaacaaaagtatacactgtgattgaggagtgcataaggattgccaaaagtgtgactgcgcaaggaaatgtttatgttcgatcgagacgaaggtggcgtatgccaaatgcaggaagatttttaggattttttagcaatgccttccaagattattttgatgatgctaaaagaatcaagtgtcacgcaagtgccaaagaatcaagagtcaagcaagtttcaagaatcaagatcaagattcaagtaaagaatcaagactcaagattcaagaatcaagagaagactcaatcaagataa

SEQ ID NO: 109765 - DNA, 942 bp, Glycine max
  Peptide Sequence Number=SeqID_226543
atgaccggtcatttggcctattttatatgtagtggatgtaaaccattatctctatttgcacatatgatccttcctgtttggaaactaggagatgtggaatatgtggtctgtcgagatgatagtggcattgtccgtgcctttcacaatgtctgtcgtcatcatgcttctcttcttgcttatggaagtggaaagaagtcctgctttgtctgcccttatcatatattaaaagacagatttctgcaggggtggacatatggattcaatggagcacttctcaaggcaactagaatatcaggaatgcgaaatttcaatgattttggccttttgccaatgaaagtagctacctggggaccttttgttcttctcaatttggaaaaagagaatctttctaagaaggaagttgatagccataatgtgtcaaaggaatggcttggtagctcttcagaaatactgagtaccaatggagttgattcttcactaagttatgtttgtagacgtgaatacacaattgaatgcaattggaaggtattctgtgataactacttagatggtggctatcatgtgccatatgcacataaaggccttgcatctggtcttaagctggactcctattctatcacacatgctttcataacttggggtgtttgctgccttgataggtatggaccttggatggacaccaatcttgtggttccactaggacccaacaaatgtcaagtaatatttgactactatcttgaacattctctgaaggatgacaaagatttcatagaaaaaagtttacaagatagtgagaaagtgcagatagaagatattgtgttgtgtgaaggtgtccagaagggcctccagtccccagcatatcgtgtgggcagatatgctccaacggttgagcaggccatgcaccattttcattgtctgctctatgaaaaccttgcaaaataa

SEQ ID NO: 109766 - DNA, 1200 bp, Glycine max
  Peptide Sequence Number=SeqID_226544
ggtggtaatgatgttgagatttctggatcaccaacagaaaaggcaatattagagtggggagttaagcttgggatgaattttgacactgccagatcaaagtcatcaattattcatgtattcccattcaattcagacaaaaagcgaggaggagttgcaacatgggtgtctgactctgaagtccatatacattggaaaggtgctgctgagatagtcctagcttgctgtacacggtattttgatgctaatgatcagttggtggagatggatgaagcaaagatgtcaacttttaaaaaagctattgaagatatggctgctgatagtctacgttgtgttgcgattgcctatagatcatatgaaatgaagaatgttccaactagtgaggaagaacttgctcactggtcattaccagaggatgatcttgttttattggctattattggcctaaaggatccttgtcgacctggtgtcaaagatgcagtgcagctttgccaaaaggctggggttgaggtaaaaatggtcactggtgacaacgttaaaactgcaagagcaattgctgtggaatgtggaatacttggttcaatttctgatgctacagaaccaatcatcattgaaggaaaaagatttcgtgccttgacagatgaagggagagcagatattgttgaaaagatattggttatgggacggtcatctcctaatgacaagcttttgcttgtgcaagcattgaggaggaaggggcatgttgtggctgtaactggagatggaacaaacgatgctcccgcactacatgaggccgatattggtcttgcaatgggtatccaaggtacagaagttgctaaagagagctctgatatcattattttggatgacaattttgcttcagttgtgaaggttgtcaaatgggggcggtctgtatatgcaaatattcagaaatttatccagtttcagcttacagtcaatatagcagcacttgctataaatgttgttgctgcatttaccaccggtgacatcccactaaatacagtacagcttctctgggtaaatcttatcatggatactcttggagcattagccttggcaactgaaccaccaactgattccctgatggatcaaagtccaaagggtcgaagcgcccctgtggtcattggagctgacagggattttatcttgatgtggaccaagtcacaaacaactagcaaatga

SEQ ID NO: 109767 - DNA, 411 bp, Glycine max
  Peptide Sequence Number=SeqID_226545
atggtgtcggcgaacaaggagatggtcgtgcactgctttgacaccctcctcgctcactacaacagcacggaagcacctcctcctgccttcgatcaggctcaacatccattgtttgttacatggaagaaagtggtgaatggtggagatcctcgccttcggggatgtattggaactctggaagcacgcagcttgatcaatgggctcaaagattatgcgctgaccagtgccctcagggaccggagatttccacccatacaagttaatgagcttccgcttttggagtgtacagtgtcccttcttactgactatgaaactgctaaccattaccttgattgggaggtatgtgctgatttacttgttttagtttctgggatattgctggcaggacttaattgtagagatgctatttaa

SEQ ID NO: 109768 - DNA, 363 bp, Glycine max
  Peptide Sequence Number=SeqID_226546
atgttggtgtcgattgagaattcatatgtggtccaatggtttgacacttatgaagccaataaagctttaccttcaggagcctttgtttgtagagcctttactagcaaggtggtgcatattagtgacataaaggtaggagctaggaaaattatggatattggcattctacttggactttttcactgtggaaaggaagtacaagtcataagtaaactggctatgttggaagacaaatataaagagcaagttaacaagtcagagagaatttttgtagagggcaaccatgggagaggcaaggggcaggtttccttgattatgggagtaaggagagaagggaattcaaccaatttattcaagatttag

SEQ ID NO: 109769 - DNA, 564 bp, Glycine max
  Peptide Sequence Number=SeqID_226547
atggagagggtttctccgaggaggaaggtggcctttgagaaggtttcaaatgatgataacgaggtactaattgcaaggtttggtgaggaggagattaaagaggctatttgggagtgtggtagctcaaaaagccagggtcccaatgggtataactttggatttatcaaagaattttggtctttgttgaatgaggatgttactaatttccttaatgatttctatgagtctgatagttttgttagaggtgccaatgcatcattcatatatctcattcccaagataagtgaaccgcaaggggttattgatgaaaggcaaagtgctttcttgggagggaggaatttcttacatagtgcaaagataagaaaccatgaatccacttgggaattccacaaaaagggactttgtgggaaagggtgcttgattctaaatatgatggatgaaaaggcttgggagagggtgagcaaaagatggtggtggctggtgacatgggctcatggaatcaaggattttggtcatggaagtttaggtggagaagaccatggtttgaatgggaaaggagattga

SEQ ID NO: 109770 - DNA, 741 bp, Glycine max
  Peptide Sequence Number=SeqID_226548
atgatgtacgagcagcagcaacgatttcatcatcagcaaccgatgacaatggatacgaggaggaagaagaaaggatcatcaggcggcatagaggaagctgatgagaggcttgaaatagtggacttgagtggcatgtccttggactcccttcccaacccttctcttaatttagccaccatttgcaagttggacctctctaataacaatcttctgatatatatagtactacggagaaatatagagaagaatataccggagtccttaacggcgagactgctgaacatggtggtgttggacgtgcactccaatcagcttaggtccctcccaaattccattggctgcctctataagctcaaggatgaggttagtaatagtataaccccgtaccaagacggttacagatcgagagcgagagaggaaaacaagaaacataagcttagaagagttgaatgcgaacttcaacaagttgatccagctgccagacacgatagggtacgagctgaaaaacctgaagaagctatcagtgaactccaacaagctggtgttccttcctcggtcgacctctcacctgactgcactgaggattctggacgcgcgtttgaactgcctaaggtctctcccagaagacctggagaatctgataaacctggaaaccctaaacgtgagccagaacttccagtacctggactccctcccctactcggtgggattcctcttgtccctcgtggaactcgacgttag

SEQ ID NO: 109771 - DNA, 213 bp, Glycine max
  Peptide Sequence Number=SeqID_226549
atggatatggatgacgataatgaagttccattgattcctggcagacctttcgtgaagactgctaaattttttattgatgttgatgatggaaaactcattgaatttgatttggaaatcaaggataaaataggagtgaaaatcatgccatggtttgctgagatggccaattttaaagcagttggtgcacttcctgatgatcccacttggcactag

SEQ ID NO: 109772 - DNA, 321 bp, Glycine max
  Peptide Sequence Number=SeqID_226550
atgggtggaagcaatagttgttcaacatgcagatgcaaagaccgttatttgcttcctaaagaaaaacatcctttcaaggtttggcacaccaagggtattgggaagctaaaatctaagtggtccagatcattcatcttaaatgaagtcattccacatggagttgtggtattgaaggatccagccacaaagaggacagagactgtgaatggcagcagaatcaaacactacttgggtggtcctacaaatgaccaaggaggaggaagagtagatggcaatgaagacatgacagatcctattgattattacattggaggagactga

SEQ ID NO: 109773 - DNA, 1617 bp, Glycine max
  Peptide Sequence Number=SeqID_226551
atggcactcaatcggagagagcaaatgaagcaactaacagcagtactggcacttggtttgggtgtttggtcccataatatcatgttcttctcgaccagcaggaatcaagcaatgaatgcattcctcactagaaagccaacattttgtcttaaaaatcaaatttttaggctttttttctcttcccacagatcgtcaaccacgagatcaagcaaaggcttagctattgcacagagggtccttaaccttctatcgtcccaaaaacgtggtactactgttgaccgtcgtcaaagtcatcttaggcttattgatgacatgttggaaaactatgtaacaattcctcttggtcacaattcagctactaatgggactacagctgaaataactattgagtcctctgttctacatatggaacaagggttcggagttgatgtgttcttcttgtcacaagccgtgagttcatgtggttccaagcgtgacctttggggaggaattcagtatcactgcctagcaataacaactgggttcgttgccagtgtttatgttggaagttctttgataagtttgtacagcaggtgtgcctttttgggtgatgcatgccgtgtgtttgaagaaatgcctgtcagaaatgtagtttcatggacagcaattattgctgggtttgcacaagaatggcatgttgacatgtgcttggagctcttccaacaaatgaggggttcagatttgagaccaaattatttcacgtacaccagtcttctgagtgcttgtatgggcagtggagcactgggacatgggagatgtgctcattgtcaaataattcgaatgggctttcattcttacctccacatcgagaatgctctcatttccatgtattctaaatgtggggcaattgatgatgccttgcacatatttgaaaatatggtgagcagggatgttgtcacgtggaacaccatgatcagtggctatgcacagcatgggcttgcacaagaggcaattaatctctttgaagagatgataaagcaaggtgttaatcctgatgctgttacttaccttggtgttttatcctcatgtcggcatggaggtcttgtcaaagaaggtcaagtttactttaattccatggttgagcatggtgtgcagcctgggctagatcattattcttgcattgtagatcttcttggtcgggctggtttacttctggaggctcgtgatttcatccaaaatatgcctatttttcccaatgctgtagtatggggttcactgctttcttcctctaggcttcatggaagtgttccgattggcatcgaggcagcagagaataggttattgatggaaccagggtgctcagcaacacttcaacagctagcaaatctctatgcaagagttggttggtggaataaggtagctagagtgcgaaaatcaatgaaagacaaaggtctaaaaccaaatcctggttgtagttgggttgaagtaaaaagcaaagtccatagatttgaagcacaagataagtcaaacagcagaatggcagacatgcttttgataatgaatagtctgatggaccacatgagtagtttaaaccttcagtctcaaatgtttgaggaggataatatttggcattcataa

SEQ ID NO: 109774 - DNA, 141 bp, Glycine max
  Peptide Sequence Number=SeqID_226552
atggccttgcttctccacgctacatgggaatgttctcgcctcgtcgcctcttctcacctcggtggacaaggaaatgatggtcggctagttcctgagaccttgttagcccattgtgcttcatggatgaacagggtctattag

SEQ ID NO: 109775 - DNA, 840 bp, Glycine max
  Peptide Sequence Number=SeqID_226553
atggctgtactaaatgcattttctttacttcctgcatctccctcaaaatcaactaagctatctgctttatttactcttggatttgttatgtctctatctactggccttgctaatgtcagcttgaagtataatagcattggcttctatcagatggcaaagattgcagtaacaccttcaatagttatggcagaatttgtattgtacaagaagaaagtttcttggcccaaggctttagcattaacggtggtatctattggtgttgctgtggctacagtgacggatttgcagttccatttctttggtgcctgtgtagcattagcatggattgtacctagtgctgtaaacaaaatcctctggtccagactgcagcagcaagagaactggacagctttggcgttgatgtggaaaacaacacctattactttaatttttctggctgctatgttaccctgcttagaccctcctggtgtactttcctttgattggaacttcattaacacattggtgatactcacatcagccattcttggatttttgcttcagtggtctggtgctttagcactaggtgctacatctgccgtctcgcatgttgttcttgggcagtttaagacatgcattatcctcctgggaaactattatctctttggatccaatccaggcataatcagtatctgtggggcatttacagctattgctggtatgtccgtttacacttaccttaatctgaagcagcaatcaaacaagatatttcctcgacaggccacccttttaccaaaatctaaactaagcaaagaaaatggaacttcccaaaatggacactacagtgctgaaaatgtctaa

SEQ ID NO: 109776 - DNA, 875 bp, Glycine max
  Peptide Sequence Number=SeqID_226554
ctcctcctccggtttctcagttagggttcccaaacgttagagagaatgagaagggattgaagcctccattccatggtcctacgtgcgatgcatctttctctgttcacaggcattattttataaatcccaatagtgaaggcacgatagttgatgcataccagcttctatctttcttcttgacaaggagcacaatagatgaaaaagggctttggctgatccaaatcgggccaaagtcaagcattgcagtgacttttttctcgagttcatgcagaaagagtttcgaacttggagaagagggctatgttctatggtacggggtgggtgtgggcaacaagtacaagtgtttggtggccgatgcgccattaggccacaaggggacatctgtgtggaaagttataggtcgtcgaaaaagctttggttctgaatatgagtgggattttatgggcaaagatgggtgcaatgtagaaagacccattacctaccatgacgagcaaggtagaggtgggaagaagctggagattcaaaaattttgtgacgcgtgtttggaggaagttgtggtcgtcgagaagttggcaatcagggatacgtcactagacagggcattcatactgatctatggagtgggcatgtcattcacgtttggagtgagttatacaaaagttgaactaggggaagtggactttctgagacatgggggaaggcgaagatggactgatgacagtagaaataagggagtaaaaggatggcatgttgtggatgggacgatgacgatcgttgatcttgtccccttgaagcatggccaagtgcgccttgtggatcatcataataagagggtgcaaaatgggattccagattttgtaacaaggcaaggctag

SEQ ID NO: 109777 - DNA, 1600 bp, Glycine max
  Peptide Sequence Number=SeqID_226555
ggtggacccttgggtactagtaccctcaccttccgaggactacacatcttcacctttagagggctacacgccatcacctttagagggctgcaccccctcgcctttagaggactacacatcctcgccttcagaagactgcacgtcctcaccttcagagggctacacgccctcaccttcagagggctgcacgccctcaccttcagagggctgcacgccctcaccttcagagggctgcacgccctcaccttcagagggctacacgccctcaccttcagaggactacacgtcctagccatcagaggacaacatgtcctcgccttcagagggctacacgccctcgccttcagaggactacacgtcctcgccatcagaggactacacgtcctcgccatcagaggactacacgtcctcaccatcagaagactacatgtctttagagggctgcacgctctcagaggactgcacctcctcgccatcagaggactacacttccttgccatcagaggactacatgccttcagaggactgcacgtcctcgccatcaaagtgctgcacgccctcaccttccgaggactacacgtcctcgccttcagaggactacacgtcctcgccatcagagggctgcacgcccttgccttcagagggctacgcgtcctcaccttcaaagtggggctacatgccctctccttcagaggattacacgccctcacctttagaggactacacgtcctcacctttagagggatgcacgtcatcgccttcagagggctgcacaccctctcctttagagggctgcacgccctcgctttcagaggactacacgtcctcaccatcagaggactacacgtcctcaccttcagagggctacacgccctcaccttcagagaactacacatcctcacctttagagggttgcacgtcctcaccttcagagggttgcacgccctctcctttagtgggctgcatgcccttgctttcagagggctggacgccctcgccttcaaaggggctacgtgtcctcactttcagtgggctccacatttgcaccttaagagaatgaaagggccaactgtgcgagcacaactagaggaggaggctattgtacagccactatgcatactggggcaagatttcatccgtgtccaacattctgcccagcggccacaacgccgatctccccttgcggaagtatcagttggtctgtgccgtcccaacatagggatcgcgcccacaagactcccagtggacccgaaggagcccaaacagggccctggggtttccaactctggttacgggcctctgtcagtcctacagggcgcccgtccctccagcaagttcatgccatcatggcatagggatcacgcccgcaagacactcagtggacctggagaagtccaacagggtcctggggtttccagctctgattatgggcctctgtcagttctacagagtgtctgtcgcccccagcaaggcgcagggcgagacaccacagcagcctggggatggccgacagtaggcaacagacgcaccaccaccacctccaaagcccctcagctcatctacaaaagctggagcgttgcctacgacctgtggtcgacca

SEQ ID NO: 109778 - DNA, 1146 bp, Glycine max
  Peptide Sequence Number=SeqID_226556
atgaatgcaaagattaaggctttagaacttaatgatacttggattttaattgatatgcctcaacataagaatgttattggttgtaagtgggtgtataagatcaagcacatatcagatgggtcagtggagagacataaggtcaggttagtggccaagggctacattcaagtggaagggcaagattacctagacaccttttctccagttgccaagctaaccagaatgagatttctattggccttagctgctatcaataaagggtatctcaagcaattagatgtgtacatggtacttcctcaaggtatgcgagtagccaagcttgggcaagtttgtaagttgcaaaggtccctatatgaactgaaacaagccagcaggcagtggtatgccaggctctcttcctttttaatctctcatgggtacaagcaatgtgcttcatatcattctttgtttctcaagcatggattcaatattgtcattgctctattagtttatgtggatgatattgttttgtcaggaaatgatttgattgaaatacaagctattacacagttgctggacaatgcttttaagataaaagatttaggtgacttgagatacttcttaggttttgaagtagccagaaaacctactggtatcaatctttgtcaaaggaagtatgccttagacattcttagtgatgctggtatgcttggatctaaaccagtatctactccatcagattatgctactaagctgcatcaacaatcaaggactcttctttcattggaagatgcttcctcttttagaaggtttaattggaaggttgatctacttgaccaatacaaggcctcaacagctgttcgaattcttaggtatatcaagggatcccagagcagggattgtcctttctgctgcaaaaacaagccactatatctagaagctcatcagaaggtgaatcacatagcttcgaatccagtatttcatgaaagaacaaagcatattgagattgactgccacatagttcaagagaagatgttaaggggtcttgtgaagttgcttcccattccttctacaaatcaattagttgatgtttacactaaagctctaatgcctggtgcttttaaatttctgaattccaaactagggatgtctgatatccactcctag

SEQ ID NO: 109779 - DNA, 564 bp, Glycine max
  Peptide Sequence Number=SeqID_226557
atggcgcacgatacatcatctgattctgaaaatgaaattattggagcacgggcaaagctctttggacatgaaaaaccgattcatgaagttcttggaggaggaaaagtggcagatatgttattatggagggacagatatgtatcaggtgcgcttttgggtgggatgactgtgatatggtttctatttgagatcgttgagtacaatttcgtggcactcctttgtcacatttccatcaccaccatgcttgttctattcatatggtccacggttgcagatatatttaaatggaaaggtccccagatcccaaacattgttttacaggaatctttcttccatgatcttgcttccatcctccacaaaagatttaaccagttattaccaatgctcctccacatttcatgtggaatagacctgccaatctttcttctgtttaagtgtactaagatgtcttgtttctttgttgcatcgttcattcgtgacaagggtttctctgcatgcaaacgctgccaattgtgtatgaacggtatgaggaagaaatcaacaattgggtcagcgatatcataa

SEQ ID NO: 109780 - DNA, 140 bp, Glycine max
  Peptide Sequence Number=SeqID_226558
atggccgagttggtctacggcgctagtttcagaggagattatcacacgtgcttgattcctgaatcttctatgtataatcagccagcaatactcatattgctaacaatatctcttgctggccaagacaccttttccttaag

SEQ ID NO: 109781 - DNA, 672 bp, Glycine max
  Peptide Sequence Number=SeqID_226559
atggccatcaacagacacaaaagccttctccatttcaccaatcaaatcctccacctcttgaaccatattcttcctgcacaactcgccaagcagagcccgttaagtcacctcatccggacacaaccccgcctccctaatcctcctgtaacaagaaaccgcaacaccgatatccccagcatcaacatgcaaagacaaaaaaatgttaaaagtctttgtatccaggaccacccttttctcctccatcatcccaagcaaagcctccgcctccaccaaatcaccccgactcccacaaacaaaaatcatgttagcggtggtggagagaaagtgaaggatggaaggcaaaacgtggtcgtagggtttttttctttttcctttttctgttgggtgggagggggagggacacgtggcggttggttgagaagggagaaggggagagataggggtttagggaagagggtgttggtggtggtgaaggtggaagaagggaaaggagaggaagaagaaggtcttagggagaataaggtgcgaacatggtggttgttgttgtgggaaagagaagagactagagagggggaaaacgccattgccactggcggtaaggctcaacccgccattgccagtggcggcaaagcaggagagaggggtgtatcgcccctggtagtggcgacatag

SEQ ID NO: 109782 - DNA, 2733 bp, Glycine max
  Peptide Sequence Number=SeqID_226560
atgaatgaagcaaccatcaacaacacggagagttatctatacctccatccaagcgagaacccggccactgccctcgtttccccagttctaaactcaactaactaccactcatggagtaggtccatgatcactgcattaagtgccaagaacaaggtagagttcatagatggtagtgcgcctgaaccactgaaaacagataggatgcatggagcatggcgtcgatgtaacaatatggttgtttcgtggatagttcattcagtggcgacctcgatacgtcaaacttcgacgatgaagcaaggctcactcatagtgactgagtatttcactcgtctacgtgtaatttgggatgagatcgagaactttaggcctgatcccatctgttcttgtaatattagatgctcctgcaatgcattcaccattatcgctcaacgaaagctcgaggatagagctatgcagttcctgcgaggcttgaacgaacagtacactaatattcgttcccacgttcttctcatggatcctatacctgccatatccaaaattttctcctatgtagctcaacaggaaaggcaactgctgggcaacaacggaccaggtatcaacttcgaacccaaagatatctccattaacgccgcaaagaccatttgcgacttctgtggacgcattggtcatgtggaaagtgtgtgttataagaagcatggggtgccctctaattacgattcaaggaataagagtaacagtgggagaaaaacgtgcacccactgcggcaagataggacatacagtggatgtctgctatcggaaacacgggtatccgccgagatacaagccttacagtggaaggaccaccatgaacaatgttgtggcaattgaaagcaaagctcatgatgatcaagctcagcatcacgagtcccatgagttcgttcgcttctcccccaagcagtacaaggcacttcttgccttaatccaggagccatccgccgggaacacggcatccactcaacccaaacaggttgcttcaatttcatcatgcacagttaacaccccaatggactcaggtatgtcactttcctccagtgcactttccaccccctggatattagattcaggggccacagatcacgtaacctgctctttgcataaccttcacttccatagacgaatcaatccaatcacagtgaaacttccgaacggccaatatgttcatgccactcactcaggaacagttcagctctcacccaatataaccttgcacaatgaaatgaacaaccatacgaagattggtatagttgaagcaaagcacggtctctatcacttgataccaaaccagttgaccaccaaagctgtaaactctactatcactcatcctcaatgcaatgtaattcccatagatctttggcattttaggttaggtcacccctcagctaaaagaatacaatgtatgaaagcatattatccccttctacgaaataacaaaatttttgtctgcaacacatgtcattatgcaaagcccaagaaaatgccattttctcctagcagttcacatgcatctcacgttttcgatttacttcacatggatatatggggttcatgctcgaaactatcaatgcatggacacaaatatttcctaactatagttgacgattgctcacgctttacatgggtacatctcatgaagtctaaagctgaaacacaacaggtcattatgaatttcattgcattcattgaaacacagtataatggcaaggcgagtctaccgcctagtttctggtgttatgccttgccacatgccgcatacttgattaattgcatccccacaccatatttgcataatgtttcaccttacgaaaagttgcataagcatccatgcaatatttctcatcttcgagttttcggatgtctgtgttacatcaatactctcaaagcaaatcggcaaaagcttgatgctagggcacacccatccatcttcattggttttaaaacgcatacaaaaggatatcttgtatatgacttgcattctaataatgttacagtgtctcgcaatgtcacattttatgaaaatcattttccatactactctgaaacccaacatttaaactcagaaaattcagctccttctccagtttccttttccggcaagaaccttgacccacaaatagaagattgctcatcacaacccacgatatcaataccttcatccaacgaacctttaaatgagcaatctcctccacatcttaggcgttccacaagaaccaaacaagccccaacatatctccaagattatcacagagaccatgcttcatctacaccaaacactttggcggttgttcgttacccactaagttctgtactctcatactcacatttgtcacctacacacaggaactttgtcatgagcatctcctcaacagcagaaccctcctcatatgccgaagcttcccgccatgactgctggattaaggcgatgaaggtcgagttacaggctctccagtcgaataacacaaagagactcacatctcttccccctcacaagacaactattggatgtaggtggatatataaaatcaagtatcgggtagatggttccatagagagacacaaagcacgattagttgcaaaagggtacacccaaatggaggggttggattacctcgacacattctctccggtggcaaagcttactacggttcatcttctccttgcgctagccgcactcaaccaatggcatctacggtag

SEQ ID NO: 109783 - DNA, 402 bp, Glycine max
  Peptide Sequence Number=SeqID_226561
atggtgggactagctctcaaatcagccatatcaactagtgatgatagtgaaggagaagatgcagaaggatcaaaagctgaaaatctaactttgctcaaaaaacaaaatgaagaaaaacctggctacatagcatggaaagaaaatgcttcaagctcttcaagtggaagtaatgatgaagaggaagaaaatctctaccttatggccaatgaagaagttgatagcaatgtaggtgcatccgattttgatcaacttcttgatgcttttaatgaaatgcatgaggaagtacaaaaattatctcttgctaataatttccttaaaggaaagctaaggtggcatgtggataaaataactagtattaaaaaaaagttacttgatttgaaaaaagaaaatggaagctcttga

SEQ ID NO: 109784 - DNA, 411 bp, Glycine max
  Peptide Sequence Number=SeqID_226562
atggagggtggttatgacacccatttttgcaaggctttgatgttgtataaacaaatgtttttcaaggacattgtgcccaattgcctcactttccccttccttttaaagggttgcactaggcggcttgatggtgctactggccatgaatctaatgggatattgccggctcacatgatcttccaaaatccttctgctgatgctgcgtatctgaggaaaagcatccataacagaattagttatattcctaggattataccaattctagaaggaaattattcctttctaaggatctataaatactatgatatttatattggcaattctttgatcagcttgtacatggcttgtgggtggtttcgtaatgccaggaaggtgtttgatgaaatgctggttacagatgttgtcacttga

SEQ ID NO: 109785 - DNA, 228 bp, Glycine max
  Peptide Sequence Number=SeqID_226563
atggagcttttggtacaccaagattacttcaaatggagttatcccggtgctcgaatgcaaggaggtgttgtaggaccattcagcaagaggaaggtatttggaccattcagtaggcctgtcgtggatgaatgcgcgaagatacttctcaaggaccttgttgatcacctctgtttgtccatcttattatggatgatacgttgtgttgaggcacaaggtggtgttgcttaa

SEQ ID NO: 109786 - DNA, 342 bp, Glycine max
  Peptide Sequence Number=SeqID_226564
atggcgagtcccacagattgggtgtcgccagtgagaatggcgattctcactcctacgtggcctatgtcgccactaccaggggcgatacacccctctctcctgctttgccgccactggcaatggcgggttgagccttgccgccagtggcaatggcgttttcctcctaaaaaccgaccccctccgtcattacttttaaaacaaaccctcagacggactatacatgattgctgtgtcatagagaatctatgccttatatacattatcattggcctcaattccaaagtgatttgggattttatgactacgggaacaagccacgtagtcaaggctaagagacaataa

SEQ ID NO: 109787 - DNA, 1281 bp, Glycine max
  Peptide Sequence Number=SeqID_226565
atggccctccgtcgggagaaaggtttgtgctacaattgcaacgacaagtggagcacatcccacaagtgtcgtggtcggattctgctcctcatagaagaaaccgacgaagccccaccagaacctaacctaaccacataccatatttcttaccctcccaacatagaaccccctgacccaccacttgatgaccccacccctcacattagtttcaacgccctctccggtttgacagccccagcgacattctgtctatatggcttcatccaccataactgcgtcactgtcctcatcgacaacggaagcactcatagcttcatacagcctcgagtggcgcgatttatctccctcactccaatggacacccctctgctgcacgtaatggttggcaatgacaccattttggaatgccgacaacaatgtgctgccacaccactgctactccagggtcacgagttccgggttacctttcacctgctacctataagcggagctgatatagtcttgggcatagactggcttaaacaatttgggccgatccttactgatcacaccaccttatctatgaagttcacccacaatggcacaccagttgaattaagcgctgatgtaccccttgggccttcttcttcctcagccaagcaaatcctcggcatgatccacactggctccacttcttcgttcttccacctttccctccaccacccttccccacctcttgaagccataaccacccataccattttcgaaatttcccacatcctatcccaatacagtgtcatcttcctaaacacctcatccctccccccctcctgtgacattgcccaccacatcatcctccaaccttccacaggtctggtcaacgtgcgcccataccactaccctttcttccaaaaagctgagattgaaaaacaggtttcagaacttcttctcgatggcttgatacgggtaagtcacagccctttctcctcaccagttcttctggttaagaaaaaggatggaagctggcgcatgtgcgtggattattgggccttgaatgcagtcaccgtccgtgactggtttccattgccgacaattgaagaattattagatgacctcggcaaagcttcctggttatgtaaattggaccttaaacaaggcttccaccaaattctaatggcagaggaagacatcccgaaaatagctttcagaacccatcgtgaccactgtgagtataaggtcatgcctttcgggttgtgcaattcacccttcacattccaggctattatgaactccgtattatag

SEQ ID NO: 109788 - DNA, 322 bp, Glycine max
  Peptide Sequence Number=SeqID_226566
ttgaagaggcgtgtggcaaagcttcaagagggtgatgctgaggcaattccttctgtgtttgaggctatattgcagaggtatttagcagggaagcctatagaagctgaccaggagttgatgaggggaattctagggaagtggacattgtccgaagatgaagaggatgagtccgattctcattgggaagaaatagatgacactgataatgaagatggatggctgtcaagatttcaaatcaaccttggattggttgtgttgtataacagataccagataacaggaggtggctcggggcctctggctactgctgttaaactatatg

SEQ ID NO: 109789 - DNA, 345 bp, Glycine max
  Peptide Sequence Number=SeqID_226567
atggataatgaggctgcattaaaaatagagaggtcaaagaaaaaatctagctctttaccctcgatgtctaaccaagagacaaccaatgttgatccaaaaaagagaaagacccttgaagctctcaacaatgggggtttagcttctcattgccatgagaggctttacactttaggggctgatgtggataaaagaagggaagggatgaataaaggaagagaaggggataatggacatagaaagaggtatggcggtgatcgcgcgcttaacacgggactcgcgttaagcgcgcctttgggctacttcgtgggtcttctttgcgctaagtgtgagctagtcgctaagtga

SEQ ID NO: 109790 - DNA, 3121 bp, Glycine max
  Peptide Sequence Number=SeqID_226568
tttgagaggagtgtccaaatcaaccgcaccaccaatcgaaggtggatctcagtttgatgctgcttgggtttttgtaacgtgcataaagaaggaaggagatttagtacgaaattatgttagaagggagggacacgtggctcacagtccgcaaagtgagggaggcagcttgcttcttctccctgttattcctttctctcaccttacccctttctctcaggtgattctgttgccgaatgcttctcaacctcctggaagttcttcgaacaatggctccccgatggtgcaaccgattaatgcttctttgcctgtaaaagagatctcacttggatttcctcacttcgatggaacgacgtcgaaattagctctagtgtctacttggtctgagttgactcgtgctctagagtctcaattcggtccttcaccttttgattgtccaatggctgagctcttcaagcttcaacaaacaggttcagtatcagattattacctcaagtttatgtctctagctaatagatctttgggattaagtaatgaggctctccttaattgtttcaatagtggtttaaatcctgatattagaagagatgttgttgctatgtgcccttctaccttattatgtgcagttgctttagctaaactttttgaagaaaaatatggtcctggtactcaagaagatgaaatagtagaatctgaagatcatcatttgtctttaaatgctttgaaaggtggtaggggagttggtactatcagagtggccaagtttttgaaattacctgtggaaccagctactcaatttagagtaatggttggtaatggtaattatatgtctgttgaaggattggttaagcaattgaaggtacaggctcaagggaatacctttcagttaccaatatttttgcttcctacttctggtactgatctcattttaggagctagttggttgaagactattggttctcacattgctgattatgatgctctacaattgaagtttttgtggaaggatgttgttcctaagtctatgcttgacttaccagttatgatggagcctgaattagccttattattgcacacttacattgtgctttttgatactcctagcagcttacctccacagagatcccatgatcactctattcctttattgagtggttcacaacctattaaggttaagctttatagataccctcatagtcaaaaggaagaaattgagatattggtgccaggaatgttagatgaaggcatcatacagcctagtaagagtctcttttcttctcccattatattggtaaaaaagaaagatggttcatggagggtgtgtattgattatagggctcttaatgcaattactatcaaggacaacttccctattcctactgtggatgagttgattgatgagctttttggagcttccttcttttctaaattggatctaaggtctggttatcaccaaattttgttaaatgcagatgacagacataagacaatatttaggactcatcatggccactatgagtggttggtcatgccatttggcctaaccaatgctcctgctacttttcagagccttatgaatgacatttttggtggaatactaagaaaatttgtactggttttctttgatgatattctggtgtatagtgctaattggaaagatcatttataccatttggaagtggttttaagtatcttgaaacaacatcaattgtttgcaaggttttctaagtgttgttttagagttcaacagattgattacttgagacatacactgtctggttcaggagtagctatggagggaactaaattggaagctattcaaaagtggcttgagcctagttactataggaggtttgttaagtcttatgctagcattgcaacccctttaactgatttgttgaaaaaggattcttttaaaaggagtgtggctgcatcagaagcatttcaacaattcaaaattgccatgacatttgctccggtattggctattcctaatttcaaggaaatttttgtattggagactgattcctcgggaagtggagttggtgctgtccttagccaaaataagcatccaattgcttatttctctaagaaattgttgttaaggatgcagaagcagtctgcttatattcaagaattctatgctattactcaagctttggcaaagtttagacattatcttgtgggtcataagttcataattaaaacaaatcagaaaagccttaaagaattgttagaacagaagttgcaaactcttgagcaacaacaatggcttcctaagttcttggggtttgactttacaattcagtataaaccagggaaagaaaatatacctgctgatgctttatctaggagtttcatgatggctgtatctactcctatacattcgtggattaataaagtgatggatttgactcaaactaattctcaattatccaaaatttatgaaagatgtttgcaagtagttgatagattgtccaaatttgggtactttatccctttgaagtctaagtttaacaacaaggttgtggctgaagttttcattaccaacattgtcaaaattcatggtttttcaaaaaccattgtttctgacagagatagaatttttatcagcactttttggcaacaattattcaaagctcaaggcacaacattagccatgagctctttatatcaccctcagtccgatggccagactgagaatcttaacaagaccgttgagatgtatctaaggtgctttgtatttgaacatcctaagagttgggctactatgctaacttgggctcaattttggtataatactttcttccaccaaagcttgggtatgacaccatttcaagcagtttttggtagacctccactagcggtgatgcactacgaggttgatcctaaagatcctaatccactcaaggatttattacaactacgtgatcaacttttgagcaagcttaaagttaagctacaaccctataggcaacattcagtggctttgaggaagcatcagaagctaggcatgcgctattttggtccatttccggtgattgaaagaattggtattgttgcatataaagtacagcttcctgagtctgctaaatacatcctgtatttcatattgctcttctga

SEQ ID NO: 109791 - DNA, 999 bp, Glycine max
  Peptide Sequence Number=SeqID_226569
atggcagagcaatcaggaagaaaagtggtggtgttgtccaaagcaacaacagaacaatactctaacatcaagaattgtatgccaaccacattctcctcaacaattcccatagtggacctctccaaacccgatgcaaagaccctcatagtgaaggcttgcgaggagtttggattcttcaaagtcatcaaccatggtgtccccatggaagttatatctgaattggaatctgaagccttcaagttcttttctttgccactcaatgagaaggaaatagttgggcctcctaatccatttgggtatggtaacaagaaaattggacgcaatggggacattggttgtgttgagtaccttctactcagcaccagtcaagaacacaacctctctctttatggcaaaaaccctgagaaattcaggtgtttgttgaacaattacatgtcttctataaggaaaatggcatgtgagattcttgagttgatggcagaagggttgaagattcagcaaaaagatgtgtttagtaagcttttaatagataaacagagtgactctgtttttagggtgaatcattaccctgctaactctaaaattcctgtgaatgatcaaagcttgattgggtttggagaacacaccgacccacaaatcatttctctacttaggtcaaacaatacttcaggccttcagatttgtcttaaagatggagattggatttcagtcccacatgatcagaaatctttcttcatcaatgttggtgattctctccaggttatgaccaatggacgattccatagtgtgaaacatagggttttgactaatgaattcaagtccaggctctctatgatttactttggaggtccacctcttgatgagaaaataacaccattaccgtctatcatgaaagggaaagaaagtctatacaaagaatttacgtggtccgagtacaagaattttacttatggtacaaaattggctgataatagacttggacattttgagagaaattag

SEQ ID NO: 109792 - DNA, 357 bp, Glycine max
  Peptide Sequence Number=SeqID_226570
atgggagatcctaggtacaaggtggaagtactcacagaaggtggtcctggagaatggttcggacacacaccggattattgcagtacctatcgtggcacggtaactattttcttgattgacactatccaagaagctgatgattattgtccacctctctcatttatattacttttggagcttacaatgccggttcccatagatggaataatcatacctcgtgagagtacacactatttttgcacatttctgatgaagattccaaccccgattccccttcggcttcctctggatctaactgcactccgagtacgtagttcatctcgcagtgcttgctgtggatggttagatcatgagtag

SEQ ID NO: 109793 - DNA, 123 bp, Glycine max
  Peptide Sequence Number=SeqID_226571
atggcgcgtgatgcatcatcttcagcatcagaaacacgagcaaagctctctaaatgggagaaaccgatgcaagaagttcttagaagaggaaacggcatgaggcagccccacaaacggaaatag

SEQ ID NO: 109794 - DNA, 820 bp, Glycine max
  Peptide Sequence Number=SeqID_226572
tggctctgatcccatccctgaaaggggagttccagtggatgttcgaattccgcctcaaggccttcgacaaattccagtccatgaaggaacccacgtgaacatctgctactactctaagtcgaagaataagcccttactccaatccctcgacgacgccaacctaaagcttccccgctacttcgacaagcttagcatccctctcaatgagcaaaagagcctcgccaatgtcatcatcgatgtagtcctcaacagtgtcttcatcgccacaacgcactgcaaaaccctagaaaaagttgacatcattttctgctccatcttcgaggccattaagaatttgttgaaggagcaaaatgaggaaagtggacttgtcaaaagaagcattgcttcaaggactttgtttctattatgttttggactcaaacatagagtgtttgaggtctccttggttgatcttcaaggagatgaggatcatgcattcaagaagattaggttgagagctgaagatgtgcaagggaaaaatgttctgacaaatttatggacaactgataactacacattgaggatgttttgcattggagttaccaagagaataactaaccaagtgaagagaacctactatgcacaatcaagccagattagacagatttataggaagatgagggagatcatgaccaaccagacaacatcctatgatttgaaggagttggtccgcaagtttattcttcagatcattagaaaagagattgagaaggcaacatctagtatttaccctcagcagaatgtgtttgattgtaaagtcaagatcctgaaacactgctaa

SEQ ID NO: 109795 - DNA, 312 bp, Glycine max
  Peptide Sequence Number=SeqID_226573
atggctcaggagggatgggctcgtcctcctctggcacaggctcttgggctttgcaaaatagcaaataaagtttcagagctgaatgaggaaggtcttgtagaaactggagtaggaactggcaaaggagtggatgctgaagctggagctagcaaagatgaagctggaatagatggagcagcagtagaagtagaaggagctggggtaaggagagcagaagatggtggagcctcagacctttttcccttggtctttcggggtccccgaaaagtgaacaagaggtcatcaaggttccaacagtttttcttcacataa

SEQ ID NO: 109796 - DNA, 159 bp, Glycine max
  Peptide Sequence Number=SeqID_226574
atggggcactgcacccccaaatgcgcaaccataacccctgctaggtttcctcaacctccatttttccgaggatacgactcgaacgcaacatgtgcatatcatggaggagttccgggacattccattgagcattgtatgacctcgaagcgtaaggtgtga

SEQ ID NO: 109797 - DNA, 156 bp, Glycine max
  Peptide Sequence Number=SeqID_226575
gggaatccaatagataccctgccatctgcaccagcattggagcaagagcagcctattgttcaggatccaccagctgctccagtgttggatcttaatgagcatgcagaggatcacccacaggaggattggcaggatctttatctttttgcattttga

SEQ ID NO: 109798 - DNA, 318 bp, Glycine max
  Peptide Sequence Number=SeqID_226576
atggctactcagccaggcgagctgagacttagccatgaagcaactggctcgcccaagagagttggttacttaacatggaagtcttttggtggcctaggcgagccagaggctagtctgggcgagctaggggccaggaaacttaatgaaaagacccttttgcccctctttttggtatctttcccattcttgatcaaaatgttgaatgatccttcattttgtgcggtaactggtgtcaaaccacgcagtttggctaacgagaataaaaaactagggggttgttgtagccttgtagataattcccgtgcggcttgtagataa

SEQ ID NO: 109799 - DNA, 400 bp, Glycine max
  Peptide Sequence Number=SeqID_226577
atggagacaacaacggggtcatcttggttgatggggttgattcccttaaagtccttgtctataaaggtgataagagggagacttcgctataagggtgcatcgacaaaaattaatgttgatatcatgtatttggttgtgtctgaccccgacctgggaggcttcactggggtagctgaatggcccttggctcgttcgcacaattcattcatgttaccaggtggttttttgcacagactgtctacgaacttgtcagggcgtaaggcgaggagcatggaatgcaatattggccaaggtggtcggggtcatgcgatgagacctgctagtggtgtactacatattgaatcgttcgatgatggtttcgaagctatctatggacctaggtggaagtccaccgtaccag

SEQ ID NO: 109800 - DNA, 339 bp, Glycine max
  Peptide Sequence Number=SeqID_226578
atgaaaagtgagaaaaggggacttacagagaggaagaaggaagaggtggggcatggtgcagaaaagggaaagcagcattcaagtagagaacaaaaaggacacgacagtgagcgtgatagcgaacacaaccagagcgcgacgatggacacggggtcagagatgatggcaatgacgacacttgcactggagacggggtcagagtcgtgcgagtgtgggtttgcgagactgagcgtggacagaaaagggtcttggatgaatagcagtggaatggagaaggaagagagagaggagacgcctcttcaaggagaagatgagtctagaagaagctcaccaccatag

SEQ ID NO: 109801 - DNA, 432 bp, Glycine max
  Peptide Sequence Number=SeqID_226579
atgggtgttaaacattttgtgttggtcaaacgatggtcgcatgctgataaacaatggtctccagacgaaattaggaacttctctctaggttcctcactgaaccaatctcggacttatcaaggtaatccttgtggcgtctaccctgacttatcttccatctctggaagtggcgtcatccaaaactctgtaacatgtatcaagcgatccgctcctagtaaggatcacatcatcgagagccactcaatgttcctttctatgaaggaggggaggttggtgctaaggcctcaatggatgctgctgttgctcacttccaagcaagaactttgggaattttcgagttttgggtcgacgagttttcctggaccgagtctaggaaggcttaagaagacctcaccaaggctgagaaaaatttggttgaagttaccaaagtaa

SEQ ID NO: 109802 - DNA, 327 bp, Glycine max
  Peptide Sequence Number=SeqID_226580
atggatgttggagagaaaaggaggaagatgaaagatgaggtaaatgaattaggctgtgctgctggtgccgctgcattctgcatgcatatgtgtccttttaactttgtaacactcactttcacacacaaccttcagccaaggctcggagctggtagaggcatcagcgaaggaggagatgctggtgcaagagtgccacacacccacgtcatcatcaaaagtggctcaaacgttgttggtttgtccaccacctccgaagaaaccacgagtgtccagaaggacttctcattctcattctcaagctggcttctttcaagtgccccacgatga

SEQ ID NO: 109803 - DNA, 159 bp, Glycine max
  Peptide Sequence Number=SeqID_226581
atgagaacgagagtgacagagcgagaacacggtggtggcacggtgggcacgtcgccccgtgagaagttgagtcaaagtgagagagcgagagtgagagtcagagagggagaatgggagttacaacactgtgagaaggaagaggaaaagattcagttttga

SEQ ID NO: 109804 - DNA, 1161 bp, Glycine max
  Peptide Sequence Number=SeqID_226582
atgactgaacactctgctcctcagcagcaaaaccaggcaaaacttgtgcattatgttgctactttgcgtgaacaattggaacaattggctgaagaaaggacaccggaaggcttaccaaggatttcaaaggctgtgttgaatgattattcagagaagattgaagccattgcttccaaattggttaatcgtgtgagtgacccaccagtaaccaagaaggactttgaaaggaattctgtcaaagaaaactcttctgaaactgaggaaacaaagcagatactcctttcttctggattgagaagaaggcctgtgctgttttactgttgttcatctgattcattggacagacctgcctcaagtacggaagatagagcgcatgagcctgctgagactggcctcacatcacctgttaaactggatgctacagcacatgcacacattgaaaagcataggtacggtttacttgagttgttatttaaagttcatgtaatggtgggtcaatggactaagtaccgctttggtgaagagtccatgacctacaggctacaaacatgttcctatgtcaatttgtctagaacagcaaaaaagcttcaagatgatttgactgatgagatggtggtgttggcaaaacaactgaaagagagtagtctcatgatgagccagtccctgcaaaatactgaaaaggtctcgaatctcatattttcattcaatcctgcttgtctaactgctaaacggttgtatgagatgatgatgcaaaatatacttgattctaccgagaaggctattgagcatagcttggcaagcaccggtcgtgccaatgtgcgagcaacggcaatctactcagagagttccaagacttcttgcttaacatggcttgtgatgtttgtgatgacatgcgtatttgtcatgagagtgatggaacgaagtactctggttgaacaccactcccccatcccatgcctcggcatccccgcttacgagtccacgatgtcagaaacgtggtgcgagattgcactggtggcggcgacactggtgcaacatcggcgctggtgtgacatccactttgggattccgcagatggcgaagaccccctcgtcacttctcactatgcggtttcctatttcagaggccttcaaggggcgtccttcatcggaggcaaattga

SEQ ID NO: 109805 - DNA, 1788 bp, Glycine max
  Peptide Sequence Number=SeqID_226583
atggtgaagaagtcaaaaccaaaaaggagcgaacgtctgtgtacgtgggcgagaagaatggagaagaagaagaagaaagacagagttaagagaaaaaggaagcagaaaccctcggcgcgtgagcttcaccgtctccgttcctcagacgccaatgccatcttcgctttgttactcgcatctctctccaacacaccccactctgttatcttcatcaacaaatgcctattcaaacttcgccgctcccttcttctctcgccaacctcgctgacgcccattctggcgttgctcccaaccctactccgctccaagggctccgatatcgcgtgccccgccgcagacatcatcggcgccgcctcgcttgtttccttcgacgccaacgaggagatcgcttccgattctgaaaccgtcgagggactaatctcgctgttgcagagtcgcaatagaaaagttctgctatctgcctgcaatgccgttttggacttttccaccaccaccttcgcccaacgacaattgctcaagttttctgcgttgaacaaactaatgtttgtgtttcttcagattttcaagagtttagaatatgtctgtttatggtctgagggtgatgaaagtcttccctctcttaagattgggattaaggaagatgaactgtcattggcttttctcactgcagttgttgttcttatcaatgcctgtgaagttgagcagctacagagtatcccacaaagtctttctgaagcatttctgagaattttgaaagagattagggtgagagtgagtggtcaagaggtgatcagaggtgctaggaaatgtaacaaggaagggcgtctttataaaagcaacattgctgttagtaatcttgcagaatgcgtctttaggctttccattaatgcttctcaacctactggctctttgtcatttgaagttgttcaaagaggtctttttggtgcgagtgatactagttttgaagattttatatcaaattactgggaggtttctccttttctgctatcgaagaccaagagggatccagatatgcatgatatgtttggtgcatttgttcactctttgaactggaataggagcgttccttcccttctctcctcgattcttcaacgtctagtggcttgtttccctattgcttcagatgaacaaaacatactcaattttctgaatgaggtgaaagatagactgggttgtcctataatctaccagcaggatatacgtgttgtaaaaacagagagccaattgagaaaagagatgcattactttcagagctttcattcaggctgcattaaggaacctctatattttacttttgatgacgtcttaaaatgtgggcaagcatataaagagggttacactgttgccctgcgtggtctggagtttcgctatcagagcattgcagctattgcagatacattagcacttatgtttggccaaccctcagtgggtgccaatttgtacttaacaccccctaattcccagggcttggcctgtcactttgatgatcactgtgtatttgtatgccagattttcggttcaaagcagtggactatattttctccacccagtcagctgttacctcgcttatatgatagtttacttggttctgatattgactgtacaaaagccggtagaagagagttctttctcagggaaggtgatgtattatatattcccagaggttttcctcatgaagcttatacaagctctgctgttagtgatgattctcctgggttctcattgcaccttacccttagtattgaggttgaacctcctttcgagtaa

SEQ ID NO: 109806 - DNA, 1320 bp, Glycine max
  Peptide Sequence Number=SeqID_226584
atggggaattgttggagtcttcaatcaggttctccaggcgatcatcccaactccaatactgcccccaacctcaacaatcaatcagggaatattcaattttctgctggtctaagcaacacaagattaacacagaatggcaattctacttctcttgggcgtagcagccactctggaggaatcagcagcaggttctttgggccaagtagtagtaataactactcaactggaaataacactagcacatccctttggggaggctctgagactagccaagcctctcgagttagagatgaagaggagtttcctcaagggcagatcttggataatgttgacttgagagcatttactttggcagaattgaaggcagccaccaaaaatttcagagctgagactgtgataggagagggggggtttggtaaagtatacaagggcttgattgatgatagagcagcaaaaaaaagaggtgaggggttgactgttgccatcaagaaattgaattctgaaagcacccaaggaattgaggaatggcagtcagaggtgaatttcttagggaggctttctcaccccaaccttgttaagttgttgggatttgggctagaggatactgaactgttcctggtgtatgaatttatgcatcgtggcagcttggataaccacctatatggaagaggtgcaaatgttcggtcactttcttgggatacaaggctaaagactatgattggaacagctaggggactgaatttccttcactccttggagaagaaaattatatatagagatgtcaaaccctcaaatatactacttgacaagcattatacagtcaagttatcagactttggcttagctaaatctgtgaattcgcctgatcatagtcacatatcaacacgggttgtggggacacatggctacgctgctcctgagtacgttgcaacaggtcgtttgtacgtgaaaagtgatgtgtatggatttggaattgttttggtggaggtgctgacgggcaagaggataagggatatattggaccagtgtcagaaaatgtccttgagagattggctcaaaacaaatctattaagtagagcaaaaataagaagcaccatggatgcaaagttagaaggaaggtatccaaacaatttagctttacaattagctgaactagctctcaaatgcatccaaacagatcccaaagtcaggccatcaatgaatgaagttgttgaaacattggaacagattgaagcagccaatgagaaaccagctgataacagaagacgggttactcgtacccgggtagttcaacaacatggagggcctgatggtggttaa

SEQ ID NO: 109807 - DNA, 318 bp, Glycine max
  Peptide Sequence Number=SeqID_226585
atgtataagcttgtagtgtacatgtctccttctaataaggaggatatgcctgtactttacaagtttcctagggctcttcattccaagacccttgtagacattcctttctctgagactctaagagtggattcgggtcatgagcatcctttattccaagacccttgtagacatgcctttctcactctgcttttctttcctttttcatgtaatatggctaaatgttacaaggaagaagcaaagagtggctactccatcatcgattatcgctccctctcccatcgagagccactcaatgttcctttctatgaaggagggtga

SEQ ID NO: 109808 - DNA, 201 bp, Glycine max
  Peptide Sequence Number=SeqID_226586
atgggtggtttagcctctcattgtcatgagagacttcctaatacaaaaagaaagcaagaggtgtggaagaaaatggaggaaggggtccccaactacgcgctaagccgccagatgctggctaagccccagatgcgcgctaagccgccaaatgggcgctatgcctactctccaagttggctcctcgcgctaagccgttgttga

SEQ ID NO: 109809 - DNA, 1227 bp, Glycine max
  Peptide Sequence Number=SeqID_226587
atgatgaagtcttgtgacccactgattgcagagaaacctcctattccttcacaccatgaccctggagtgtttttcttccttggagggattgtagtgctcgtcatattgctgattcttgtgtttatattttggaggcgtattaaacggccagcaaaggtgatggagaacacagttctaacaagtcagcagcatggaccaatggagttcattagtgggaaccttcggacaattagctactttgacttccggacattgaggagagccactaagaatttccatcctcgaaatcttcttggaagtggtggatttgggcctgtctatcagggaaagttggcagatggaaggcttattgccgtcaagacattgtctcttgacaagtctcaacaaggtgaaaaagaatttctggcagaagtgagaatgatcacaagcattcaacacaaaaatctggttcgccttattggatgttgcacagatggccctcaaaggatacttgtgtacgaatacatgaagaacagaagtttagacctcataatatatggaaagagtgatcaatttctgaattggagcactagattccaaattattcttggtgtagcacggggattacaatacctccacgaggattcacatttaagaattgttcaccgagacatcaaagcaagcaacattcttcttgatgagaagtttcagcctaggattggagactttgggctagctaggttcttccctgaagaccaagcttaccttagcactcagttcgcaggaacattaggttatacagctcctgagtatgccattagaggagaattgtctgaaaaggcagacatatatagttttggagttcttgtgcttgaaatcatcagttgtaggaaaaacacagatcttactttagcatcagaaaaacagtacctccctgaatatgcatggaaactttatgagaagtcaatgttgatggaaattgtagatccaaagctgcaagagcaaggcatagaagaaaaggatgtcatgcaagcattccacgtggccttgttatgccttcagccacacgcggatttgaggcctgccatgtcagagatcgtagcaatgttgacattcaaagttgaaatggttacagcaccaatgaggccaatcttcgttgatcgaaggcgcgtaatggatgatgaacatcactcatgggaaaccatatacgaggctttcaccactgcagtggcatcccggcccacgtaa

SEQ ID NO: 109810 - DNA, 1113 bp, Glycine max
  Peptide Sequence Number=SeqID_226588
atggtttctcagaagaagcctttcactgtagccacgctcttcttcctggcattgttccttatctccatcttcttcttcttcttcttctccaccagaacaactcttcaccccactccctccatccactcagatctctacctcctcctccaacctctttctccgcctccgcccccacagccacagcaaccagactcctcctcctccttcaccaccactgaaacccaacctgagcctgtcggtgacattgacgatgccacggacaatgtcaccgatgccgaatctgatgcccaaccggcaacagaaaatgcggcagaagatgtagcgttgaatttgaaggaatgcgatttgttcacgggaacctgggtgaaggatgaaaattacccgatttaccaaccgggttcttgcccttatgtggacgaggcttacgattgcaaagttaacggaagaaccgacaccctctacaccaattggcgctggaaacctgatgcctgtgatcttcccagggaaggagttcgtctaagtggacaagggagctcaaatcctacattgtcaatagatcggattgacaagacatcgggtcgttggaagaaggctgacattcttgtcttcaatactggacactggtggactcatggaaaaactgctcgagggataaactactataaagaaggtgattatctgtatccaaaatttgatgcagttgaggcatacagaaaggctataaagacctggggaaaatggatcgatgataatatcaatccacgaaaacagattgtttactatcgtggatattctaatgcccatttcagaggtggggactgggactcaggtgggtcatgcaacggtgaaactgaaccagcttttaatggctctatcctgaataactatcctttgaaaatgaagatagtagaggaagttatccggggaatgaaggttcccgtaaagttattgaatgtcacaaagctgaccaatttccgcaaggatgggcacccatctgtctttggcaagaatactatgggtggaaagaaagtctctacaaggaagcaggattgcagccattggtgtcttcctggggtccctgatgcatggaatgagctaatttatgccactctt

SEQ ID NO: 109811 - DNA, 177 bp, Glycine max
  Peptide Sequence Number=SeqID_226589
atgagacctgggagtattcttcgaggcatcttggggacagaagcatgcattctggttgaacggtgttggtcaatattgtcatgggcaaatatgaaagggttaagttcaacaactggcaacagcaaccattctccgatgaaagttggagaaacattctattctagaggtgtcccgtag

SEQ ID NO: 109812 - DNA, 216 bp, Glycine max
  Peptide Sequence Number=SeqID_226590
atgatcactgatggccaccacaagccaccgttgcttgccattgaaccaccacaccaagaggaacattttaatcagagcggaatcctcataatccacctcaaggatttggtggagaacaacccctcaaatcctttctttcatagcttctatgagaaccttgtgtttggattgacaaacgtgaatgagaggtctttgagcgacgcaaagaggaattga

SEQ ID NO: 109813 - DNA, 339 bp, Glycine max
  Peptide Sequence Number=SeqID_226591
atgcagctatcttctcttggggatactcatgatgaaatagattttgaatttctggggaacagcagttctatctggtggtttgaccccaccaagaacttccacacatattccattctttggaatcctcagagcatcatattctctgtggatgggacacccataagggagttcaaggatcttgaatcaaaaggggtttcttttcccaaaaaccaagccatgaggatattttcaaggcaagctaggattcagtgggtgcaaaagaactacatgatttacaactactgcactgatactaagcggttcccacaggggcttcatcctgagtgcacaatcgcataa

SEQ ID NO: 109814 - DNA, 312 bp, Glycine max
  Peptide Sequence Number=SeqID_226592
atgaaaactggtttaaacaccgagcacgtggcacaagcagaggagtgggaattggacataaaagagacatgtgtcaattttttaagaaggatcacaccaagggggtttgttttttacgtgggtgccgccattgacactggcgggaaggcgggacaaacacggctgagtaggagtgaaaaatgggtaccgccatttctcctggcgggacatgcctacgtgggcagtcccgcctttggagctggcgggatagggggagagaggagagagggatgggatgccgcaactgccagttgcgggacagtagggccataa

SEQ ID NO: 109815 - DNA, 144 bp, Glycine max
  Peptide Sequence Number=SeqID_226593
gttgaggatcttgcccgtttgcaatttcagacaactcctgtctatattgatgtagatgatgggagaaccaaggtttgtgctttcgcccctgctgtgctggattcaattgtcacatttggattcgattgtttcaacccctttcag

SEQ ID NO: 109816 - DNA, 273 bp, Glycine max
  Peptide Sequence Number=SeqID_226594
atggctattgctgcagttattggactcagtggaggaaagagactcttaagttcatcataccattactttgatattatagaaaagctttcttatggcagtgattttggatccacacactaccaaattggatttaagtattatgactttttcatcgatatcagaagagagcttggaatggaaataattgaggaacatacggtgatggaatattctaaggtcagcaagaaatgtgaaaaatgtggccatagggaagctacctattatactagatag

SEQ ID NO: 109817 - DNA, 1221 bp, Glycine max
  Peptide Sequence Number=SeqID_226595
atggcagccacaagcacggataagttggaggcaggaacggtttcaagttatgacaggaaaagtgaaatcaaggcatttgatgattcaaagactggtgtccaaggactggtagaaaatggtgtaacaaaagttccacttatgttctattgtgaaaactctaatctcaatgatggcgtaaccagtgcatcaaattcaaagatcagcatccccataattgacctcacaggcatccatgatgatcctattttgagagatcatgttgtgggaaaagttagatatgcatgtgagaagtggggcttctttcaggttataaatcatggaattccaactcatgttttggatgagatgatcaaaggaacttgcaggtttcaccaccaagatgcaaaggcgaggaaagagtactacactcgcaaagtaagccgaaaagttgcttatctttcctattatactctttttgaagacccttctgctgattggagggatacacttgcattttccttggcacctcatccacccgaagctgaagaatttcctgcagtttgtagtgaaattgatattggtgttcctgatgaagttggaagacttgaagtccttcgcgtacataccaaaaacatgaagctttcagatgctgttgatctagagagaattgcaaaagatactcatggatatgttgatgctgaccttactgccctttgcactgaagctgctcttcaatgcatcagggagaagatggatgtcattgatttggaagatgagagtattgatgctgaagtactgaattctatggcagtttcaaatgagcatttccatactgctctgggaacaagcaatccatttgctttacgagaaactctgtgggaggatattggaggccttgaaaatgtcaagcgtgagctgcaagagactgttcaatatcctgtggagcacctagaaaaatttgagaagtttggtatgtcaccattaaaaggggttctcttctatggtcctccaggatgtggaaaaactttgttggccaaagcaattgctaatgaatgtcaagctaatttcatcagtgtgaggggcccagaattgctcactatgtggtttggtgaaagtgaagccaatgttcgagaaatttttgacaaggccagacaatcagctccatgtgtcctctttgatgagcttgattccattgctactcaggtctatttttgtacttcgcatccatgcaggccaggttga

SEQ ID NO: 109818 - DNA, 348 bp, Glycine max
  Peptide Sequence Number=SeqID_226596
tgtatggttctgggttcgtattatcttggtttatgccggttcggcttccgtggtctgtgtgatgattggggtacgaatcgtgtgatttgtggttatggaatacgaatctgtggtgttgaatgtgtttcggatttcgtttctgttggttttttttttgtggttgatttgtacggatttgtgaaaacggtggtgggtggtggcctgagggaggctgtgttggtggttttcggtggcttgagggaggctgtgttggtggtttgcggtggcttgagggaggctgtgttggtggtttgcggtggcttgagctgttccggcactctgactgtttgtattcacctctctctctga

SEQ ID NO: 109819 - DNA, 174 bp, Glycine max
  Peptide Sequence Number=SeqID_226597
atggttcattgctttgcattgtgttggagttatttcagtgataccccacatctggtgattaacagggaagtcgatatgttctttgacaaaggtgaagcactggtgccatggaaaacaggaggaacactagggagtttggataattggaggtgcggtactcaagcttttgggtga

SEQ ID NO: 109820 - DNA, 498 bp, Glycine max
  Peptide Sequence Number=SeqID_226598
atgaccggaaggcttcttgccggttcattggcttttgagagccgcatccttcattaccttattgttcgtatcttacttccaagatcttcaaaccttgcacaggtttcggaagaagatcttattgttatgtggaattttcataaaggcgcttcagtcattgcatcctttggttatcacaaagagcatgatggctcttgggtgaaaaagggtgctcgacatgttgatgaagaaggacatggtggagaagattcatctcttcttcaaagattttggataggttcgatggtcttcaaacctttgttggtgaaagatgatgagaaaaagcccatgagaatgatttcaagattgagtcaagaacaattcaagaatcaagagaaagattcaagagaaagtttcatcaagaagattcaagattcaagattcaagaataatcaagatcaagattcaagactcaaagattcaagaatcaagagaatacttaatcaagataagtattaa

SEQ ID NO: 109821 - DNA, 330 bp, Glycine max
  Peptide Sequence Number=SeqID_226599
atggagaggaaatccaagcgggagagaattcagaggccacaatggaaatggaaatcggaaaaatgcaaaggcatgaacactgcagagccaagcccaactcgaaaagacaaaacaataagttcagtgttggtccgcaacaaagacttattctcccttgcctatgactccctcgtcgaaacagttgatgacggtcacatcaggtcgtgtgactcctcctacgatgcgttctacttgctagaagatatcgttaagggtgtcattcagttcgatactacaaaggatgtgaggcgatgcttgatggagtcggcaatggtagcaacgacagggtga

SEQ ID NO: 109822 - DNA, 465 bp, Glycine max
  Peptide Sequence Number=SeqID_226600
atgggacctgagttctatgggactgccatggtctcatgcaagtgccaaccagctaactttgcactatggacagttgctaaacaagccttaacaggcctaactattcctcctgtaagtccttcttcctatcactccccacgccatctagaaacaccttgtcctcaagagccatttggcagtgtcgatagtggcgtagaaggtgaagaggaatgggtggtcgagctccttgtctcttaccttggcggcgaacatggaagaagaggatcagtggaggtccgagggaaggatgcgcagagcttgctgttagcggggagatggatgataaaaatggaatcagcatgggaggcgaagtcggtatgggggcggctggtgtcggtgacggtgcaagggcataagatggaaagtgtggagtgggattgtgaaggtttagtcgctaaagaaggtcatccaatttggtggtcatga

SEQ ID NO: 109823 - DNA, 1386 bp, Glycine max
  Peptide Sequence Number=SeqID_226601
atggcttgtacagcttccacacatttaaacgaaacatacacattggttgccgcaaatgatgtgttgctagattcttcacttatgaagtatagccccacggattgccagagaccagaacttttaaataagaatttaataaagggaaatattcttctctgtggatattccttcaactttgttgttggcactgcatcgatcaagaaagtctcagaaacagcaaaggcccttggtgcagttggatttgttctttgtgttgaaaacatttccctaggaacaaaatttaatccagttcctgttggccttcctgggattctcatcatagatgtcagcaattcaaagactattaatcctaatgtggtgttactatcaatgaagtcgcgtgtgacagtggaggttgaagaggtgtttgtggagaagaggaggagcatggaactgatagattattataatatcactacaccaagagactggactgggcgtgtaaagagtttcgaaggtaaaggtaaaatcggtgatggtttgatgcctattctgcataaatctgcaccacaggtagcattattctctgctcgagggccaaatataaaggacttcagcttccaagaggcagatcttctcaaaccagatatattagctcctggttcattgatttgggctgcttggtgtccaaatggaactgatgagccaaattatgttggtgaagcgtttgccatgatatctggaaccagcatggctgcaccacatatagctggaattgctgctcttataaagcagaagcatcctcattggagccctgcagccattaaatcagctttgatgactacatcaacgactctagacagagcaggggatcctcttctagcccagcaaacttctgaatcagaagctatgaggctggtcaaagctactccttttgattatgggagtggtcatgttgatccaactgctgcattggaccctgggctcatctttgatgcagggtacgaggattatataggcttcttgtgcacaacacctagcattgatgttcatgagataaggaactacactcacaccccatgtaacacctccatgggcaaaccatcaaatttaaacaccccatcaataacaatttcccatcttgtgagaactcaagttgtcacgcgcacggtcacaaatgttgccgaggaagaaacctatgtgatcacagccagaatggaaccggctgttgccattgaagtcaaccctccagcaatgactatcaaagcaggcgcatcgcgccagtttttggtgtcacttacagtgcgctcggtgacaggaaggtatagttttggagaggttttgatgaaagggagcagagggcacaaggtgaggattcctgttctggccaacggataccgacgatag

SEQ ID NO: 109824 - DNA, 963 bp, Glycine max
  Peptide Sequence Number=SeqID_226602
atgcttcaagcgttggagtcccgatttgcaccttcctactacgatgatccccacgacgcccttttcaaactccaacagcgcaaccccatcaacgattatttgatggagttcgaatgcctcgccaaccgcatcgttacccttgccccaccattcctcctcagttgcttcatctcagggcttaaccccgatttgcgtcgcgagaggataagcttaacgaccgccgtaagagttcgtggaccatgccgtcgacctttaccccttctgccagtcgaccttcctcgcaccctcctcctcgcgcttctatttggcgcttatcttcggcggaattggcgtcgccccgtgacaagggcttttgttaccattgtgaagacaaatggtcatagggccatcgttgtaagcctcgtcttcagttgtttattgtcgaagacgacaaggatttttccgacgacagtccttcttcggaaacgcctttgtcccccacaagtacttccaccacccaccatcgtgttgtggccctctgttcctcattacttacaaggatcttgcccggtggaagctgtcgatacactcctatctgatcataccaacattcgtaatactctgcatcgacgtctgctcaaggcaaaggccagtatgaagtgctctgcaaacgctcatcgtcaagatgtccaatactctgtcagcgattgggtcaacgttcgcctgaggccctaccataaaactttagtgaccaaccaatatcacaaactctccaagcgatattttggtcctttccaaatcactgaacttattgcagcagtagcttatcgcctacaaattccgaagactgccaaaatccatttggtgttccatgtcttgttgctcaagccgcatcagggtccaccacccattacttcaggtactttaccaaccatggtccacgacaacaatcccattgtccatcccttgactgtgtcgaactag

SEQ ID NO: 109825 - DNA, 360 bp, Glycine max
  Peptide Sequence Number=SeqID_226603
atgttcgttataaaggtgaagggtctaaggtgtaagggaagcggagaaaaaagagacaaactttttgccaagaacataaagaaaaaggagagaagtgagatttttcctttcacaaagaatggagaaataggcaaccaaagcaagattttagaaacacttcattgtgatgcacaggagttgagaaacctccaaatcaccatacaagatttgatgaaaaaagtagacataaatgagaagagcacaaaaggaaaaagtgttgagtttggtgaggtgaaagggcatcaatcaagattgacatgggtgcatttaataccaacttactgtattgccagtaagattgctgaatcaaccccatggtaa

SEQ ID NO: 109826 - DNA, 291 bp, Glycine max
  Peptide Sequence Number=SeqID_226604
atgaaggtgaggacgtgtagtcctttgaaggtgagggcgtgcagccctctgttggcaaggacttgtagtcctttgatggtgaaggcatgcagccctcaaaaggcgaggacgtgtagccctctgatggcgaaggcgtgtaaccctctgaaggctaggacgtgtagtcctctgaaggtgaggacatgtagtcctctgatggcaaggatgtgtagtcctcagaaggtgaggacgtgcagccctctgatggcgaggacgtgtagtcctctgaaggcgagggcgtgcagcccttaa

SEQ ID NO: 109827 - DNA, 1461 bp, Glycine max
  Peptide Sequence Number=SeqID_226605
atgcttcttaaccacattggcgccggattctactggatcgacccgccacgacccgatccgaaacgtcaaacccgaatactctcctctagtttaaaccgccggcgggcgtcgccgccgtttccggcgaggcatgcggctttccacggcgtgcgaatggagaagaaaggcgataagcggcggtcgatatgcaccgccgacgagcttcaccgcgtcgcggtttcgaactccgattggaagctcgctctgtggcgctaccgtccttctcctgaggccccgtcgaggaatcacccgcttttgttgttgtcaggggttgcaaccaatgcaataggctatgatctctctcctgagtcttcatttgctcggtacatgtcagcacaaggtttcgatacatggattcttgaggttcgaggtgctgggttgagcacacttggagatagcttggaggaagatgaggagtgcctcaagaatttttccaagattgattctgttattaatgatgatattggcgaaagcagtgcttcttctgcaacagcagtgggacttgagaacctcggtgcttcttttgtatcagaagttcctcatatgaaaaggagaggatcagaggtagtaactaaatacaaggaaatgcggctaacgacaaggttcatggaggttcttacaaggatatctgaaaggcttgcaggatttctcaatggagatttgttggaaggacagaactctgcaattgccggtcaaatcaaggatttcaatcggagacttcgaggtatgattgaaggtcagcggctgttcccagcacagattttagaattgcaagaccgtttatctgccactctagaagagttccagaaacagcttgagctgatggtcaagtatgattgggactttgaccattatttggaagaggacttacctgctgccgattctgggttggcatctgttgttactttggcatcgtcacttgactataccccttcaagatcatctctcaagttgcttttacccctggcaaaacctactcgagctttgaacattcctgttattccagttgggccattgatggctactgttcatccccttgcaagctatcctccatatgttttttcttggctaaattctcagatttcagctcaagatatgatggaccaaaatctatttgagaagcttgttttgaacaacttcgataccgtaccttccaagcttctcttgcagttatcatcagttttccaaaaaggtggtttacgtgacaggagtggaacattcttctacaaggaccatctccacaaaagtaatgttcctgtcttagcaattgctggtgaccgagacttaatctgccctcctgaagctgtatatgcagaaacggtgaagcttattcctgaagaattggttacatacaaagtctttggggagcctggtggtccacactatgcccactatgacttagtgggtggtcgtctggtatga

SEQ ID NO: 109828 - DNA, 375 bp, Glycine max
  Peptide Sequence Number=SeqID_226606
atggccttttccattgtcatcaccaatttcattgtgtctaaagtccttgtcgaccaaggtatccatcctagcatcatatgccacaaattggtcatctgtcctcaagccaaaccagtctcacaaaagaagagaaagatggaagaagaacgacgaaaggtggtcagtgaagagattgacaagtttctgaaggctcagtttatcagagaggtcaaatattcgacttggccaaccaatgttgtcatggtaaagaaggccaatgggaaatggcgtatgtgcactaactacactggtcttaacaaggcatgcccaagagcgcatatcctttgcccaacatcaacaggattgtggatggtgcgtccgacttccaattattga

SEQ ID NO: 109829 - DNA, 190 bp, Glycine max
  Peptide Sequence Number=SeqID_226607
atggggatgcgattcaccctgggtgccctcgttgatcttgtgggtggagtgttcgcccccttaggggcgtttcacatgagcctccaactcattgcgatcgactttcaattttctaagttcctccttttgacgacgttccatgtttgtgatgcgggcttgaagttgacggagagtattgttgtctgtcatg

SEQ ID NO: 109830 - DNA, 303 bp, Glycine max
  Peptide Sequence Number=SeqID_226608
atggaggtcgacctgtctttaggttggaagctgctcaacttggagcgttatgatgaaactatcgatccaaatgaacacctggacatattcctcacccaagctaatctctacaccaatgatgatgtgatcctatgtagagtcttcccaatgtcccttaaaagggtggcattgacatggtatgaaggactccctcctcggtccattgacagtttcaacacccttgtcgaacgctttagttcccagtatgcaacgagtcggtcacaccatttgacatctgcagccttggctagttacgctaggtag

SEQ ID NO: 109831 - DNA, 902 bp, Glycine max
  Peptide Sequence Number=SeqID_226609
atgagcaaagccctgggagcaactacagaagaagacgaagaagacgaccaacaacatccacaacaagattgtttctacgactcacacgaccgtttactttcactctcttcttcatgctcttgttccaactccaactccgacaacgaaaacgacacccaagaccaccaaaacgacaccagcctccccaatttcaccaactacgacatatggatctctcaaccctcctccgtctccgaacgccgcacgcgccttttactttccctcggactctcttccctcacgcgctcaaaccctcgcgatcgcgcgtcccctctccgatccgtatccgacaccaccgcaaaccctaacaagccaccaaatccaaaaccacccccaccgccgccgccaccaccgattgaagagctgtgcacgattcgagatctcgataacgggaaagagttcgtcgtgaacgaattggagaatctgcgggaggttgccacggggcggcaattgacgatggaggagtttgagatgacggtggggcattctcccatcgttcaggaactgatgcggcggcagaacgttgaagaggcgagcgttgattccaatgcgggtggttctaaagtgaagaagaaggggacggggtggttgaagagtatcaagagcgtggcgagttcggtggcggggtatagggatcgccggagtagcgacgagagggacacgtcgtcggagaagggcgggaggcggtccagctccgccaccgacgacagccaggagggagggggcgcgtttcacgggccggagagggtgagggtgaagcagtatgggaagagttgcaaggaggtgactgctttgtacaagagtcaggagattcaggcgcatagtgggagcatttggagcattaagtttagtttggatgggaa

SEQ ID NO: 109832 - DNA, 912 bp, Glycine max
  Peptide Sequence Number=SeqID_226610
atgcccttggtaaagcagattggacctgctggaaatgatgtgcctcctcgtccccccatcatttatgagacttctttcaagcaaagaggcacatcatttccagaattgaccttccttgagcttccaaagctggcaattgctgccccttcttccactactctggttgcatcaactcccttggcattgctaagtgttggtgtgatgatagcaaatgtcttggcgagcctgcctccttcttccccggccttgcaaccttcagctccaattatcttaccttcgacaatgtcttcctctttttcacatccaagtgtctcactaaaccattgggtggagcatcccaaagtagccagtgtcacggtcacccttgttgaagctactaggttcaactaccaattgttgtctagagttaatgatgtcttcgctaaattagcaagcacaagattggacggtgacaaggtgcttgaatgctatcaaggtttgttaaaggagaagaatgatttggcaagcaaggtggagcacactactgaaaagaaagaaaaacttattgcgatagtggccgaatctgccaaggtaattgctaacctccaagcccaactaaaagaaacagagcttactatgtccgccctccagaataagatgaaggagtccgagcttgaagcagctaaggagaaagaagcaaataaggagcctggggaggagctcttaatgtttaaaaaggaagtcatggagcagcacaagaaagagttctttaaggccatcaaccaagccaagttcttcattgagggtctcgacttaggtctttttgacccatctaaggatattaaggatggtgaattgcttgacaaggaagatattgttgttggggaggagaagaacgtcggcgaagaagaaaatgatgaggccaatgtttag

SEQ ID NO: 109833 - DNA, 402 bp, Glycine max
  Peptide Sequence Number=SeqID_226611
atggggtcatggttgtgcttaaaggtcttggagcaccaggtggggcacggtggttatggagatttgccggctaggagttgttcatgcttgttgtcacatctatttcattattatcacttgtccctaaaagttagcaaggaagatccttttgaacaacttctggaaagtgcggctcagtggcatccatcctccctgtttttttctagcttggaggttatagctgcccccaaggaggttttcttaaattctgaactggggatgcaccttttatttgtttcttcaaattctgcttttgtgactttgagaggacaacttgaaaatcatctaccaattgtacaggcacttcctgcatattctgaaggttatcatcctcagctaagtcagcccaggctgttgagatga

SEQ ID NO: 109834 - DNA, 1302 bp, Glycine max
  Peptide Sequence Number=SeqID_226612
atggacaaaactgtgcggttgtggcatctgtctagcaagtcttgtttgaaaatattttcacacagtgactatgtaacttgcatccagtttaatcctgttgatgatagatacttcattagcggatctttggatgctaaggttcgcatatggagcattcctgatcgacaagttgttgattggactgatctgcatgagatggtcactgctgcttgttatacacctgatggtcagggtgcattggttggttcatacaagggtagctgccatttatataatacgtccgaaaataagttgcaacagaaaagtcagatcaatctgcagaacaagaaaaagaaatcacatcacaagaaaattactggtttccagtttgccccaggaagttcatcagaagtacttatcacatctgctgactcacgaattcgggtggttgatggtgttgatctagttcataagtttaaaggctttcggaatgcaactagtccaatttcagcatccctcacggcaaatggtaaatatgttgtcgcagcaagtgaggactcccatgtattcatctggaaaaatgaagctgattgcagaccaaacagaagtaaaggtgtgactgtcacacgatcatatgagcattttcactgtaaagatgtgtcagtggccattccttggcctggtatgggtgatgaatgggacatgcaagatacgttttccggagaacagcccgagattgataaccatgctgatgaagtctcatcagccaaccatcctcctacccctgtagaggaaaactttgttactgagggttcaagatctgcatcaggttatagcaacagtccacgccatgcaaccattgcaagtgcaacaaatagttacttttttgatagaatttctgcaacatggccagaggaaaaacttcttctggctacaagaacccaaagccctcgtgtcagtatggatttctctaacgggggccttcccatgaagtattggcggtcgaacatcattcttgcgattgcaggtgtcggaaccccggtcaccattgatgattcaaccaggaaaaaggtctttgggcattatgctagagccctggtggacattaatctccacggtggtcttcgagattccatcttggtcgaaagagaatcattcgctttctttgtcaacattgagtttgagaagattcctgaattttgtaatttttgcaagcatattggacatgtggttagcaattgcaagaagaaatcctttgttgattcgaaaatgacgcgggaggaccccaaagccatgttgtttatgttgctgagacccaactga

SEQ ID NO: 109835 - DNA, 1008 bp, Glycine max
  Peptide Sequence Number=SeqID_226613
atgaacttaacttgtgctcagagattgttaaagcttgtgattctgcttcagcagattctgggtactctctgttcgtgcaccagaggctattataacttatatgacttggccattataaagggttgcaaagtgacatttatctgtgggcgtgctggtgtttgtgctcttggtgctgtgatagctaagcatactggtgatgaaagattacttgactattacctgaggcaattcaaagagattgcgatacctcgcgagtctccctatgagctattgtatggcagagcaggttacttatgggcttgttcattcttaaacaagcatattggtaacaacacaatacctactacccacatgagatcaattgtggatgaagttattatggctggcagacacttaggtcgcaagggaagatgtcctctgatgtatgaatggcatgggaagaaatactggggtgctgctcatggacttgcaggaattatgcatgctttgatggacatggaactcaagccagatgaagtggaagatgtcaagggtacgctaagatatatgattaacaatcgtctccctagtggcaattatccctccagtgaaggaagtgaaaatgaccgtcttgtgcattggtgtcatggtgctcctggactcactcttactcttgtaaaggcagctgaggtttttggggacaaggagttttcgcaagcagctgtagatgcaggggaagtagtatggaagaggggtctgcttaagcgagttgggatctgtcacggcatcagtgggaacacctatgtctttctttctctttacagaatgacaggaaatgaggagtacttgtacagggccaaagcatttgcttgttttctacttgatagggcacaaaatctaatctcagaaggaaaaatgcatggaggagatcgcccctattccttatttgaaggtcttggaggaatggcatatacttgtctagacatggttgatccacaaatggcaaagttcccaggctatgaactttga

SEQ ID NO: 109836 - DNA, 312 bp, Glycine max
  Peptide Sequence Number=SeqID_226614
atgaagcaaaaaatagtcattaagctgcaaatggactgcgacaaatgtagaaacaaagccctcaaaattgccgcagaggtaccaggtgtgacttcggtgtccctggaaggggacgacaatgatcgcgttgcggtgaccggtgtaaacgtggacatggtttgcttggccaaccagctgaagaagaagttcagctctgtgaccattcccaccgtggaagacctaattaaagcggacgaagagaagaagaagaaagaggaggagaagaagaagaaggaagaaaggttgaagaagatgctgcgtgctgctctgtga

SEQ ID NO: 109837 - DNA, 144 bp, Glycine max
  Peptide Sequence Number=SeqID_226615
atggagtttggtctgtggtctctgccacgaagcgtggcagctcgttcggaaagaagcgatcggccatctgcggctaacggcgaaaaatgcagagtagaatttgctggaaaatccatacataatatcgagcatttctgtacagaa

SEQ ID NO: 109838 - DNA, 377 bp, Glycine max
  Peptide Sequence Number=SeqID_226616
atgtggtcactgtcatccttcccaaaagtccacgttatttgctattaccgtgggagattggaaccagtttcccttgtttggacagtaaagtcacttattgtaagcaatatggccaagcgtactacctatgtctcaaatgcacatgttgaggtagagaggcaaagacttgtgattgcgtcaccacaaccagaaatatcgtctgccgaccatatcatcggactcccatttggaggagaccttgtggatttgacattgcttcaatcctataaggaccacgtagttggacgtgtatggattggtgagcctagagtggagttaaagcttattaatcatggtgacaatgttatgccttaccctacccaactgacagtgaaggg

SEQ ID NO: 109839 - DNA, 477 bp, Glycine max
  Peptide Sequence Number=SeqID_226617
atggagtcgccatctgtcacaacctacccttcgacgggagtgcgggtgaaaagccaaaggagtgtcttccaaaaaggaaaacacgtgggagttgctaccaacatttatttgaggaaaacgttaggaaaaaccaaaagagcttctcaaactgttagtttttctgatattcaatatgatattcccaaactcaaaggagataacaataagatatggaaggagaaaattcttttgcaattggggtggatggacatagtctatgttataaggaaagacaaaccacctacaatcactaatgaaagtagtccaactgttgttgcactatatgagcattgggagcaatccaatcggctcaacataatgttcatattaagaccaaaatctcaactgggatatgtggaagaagaaaggcttgtaatggatggtgggagtgcattgctggcaactgcttgtgggaagaacaaagctactaagtcttaa

SEQ ID NO: 109840 - DNA, 243 bp, Glycine max
  Peptide Sequence Number=SeqID_226618
atggttgaaactagccaattaaacactaaaagaggtgtgaaagataaggctcccaacacacttccaatgaaaggcctttttgttacaaaacttgaaagcaatgaagtgcttcttagtccaatagctcttaaggtggttggccccttgcttctggactcaaattcttcaagggatggcaccaatcctccttccaattccctatatggcaacccacaaataaggaaacaaagagacaagcaataa

SEQ ID NO: 109841 - DNA, 361 bp, Glycine max
  Peptide Sequence Number=SeqID_226619
atgaggatcaaaaggtcttttaaggttgtaacggggccaaggacaaggtatggaaaaatatggaataagtggctaaatcccaaaggaatagaggagcaatggggaataacctttgagaaacaacatttcattcagcatgtccaacatttaaccaatatacaatgtacatcaagtatggcccaaaacaagttatccaatgaaacaaaaacccgccacacttattcccaaaacaattccaaagctccaaaattccttaaggatatggtgatatcatggtttttttcatttaaggcttgtagtgagcttcaaaacaaggaaagggaacaaggctcaaaagggctatcaaaagaattaattcaag

SEQ ID NO: 109842 - DNA, 1044 bp, Glycine max
  misc_feature (136)..(136): n is a, c, g, or t
  Peptide Sequence Number=SeqID_226620
atggcagagccatcagagaagagaaagggatcatctccaccgctaccgctactgcccatcgccgtcacggcccatccggagcacccacagcacctattcctccttctttgtcatctccaagatcatcaacactgtnttcatccgatgatcaacgtctacgtgtttcaaaattctggtcttgttgatttcatgtcatttaaattgccatattatcctgaacttgtaaaggtcttctactgcaatttaaaaattcaggatggtattattatgtctgaggtgcatggtacttctatggtcattgatcagtcacttttcttttctttgactcatttacccagtcaaggtgcaccttttgagggcaccattgttgatgactggaaattcgattattcgagtcatgatgctcgtcgcatggtctgcaatgatcaagctgacatgaccggtagattgttggccgggtcattaacttttgataatcgcatcatgcattatatcattgttagaattttgcttcctcggtcttcaaatttagcacaagcctctgaggaggatttgattcttatgtgggcttttctaaccggtcgtcagatcgactgggcccatttggttcggtaccgaatgcataaggcattacgggccaatgcacctcttccttatccacatttgattactctgtttttgcgtcattttcaaattccgcttgatgatgaaccctttgttcaagtcaagcgttcctttgcaattggtgctggagcagtgacctcctttgggtatcgtaaagatcggaatggacaatggctgaagaaggatgcactccctcctcaagatgaacgtactccttcacctccccctcaacgtgaagattccgcactcatgaatgaagtcctctccgaattacggggtcttcgttcgtatgttggtgaccgctttgactcgttagattcacgctttgccggtatggacattcgtcttacacagcttgaagaggatgtcggatacattcgtcagagttttgatcttccaccacctcctccgtcttcttag

SEQ ID NO: 109843 - DNA, 467 bp, Glycine max
  Peptide Sequence Number=SeqID_226621
atggaggaccaagaaaaagaaaaagaaagagaaaaagaaatagaaaatgagaaaaatgaaaatgaaaaaaataaggttgtagagaagagtagaagtggaaaggctgtggaagagagtgtggaagtaccatatcctatggtgccgtccaagaaagaaaaagatcgtcatttggaaagatttttggatattttcaggaaactggaaataaccatgccctttggcgaagctctgcagcagatgccactttactctaaatttttgaaagatatgttgacaaggaagcagaggtacattcatcaggaaaacatcataatggaaggaaattgtagtgctataatccaaaagatccttccacctaagcacaaagatcctgggagtgtaaccattccttgttcaataggagaagtcaatgtgggaaaagctctgattaatctgggagccagcattaatttgatgccactctccat

SEQ ID NO: 109844 - DNA, 120 bp, Glycine max
  Peptide Sequence Number=SeqID_226622
atggtgcttttcctaagctacacaaaagcaaagactgaaaacgctcaaggtgttacaacttctgctaagcggccacacctgtcgctgagcggtagtgtgttttttgtgaaggccagctaa

SEQ ID NO: 109845 - DNA, 290 bp, Glycine max
  Peptide Sequence Number=SeqID_226623
tgagagcaacagcttctccagatgatgaatcagaaagatcggcaattcctccaattggggaagtaggagggtcagctgtttcttcagctggtgaatcaggaggggcagcagcttcatctgatgatgcatcggagatgataatcagaggtggagatgggggaacttcttcaaacacaggagaaggaggtggattcactactggagatcatggctcagctggaattggttcaacccgtgctggtgcgggctcagaaggggcagcctcattgggtctcaccaatggaagttga

SEQ ID NO: 109846 - DNA, 213 bp, Glycine max
  Peptide Sequence Number=SeqID_226624
atgccgccggctcagatggaaccgccattgccggaatcctcgtcggtgccatcttttagctccgacgccgcttctccgggatcggcgccggagagtcggcgattcggggatcttagaggtttgcagtggcgtataaatcttggggtgttaccttcttcttcttcttccattgatgatcttcgtcgtgccaccgctaattctagaaggaggtga

SEQ ID NO: 109847 - DNA, 482 bp, Glycine max
  Peptide Sequence Number=SeqID_226625
gcggtgttgtccttgctgaggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgaggacccattccatccaggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactcttaggtcaacacaggctctgcctgttgctttgatgattcatgataactcgtcggatcgcacggcctttgtgccggcgacgcatcattcaatttctgccctatcaactttcgatgggtag

SEQ ID NO: 109848 - DNA, 874 bp, Glycine max
  Peptide Sequence Number=SeqID_226626
tttggagtacaagttgttccttcaacgttgccaaagataccgtagtgctcatgatggtatattggtcaatagcttcatggaattggaagaagaagcaacaaaagcaataacccaacatgctaaagggaatgggaattgtagctaccctcctgtgtatccaattgggcctattacacacactgggcctagtgatccaaaaagtgggtgtgaatgtttattgtggttggataaacaaccacctaattcagttctttatgtgtcatttggaagtggtggcacactctgccaagagcagatcaatgaacttgctttagggttggaattgagtaggcacaagtttttgtgggttaatttgagggcaccaaatgatagagcaagtgccacttattttagtgatggcggtttggtggatgatcctttgcattttctaccattagggttcatagagagaaccaaagggcagggtttggttatgtgtggctgggccccacaagttgaggtcctaggtcacaagtcaattggtgcatttttgactcattgtggttggaattcggttttggagagtgtggtgcatggagtgccaatgatggcttggcctttgtttgctgaacaaagaaccaatgcggctttggtaaccgatggattgaaagttgctgtgagaccaaacgttgacactagtggcaatagtgtggtggtgaaggaggaaattgttaagctcataaagagcctcatggaggggttggtgggtgaagaaattcgtaggagaatgaaggaactgcaaaagtttgctgaatgtgctgtgatgaaagatgggtcgtcaacaaggacaatatgcaagttggcacacaagtggaaaagtttgggaagaccttaa

SEQ ID NO: 109849 - DNA, 2343 bp, Glycine max
  Peptide Sequence Number=SeqID_226627
atggatttggcaattgcctgctgctacaacttacacgttatgtgtagagttgccaggactgagttgttagatccacctgtttcttggtatgctagtttgagagggcgcctccttgttgatcctcatatgccaaaggatgggagtagttcacccaatcttgtcatggacaacccactttcacaaaatccagacagtacatggagtcgcttttttcgcaatgcagagatggagaagatggttgatcaggatttatcacgtttatacccagaacatggcaactatttccagacaccaggatgccaaggcatattgagacgaattttattactatggtgtctcagacacccagagtgtggttatagacaaggaatgcatgaattacttgctccggtgctttatgttctccaatttgatgtggggtgtctttcggaagttcgaaagctttatgaagatcacttcacagacagatttgatgacctcttttgtcaagagaatgatctttcttacagctttgattttagaaaatcttcagacttgatggaggatgaaatcaactccaatggaaatgcaacgaaaatcaagagtcttgatgagcttgatcctaagatacagaacattgtattgctaagtgacgcttatggggctgaaggtgaactgggtgtggttttatctgacaagttcattgaacatgatgcttactgtatgtttgatgctttaatgaatggggcacgtggttcaattgcaatggctgatttcttctcttattctcctttgcctgggtcccatactggcttgcctcctgtaattgaagcttctgctgcattgtatcatttgttgtctcatgtggattcatctttgcatggccatctcgttgatctcggggttgaaccccagtactttgctctccgctggttgcgagttttatttggacgggaattttcactcagcaacctcttgataatctgggatgaaatcttttcatcagataatagtaaattggaaaaacatgcagaggacaatgcagactctggttttaggatcttcaattcgtctcgcggagcatttatctcagctatggctgtagcaatgatgcttcatataagatcttcgttacttgcagctgaaaatcctacaacctgtctccagagattattaaacttccctgagaacattaacgttgaaaaactaatagagaaagctaaatccttgctggctcttgcattaagtactgagatttcatcctcaatgcctttattggtcgagtatcataaccagggtaaatcagctattgcaagatctcgcaccctttcatctgaatcaatttcaccaaaaactcctctgaatttggtacctgatagctactgggaagaaaagtggagagtggtccacaaggctgaagaactcaaacaagatggagtagaaaaacaggttcctactcggaagaagggatggacagaaaaggtaaagttcagtttgaaaagaacggaatctgacccctcttcatcaaggattaagagtggtaaaaaggaatccaagtcaccggttaggcgatgtttgttagaagatctttctaaggaacttggcttcgaggaagatactgaaaaactctcttgtcatgatgatctgtctgccacagttgaagaggagcaaggggaagatggctctgaaggcagcaacaactattctcctgaagatagatgtcaaagtcaaaacacaagtagtgaggaaaactcacctgttatttcttgcccagctagtcctaccaatgagaccattgatcacaaaaatgactccgagaaaagaagtgttgggtctaatttatccctggatataactaatgaaacttcacttagtagtcccattgattcacctcttccaatctctgatcatcctgagaaaggacctcagacaccagggagaaataatattaataattctgcagggaattcaaccacaaattctaaggagagaaaattgaacaaattccagtggctatggaagtttgggcggaataatggcgagtttatgtcagagaaaggaggtgatgcttatgaggctgtaaaacctgccaacaattgtagcaaccaaaccaatggacattgtagttctgttagttgcaaaggggaatctacagatcagactgtgatgggcagtatgaggaatattgggcagtcaatgcttgagcatatccaggtgattgagtgtgctttccaacaagacaggggccaagaagcatcattagataacatgtctaaaattgttgtggttggtaaagcgcaggttaatgccatgtcagctctcaaggagctccgcaaaattagcaatcttttgtctgagatgtga

SEQ ID NO: 109850 - DNA, 132 bp, Glycine max
  Peptide Sequence Number=SeqID_226628
atggagcaggttgataggaaaagtggcggcagatcacagccacaagtctgtgacaaatgtccaaatgttaaatatgaaagagatggtcatttcatcactgttgatattaagaaaggcattcaagatgggcag

SEQ ID NO: 109851 - DNA, 378 bp, Glycine max
  Peptide Sequence Number=SeqID_226629
atgggggaggaagtgctattttttgaggatggtgagcccataattgatggagagtctggagatctaaggtttcgtatccgcacagcagcccatgacctcttcagaagggaaggcaatgacttgcacaccactgtcactataacactggttcaagcacttgtcggctttgagaagactgttaaacacctagatgagcatctggtggacataaggaccaagggaatcacaaatccaaagcaagtgacaaagttcaaaggagagggcatgccagtgcatatgagcacaaagaaaggagatctttacgtcacgtttgaggttctgttcccaaactcactaacagaggagcagaaaacaaatataatagcaattattgcttag

SEQ ID NO: 109852 - DNA, 555 bp, Glycine max
  Peptide Sequence Number=SeqID_226630
atggcaaataatgtctcagatgtgaaagaagatggttttgtaggaggagctggagcaggaattggagctggtaaaggagtgttagttgaagctggtaactatggaagatgtggagtcgaagtggatggtgctgaaggatctggtaaagtagttgaagaaggagcagaagaatctggtgctgctaaagtagggggagcctcagatctcttacccctggccttccttggccctttgaatgtcactgttggatcatctagattgcaacaattcttctttatatatgccaagttaatggcagggctaaggctctacaaagatctggaatctgatgtgactcctctagctttacacaaagttgtgattaaggctggaaatccaagcctagaggagtcatgctgggcaatgatagaaatctggtgggagatgagaagtgtgggaggtagggaccaagttggagtaagaaagaacactctaagtctgaacgagtgtggtcatgttcttcctaaggatcttcagtggcaagccgtcagcattaagctcaaatcccctccctag

SEQ ID NO: 109853 - DNA, 300 bp, Glycine max
  Peptide Sequence Number=SeqID_226631
atgagtatggatgagtttcttgcacaggtggcttggccaggagtccagccttctccttctggagggggtgaggcctccgcagcccaagagcctgtgctagcagaggagccttgtgccagatttgctcaggaggaagcagcagttcaggagcctacttcttcagctcctatatctccagcacccatatctgaggacaccaagccatcagcaccagccatggagccagagcagcctattcttcaggatgtagcagctgctctagtgctggatttaaatgaagatcagccacaggatgagtaa

SEQ ID NO: 109854 - DNA, 882 bp, Glycine max
  Peptide Sequence Number=SeqID_226632
ggtatttgggcttctttctctggtcaaccatcgaagattgataagttagtgcttgagttacaagaggaaaaggtgcgttcgctaattcccttatctctttctgatgagattctttatggagtttttgaagaactgattgttgttgggctttggccgaaattggaaaaaatcttcatgacaaaatcaacttgcaacaagtttcttttgaaaaaacgttcgtttggccttcgaatgagggaagggacgccattgaaggaacatcttgatgagctaaactctattctgatggagctatgtgaaattaatgcaaggactccatttcacttgtggaaagtcaagtccaatctctattctagacagcttcgactaaaggtgtctgagaatggtgaagaatcctttgcgtccggactatcagtgattaattctgctaaagggcagaagaagaaaggcaaaggtggcaagaagagcaaagtcaatcttatggacatatgcagttactgcaaagaaccagcaacaccagacgaagtttccaaaggcagtgcagatgactactccaagatgacatgggtgtttggatatccgtcatattatcacataagtgaaggtaagttggaacccagagccaagaaaggattctttatgggttatggagatggggtaatgggatttcaagtctggtctccatctaaaagaaaggtcattatgagtatagatgttgcctttgatgaatgttctatgctacattttaaatttggtgaagatttgggcaaggttgaggatgtcactgttcaggtagatgagtggtgggatgcaagtgggtcttcaagaagaaatctggatcatccattgaagaagtcttccattataatgcatgtgtggtag

SEQ ID NO: 109855 - DNA, 192 bp, Glycine max
  Peptide Sequence Number=SeqID_226633
atgaagaattcacatgaaacggagaaacctctagtaggattgaatgtagaggaaccaaaccagatcatggatgtcgacactgatggaattaatttccccaagcttcaagacgacaagaggttcagagttagactgcaaaatcaaggcaatggtattgaggataagcctggcatgctcaatggagatctatag

SEQ ID NO: 109856 - DNA, 663 bp, Glycine max
  Peptide Sequence Number=SeqID_226634
atggctggaaaattcaagaggcttagaaaagttggtgtagactacgagctgatggaatactcacctgacgatagaggtgatttgtatctgcttatgatttctagtatcacttttggtgatattgctgaagatgagactaacgatgatgtggaggatggcatggaagattttatagtggacgatgaagatatcatctacgggaagcttaaagccgtgaaatatttgcctgcattttcaaaaggcaaacatagttttggcaaggaaggtcagctggaaaaccacattgggaaagttcaaattcaggctactaagtctgatgatcctaacaaatataaatcattcatccctactgacatgcacatagctagagaggatagttgtgtaaatgatacggacatacctgagaggatgcaattaaagtcctatcattgtgggcactatgatgcttatcttggttgtggttggcttcgcttacttttctttgggttgatccttctcacatgcacttttatattaagcagcatatctttagttgttcacaagcttttggttacacttacttttctttgggtggatccttctcacatgcacttttatattaagcagcatatctttagttgttcacaagcttttggttacagtatgcctacatgggaatcttag

SEQ ID NO: 109857 - DNA, 294 bp, Glycine max
  Peptide Sequence Number=SeqID_226635
atgtctgagtctgaattagtctcttctgatgatcaatctcccccatcctccacatcaagtattccaaccatccaaatggtctcaaaatccttctctgaaaggcttatggggaaattctttgatgtctctcaattcgattttgtgtatgaacaaagtgggttgtggtctcctcctgtaagtaggactgtgtttttggcctcaccaggtaacatttgttctcgggatgaaatgttgaggaagctcaagaaggcaaagaggaattggaagaaatcacccatgttatgcatcttcaac

SEQ ID NO: 109858 - DNA, 423 bp, Glycine max
  Peptide Sequence Number=SeqID_226636
ggtaggggtaagagatcagaggcccctactacttcagcaccaccagagacactagctccttcttcttccacagctccattacctcccactcagactccaccaggagcccaaccttctccttctggagggggtggggcctccgcaacccaggagcctgcttttgaggagccagtaacaacagcaacagagggggaggatgagctcacccctcctgagcctttttattttgatacaggtatacacatggctcaggaggaggagacttctatagaccagatcctagagccatcctcagcacctatacctgatgatgccataccatctgcaccagtcacggagccagagcagcctatccaagaatcatcagtagctccagcactggatcttaatgaagatcagccacaggatgagcaggacatttaa

SEQ ID NO: 109859 - DNA, 741 bp, Glycine max
  Peptide Sequence Number=SeqID_226637
atggaagtgagggacaaggttgaactccttccatatagggacctagatgagctagtccaactttgtataagagtggagcaacaacttaaaagaaagtcttcttcaaaatcttatggctttcactcttatccaacgaaggaccaagcccaaggaattttgggggctacaccttcaaaacccaaggatgataaggaggtcacattgtctctcaatgcccccacaaagaaaaccatgattatgaggggtcaaaacatttatagtagtcatgaggagactacttctttcccttcctctagtggaattgaagatgaagtaaggggtgaagagtctagtgaggaagactaccccactactaaaaaaacctttttttacgttgcacattctaaggtggttccttggaaccgatgtagaatgtacatcggtgacatttttgtaattaatggaaatataactacgatggtcttccacactcgtctttcgaagcacttgaacctcgaagttgaccgagaaggtgacatctgccgtgccctagcctgccccgctgtggttgtgtgtgtcatggttgcctgtgccatggatgcctttgttttgtgggtcaggcttcatatcagaaaggtttccgttgataatggtaaagatgaaattgaagaatctaatggaagtaaagtaaatgagttcgcttccatagatatttcaacttctcgaagaacaatggtgggcaatgaaaatcctcaaatttaa

SEQ ID NO: 109860 - DNA, 402 bp, Glycine max
  Peptide Sequence Number=SeqID_226638
atgatagaggttgtgaagggaaaggtactaaagttgttagatgcagacatcatcaaccccatctctgacagtgaatggttcatggtgcaagagtgcattgtgcttggatgtaaagtgtcatctactgccattgtcgttgacgccaccaaggtggcggtgattgcaaaattgccttcgcccaattgtgttaaggcgataaggagttttctaggccatgctagattctacaggaggtttgtgagggatatttctaaaattgttaaaccaatgaacgaccaccttgccaaagaggccacttttgttttctcggatgtgtgtttgagtgcttttaatttgttgaaagagcacttgactagtgctcctatggtagttgcccccgatggccattaccgtttgaattga

SEQ ID NO: 109861 - DNA, 207 bp, Glycine max
  Peptide Sequence Number=SeqID_226639
atggaggaagatgaggatatcctaatcatattgggacatctattcatgaatactcgtgacatggttatagaggttaggcaaggaaatctcactctaaggatgggcaagagacccactgatgctttggtggaagcctcattcccaagtatagggatggaggacccctggaaagagttcttactgatgaggacttggatagggatttga

SEQ ID NO: 109862 - DNA, 705 bp, Glycine max
  Peptide Sequence Number=SeqID_226640
atggctgctgctggtttcctggctaaccagccaaaatccgaacaagaattcactatgaagttgattgagttgagtggacttgatgcaatcctaagcatattgaaaactgggaaaatggaagcaaaagaaaatgctcttagtgcactcttcaggttcacatgcagatcttacaaatatcaagtcacaacgagatttgattctctgaacactggttcgatcacgacaaaggcaagagcagcaacattcattggtgatccttctatgagcactccaaaactcacagttgctcccaaaccaactgattgttgttggcttttcagatcatcgcatgttgcgttatgttcagcacatgggagtgtatgcagtgtaaacaccacattttgtcttttagacacgaaaactttacctagcttgataaagttgttacatggggaggtccatgcaactgcttgtgaagaaatacagacactctccacattggttttggaagattttccccaaaggggagctcgtgtttcgcatgactataatgcactaaggttcatattagacattttgaactgggaaaacctgcaggccacctccaaccttgagggcaaggttgattttccaggggagggtattgatagcaatatgacccaagcactcagcagcaggcccaagaggacacttgggaggcctacacatttcgaggattatgagtga

SEQ ID NO: 109863 - DNA, 396 bp, Glycine max
  Peptide Sequence Number=SeqID_226641
atgggttctccacctgcctccactactcctcctcctcctcctcctcctcctccttcttctccttctcctcctcgtcctcctcctacttcggacgcatcagcttcgacgcctgccaggcttctgacagtaggacgaaaaggaagttactacagaccgtgggggagagatggaggcatcttaaatcagacctcacgaggaaataggcctttgcagccgatcaggacggtgttgacggccactgtctgtgacaaatacggcatcagcaaggaaaagtgggcccttaagacaaaaatggcgtacacctccttcaataaacacaaacatcaatgtaaatttagagcaaacttatgcacatatttccttacgaacattcactcgcacaagatattcttctaa

SEQ ID NO: 109864 - DNA, 867 bp, Glycine max
  Peptide Sequence Number=SeqID_226642
atggtgaaaagttggaactcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcaaggtaacggggaattttatccaagaacttggtggacatacctatatcatgtcgattgcgatagtgatgttggcaatcaatgtgatgtgcagatatgcgatgggtacacactcggtatgcacgtggattgagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacgggcggagatttcctggaagatgccaggaagatacttaa

SEQ ID NO: 109865 - DNA, 1128 bp, Glycine max
  Peptide Sequence Number=SeqID_226643
atgactggtcagattagggaagaattgaggactcaaattaaggaagaattgaggactcagctagaagaggaaaataaaaggagcttggaaataataaccatggcattgaaagaggctattaaaaaagagttgtcacataaaggatccccagagtcactcctaattcagccggacatacaacaattaggtgcgcctgtcaacactaatggaagtaatgttgttatcaatcgtaaggatggtacactagggttggtggccatggggaaaataatggagggggattcagtcatgcacatagtggcttatgaagatgatgttgtaagggtaagtgtggaaacaattatagatcctgaggctgaggtcctctatgccacctcagaaatacaatatgtgaagcaggccgtcgatacatttgtagcttggcccacacaccttgtgaaagctgtattagatgaggatgtagaaattattccgcacaacgaggatgcacatgtgccaaagccggctaatgtggacgcagatgatccgttgcgtggcctgataaagtacagttttgatatttatgagaagccagttgaaatcaactttgatgggagctgctttggaattgcagatgcacctacatcgatattcataacatattcagatgttagtgaaataatagcaggagacaaaagtctgaacatatctgtacaacaattatggttaattcaaaccttgggtcaaggttccatgtatgcattccttgagccacagtcattggtggtttcaaaggatagacgcagcgagtgccaacaatatcttgaaagatggcttaaggaatctgaccgagaggtgtacgttggaccttacttccatcatgtaatgacgaaattaaagacaagcttgtctcctgaaagtaaggcagctgcacctaagtggattgaagttaagagtcacgttcaaaccggatgttatgaatgtggatattacgtaatgcattggatgtggaacatcataaccagcgagataaagagtgactggtccatgtggtttgctgatgcgacatcgttggacatcgacaacatcacaaaaattcgaaacaaatgggcaagatattttttaaagacttcgtgtaaaaagggctaa

SEQ ID NO: 109866 - DNA, 417 bp, Glycine max
  Peptide Sequence Number=SeqID_226644
atgggaaagtatgtgggggttggtgaattagaggatgtgcgggccttctactattcaattgagtcaaagaacaatcccaaggaggatcctcccatgctttggcttactgtggccctggttgctcatggtccagttgcatttaatcatgagcaatataatgggagccttcccactttgatcttgaggccacaatcatggacaaaggtgctttcaaattcaattttcattagtctaacccaaaatgaacatggattaccggatgaagatgcacagaatgtgtcgcaacgtgcccttttgcgggcgagcgaaggcgaggctcacgggtgcgttttccaaaggaggaaagatgcgcggagtcgccaccaacgtttatttgtggaaaacgtcggaaaaaccgaaggaaaccggtcaaaatga

SEQ ID NO: 109867 - DNA, 273 bp, Glycine max
  Peptide Sequence Number=SeqID_226645
atgaagcttgcttctacagataacacatacacggttactctaaccaaattgacttttgaggttgatttgtgtttgtgtttcatgctgtcaatttccagcaagagaatggatgagtcaacaaacaggcataatgataatttgggtgtgaacaaaatggggaaaaacattaggaagaccaaaagagaccagcccaattatggcaagaacaacaacagcagcatgaatggggtagacagcaacagcaacacaaacagcctcagctttacaacataa

SEQ ID NO: 109868 - DNA, 645 bp, Glycine max
  Peptide Sequence Number=SeqID_226646
atggttagaacacgaggtttaggttatgctttagctagggttataggtagaggtagacaggatgagcatgatgcagttgatgttccctggaggcgtaggcctactgcatcagtccgtaggcaacgggtacatattgcagttgatgaaggtgtttctcaggtgactgaggatgtacctcatatggcgaaggatgttcctcagatgactgaggatgtccctcatatggctgacgatgttcctcagatgagtgaagatgcgcctcagatgaccgcggatgtagatgcgactgttgcagaggacttaggtcgtaatggtgctaagggatcacatgctgatgagggattccctggtggtccacgtgacccatcagtgctgacttcatttgcggagcatgttgcagatgccatttggactgggcaggagcgtcctgagctgaagttggtgtcgcacgggaggaaggtggcattaattgggaggccagtgcctaagattgaagctggttgccgccacaagattaagtccattgatcgggtgttaagttgtaaccggcgatcctggacttatattcgcatttgtggagaggaggcacagagagaccagcaccttccaccttctagtaggagagttgatgatcacactagatga

SEQ ID NO: 109869 - DNA, 318 bp, Glycine max
  Peptide Sequence Number=SeqID_226647
atggacgaagatcaatggattgtgaatgaacaacatgttgattgttcggatgggttcaatacttctcaggtgtttgctacccgagatgatattttgcaatgtgcccaatcagttgctcatgaaaacggatttgtgacggtgattatgaagtcagacacaaacactggtattagaggaaagacttcatttgtgttaattggttgtaagaggagtggtcaatataggtctaggaagaaagattttgttagaagagatactgggagtaggaaatgtgggtgtcccttcaagcttcatggaaaatcagtggttggagggtaa

SEQ ID NO: 109870 - DNA, 483 bp, Glycine max
  Peptide Sequence Number=SeqID_226648
atggctggagatagaccaatacatttatgttttttatatttgattatctaccatactactacgagaaacaacaacaacaacaacaaaagaacacatgttctcttcattgcaagagcgcttactacaccaacactagcatccaatttcctagataagtttgttgtgccttatcataattacttctccttccaagtagaggaactccaacaacaactctatgaggttccacaatgtggtagtacttgtgtggatcttcaatgtgagaagaaaggttgcgagagaatcgtatctccccagatcatagcaatgagagaaaggacaagaaatatcactgagaagactcaacaacttgggaagttaattcctggtggaccaaagatgaacgtggctgagatgcttaatgcatctacgaagtatgttaagttccttcaagcccaagttggaatgcttgaactcgtgaacacagtcgagacaaatgcttaa

SEQ ID NO: 109871 - DNA, 288 bp, Glycine max
  Peptide Sequence Number=SeqID_226649
atgtcatctccgggattgacaattttacaagtcccaaaagcaatttacaggtgctcattgtttcatatgagacatttggaatgcattcgtcaagaggtttctgaactggtttttgccaaatttgggcccactatcattttattggctggacttcagggagttaggaagacaactgtttgtgcaaagttggcaaattatctcaagaaacagggaaaaagttgcatgctagttgctggggatgtttacaaacctgttgctattgaccagcttgctattttgggaaaacag

SEQ ID NO: 109872 - DNA, 933 bp, Glycine max
  Peptide Sequence Number=SeqID_226650
atgcacgggaaaaaggagcaagaagaatacataaggaaaggaccatggaaagcagaagaagatgagatgctactgaagcatgtgaagaagtatggtcccagagattggagctccattcgatccaaaggtcttcttcaaaggactggcaagtcgtgtcgtcttcgttgggtcaataagcttcgaccaaacctcaagaatggttgcaagttttcacttgaggaagagagggttgtaatagagttgcaggcacaatttgggaacaggtgggctaagattgcatcctatttgccagggagaacagacaatgatgtcaaaaatttctggagcagtaggcaaaagaggttggctaggattctgcaaacatcagcaactcctaaatcgcagaaaaataaaactagagttccttcccttcatgatgttccaattttgcagcctcctaagttcagttcaccatcagagggagaaccatcatcaaagcctcagtcatgctcactgccctacattgataattctgaggttatcaaaatggtgtctttgccagatctcataaagtctgagttgcctagttctgacacaatccatgttgaacaagagtttaccctttttgagaactacaaaagcactgaacagattgcatttcctcagattccagaactccaaaatggcctcacattctcaatggaaaaccaagatctcttgcccacaattgatgagccatgtttcattgaagaattgtgtcctcttgatgcatctgagtttggaataggtccacaacaccccattgggttccctttctttcagccaccaggaagttgcagattaggaacaggggatgcaattgataactccaaaatcagtgacagcttcttcgatgatttccctgtggacatgtttgatcacatggacccacctgcaagcccttcaaacctctga

SEQ ID NO: 109873 - DNA, 329 bp, Glycine max
  Peptide Sequence Number=SeqID_226651
atgaatctctatgatacaatgtgtgcagtgtgtatgcatgcagtcttcaccactaggccaaggtttaaatttcgacatgtatccctcaaagttggtacactgcaagaaccacctccgaaaatcaaagggatcgattgggacgtcatcgccgacgatgacgttggggtcgtcgccggcggcgatggcagagagtgcaacgacgacttcggcggcggtttggatgcatcggaggaagggagagacgaagacgcggtggagagtgaaagggaggttgttgcggaacttgcgacccgtggcgaaggctcggacccgaccctgttggataaggg

SEQ ID NO: 109874 - DNA, 522 bp, Glycine max
  Peptide Sequence Number=SeqID_226652
atgggtgctcctgtgatggcacctcctccttctttagcttcaccggttcctccctcggttgtgttgacttcgacgtcctcttcctcctcttcttgtccccatgtgccattacataacatctacacctcgaacgatgttgattccctatgtggtataggctcaggtccagcatgccatgaatttgccaaggtcttccttcagcgaagtttggcgatcttggaaaagaatggacaacagcaccaagaggctctaagcaagagagtggagcgcccaaaggtagcgagtgatattgtcacctttgctgaagttgtgaagtcaaaccaccaattgtcttctaaggttggctatgttttgatcaagttgttgcacagcaggttggacggtgatgaattgttcaaacgttgcaagggcttgcaagaagagaaaaaggacctcgctagcaaggtggagggcattacgatggagagggacaagctttccaaactgattgttgagttagaggctcaactgaaaggagaatga

SEQ ID NO: 109875 - DNA, 903 bp, Glycine max
  Peptide Sequence Number=SeqID_226653
atgtcttcatttctgtctgactctgccatcgacatgggtggtaacgattctagggattcaattcaacaacccctgatggaccaggaggttattttcattggcagttcctcgaaggaggatactcgttccaatgcctccgacaacgaatcctcttccttggagaggttaagggtttcgtgtcatactggtggaggcacctctcgtctccacaggaagacgtggccttccgctacctccccagccagggagcttatcccggtcattgtgattctctccccttcgttttctaagggagcaaggacaagtggtagggacattagggcgtctccccacgtgcgacgtagccatagtgttgggtcgccatcatcctcacctattgttactggatatgattgcgtgagggatgatattttgaagtataagtcctctctcacctttgcggtgagtgtcgctgctatgcaatgccaggtgaagctggcaaatcttgacgactcctggaagtctgttcccatcaagtttaagtcatttgacaaggatctgttgactcttatggagagggtcgacaaagatattttggagcaactgtcggcctcattgaatgcacgggccattttgtctcttccctcggaaagtgatcctcttgttgccttgaaccgaattatggatgtcttcccttggaggccacttgtgaagcaggttgtccctattgttggtgctactgaggtcaccctcggtgctccttcctctattttggctaagaggaagcgagatggtgccactagggtgtcgggttttggtgtgccaactgaagtttttgcccttgtcgttgttgcaatccttgttcctgctaaagtcgttgttgttactcttgctcttcctcctcctcccgccgtgcatgtttag

SEQ ID NO: 109876 - DNA, 177 bp, Glycine max
  Peptide Sequence Number=SeqID_226654
atgggcccttgcacccgatcaggacggtgtgggacgacaccgtctgatgtgcgcaaaaaggcacagggcatccaaaaacagaacactgccccccacgtatcaagcaatactttggattggctccatggacgtcctgcagctcttcctccttgcctcctaaagaattacagcagctga

SEQ ID NO: 109877 - DNA, 330 bp, Glycine max
  Peptide Sequence Number=SeqID_226655
atgaaacaagcaatcaagatcctggcgctgccctgcatgggcatggcgctgttgttcagcgcgagcgcgatatctgcccccgaggcgcctgcggccaaagcggtgccgcccgcggcggatgagccgatgcgcatgccgcctttcccgggcggccacccgcccaagccggggttctgccacggcggtgaactgttctgcgccacctcggtcagcgacaatccggtggaaaccatcaataaactgacggcggtgatcccggcgggcagcgccaaacattacgaggtgcgcgtcgcggtggtcgccgtgccggacgccccgcctgcgcgttaa

SEQ ID NO: 109878 - DNA, 123 bp, Glycine max
  Peptide Sequence Number=SeqID_226656
atggaggtggacacgattggaatgatgtggatggacgatgatgctaaggctcttgatgtgaaggtgagcaaattgttaagtctggctgcgtccgattcatattggactataccaaacaattaa

SEQ ID NO: 109879 - DNA, 261 bp, Glycine max
  Peptide Sequence Number=SeqID_226657
atgaaggcttattgctcgcacagtttagagagtggagcgcccaaagttgtgaagtcaaaccaccaattgtcttctaaggttggctatgttttgatcaagttgttgcacaacaggttggacggtgatgaattgttcaaacgttgcaagggcttgcaagaagagaaaaaggacctcgctagcaaggtggagggaattacgatggagagggacaagctttccaaactgattgttgagttagaggctcaactgaaaggagaatga

SEQ ID NO: 109880 - DNA, 1086 bp, Glycine max
  Peptide Sequence Number=SeqID_226658
atggcagaacctggtgacgatggtggtgaatatcatcaattggacagatctcaatgtttgttattgtatgtggtgactacacagatgcaatgtttgcttaactgtaacaatgaagggctctatagacgaatcaatggattggagaaccaactgaatcaaaatgctggaagacattatggtgggaatagaaggggcaatgatggacccaggaaaaacagaattgagggattgaacatgtattctcctgcaatgattatactgaagagtagaagaaaggaagggcttgagatagatacatggactgagatgagaagggttatgcaaaagaggttgtcaaagggaagtttgactgtggaggagtactacaaagagatgaagatggcactagtgaaggcaaacattgaagaggaaaccaaggacacaatggctcgttttctgagtggcctaaatcttgacgaaaagaacagcaagaaggaactcatccaacaccttcaaccagaactggaccaacagatccaagaaggagggaggcaactcgtccagcccatcaacacactctccacatggaaattcagcaacgcccagaccatgatcatgaaggcagatggagaaatcaccagtgaatctgaaatcaatgaagaagaagaagtggaagaaaagcttgaggaggaagctatgcagggtgacatgctaattgtgaggaagctcttgggaagaagttgtaccaatgttgtcagttctaggttagtatccaaactgactttggatactaagtcccatcctaggctatacatacttcagtggcttagtgaagatgaagaggtaaaaataactcagctagttgagtatgacaccaaaggagtacatgatagcttcaccaacaagatttctttccagcaccatgaccagaagattattcttaaacctttatcccctagagaagtgtgtgatgaccaaatcagaatgagagaaaatagagaacaagagaaagaaaggagtgaagcaccaaagaggaataggaaaaagaagagtgatacacatgagagaaaatttaattgtttagcaaaggcgagtgtagaaggatga

SEQ ID NO: 109881 - DNA, 1377 bp, Glycine max
  Peptide Sequence Number=SeqID_226659
atggggtctactgttgaatatcacatccaacatataattaacatcccagaacagattgagcctgcattgtggccagaatgttgtatctacaaggtacctactagtcttttgaaggtgaaagaggtggcctacactcctctattgatctcaattggccctgttcaccataacaaagaacagctaatggaaatgcaagagcagaaacacagatattttcatttcttttgggcacgcctaagcctagtgaacaagcttgatttggtgcaatacaaagcattccttgaactagaagagcgaaacctacgctgttgttaccaaaagaaattccctgaaatcagcaaggagcaatttgtggagatgatgctactggatgctgtgttcatcatggagctgtttctgagagaagcgaaaaaatgggaacataaggatgactatctaatgactcaaggatgtgttagcaaaagtatccagtgtgacttgatgttgcttgagaatcagcttccaatgttagtgttggaaaaactatatgatagagttgtcccaagcaatgccaaaaatcacaccagatttattaaccttgcccatgagtacttcagatcttattaccctcatcagcattcttcagaaaacaagtttgagctgagaaagtgggagaaatcactacatttcactgatctaattagaaatgcctatcttcctaagaaactgagcagtcagatgaaatattctcagcaggagtgtgtgctaaggactgcaactaagttgaatgaggccgggataagctttgagaaggttcatgacagatgcttactagatgtgaagtttgagaagaagcgattcttcagctggtttctttgcttgggttgcttaccatgctgcaagttgttcaaagcccggtttcaaatcccccagttgaaagtagaccacacaacagaatgcgttcttaggaacttaatagcctttgagcagtgtcactatcccaaggagccttacgtttgcaactatgtttctctaattgactctcttattcacaccaaagatgatgcagagttgctggttgagaaagaagctattgtccatgaactgggaagtgatcaagatttggcaactctggttaatggtctttgcaaacatgtggtgacaaattcaacatgctaccaccaaattatgaaagctgtcaatgaacactataacaatgattggaagtgggcaatgggtacattaaggtgggtttacttccgtgacccttggagaagcagttctactttagttggggttgctgtccttgtgttcaccatcttcaacttttaccgcgtaactgatctactcttttgtttatgcgtcttttgggctgttggaagcacttttggtggttga

SEQ ID NO: 109882 - DNA, 1731 bp, Glycine max
  Peptide Sequence Number=SeqID_226660
gccacaatggagtttgacaatccatcatatgttgaagatgcatcgctaacagtgccggaagaaaacaatatttcaaatcaaacccttcctatttctgtcaatggaagaattgaaccccaccaccaaggaggaggtgagagtagtgttaaagaccaaatcaagtttgggaataatgtttttgaggctaagaagatgatggaggaggagttggtggaagtaaaagatggagatacaaaaattaaccaatattatcttcgaaatataaggctagaagatgaagtgttgcaaggtcttcataccatgagacaagaatttgactccagtatggtaattgcttcacaaaataaaagggagtctctagatgattttgtgatatttcttgtgaaagaagcacaagcaaggaggaacagaaaaagagatcttatcgaccggataattgacatcccagaagagattgaacctgagttggggtttgaatgttgtatctacaaggtacctactagtcttttgaatgtgcaagaggaggcctatactcctctattgatctcaattggccctatccaccataacaaaaaaggactaaatgaaatgcaagagcagaaacgtaaatattttcgtttcttttggaatcgcctagagaacaagcttgatttagagaattacataggcttcctagaacaacacgagcaaaacatacgcgcttgttaccaaaagaaattttctgatatcagcaaggaggaatttgtggagatgatgctgttggatgcagtgttcatcatggagctgtttttgagagaagagaaaagattggaacataagaaagactatctagtgactcaaagatgtgtcagcaaaagtatccaacgcgacttgatgctgctcgagaatcagcttccaattgtaatgttggaaaaactatatgatagagttgttccaaaaaatgtgaaaaaacataaaaagtttattcatcttgcacatgagtacttcagattttattaccctcatcagcattcttcagaaaacaagtttgagctgagaaagtgggaaaaatcactacatttcactgatctaactagaaatgtctatcttcctaagaaactgagaagtcaaatgaaatattctcagcaggagtgtgtgctaaggactgcaactaagttgaatgaggccgggataagctttgagaaggttcatgacagatgcttactagatgtgaagtttgagaagaagcgattcttcagctggtttccttgctttggttgcttgccatgctgcaagttgttcaaagcacggtttcaaatccccgagttgagagtagaccacacaacagaatgtgttcttaggaacctaatagcctttgagcagtgtcactatcctgaggagccttacatttgcaactatgtttctctaattgactctcttattcacaccaaagatgatgcagagtttcttgttgagaaagaagctattgtccatggactgggaagtgatcaggaattggcgaatctggtcaacggtctttgcaaaaatgtggtgataaattcaacatgctaccaccaaattatggaagatgttaatggacactacaacaacaattggaaatgggcaatgggcacattgaggtgggtttatttccgtgacccttggagaagcagttctactatagttgggattgctatcctagtattcaccgtcttcaatttttaccgcgttactgatataatctttagctaa

SEQ ID NO: 109883 - DNA, 585 bp, Glycine max
  Peptide Sequence Number=SeqID_226661
atgatggaagaaggatttgatgtgaacaagactcctatgtttaagagagccaactatgactattggaaggaaatgatgattgccttctttgaatccgctcacattgatatgtgggatgttgtagaaaaagacaatcatattctcctagacgatcagaagaatgagatccttagggacaaatggatggatgatcataaatccaaatttcttctcaactcacgtgcaagaaacactatgttgtgcgctctatcacaatatgaatattccaaggttcatagcttcaataaggccaaacatatcatggaagagggagaagatatccaaaccatgtttggacgcttccaaaccattctgaacaagcttcgctctctaggtagacattatgataattatgatcactttgataaaatcttacaaagtttatctagaaagcggagaacacaggttacaacgttaagagccatcaagaatcttgattcaatgactcttgaagagctttttggtattcttaaattccataagcaagagcttgctcaagatgaaggaacaaagaaaaggaagtcgctagcccttacagtccaatga

SEQ ID NO: 109884 - DNA, 189 bp, Glycine max
  Peptide Sequence Number=SeqID_226662
atgaaaggaggatgtggaagaatgaggtttgaccgagagaggagaaaaagaaactgtccagggaagaagcaaatggaaatttcaagtttcagagagaggaatgattacggcacaaaagaaagatacgcggctggatatcctgtacaccgttggtatcatcctgatcgtttagacttcgacaggaattga

SEQ ID NO: 109885 - DNA, 286 bp, Glycine max
  Peptide Sequence Number=SeqID_226663
cagtggggctaagctcagtagttgggctaagcgcatatccaccgctaagcgcggcttcaccgcgcttagcgcaaaggagaatctggcagagcatcagcatcaaagccgtgccctaatcgtgatatcacgtcgcgatttcagagcctatttaaagcctgtcttgtgtagaattagggaacaactttctacagcttttacagcttctacagacggccaaggcacagacttccagagcagccacaggcctatttgggaaaagagccctagaagtagaaaaaaggagtag

SEQ ID NO: 109886 - DNA, 591 bp, Glycine max
  Peptide Sequence Number=SeqID_226664
atggacatagacgtgggctcgattatttctggacagatttcacagatggcccagtccaactcctctcagctaggattccctgcacttatcacaacattatacattgccagaggagtcatcccagattcattgacctttgagtctctaagccctacctttaatttggcttatattcgaaagaactgctggagctcggatgatcccatgatcacttttccggggacctgcaagactagggcttggggaccctccagctcccccaccagcaccagctcctacccctccagcactcacagcgccaaccgaccacttcgctcagagctcagacgtcatagtgccaatgttgcagagccttcaccatggcttatgcctggtgatgcagagcatacacgacctggctcagcatcggcccatcatcagtatggaggatattatggcccagccgaggagccacagccagagccggaggcgacaccagaggagactccagaggacacctctgccgccacaccgaccaaggtcactgtggagggagataccgctgtagacaccaattatgccacagatatggcaacagcacagggcacctag

SEQ ID NO: 109887 - DNA, 1119 bp, Glycine max
  Peptide Sequence Number=SeqID_226665
atgactcgctcagcaaggcagatccgctcagcgagtggcatctgcttagcgaggcatctagctcgcttagcagagaacgcaccagaggaagctgagaagacagaaggacagcagctgagagagcttaggttaaaaggagtgaagtctaggtggatgtactcggttgagcaatacatgaagttcttaaaagggtatacaaagaatctacatcatcttgaagcttctattgttattacggaagaagctattgagttttgttctgagataaggcagtttaagtcaaatttgacctccaaatgggtcctagaacatgataaggagggcaaggatgacaaggtctgcaagaaagatccttcatgggaggccattcagaaacaaaacattgcccctcacatgttgtctcgtgggggatatgattttctagaagaaaaaaagttgatagaggagaagcaaaagaaacgactggaggaagcatcccaatctgggagcattgacacagttgttgatcctccatctcccattagacgacacatgaagtggaagatgacctgcttgaagaaaactggtcaaatgacatctgaggttgcaaaggaaattgcagataggattgcctcacagggaagctttgtctcccatggacctcaggatgtactgattgttgtcattgggcaaccagagcaccctggtcgtgtccatgatgctggagtcagtgtgacgatcaaacactacattggatcggcttcaaggggctccctcacctctttctctatgccagatgcaatagcaaaatcacagggactcgcactgcctcctgaggctgacgttggtccttctgctgctcatgagtccacaaatgtccacaacattcgtttgggcaatgatcaactcaaggttggttttgaggaagtccaagatgttgatgcccacgttcctgtacctactcaagaggtcttcccttactacaaccccaagaccttccttctctcatctcccatcaaacccccgtggaagcatgcccaaggtgttgtcttcgatgttccaacacatgaagaagctaaagtgggtacttgcgaacttgttccacgagctggaaagagtggtaatagattccatggctga

SEQ ID NO: 109888 - DNA, 318 bp, Glycine max
  Peptide Sequence Number=SeqID_226666
atgtcgcgcttaaacgtgcacgccatgaacatcttccctgagaggaatgttaagctgcagatcatgcagtatgatgagttctgtcaggagcttgacaggcatagatggagcagagccttgaccaggcagcctgataaccacattgatgtggccctggtcaaggaattttatgctaatttgtatgacctagaggacaagtccacaaggcaggaactgatcgccagactatgcattccaaggcggggttttgtacttaatgttgagggggctccctggaagctccttaagaaggacctcactactcttgcacagacctag

SEQ ID NO: 109889 - DNA, 681 bp, Glycine max
  Peptide Sequence Number=SeqID_226667
atgcatttggtgtgcaccaggtacttttaccttcctagtgattggctgcgcagcagtggttgtgctcttcatgttttaagaaccgcaacaaagttgcaagactcaggagtgagctttgagaaagatgtggagagaaggttgctagacatatcctttgacaagaagccaattctgagttcctttctttgctttggttgcttgccatacttgaaccacttcaaggcacgttttaggatcccccagttgaaggtggaccacacaaccgaatgtgtgttcaggaacctcattgcctttgagcagtgtcactatcctgagaagccctacatttgcaactatgtttctctgattgactctcttatacacactcagcttgatgtggagttgctggttgagaaggaagtgattgtgcatgaacttgggagtgataaggaagtggcggttctcgttaatggactaagcaaacacgttgtggcaaacacaacgtgttactacgagactataaatgaactcaacaagcactaccagaacatctggaaccgcaccatggcagcgttgtggttggtgtactttagagacccttggagagcaagttccactttggtggggattgttgtgctcatttttgctgtgttccaattcatacgcgctgcgcgtgctgtgttaggatatgataaatcttag

SEQ ID NO: 109890 - DNA, 2403 bp, Glycine max
  Peptide Sequence Number=SeqID_226668
atgccgtttggactcagtaacgtgtcgtcgacattccaatcggccatgaatgacacactcaggccttttctgcgaaaatatgtcgcagtgttcttcaatgacatacttgtttatagctccaatctcgacacacacgtctctcacctggaatccattttggccacgttatcggacaaacagttccttctccggcactccaaatgtcttttcgcacaatcacaacttaactacctcgggcacattatctcggctcaaggcattgccccagatccagagaagatctttgttatgcttgcatggcccattccggtttctccgacggctctccgtgggtttttggggttagcaggcttctatcggaagtttattaagggttatgcggccattgcatttccccttacctctctcttacgcaaggacaagttcagttggtccccggaggcccatacggccttcacgccccttcaacaggccatgattagtgcccccgttcttgccaatcccaacttctcactcccattcaccatcgaaaccgacacctcggctacggcaatgggtgcgatgctgctccaagaggaccacccaattgcattctatagtaaggtcctgtgcccaaggttgcagaaggcttctgcttatatacgcgagcttcacacaattacttcttcggttcggaaatggagacattacctcctcggcgccacattcaccattctcaccgaccaccgcagtttaaaagacttaatgacgcagctgctggggtatgattataccatcaggtacaaaccaggggctgctaacgtggtggctgacgccttgtctcgcatcacaccaccggaggccacgtgtttggctttgacgatgccacattccctttttctttccgaattacggcagaccttactccaggacccccggtatgtcacccttttgcaagacatccaatctacgccggcaaaccacccggagttctccctccaccacgatcttattctccgtaagaagcgtatttggattcccttcccttgcgctattacacagtcgctattggaagagttccacgcctctccaatcgggggccatttcggcacggccaaaacgctccaccgtcttcaacaaaattttgattggcccattatcagggctgatgtccgtcaattcgtggcccaatgctccgtctgtcagcaaatgaaatacgagacctgtaagcccgctgggttgctccaacctttacccattccgacctccgtttgggaagatcaagctttagattttatcacgggccttcctcccttgcaggggttcacggtcatcatggtcgttgtcgatcgtttctctaaggctgcgcatttcgctgctctccccacacaccattctgcctataaggtggccgtgttgtttctcgacaccgcttgcaagttgcgcgggtttccccgtagcctagtttcagaccgagatcccatttttatcagccatttctggcgtgacctattcaaacttagtggcaccaagctcagaatgagcaccgcataccacccgcaaaccgacgggcagacagaggtgctcaatcagacgctcgaacagtacttacgcgccttcgtccatcaccaaccttcacggtggtttcgattcttatccctggccgaatggtcttataacaccaccattcatttcgggaccggcctttcacccttcgaagtggtctatggacgacccccaccgacggtggtccagtatttgcagggttcgtccaccattgaagtcgttgaccaactgttgacttctcggcaggacatgcatgcccagcttcaacagcgtctccgcaaggtccaggaatcaatgaaggcgtccgctgacaagcatcgccgcgatttctcagtcgcggtcggagattgggtatacgttcgacttcgtccctaccatcaggtctcggtggctccatcctaccataagctggccaaacgtttttatgggcccttcgaggtcgtggaacgcattggcgccgtggcctacagattgttgttgccggcatcctctcgaatccaccccgttttccatatatctctcttgaaaccccacaaaggtccattgccggcgactccggcgaccctcccctctgcgtctctggatcaccaccctctcccggcgcccttacacatccttgattggaaattggatcattcagttgaccccccagtgactttagtgcttgtccagtgggacggcatggctcccgaggagtccacctgggaacgctgggaagagctctgtcaagctcacaaccttgaggacaaggttgctttcggggatgggtgtattgatagcaatactgatagcagcaatagcagaccaaggaggattagcagaagaccaaattacctgaaggagtatgtacaagcctag

SEQ ID NO: 109891 - DNA, 630 bp, Glycine max
  Peptide Sequence Number=SeqID_226669
atgagtacccaatcttcattcttctctgatgcgggcccatcaaatatgatggcaagaacacgatttacagtagcatttcgtgttcagaagaacatcattgaagttccattgagttaccatagtcaatggaggccatattacccaacttctgttttatttgactacaatggaaccaagcattttattagggtgcgcaaatatgacactcgatgcttttttgctgatgggctcaaagagtttagaagaacccacgacattaatgacagtgtcattatccgattttttgcagcctcaaaagatacttctttggaagtcgacatcatgggacctatccttagacagacatgtcaaagaccggttgttacaaccagaaggcacatctttaccgttgatgtcacccaagacatgatcgaacataccaaccctttgcgtccaaatggcacacaaaaccaatggcagatcaccgtgcacaatggtctgccatctgttgcaaatccatggtttcaatacctctatgaaaataagttaatggcaggagatgaagtcatgttcttctttaggtttgacaaacatgtatgggaggtcatatttaggaaacaagttatgtgggatgaagacctcccggtttga

SEQ ID NO: 109892 - DNA, 237 bp, Glycine max
  Peptide Sequence Number=SeqID_226670
aagggcccatggagcgtggaggaagaccaaatcttaatcgaagcccataagatatatgggaacaagtggaccaagattggagagaggttgcctggtaggactgagaacaccatcaagaatcgttggaatggcaccaagcggcgccagaatttcaagaagcataacaagaacaaccaaaccccttatgaaggctccatgctccatgcctacattaaaaaggtcactgctactaagtaa

SEQ ID NO: 109893 - DNA, 324 bp, Glycine max
  Peptide Sequence Number=SeqID_226671
atgctcatcctagaaggtgatgtgctgctcacggatcaagatgagcctgtgacataccaagaggccattattgggcccaaatatgagaaatggcataaggccataggatctgagatggagtccatgtacactaaccaggtttggaccttggttgatccacctaaaggggtaataaggtgtaaatgggtcttcaagaataagattgacatggatggtaaggtgagtacctttaaggcgtggctagtgatagaaggtttcaagaaagttcatggtataaactatgacaagactaagggtgttcatgggtatgggtcaatttcgtga

SEQ ID NO: 109894 - DNA, 240 bp, Glycine max
  Peptide Sequence Number=SeqID_226672
atggctccgaagaagcccccaaccaagaggtcgaggaaagatgtcactggagagggttacagtgcggccccacaggtagatgtggagtttgatggacacaggttagtcgttcttcaaggggaggcgagtccagctgagggacagagagtatgccaagtttcagggggaaattgccaggaggcaatggactcagctcgcagcacccatgatgcaatcctaccccgcaagggcattggatag

SEQ ID NO: 109895 - DNA, 290 bp, Glycine max
  Peptide Sequence Number=SeqID_226673
ggtagtttcatgacaaatggaattgaattgtttggatattgtgaaagcttggcggggctgatggggacccaggctgagaggaacgaggagaaggctacgtgcgtgcacgggtcaggagaccttggggacgtcaggtggggtgctattgcccaaaaccaagcttggccaatcccgaaccaacccgggcataatcagtcagtgagaacctgtgacatacctaagcaggcgagctcctggcagtcaaccaataaaagaacaaaagtccacgaagcaaggaggcttgtgtggcg

SEQ ID NO: 109896 - DNA, 780 bp, Glycine max
  Peptide Sequence Number=SeqID_226674
atggccgggcagtttatcggcgctcgcgccggttcgcggctggtgctgagtaaagggcagtcgctgattcggccgatgatcgtcatcgtctccgcgcaacaccattatcagcagttagtcgagatcttcgacaagtgcttcgccgatgattttaatacctgtgtgattaaaggcgacgacgaaccgatctatcttcctgcagatagcgaagtgccctataaccggattgtgtttgctcacggcttttacgccagcgcgctgcacgaaatttcccattggtgtatcgccggcaaggcgcggcgcgagcaggtagattttggttactggtactgcccggacggccgcgatgcgatgacgcaaagcaagttcgaagacgtcgaggtcaagccacaggcttttgactggttgttctgcacggcggcgggatttccgtttaacgtcagctgtgacaacctcgaaggcgactttgagcctgaccgcatcgcctttcaacggcgcgtacatgcccagtttgaatcacgcattctggcgttaattgacgatatggtagaccacgccagtgatgacgaactgtttgctggcggttatctgcgcggccacctgacgctggcggtggctgagctggaaggggaaggggaacatacggcgcaggcgattaatgataaagtcgccagcagcctggaaaaggccatcagcgcgggcgaactatcgccgccggatcagattctggtgcaagggatgtggaataacctgtaccagcaggcgaaaaatcaggcctga

SEQ ID NO: 109897 - DNA, 168 bp, Glycine max
  Peptide Sequence Number=SeqID_226675
atgaggatgaggaaatggaggaaggaattggagtatcctaagcctcgtggtgtcgttggcttctactcgaagaacctttgcgcttctttgatggtttcaccatttgagatacttgatcggaaggcaaaggagaagaggagaggggaggcaccatccactagggaataa

SEQ ID NO: 109898 - DNA, 927 bp, Glycine max
  Peptide Sequence Number=SeqID_226676
atggattttggttcaagctttcaaaggccacaatacctttcaagccttttccctagaaattcctgcttgatgccacaaactcaagcaatgtttccatcccaaaactctattcatgttccactgtcaccaccactacccgccatgtttcatcctaacaacacttttcaccattttcaagatcccatcatgaatgggcctactcacaaccctccctttgcaatgaatggccctttcaaccccatcaccaccccaatgtatgggataccaacccctgctttgggtgatgggtcttccttgagtggctttgttaacgttcaccatcaccaccctgtaactttagcaccaaacaacaacaaaatggaggggttagtatcccataacccttcctttattatgaatggtccctccaactcgatcaccaccccaatgtatgggataccaaccccttctttgggtgatgggtcttccctaggtggctttgttaacattcaccatcaccaccatgtaacgttagacccaaataacaacaaaatggaggctttatatggtcatcacaaaggcaaacacatattggatttttcacagaacgccatgatgcatccatatgaagcttcttcttccaagtcaccattgcctttttctctctctaatgtgtacgaatgggggataagtgaatatcaccaggacattgattggaaggtaaagatgacaaatgattccaacattgctaatgataaaataatcaaagggcagtggacttcagaagaagacagtgcacttttggaactcgtaaatcaatttgggccgaagaaatggtcgcaaattgcaaagttattgcatggtaggattggtaaacagtgcagagaaagatggtacaaccatcttcaaccaaacattaaggttttctcttttctatttatcacataa

SEQ ID NO: 109899 - DNA, 621 bp, Glycine max
  Peptide Sequence Number=SeqID_226677
atgttgctccccctatctctaaccaaggggtccaatgacctttcggcttttttgagccagctattgccgaatgcagttgagaaggtggatgagaacgtgtcaattgtagtggctgttgccgccaaggtggggacatacaagagggtcgtttctcgtctcaagaagtgccttgtgctaaaggaaagtggcatggcgaactcggagacatgcccggtcactctccatgcgatccagctcggagtttgtgttcatgatttgagaggggatgaaataggatttcttctacatgacaaggctcgaaggatatcactaattcagctgccgaagcatccactcttccgccctttcacttcttcctataagaatttcaaaactagttacttcaaagctaggcgggctcggatggctgttgttggtgaacctatgccgaatgctgatgccaactgggcaccggggccttgtgaggttccgactaatgtggtgtcccccctccctcctagcaaggatcctagggggaagcaaaagcataagaagtggagccaccaagactatcgaagtggcttgggggaacactctgggcaaaaagaacctggaggattgagtgcttgccttgtcaaatga

SEQ ID NO: 109900 - DNA, 219 bp, Glycine max
  Peptide Sequence Number=SeqID_226678
atgtggtcatctgcaccctttctggagatgtcagcatcttctggccgagactattttagtctcacaacatctgcagatcctgacccaagagtcaggtggcaggcagaaatacccaagtggttatctgtacaaagacaacatttgttgatcctgacccaagagtcaggtggcaagcggaaatacccaagtggttatccatacaaagacaacacctgttga

SEQ ID NO: 109901 - DNA, 351 bp, Glycine max
  Peptide Sequence Number=SeqID_226679
atggcgaaagtgaagaatgaagacccgaaaaatgcaaatacaaatgtgaaagacgaagagtctccaatagaggaagtaagcctaatagtgaagaacaccgacacaaatgtccaagggatgaagagcaagaagagcttacagattcaaactttttcagacctaattggagttggtggagatgaagagttttcaaaagtaagcatgtaccttataatcgctagtgtcggactccaagggatgctcaaactcacgacggtaacaaagtccaactctttgagcagttacaggtcgaaaactacagtgttgaaaggcgacgaggaaggtcttggtcatgagggtttgcgagactga

SEQ ID NO: 109902 - DNA, 924 bp, Glycine max
  Peptide Sequence Number=SeqID_226680
atgcaaagggggttccaatctgaaccctttgatgtacaaatgggagatcacctagaggatatgattcgtgatcttggacaagagtcttttcagcaagcacatgtccttatgtatgatacatttcaagctgattcaaataagctgatgtatcccaggtgcaacaattcgttgacgatgttgttagcggtgttaagtttggttaatctcaaggccagatatgggtggagtgacaaaagcttcagttcactacttcaagtagtgcatgatatgcttctagaggaaaacatgctaccaaaagtttactatcagacgaagaagatactatgttcgatggatatggagtatcaaaagattcatgcttgccctaatgattgcatactgtacagacatgagtttgaagaaatgctcaaattctctcaatatggggtatggcggtacaaagtgaagggtgatgacaaatatagtagtgacgataactcaaagaaaggccccctaacgaagggaaaagaagaaagaaatctaaggcttggacttgccactaatggaatgtacctatttggcaatttaagcattcaacatggctcgtggccagttttgcaagttatttacaaattgcctccattgttgggcatgaagcaaaaatacatgatcttgtctataatgatctcaggcccaagacaactagggaatgacatcgatgtttttcttagtcccttgattggtgacttgagaaagttatgggacgaggaggtttcagtgtttgatgggtttcgaaatgagactttccatttgcatgcaatgcttttttgtaccattaatgaattcccagcatacgagaatttgagtggatacaatgttaagggacatcatgcataccccatctgtgaagaagagataagctacatacaactgaaacatggttga

SEQ ID NO: 109903 - DNA, 372 bp, Glycine max
  Peptide Sequence Number=SeqID_226681
atgaaggccatgtttgattgtgatggctacttagccaaaaagctgaccatgtgcttgaatgaattatcccttgtacccacatcatccacaggaagcgtggttcaaagcaaatttgtcccaaatttgggggaggcactgggtaagaatggaagtggtcaaacatcaatgaggtccttcaatggtgattttccaccatggagatgcagtagacggcaaaggagaataggagaggggaggcaccatccactagggaataagccatggaagaaggagcttcaccaccaaaaatgtgccttggataagaagcttgaagaggatgctttaatggaggaaaagaaagaaagaagggggagcacgaaattgaaggaataa

SEQ ID NO: 109904 - DNA, 372 bp, Glycine max
  Peptide Sequence Number=SeqID_226682
atggcaagtcgaggaaaaacccagggatctggcacaaccaaaaagggcatctcccgaagcaacaaagctggtctccaattcccagttggtcgtattgctcgatacctcaagattggcaagtatgctgaccgtatcggttctggcgctcccttagcggggaatgccgcaatggacaacaagaagactcgtattatgcctcgccatatccaattggctgttaggaatgatgaagagttgagcaggcttctcggagatgtgactatcgccagtggtggtgtgacacctaacattcacaacatgttgctgcctaagaaggttgggacctcgacctcaacctttatgggtcctagtgccgatgatgacgacgcttaa

SEQ ID NO: 109905 - DNA, 1824 bp, Glycine max
  Peptide Sequence Number=SeqID_226683
tgcacaagaccaccatttgagttaaatcctcctccggggagagtagcaaataatggagtgcttcctttgaaacctcctcctggaaggcctgatcttcttcctcctgatccgtgttcaattaagccttctgatagttccattgttccttctcctccacctcccccacctcctccacctggacctcctccacctcctccacctcctagcggtggccctcgaccaccgcctcctcctagcaatggccctagagctcctccaccaccaccacttagaggcaagcctggtcctagacctccaccacctcctagagttggtggaggtcctccaagagcaccacccccatttggttcaaaggttgctaagactcaggaagaagttggagcaaattctgaaggtgatcaagctaatgctactaataaagctaagctaaagccttttttctgggataaggttcaagctaactcagatcaaacaatggtctggaatcaactcaaagcaggatcattccagtttaatgaagaaatgatggagacgcttttttgctataatactacgcctgtggacaaaagcaaagggcaacaaaagaaagagacttcctccccggcagcttcacctcaatatatacagatcattgactcaaagaaatcacaaaatttatctattctattaaaagcattgaatgtgacaatagaagaagtctgtgatgcacttcttgaaggaaatgagctccccacagaattcctccaatctttactgaagatggcaccaacatcagaggaagaacttaagcttagacttttcaatggtaatttagcccaacttggtcctgcggataggttcctaaaagccctagttgacattccatttgcttttaaacgaatggaagcactactttacatgggtactcttcaagaagaactcactagtactcgagaatcttttgcaattttagaggttgcctgcaaaacgctaagaagcagtagattgttcctcaagcttcttgaagccgttctcaaaaccggcaaccgtatgaacgatggaacgttccgtggtggcgcacaagcattcaaactcgatacacttctgaaactatctgatgtaaaaggagtagatggcaagaccactctcctacacttcgttgttctagagataatgcgaaccgagggcataagagctgcacgaatggcaaaagagagccatagtttctctagcataaaaacagatgatcttcttgaagacatttcttttgaatcagaagaccaataccgcgaacttggccttcaagtggtttcacgtttgagcagtgaactcgagaatgtgaagaaagcagcagcgttagatgctgatgcattgataggaacaacctctagactaggccatggactcataaaaacaagagattttgtaaacaaagacctaagtgacatagatgatgacaaaggctttcatgagacagtgaagagttttgtggagaaagctgaggttgatgtcacgagtttgctagaagaagagaagcaaatcatggccctagtgaagaacactggtgattactttcatggggactcagggaaggatgaagggttgagattgtttatgatagtacgtgatttcttggtaatgttggataaggagtgcaaggagattaagaatgcaccaaagaagccggtagtgaaaaatgtgaagagagaagcttctaatcattctagaaagtcgtcttcctcagaaaatcatcctcttccttctgatatccgtcagagaatgtttacagcagtagtggcaaatacaaggatggatgactttagttctgatgatgagagtccttaa

SEQ ID NO: 109906 - DNA, 375 bp, Glycine max
  Peptide Sequence Number=SeqID_226684
atgattgattgtcaggttttgcaattgcgtaatgatccaaatcctgctgttagggaagcagctattttgtgcattgaggcaattctaactcgttcttttactgagaaagactacaagaaaataacagtagctacaacaaggacactccaaatgatcaagaaagccaaagagctagcaatcctctgcactgcacaagttggccttgtcatattctcctgcacgagaaagctttatgaatatgccagcaccagctttacaaagaatgcgccttacttgtgtaaaaaagatgggattgttcttcagtgcctgcatgattacaatgaatatcttgattaccttctacgtacccaaaatgtattgaccgctagtgattga

SEQ ID NO: 109907 - DNA, 192 bp, Glycine max
  Peptide Sequence Number=SeqID_226685
atggaaacaactaatcaaaaacataacttattacgttctattcacgagttgattcgcaaagatgagtttgttggctccaagttaattacagacagagcaagaatgaggtttcaaattgttcctatgtcaaatatacttggacaacatagaggcaaatatttttccttgcccagaaaaaaagataaagtttaa

SEQ ID NO: 109908 - DNA, 668 bp, Glycine max
  Peptide Sequence Number=SeqID_226686
atggcaattcaacaatatatgggtatcattacggttatattttgcatcattttggcttttaatattatggcagtagtcagcattgaagagaagaaaactcaagaagaattcattggccaactatttgatccagcatctggactattgactgaagacacggcagaggtactatggatcacttgcagggaagattttattcttttaaagaaagaagttggagatcttgacttatgcctcccaaaggaatcatacagaaacaccaatgaaattagttcagcaattggctcaatagctagagaaaacatcaaaaaattgattagtacatgttatcctcagttaaaggaaaatgttcttcactgtttgagaaaaaacaattttccattcaatgttctccagcaagagggtgactccaagatttggcatgccacttacatgggatcactttcttctagaagatatttgggtcgagtttttccccagcacgtatcagaaatatcaatcaaggaagatgaatcaccaaaaaggaataagcctaaggatcaagactccgataaaaaagacaaaaaaaagaagtccaagtcttctgactctaaggacgaaaacaaaaacacatctaatggctataattacaatagtggcaattttagttgctgcattgttctttttat

SEQ ID NO: 109909 - DNA, 753 bp, Glycine max
  Peptide Sequence Number=SeqID_226687
atgaaggccagaaccttcaagatgcaaaagctcccaatgtgtcttcctcttgcgtggcgctcaccgacaacgttgccactgccgccaatgacagagactgtttttagggttttgtttcacaagaaaatacactttgtcccaaatcgccgaagaagctcagcactaccaaaagcaagagatgtcgacttagtggagtttgatatgaaggatgtgtttcttcacataaagttgatggagcaagcttcagagagtgaccagcctacgattttcactcaagaggagtgtgattatgaggttcaggggtctgctttgaggctcacgtttgcttgcaactcttcaatctttgagaagaagggtttcaccttgggggttgtgcttcttgtggttcaatctgggcatgataagttggtgaggatcagggttgaaagtactttgatgtttgccacgaagagaccaaaaactggtgctatgaagcttccctttgggctttgtgggtgccaagaggagaattctaaagggggagagcttgtggagattgaagaagaaaccagtgatggttatcgtgggaaggagtttcaggattcgggccaaaggattcagcttcaggtgcctttgccttcttcatcttttgttgtgttagtggatgaatggcagaccataaagtcaggtggggatgagattgagaaattgttgttgaacttaagatcattgattaatcaggaacaatctatgcctattggttcatgtccttga

SEQ ID NO: 109910 - DNA, 231 bp, Glycine max
  Peptide Sequence Number=SeqID_226688
atgtctggcatattacgtatggctaaaggatatgtggtatccctgtgcattttgggttgtctagcacaagatgtggaaaaatggaaagggatgccaatcaagtcaaagtcctgtgacaaggcattgaacttttcactgctggcaatgaggcttaaggcattggcaatcattcatggggcatctcatagagtagcttttttggcaaaggcagcagggttggaatctacttga

SEQ ID NO: 109911 - DNA, 1944 bp, Glycine max
  Peptide Sequence Number=SeqID_226689
atgatggattatataaaaaggctgaaggtttgcatcaggtggttccaagaccttgagattagctactcactagagcaagaaaaattgaagagttcattggaattggcccagcaaaaatgcacggaaatagagttgctgctcaaaatcaaggaagaagagttaaactcaattattgtggaaatgagaaggaattgcacttctttacaagagaaattagtgaaggaagaaacagaaaaaacagtggctgcggaatctcttgttaaggagagagaggctaggcttaactttgagaggtcacagagtacactacaggaggatcttggacgagcacaacgagagctccaaagtgcaaatcagaagatattgtcactcaatgacatgtataagcggttacaggattacataacaagcttgcagcagtacaatgggaaactccattcagagctttctacagttgaaaatgaacttaagagtgtagagaaagagaaagctactgtagtggagacccttaccatgttaaagggtcagcttactttgtctatggcttctcaagaagaggccacaaaacagaaggatgcattggctagtgaagttacatctctccgagtagagttgcaacaagtgagggatgatcgagaccgccaattatctcaagcgcaaactttaacatctgaattagagaagtctaaagattttacagaaaagtcctgctctgaactgaacaaattgactttaagaacaaatgaactggagacaaaatgtgctttgcaagatgaacggataaaggtactacaagagaagctaactactgctgaggagaaacttcaggtttgtgacatatctgcaagtgagacaagaatagaatttgaagggcaacaaaaacttgtacatgagatgcaaagacgtttggcagatgcggaatataaagttatagaaggggagaagctgaggaaagaattacacaataccattttggccaaaaacattctttcacatatgataaagttttttgcacctgatacatcacaagaagaagtttttattgaaatttcacagcttgtgcaaagtgctcttgatggttataaggtttgcatttttgcctatggtcagacagggtcagggaaaacttacacgatgatgggcaggcctggacatccaggagaaaagggcttgatccctcgttcactagaacaaatatttcaaacaaaacagtctcagcaaccccaaggctggaaatatgaaatgcaggtgtctatgttggaaatatacaatgaaaccattcgtgatctgttagctacaaataagtcatcagcagatggaacaccaacacgtgtggaaaatggtactcctgggaagcaatacatgatcaaacatgatgccaatggaaatacacacgtttctgatctcacagtagtggatgttcagagtgtaaaagaggttgcatttcttttaaatcaagctgcaagtagcagatctgtgggaaaaactcagatgaatgaacaatcttctagaagtcattttgtattcactcttcgaatatatggtgtaaatgagagcactgaccaacaagtacaaggtattctaaatctcattgatcttgctgggagtgaacgtctttcaaggagtggatcaaccggggaccgattgaaagagactcaagcaataaataaaagtctgtcatcattaagtgatgtaatatttgccttggccaagaaggaggatcatatcccattcaggaactcaaagctcacatacctacttcagccttgtctaggtggggactcaaagacattaatgtttgtgaacatctctcccgaccaagcttcatctggagagtcattatgctcactccggtttgcatcaagagtcaatgcttgtgaaattgggacacctcgccgtcacacaaatggacgccctatagaatctcgcttgacctatttctaa

SEQ ID NO: 109912 - DNA, 1458 bp, Glycine max
  Peptide Sequence Number=SeqID_226690
atggtttccccggaaaacagcaattggctgttcgattacccgttgatcgacgacgacgttattcccgtcggcgactcctccttcgccgtctccgcttccaccttctcctggcccccacctcccgccaatgtcagtgtcgaaattgatgcttcgcttggggattctgatggcctaaaaaatcctgctttgaagaaaaggactaaatctgattcaagtactgcttctagctccaaagcgtgtcgggagaagttgaggagggataggcttaatgacaagcctcccaaaacagacaaggcttccattctgattgatgctgcccgaatggtgacacagctgcgggatgaagccctgaagttgaaagactcaaatacgagtcttcaagagaagattaaagagttaaaggctgagaagaatgaacttcgtgatgagaaacagaggcttaaggcagagaaagagaagttggaggtgcaggtaaaatcaatgaatgctcaacctgctttcttgccaccccctcctgcaatccctgctgcatttgctccacaaggccaagcccctggcaacaagttggtgcctttcatcagctatccgggagttgccatgtggcaatttatgcctccggccgccgtggatacctcacaggatcatgtactccgtccaccgccacctatcacaaaggaggatgccatacttcaggccaaaacatccctttcagcaaccttagagaaacctctaaacaatcccaaactgataggcaagttcaagaaactaagacaacccaagttcagggttgaaattccagtcattgatgactcaccagattcactgtcccaacttgctcttgatttttttggggacatgcccatcaaaagaaaaggttctcccatcaagatcttaatgttgtggcctgatgctagcttgaaagaatctgccactattgcctttcagtctcactcaacttttgaacacattgacattccctcagtggccaaaacagaccccagaatcttgaattctgcagatgtggcaatatttttggcgcctgagagttcccaattggcacccataagaagagtgagtgatgccttttatccaaagccagtggttttgtttaatccaaaatgggcatttgaggaagagagcaaccttggtgatctgagtggctttgtggattcttttgaagtggtttattcttttatagggttggaggtgagagggatcttgagcaaaagaaaaggggtgatttttaagtgtgtcagagatggggttgtgagtggagagagatggaatgtttttgtagaagaaggacaagaattgaaggtggtttcatcattcaaggtcaggccaactatagttgaagttgagaatgtattgtacaatctgatggctatcaattctcccataaccaagtctgcaaagttcatccagggattggtatccaatgtgacagggagaaagtaa

SEQ ID NO: 109913 - DNA, 159 bp, Glycine max
  Peptide Sequence Number=SeqID_226691
atggatgaggatcagaagaattggaatgatatgactaagtcttatggtgaaattagtagaagcttagctataagatggaaagatgaattaaagcatatttggcacctcatagatagtaatggaaagatacactctgttaaatacaaccaagatctttag

SEQ ID NO: 109914 - DNA, 222 bp, Glycine max
  Peptide Sequence Number=SeqID_226692
atgaggatcaatcccgaaaattttgtgtttggagtacaaagaggaaaattccttggcttcatgctaaccaatagagggatagaggccaatctggagaagagcaatgccatcattgaaatgaggagtccaaccaacttgaaagaggtacaaagactcaccgaatctatccaggttcctgccgagacttgcagatacaacctaaccctttttcaagctacttaa

SEQ ID NO: 109915 - DNA, 245 bp, Glycine max
  Peptide Sequence Number=SeqID_226693
atgggcccgaaatctaccccaaggctcatgagaaccctagggccttctcgtgcatctctggcccaatcttcttggagtcttctatccaatacccttaggagattaggagcaagaaaggacatgagaaaccacgaaaaacgtttcgaacataggtgtgggaagatgtgtcagtggtctacacatcaaggaagaggcaacatggcaatgttgcaagcgaaagaaggtggtgggtcaaatggtgttgg

SEQ ID NO: 109916 - DNA, 962 bp, Glycine max
  Peptide Sequence Number=SeqID_226694
cacaaaatggatatgccaagagagcattgcaattggttttccagatgcagcaagctggccaaaagcctgattctgtcacattggtcagtattttaccggctgttgcagatatgaagcctttgagaattggaaggtctatccatggttatgctttcagatcaggatttgaatctccggttaatgttacaaatgcccttcttgatatgcacttcaaatatgggcacacaaggactgcaaggttggtttttgaggggatgagtagtaaaagtgttgtttcacggaataccatgattgatgatgttgatgaaggggaggtacctacacgtgttacaatgatgggagctttacttgcttgtgctaatttgggtgatcttgaaagagggaggtttgttcataaattaccggacaagctgaaacttgattctaatgtgtcagtaatgaactctttaatatccatgtattctaaatgcaagagagttgatatagcagcttcaatatttgataatttgaaggagaaaacaaatgccactcggaatgccatgatattacgctatgcacaaaatgggtgcgtaaaggaggctttaaatctattctgtatcatgcaatctcaaggcattaaacttgattgttttacattagtcggtgtaattactgctcttgcagatttctcagtcaaccgccacgctaagtggattcatggacttgcaataagaacttgtatggacaaaaatgtctttgtttccactgctcttgttgacatgtatgcaagatgtggagccattaaaactgcgagaaagcttttcgacatgatgcaagagcgacatgttataacatggaatgcaatgctagacggatatggaacacatggtctaggaaaagaagctctggatctgttcaatgagatgccgaaggaagctgttaagccaaacgatataacatttttgtctgaaatctcagcttga

SEQ ID NO: 109917 - DNA, 303 bp, Glycine max
  Peptide Sequence Number=SeqID_226695
atggccaagtttgattaccagtccatgaagaaggctaaggttgagaaggtggcaaaggttaaggtggcaaaggttaaggctgagaaggctaaggtcaagaagggaattgctgagttttgggccaatgaggttgaaaaggccgaaatagagtgcctccaagccaaagctgattgtgccaaggcaaaaaaggctttggagggattaattaaagccaatgacaccttgctgcaatcagccaaggaatctcgaaagtctcttgaggatgctgaagctatgttaaaagagactaaatccagagaatag

SEQ ID NO: 109918 - DNA, 738 bp, Glycine max
  Peptide Sequence Number=SeqID_226696
atgtctttttctgggggggttgagctcttcggtggaggcaaaatgctttcaccgaaggactaccttatcggaaagtactttaatgatgatcctacccaccatcatggtggttctgatgacagaaacgaccaaggttctagcacgtctgtcggtggcactgccataagtggcatcaccgccattgctggtgagggctctcatcactctgttggtgctggtcctaaccttgatggggaagaggttgaatctcctcttcttattcctccattgaatgtgatagatttggacttgaagtttaccgccgtccaaccttgccgagaaagcgagtgtgtcttcatgcgagcttctccatgtgagactcatttcatgtatatgtactcgacttttttctcaacccttcatctcattgtcctttttgacaagttcgagattgatgttttgagaaagttgaatgttgctcctactcagttacatctgaatgcttgggtggccatttgtgtctttaggactatgtgcggcattttctctatgactccgactaccactaagttttttcatcactactctatgaaagagaacaagaaattaaaggtggttggatttctatcgccggcattcccaatagggctgttattggcctttaaacttttacatataataactttaagggccacttcttctgagtgcgtcttgggactgagtctttgccgatttacttcactcggcagatgcaactga

SEQ ID NO: 109919 - DNA, 555 bp, Glycine max
  Peptide Sequence Number=SeqID_226697
atgaacgagatgcatagaggaatatgtggaatgcactcaagagccaggtcattagtaactaaagtacttagaacagggtactattggccgactatgagaaaagattgcactgaatacgtgaagaaatgtgaaaaagtttcaaatttttggcatcatctctcacttacctgtcgaggaactgcacaacataatggcactatggccctttgttgtatagggagtagacatactcaaccttttcccacaaccaaaagagcaagtgcaatatctcctaaaatcagagtctttgacaaaggagttcaagacttccttgaaggattaggcatcaagcatagaacgactttagtaaaacatccacatagcaatgggcaaactaaagtagccaacaaagtcatactcaaagatgtgaaaaagaaattaggaaaggccaaagaaaaccgggctgaagaactatcggccatactatggacttatcattgtacttctgaatccccaacaagggagacctctttcaaagttattgaagcactcagaaatggaacctaccgactatag

SEQ ID NO: 109920 - DNA, 144 bp, Glycine max
  Peptide Sequence Number=SeqID_226698
atggtggtgacaaggtcatcaatggtgagacaacaatggtttgaaagtggtggtgacaaggttgttgtggtgagacaatgctggctcgaaggtggtgacaatgagattcggcaagaggttgcttgcgatagtgatcctttgtga

SEQ ID NO: 109921 - DNA, 324 bp, Glycine max
  Peptide Sequence Number=SeqID_226699
atggttcaacgcagctgtatacaagtatgttctatctatcttctcaatatttgcggtgaaccctacttgctgccttattttctatcagaagcatcattaaactttggtaagagtctgttagttctaagatatgattatggactgagggctagactagcagtaacggttttgataaaaggtagtgcagcagtggcacataattcaatttccaaggtttatttgacaacaatgacgggtgcacggaccaccgtcgttgaaacttcaaagaacaacgacggtgtactcactaccgacgttgacatactatcaaacaacgacgggtaa

SEQ ID NO: 109922 - DNA, 150 bp, Glycine max
  Peptide Sequence Number=SeqID_226700
atggctaccttggggctggagattttggttgaatctgcctcacaagttatttcgaagctatctgttttatatggtattggtacagagattgcagggatgccaatggaaggcgaccaggggatgaaaattatgattaaagagagttcttga

SEQ ID NO: 109923 - DNA, 122 bp, Glycine max
  Peptide Sequence Number=SeqID_226701
atggagtttgtaacggctccggattcatgtggattcacacatcgtatatcctcaaggataccaatggtaccaccactagccttcccaatgcttcgtaggcgatcctcgtcaactcacacatg

SEQ ID NO: 109924 - DNA, 357 bp, Glycine max
  Peptide Sequence Number=SeqID_226702
atggatttggctgcttcaattgatcagggacatcttcaaaagtttactagagtagtgaaggagtttaatagcataacctcattggtatacttctatatacaaataagagagctatcacaaggggcaagtggtaacgagaaagaacaactcactagtgacgacggcgttggggtgatactcaggcaaaaggcggcgagggagctgaggctagggttccacagcggcggcgggggaggttctttgaacctttataagaagctacaagcaaggtttgagcgcgaaagggcaagaggttcgaaagggttacaagcaagactagggttagagagagttcagcccgaaaggggaaagaggtga

SEQ ID NO: 109925 - DNA, 432 bp, Glycine max
  Peptide Sequence Number=SeqID_226703
atggtacagattatatgtcgtcatcacgacatttgtattagtgtgtcccatttaactgcatccccgcactcgttgtcgttgacacttagcatctttcgagaggctgaaattgctaaggttgatgaagatcaaaagaaaagcaagataaaaaagcggagtcttcctcatggcacttcagaatatcaggctgcttggattgttgatgattctgatgaggggtcggattatgacaatgaaaatgatgatggtatggtgttggatgaaggggaagatcgatcatctggtcaagaggaaaataaatattcagaatttgattgtgatagagcttctcttatattgggagattctgacaaagaaactaacaatgattcagtgatgatggtgttggatatggtggaaatcatggcccctggctgggtttgctttttctaa

SEQ ID NO: 109926 - DNA, 141 bp, Glycine max
  Peptide Sequence Number=SeqID_226704
atgggcgaatctctaagtgacactcacgaaacaagatacaagcgcaaggtcgtcaacaagggaaggtggtcttgcacaaaggctagaagcccttgcatagctagaggaggctctagcaccctcaatcgtgctggtatttag

SEQ ID NO: 109927 - DNA, 459 bp, Glycine max
  Peptide Sequence Number=SeqID_226705
atgaccactcttacacaaatatggatgacgttgctacttagcaacatttcacccagcaaccacaatgccgatctccccctgcggaagtatcagttgggatcgcacccacaagacacccagtggacccagagaagtccaatagggccctggggtttccagctctggttacgggcctctttcaatcctacagggtgcccgtcccccctagcaaggtcatgtcatcgtgacatagggattgcgcctacaagacacttagtgggcccggagaagtccaacagggtcctggggtttccagctctgattacgagccttcgtcagttctacggagtgctcatcacccccagcaaggtcatcaggcctctattaatagggctttcatcgaaaagtacagcgcccccaggcaggcgcagggcgaggcatcacagtagcgggcaacagatgcaccgccaccacctctag

SEQ ID NO: 109928 - DNA, 678 bp, Glycine max
  Peptide Sequence Number=SeqID_226706
atggcattttcatggcggccgcccaggggcgtgccccaggggccgtcgcggaccctgggactttccccaatcggggtgttacatgcggaagtgttcgcccaggtagacgcgccgaacggccggatcgccgacgatttcgtcggggtgaccgtcggtcagcaccttgccttcgctgatgatgtaggcgcggtcgcagatgcccagcgtttcgcgcacgttgtggtcggtgatcagcacgccgatgccgcggcccttcaggaaacgcacgatgcgctggatctcgatcacggcgatcgggtccacgcccgcgaagggctcgtccagaaggatgaagcgcgggctggtggccagcgcgcgcgcgatttcgacccggcggcgctcgccgcccgacagcgagatggcggcgttgctgcgcatatggccgatctgcagctcttcgagcagcagttccatctgttcattgatcttgggcgtggacagcgtgcggccgtccggccccaattgcaattcgagcacggcgcggatgttctgctcgaccgtcaggcgccggaacaccgaggcgtcctggggcaggtacgacagccccatgcgggcgcgcttgtggatcggcatcgcggtgatcaccgagccgtcgatctcgatgcggccggcgtcggccggcaccagcccgacgatcat

SEQ ID NO: 109929 - DNA, 366 bp, Glycine max
  Peptide Sequence Number=SeqID_226707
atggacttgaaggaaaattgtacttatgtcatgcacaattttaaagtgctaaaaaacaacggtcagtatagagtctgtgatcaccaatttaaattggtgtttattggagttgctgttgtaaggcagtgtgttctaaatgacctcccttttagaaaatacaaatttgctggatttgccgatgttgtggctgggcagtttgaacctggcctattggttgacgttatcgatgttgtggatgaggttgtctttcgccatgtttcaagaaaaggtagaagggtagtctttaaactaaaggacttgaggcttgcagagttgggcattgaggcccggtcagtttttaaatcccttggtcaaggcagttcatag

SEQ ID NO: 109930 - DNA, 1522 bp, Glycine max
  Peptide Sequence Number=SeqID_226708
ttaagtgtgctcatctccaggctttgcgaaaggagtttgaaacctctcacatgaaggaaggagaattagtgaatgagtaccttgctcgtgttcttgtcatcagtaacaagatgaaagccaatggtgaagatgttaaagacgttgttgtggtggaaaaggttttaaggtcaatgacaccaaagttcaattatgttgtgtgttcaattgaagaatccaaggatatgagtatgctgtcgattgatgagctacaaagcaatttgcttgtacatgaacaacgcatgagtaatattgtccatgaagaacatgctctgaaggtaactcatggtagccaatatgctggtcttgctggacgcaaaatagggcatttgaattttggaggaagcaggcaaaatgttgataaagcaaccgtggaatgctataattgtcacaagctcgggcactttcaatgggaatgtaagaaaggggtggaaaattttgcagaaaatcaggcagagagtgaagaacacatgttattgatggcttatattgaagaaaagaagcagcaaaagacagatgtgtggtttcttgactctgggtgtagtaatcatatgtgcagaaaaaaggaatatttttctgagcttgatgagaatttttcagattcagtgaagctgggaaataattcgaacatggtggttaatggaaaaggcaacatcagacttgatgtaaatggagttatcaacatagttacagaagatgtagcacaactgtggcattgcaggtttgggcacttaagttttaaaggcttacagactctgcaacaaaaaggaatggtggaaggtttaccactgcttaagccaccctctatgttgtgcaaagattgtctggtgggaaaacaacatcgagattcatttcccatgagaagttcttggatagcttcacagattttgcagcttgttcatgcaaacatttgcggaccaattaagccagcctcaaatagcaagaaaagcttcaagttacatgttgataaagcgacgaatatgtcactcaaggggctgcgcactgatcatggtggagacattgaaaagaaagtgcctaaaactttttggccagaagcagtaaattgggttgtgcatgtattaaaccacagttccacgctagcggtgaaggacataacacccaaagaagcctggagaagaatcaagccatcagttcaacattttagagtttttggttgtgtttcttatgctcatgtacctgataatttgagatctaaactagataagaaaagcttgaggtgtgttttactcagaatcagcgaagaatcaaaggcatacatgctttatgatcctatctcactaaggattatagtaagtagagatgtggtttttgaagaaaatgaagaatgggaatgggacaaacatgagtcaactgatatatgtgagctagaatgggaagatgatgaaaagaaactttctaaaggacttgtgggagggaggagtagaaagcaaccggcttggctaagagactgtgtgtccgctgaagg

SEQ ID NO: 109931 - DNA, 126 bp, Glycine max
  Peptide Sequence Number=SeqID_226709
atggaaattctcatcccgagtcaaggtttatggtggtttgagggcgttggtttggccagcagttcagggataaaggggatgtcccacatttatttccatgacacacatacaacaatgatgatttga

SEQ ID NO: 109932 - DNA, 186 bp, Glycine max
  Peptide Sequence Number=SeqID_226710
atggtcctgcatggtggaggaggagtttctagagtggtttggaccacaattcctctcgggttgggatttgcgttgagcacaaaaattcaggttgagcgcaatttctcttgcgctaagcgcaacaattctcgctcaacgctatttcctctcgggttggaattgcgcttagcatgtttctcgcattga

SEQ ID NO: 109933 - DNA, 654 bp, Glycine max
  Peptide Sequence Number=SeqID_226711
atggagaaaatgagagtggtactaattactctattgttgtttataggtgcagcagttgcagaaaaagctggtaatggcaaagctgccaataatcctgcagaagatgctagtgatggcgaagccattaatcttgtagaagaagctggtggtattggtgatgccattactcctgcagaaggcaaagccactaatcttcaagcgtatgagtcagctagattcaaaaagtttgtgacacattgcagctcacatgttgctcaaacatgcagtggaaatgatccattgcatcatcaggaaggtggccatggaataaacgttccacttgggttgtcattttgcctttttgattctatggagaaatgcttgggagaccatgaagccaaacttatagatcccaacccaggtcccatgtcggctattcctaattcaatccaatctcagcaactcctcattgagactgtaaaattcagaactgtcttgaaaacctgtactcgtgttagtgcacaattttgtttaactgctcctaacgttgatacatcggttttaccggcatgtctcgggccatctctcaatcaatgtgtttatcctgcagctggcttcacaagatgcatttacacctggcccgccgctcgaactcccacctattattatttataa

SEQ ID NO: 109934 - DNA, 159 bp, Glycine max
  Peptide Sequence Number=SeqID_226712
atggctaacgtagccgccgggacctccgccgatgaccacgatgtcgttttcgtcagatccggacgcgaaccccctccaccttgtcagaaaaagtgtataaactatctgtgcaaaaagaaagaaaatcatgcgagagaaatgatgtgtaaaaacaagtag

SEQ ID NO: 109935 - DNA, 430 bp, Glycine max
  Peptide Sequence Number=SeqID_226713
atgggggagacacatgaaatgccccaccacaatctagccgacttcaagccttgcctcggatatgccactaaagggcaagcagttggtggtatacccctgcaaaacactttggagtgccctcaatatcacccacaatcacaccccttgcattccacaatgggtaaaaaccctcatgctatggcagaaatgggaaagttggatcatcctgaggaaaggctcaaggccattgaaggaggtgaagattatgcctttgctaacctagaggatttgttcctagtacccaatatcatcacccctcccaagttcaatgtgccagactttgacaagtacaaggggactacttgccccaagaaccatctaaagatgtattgtcggaagatgggggcatacacaaaagatgaggaactattgatacctttattccaagaaa

SEQ ID NO: 109936 - DNA, 177 bp, Glycine max
  Peptide Sequence Number=SeqID_226714
atggagagagatggaaaagaaaggcctaaggaagaaatcaaagtgcaccgaagagaagttcctatgatgaaaggtataagtcttcctatggagaaagtaacacaaacaaactcctgtaggaaatatcacaggcataaaattcagcaggaggcagccaaagaagcgataaacaagtaa

SEQ ID NO: 109937 - DNA, 1266 bp, Glycine max
  Peptide Sequence Number=SeqID_226715
atgcccgttgccacgcccctcttccatcggctgcccctggccgccgccattgccctgaccctgccgctgcccgcactggccgccaatccgaaaccgaccgagctggaccgcgtgcaggtcaaggtcagcaccgccacccgcagcgaacgcctgctatccgatgtcccgatccgcaccgaagtgctgcgcaaggaagacatcgcactgcgcgcggccaccgacttctcgcgcgccgccgagctgatcaacggcctgcgcgtggaaagcaactgccagaactgcaacaccagcgaagtgcagctgctgggcctgcccggtgcctacaaccagctgttgttcgatggcatcccgctgttgtccacgctgggcagcgtgtatggcctggaacagatcccggccgggttcgtcgaccgcatcgaagtggtcaagggcggtggctcggcgctgtacggcccgggtgcggtggccggtgtgatcaacctgattcccccgctgccggcgcgcagcggaggccatgtgcaggccggcgtggatgtcctgaagggcacaccgcagaagaatgccgacgtgcgcctggacctggtggcgaaagatgccgacgccgggctttcagtgattgcccagcgcaactggaacagcggcatcgactacaacggtgacggctacaccgagatcacccgcaagaacctcaaggtcggcgggctgcaggcctggtacgcgccgacgccgggcacgcggctgcgcctggacctgcaggtgaccgatgaaacccggcgtggcggcaatcgactggatcagcccgaatacctggccaacatcgccgaatcgctggatacgaaataccggcgcggcagcgtctcgtgggatcaggaaatcaatgccgacgtcgatttccgcctggcctatgccttcgccgacatcgaccgcgacagtttctatggcggtcttggcgacgtggttaccgatccgtctgcacctggctatgacccctcgcagctggatcccaacgtggccggcagcgcggcctcgcgttcgtggcgccagtacggccgcacccacaacccgctgcactacatcgacagccagttgaactggcggctgggcgcgcacgcgctggccttcggcgtgcagtacaagcacgaggcgctgcgcgacgacaaccgcaccggtgacgggcagcgcttggcgatgctggaagatgcaaccttccacaacctgggcgccttcatccaggacgagtggagcctgcgcgacaacgtcgacctg

SEQ ID NO: 109938 - DNA, 1560 bp, Glycine max
  Peptide Sequence Number=SeqID_226716
atggcggcaccaccgcagaatggcaaggaagattcttttgccaactgccatagacagttcgtgaagggaggcttgctatggcggaatttgggccttctgctgtcctccattgataacactgacctagagactggaagtgtcccagggcctaggttcggggagagcaacgaccataccttcgaggtcgaggtcgaggaggacctggcatccgagcctggagtgcttgttgagggctctggctcgggaattgcggacgaggacgtactcctcgtcgtaggagcgaggggggagcttgtcgagccactcctgggcaatgttgacctcgcagtgggccgcgcaggcgtcgatctcctcgaggcggtgggactccgggtcgaccaggcccgtgttgatcagggccttcagcaaggtctggccggccaggcccaccacctcgtgcttctttcccacgaagtcgatcgccgagagccgtacgatgcggtcggcgaccttcttcgtggaagaggaggtgcggcggtagatcagggatttggagaagaacgagagggaggggaggcggtgcgcttgcgaggacagtctctgcagattcgcgactgccattggtgcttcttgttttgggaagctcgtcgagagtggtcttttggttgggaaatcggaacaaaagaaatgattgggtttggccgtgaaatgggcggaatacaaggtagcaaattcctaggtgcacccattccaatctctgaacgtcctgagttgaagttgtcctctcatgggaggaaggtacaaaaatttggaaggcatgcaccagagattgaaggcataatggttgtcacaggattaagtcttctgattgcatgttccttgggcactggtcacttcactatcaccctcgatgatgtggcatttttgctacacctgcccattacaggagccttccatacctttgatgctcttcatgtagaccaagttgtggacttgttagttgagttgcttgaatggactgtagcaactcgagcacatctgttgcatctagttggttgcacactgttttctaacaagagtgtcatacatgtgcatgtggtattcttggacgcatttcctaacctcagccaatctggaagctattcattgggagcgattgcattggtccatatgtatgacaatttgaatgatgcatcaaaaaaatccgctaggcaacttgtaggatatatcacactattacagtattggatctacgagcatttccctactattgtttcgtgtgtttccgataaggattatcatgaaaggaaaccgcgtgcttgttggtggaagtctgggaaggcattaacagtgtcaacgtatcgtaagcgattggatagattgacgtcaaatgttgtctgttggattccttatggtgatcaccgtgcattcaaagaatttgagcttatctccttattttcggacaaattagatgtggttcataagattgacgatagaaggatgcagttttctgaataccttgcaccggtgggtcagatttgtgttgctcctagacagtgtgcaactgactacatggagtga

SEQ ID NO: 109939 - DNA, 312 bp, Glycine max
  Peptide Sequence Number=SeqID_226717
atggtgagtcggacaatagctaggcctatgcagttgtctgagtttgggaggaaaactgatcatctttccttattttcacaaggacctgcgtgtaaatggcattggggtcagatacaaaaggccctagatcacaggaagccataccgaagttatccctttttggttaatttgatagacggttttgatgatcaagtagactcagggcagtgtaaagctggtgtgcaggaacctattcttaaagaatattgggctttgcaagtgttttcacagttaattaaagaatctttaatttgggaatattactatatgtga

SEQ ID NO: 109940 - DNA, 477 bp, Glycine max
  Peptide Sequence Number=SeqID_226718
atgaggcttcactgttatcaagcgaatcggagacccaacatgactacagatcgacctccactccttatggctcacatagactcgggtatagggcctaatatcacaatgtgtgtgcaaaggtgtagtggagtcgccatctgtcgcaacctaccctcacaacaagatggtgaaggcaaaatagataagccaaaacgttcgtctccaagggagaaaatgaccggagtcgccaccaatgtttattcgaggaaaacgttagaaaaacaaaaaataggtctgggaatttttgaaaataagggtttggaaattgtttatgtatggggaaggttcgacaagggtgttgcccttgctcctacgtatcctcaggcaaaaggccaccctggggtggttgcagctcgcccaggcgagctgaaacttaaccttgaagcagtgagctcgcccaagcgagctggatctcgcccaggcgagctagtcccttag

SEQ ID NO: 109941 - DNA, 648 bp, Glycine max
  Peptide Sequence Number=SeqID_226719
atggaaaaatttgatcatatagaggaaaggataagggtcattgaaagaggcggaaattatgcctttgctgacatggcagagttgtgcctagcgccagacatggtcattcctccaaagttcaaagtgttggatttcgataagtataaagggactacttgccccaagaatcacctgaagatgtactgtaggaaaatgggggcatacgggaaagatgaaaaattgttgatgcatttcttccaagaaagtctcactagggcaatcgtcacatggtatactaatttggaaccttctcgggtccgttcctggaaagacctaatggttgccttcattaggcagtatcagtacaattctgatatggctccgaataaaatgcagttgcaaaacatgtgcaaaagggagcatgaatctttcaaagaatatgcccaaaggtggagggatctggcagctcaagtagcacccccaatgatggagagggcaatgataacaatgatagtgcacacattattagtgttctactatgagaagatggtgggttacatgccttcgagctttgcagatttagtgcttgtgggtgagaggattggagtaggcctaaaaagaggcaaatttgattacgttgcttcgatgaattctggtgataggaggtag

SEQ ID NO: 109942 - DNA, 396 bp, Glycine max
  Peptide Sequence Number=SeqID_226720
atgatagggtgtggaagtattggtcatcaaaattttcattctcacaaacatggggtcagaccaagcgccatctttaaaaaaaaaaggttctatcatgtcaaagtcaagaatctagagctagccagcttgcggaaactaaggcagcagatgaatcaagttcagtgtcaaccctttagcaagttagcaccaaccatagaagagttcgaagggatcttaggatgcctgctaggggggaggaagccatacattttttccagattctatccttctatggcaagaatagcaaaagtggtcaagatctcagaacaagagctggaccgagtgaagcaaaataggaatggagtggcaggaaaatgttcggtcgtggaaagtgcaccggatcgcacaagtagttga

SEQ ID NO: 109943 - DNA, 252 bp, Glycine max
  Peptide Sequence Number=SeqID_226721
atgcttgtctacctcattacctacattttcactccaaggtcaagtaatcgtgctcagatagtagattttaccaaagcatctagtaagattactgaaaggcatcttaagaagcttggaatgaggtttgttaaccatgagtggattatggctaaagagctagcagtaggaaacttggaacagatggatgaagaaactaaagctgaagttcaacaagagcttgcacatcaatggagtcgtttgagtctctcatga

SEQ ID NO: 109944 - DNA, 351 bp, Glycine max
  Peptide Sequence Number=SeqID_226722
atggcgggaggcagtccttccaccgcaaaatgtaagggttgtgattggggcgatactgagggccccccaaagtgtttggcaggggtacaccaccaactgcttgccccccaacggcgtatccgaggtgtggttcaaagtcggctagattatggtctcggggtgcttcatgtgtctcccccatgggttgagacacatagttgtcgacattctcatcgggagcatgtgcaacatcgggtggtgtatagttgggaggcaagccatatggtgggaaagaatgcttgctctggacctgcacaaaatgggggccgccctgacctaccatatcctagactggacgatttacttgattga

SEQ ID NO: 109945 - DNA, 408 bp, Glycine max
  Peptide Sequence Number=SeqID_226723
atgtctggacctggtgccagcggagtccctaaaagcaacatcccgctgatccctggtcggcatcgtttatggttgagactaggacgcaccggaggcacgacccggccagttaaggacaggagcgcatcgccggcagaagggacgagccgaccggtgcacaccggaggcggaccgatcgacccaacccaagctggaattaccgcggctgctggcaccagacttgccctccaatggatcctcgttaagggatttagattgtactcattccaattaccagactcaatgagcccggtattgttatttattgtcactacctccccgtgtcaggattgggtaatttgcgcgcctgatgccttccttggatgtggtagccgtttctcaggctccctctccggaatcgaaccctaa

SEQ ID NO: 109946 - DNA, 540 bp, Glycine max
  Peptide Sequence Number=SeqID_226724
atggaggtcgctttctgccttgctgtgaagagctcgcgaattcatctcgttttgacgataccatgccaatccgccgattgccgcactggcaaaaagcacggacgcaaagccataagctgttattctgatccagatcggtttttttacggtgatgacggacacttgaatttccccaggcatgattgcttccccgcgccgatcgttatttatattcgtaatccgttgactgcggcccaaggttcgaactttactcgccccggagatgtccgcggttctttttcggacagcgggagcactgcgacatcgacaagatcggctatcatgaagggcggaatgtcgcagctgaaggtggacgcaagcgagagagagctagcttcgactccagcctgcggggctcgaggcgatcccgaattccggaatcctgtgatgagcactgcgcccaggaacagcgtcatatcaaggcgctttttcaggcgcgttgctgagctgagaactcgggagatacagtgcagcgctggtcccaacggcgtcagtcaaaag

SEQ ID NO: 109947 - DNA, 302 bp, Glycine max
  Peptide Sequence Number=SeqID_226725
gtgttgagggaagaagcccaaagtttctagaagctctagatttgaggtcaaatccatttcaagggggaggggatgatcctaccccccgagggcattggatagaagactccaagaagattgagctagagatgcaggagaaggccctagggggtgtgagtagcccctccttagcttctcaaggaagctttcttctttgctatgatggttcatttgatggttattggatcccagacctaacaaagggtgatggagttgcagcgaaagatcatgcagaagaggggacaggaggtgccatccaataa

SEQ ID NO: 109948 - DNA, 249 bp, Glycine max
  Peptide Sequence Number=SeqID_226726
atgtcaacgttcatcatgtgtacactttttttgttgttgttcattgtgtttaacatcggtgccatcaaacctccttgtgaaaaagggattatgattgggtcccccaagagaaaaagttttatgaaggttgagaagtctagaaggaaaaggcaaagatgtaagtatgaagcccctactctatttcaagacaagaagcttcaagagaagtttaatgctagatgggtcaacaagaaagtgatcaatgtgtaa

SEQ ID NO: 109949 - DNA, 611 bp, Glycine max
  Peptide Sequence Number=SeqID_226727
agcttaactatgtcaaatttactgtgtgtgttttcaaatgtaaattggttgacaacaacaccggtgtacgcactgatgatgtaggatttacgttggtaaacctaaagaaactagcttacctgaatgatcctttcatcatggcagaacaagctaaacaagtattttatgtgcaagaccattctgatgaaaggtggtgtgtggttctacatgggaaaacaattggtgttaatgtagaagatgatgattcatacattgacacttatgttagtcctttgtccacacaaatcagtcctaacattgacggagaagaagaacttgacgacattcatgctaaccttgtttctccagcaaaacctccacaaaggccggatcctgaggttaactgggatgctaccgtgttcagagtttttaatccagacttcccactgtacataaagcacgaagatctctccgaaatcgtacacggtggtcaatgtctcagcatatctatcatacaattgtggattctgccagacaactaccttaagggaataattaacagtgctttgaaaggacttaatgatactccacaacctaaatccaaggctgctactaggtggattgtcattaag

SEQ ID NO: 109950 - DNA, 363 bp, Glycine max
  Peptide Sequence Number=SeqID_226728
gttatacgaaccggttctccacgcaatcgagagaatgttgctgctgtcttgtggtcactatgcaccggagatccactgcaattaaaactagcgaaagaacatggtgcagaagcagcactgcaggagttgtcagaaaatggaactgatagagctaagataaaagctggaagcatattggaactcttgcagcaaatggaagggggacctgctatcaagtcagcagcaacagcagaactaggtagtcaaaacggaaagaaattggaaggtgggaggtggggagaagttaagattttgggaggacccttggacacaaaatgctataccattaatggacaaataaccaaggctgtaccgaatttctga

SEQ ID NO: 109951 - DNA, 825 bp, Glycine max
  Peptide Sequence Number=SeqID_226729
atgcacccttgcttgtatgaagatcaccttgggacaaactacaatcttagggataggttgaaacgtgacaagaagattttagttggccaatctacaccatctgcacgaagctcttctgattcatctgtaggagctgagaacagaacaccaagtcctcatactgaagatccctctgatgcaaattcaggtcttgacagatgtgccaccgtacgcatccctttgggggcaaatcatcaagctgaaataccagaatggaccggtgtgatttctgaaggttattctaagttttcagggaccccgatatggccattggcaacagcaaataccagactacttattgaaagggaccctataggaaagggaagacaagattcatgcggctgccctgtaccaggttctgttgagtgtgtaagattccacattactgagaaaagggctaaagttcatctggaattgggggcagtattttatgactggaattttgatcaggtaggtgaagatgttaagctattgtggatggaagaagaagagaaaaaattcaaggatgtgatacgatcaaaccctccatcacctgagacatatttctgggaccatatctttagggcatttcctacgaagagcagggcagatttagttagctactacttcaatgtctttattttggagcgcagaggataccaaaataggcatactcccaataacattaacagtgatgacgaggacgatgaagctggaccactgaggaatgttttcggacagcagacacaaaattcgcgtggttccatcttattaacccccaaaaagtcacagacaaagaaaaagtag

SEQ ID NO: 109952 - DNA, 192 bp, Glycine max
  Peptide Sequence Number=SeqID_226730
atggctaccattgcattatcaagtagatatgggagcaagttagcatatgacaccggaatttggggtgaatcctacaagttttttgctacaaaattcctttttggtttgcgctataggtggtgtttgggcattgtgcatttggaatgtgatggaagcttgcttgtggggcttctatggaggctggatctttga

SEQ ID NO: 109953 - DNA, 1272 bp, Glycine max
  Peptide Sequence Number=SeqID_226731
atgacctacctacaactgtctctgtcaagctggatagagataactatctcctatggaagtcactactacatcctaggaacaaaagaatgccttgaacagtttgttaacacaaatgacacaactgtgaaaatcaattctgactatgaagaatggattgctcatgaccaagctctcctagggtggctaagaaattcaatggccattgacattgcaacacagttgctgcactgtgaaacctctaaggaactttgggatgaagcccaaagcctagcaggtgcacacacaaaatcaagaacaatctatcttaaatcagagtttcacaacactcgcaaaggagaaatgaagatggatcagtatcttctcaaaatgaagaaccttgctgacaaattaaagctagcaggatcaccaatctccaactcagatttgacgattcaaacactgaatggcctagatgctgattacaatcctgtggtggtcaaattatctgatcaaatcaatcttggttgggttgatctacaagctcaactattggcctttgaaagcagaatagaacaactgaacaatttcagtaatctctcaatgaatgcttcagcaaaccttgcaagcaaaacttattccagaggcaacaaacctagaacacgaggcaactggagaggctctaacttcagaggaggtagaggaagaggtagatctaaaccaacatgtcaggtatgcaacaagtttggacatactgcagtgcaatgtttttatcgctatgacaagtcatacacagaatcaaatgctgagaataacacgcaagaaaatcacagtgccttcatagcctcaccctaccacggccaggactatgaatggtactttgatagtggagctagcaatcatgtgactcatcaaaatgagaaactccaagatctcagtgaaagcaatggtaagaattctttgttagttggcaatggtaaaagattgagcatattggcctcaggctcgactcaattgaataacctcaacttgcctaatgtcttgtatgtcccagaaataaccaaaaacttgttgagtgtatctaaattaactgcagacaataatgctcttgttgaatttgatgcaaactactgctatgtgaaggacaaactgacagggaaggcactactaaaagggaaacttagagatggattataccaactttcaagtgtcaactctcaagtcaataaagacccatgtacctacatgtcagtcaaggagaattggcatagaaagcttggacaccccaacaattaa

SEQ ID NO: 109954 - DNA, 270 bp, Glycine max
  Peptide Sequence Number=SeqID_226732
atgatgtactggcaacaatcacggaaaggtactcatttatggacaccatggtaccgcaccaacaaaaccaggggcatagtcttggctattcctaacaaggataggcactgcacggggcatccaaattccaaaaacactaactataatcacggtaaaattgatttggaaagtgcaccgtactgtgcaagtgcaactgcatttcagttgccgcatcacaaacagtgtagctcatttgggtctattgaggtgcatgctttattagatcactga

SEQ ID NO: 109955 - DNA, 771 bp, Glycine max
  Peptide Sequence Number=SeqID_226733
atgaggggcaccgtgcatgagcctcaagcaaaccaaggggcagatcaaaataccctcacccttagaaggctacacgccctcgccttcagaggactacacgccctcgccttaagaaggctgcacgccatcgccttcagagggctacaagccctcgccgtcagaggactatacgtcctcacctccagaggagtacacgtcctcgccttcagaggactacacgtcctcgcctttagaggactacacgtcctcaccttcagagggcttcacgccctcgtcttcagaggactatacctcctcaccatcagaggattacacgtcctcaccttcagaggactatacatcctcaccttcagaggactacacgtccttaccttcaaagggctacacgccctctccttcagaggacaacacgtcctctcttccaaaggactacacgtcctcgccttcaaaggactacacatcctcgcctttagaggactacacgtcctcaccttcagagggcttcacgccctcgccttcaaaggactatacgtcctcgccttcaaaggactatacgtcctcacctttagaggattacgcgtcctcaccttaagaggactacacgtcctcaacttcagagggctacacgccctcgccttcagaagactacacgtcctcgcctttagaggactacatgtcctcgccttcagaggactacacgtcctcgccttcagagggctacacgccctcgccttcagaagactacacatcctcgccttcagaggacttcac

SEQ ID NO: 109956 - DNA, 321 bp, Glycine max
  Peptide Sequence Number=SeqID_226734
atgaagcttgcttctacagttgttgacaaactatgtagacaacaccagtatttctctgatattatgaacaaaaaagccaagtatagaaaagcatgtaaaaagcctttcttggagattaaatgtaaagagaaagcttgtcactgctcactaaagaaaaagaaagccctaccaagtgacgctaagacgaagaagaggccattagagtttttcaaaaaagctagaggaaaggaaaggctaggggacaaagatgttttatctgcaatcggtcaagacactttgcaaagaattgtccaaagaaatcaaaaaaggtcgtcaagctaa

SEQ ID NO: 109957 - DNA, 267 bp, Glycine max
  Peptide Sequence Number=SeqID_226735
atgccatcacttgtttcctcaaaagaaaggaacttaaaggggaaacaaagccaaaaggaagggaaaaatgatattttcacaaagattactgaccctaaatttgcccgggctagcatccagctcgcttgggctaaagatgtaacttcagccctaagcaaccaactcactaggcgagctacaactcgcttgggcaactggatgccttcaccaataagcaacaaactcgcttgggcgaatttgtctgctctccaaggttgttttctataa

SEQ ID NO: 109958 - DNA, 153 bp, Glycine max
  Peptide Sequence Number=SeqID_226736
atggagtcgaggcactacagagttgtgaccgtggattgtggcgtccctaaattaatgactggtttagaaggaaaatcctcactacagagtcctgaatggccagttcacaactctgttcggagtcatttctttcttaccgctcataatctctaa

SEQ ID NO: 109959 - DNA, 771 bp, Glycine max
  Peptide Sequence Number=SeqID_226737
atggggttgtacgtccaaagtcaagattgtacaaagctggtggcgttgggaaaaattcatgatggaccatctaccatacattgcgtagcctatgcaaatgatgtcgtaagggttagcgtcgaaaaagtaattgatggtgaagctgaagttccattagcaacatcagaaattaagtatgtgagagatgccattaacacattcattgcatggccattgcctttgcattcaggcatcactccagacaaagtttccaatgctgccgaattaaacaatgatgttcctaaacatgaccccttgcgtgagttgattaagacccttgttgacatttacgacaagcctgttgagtttgtgtgggatcttactgaatttgggattccaaatcgaaataacatcaggcgacaaatgcttgaacatagtcatacttcaattgtggaccattgtatggattccttgagcctcaatctatacactatgcaaaggacagatgtgggcaatgtgaagaatatatcgaaaaatggcttaaggaatcgcaacgacaactcgcccattggcaaacggttgtgttgtgccctaaagacaatgtcgtggtctggttttgttcatgcatataagaaattaaacacaactgctgatgggaaagtacctaaaactggaccccagtggcttgaactgaagactcgcattcaacgcggaggctatgagtgtgggtattatgtgatgcattggatgtggaacataattggcgtggagttgaagagtgattggagtgtg

SEQ ID NO: 109960 - DNA, 492 bp, Glycine max
  Peptide Sequence Number=SeqID_226738
atgtgtcgcaacctaccctcacgacaggacgacaaaggcaaaatagataagccaaagcgtttgtctccaagggagaaaatgagcggaatcgccaccaacatttattcgaggaaaatgttagaaaaaccaaaaagaggtctgcaaattttgaaaataagggttcaggagttgtttacgcatggggaagggtgttgcccttgctcctacgtatcctcaggtacgatgaggaatttagacctacgtagttctttaagtctgaatgcaaaaggccaccctggggtggttgcagctcgcccaggcgagctgaaacttaaccatgaagcagtgagctcgcctaggcgagctagagcttgcccaggtgagccaaatgctggcctgggtgagctggggcctagcaaaaacaaggaaaagacccttttgccctcctttcttggtatcttttgtcttcctgatcgaaacaccgaatggttccttgctttgcattgtaactag

SEQ ID NO: 109961 - DNA, 657 bp, Glycine max
  Peptide Sequence Number=SeqID_226739
atggcaaagctcagagattcggtgaagtttgatgatgaaaggagtagcaagttgttatctgaaagtaaggaagcttcgccggagataatggatacgaagcaaagaagaagaagggtttcagaagcaaagaagaagaaaggtttcggggtttcggaaagcaaagaagctgaagggtgggagatcgaggcgacggttaccattaaaacgtgccatcgtgttgccattccagggaaactgttagaagaaggaaaaaatgtcaacttctcatcttccttcgatctcgaatcgaagcagacattttttgggggcaatttgttagcccatatttttgatgagctaaaaatatgctctaagttcgagtttggtcaggacctgttcgaatcgaaaagagagaagagtcgtttgaaagggattcccaggttcaaggaagtatttgcgaagtacaaggctaggacaagaaagagggcttcgaatcattgggcgattcgaactggtgtatactcgagtcgaagtcgaggcagccagatttctggacttagcgcaatttctgacaaaactttacaaaatcagttcgacttcgagcaatgtggataccgttctaaggagcagttatgtgcatgcaaggtgtacgtggcaggacacttgcatctacgatag

SEQ ID NO: 109962 - DNA, 126 bp, Glycine max
  Peptide Sequence Number=SeqID_226740
atggctgtggtattagagcaaaagttggattctagtgaacctgttatggtcttgctgtgtggatgctgtgtatctctggatggtggcccgggggagatggcgatcagcggaggctcttcatcctag

SEQ ID NO: 109963 - DNA, 432 bp, Glycine max
  Peptide Sequence Number=SeqID_226741
atgcccggcgatcgccgtgtcgttcgggccgattggcgtgccggccatacgcagcgccaccttaatttccgtggtagcgtcgaccgctgcgcgatcccagggaaggatggcatcgaggcgggcgcagaacgcgtcaaccagctcaatgtggcgaggcgaggacttcgggccggtggcgccgaagcgcatctcggagtaggtgatggccgagaccacgatacgctgatttcgcagcaccgcctgcgccaggcgctgcagtactgcgtccggctgctctcgcatgatgaacgaacagatgcaggtgtcgagcatgccggcgaacgagccccaggtcggccgggcgggacgcaggatgatgctgtccccttcccggacgatctccagctcgcttacgccgtcaaagtccatatcccggggcagacgaatggcgcg

SEQ ID NO: 109964 - DNA, 6846 bp, Glycine max
  Peptide Sequence Number=SeqID_226742
atgcagtcatttcaacagcaactgcttagaaagccagaaggaaatgaagcttttttagcttatcaagcagggattcagggggtatttgggaataacaatttctcatcccctagtgccatgcaactgcctcagcagcctcgaaaattgcatcttggttccaaccaggatacccaccaaaggggtcaaggaattgagcagcaaacgctaaatcctgtccatcaagcataccttcaatatgctctccatgcacaacaaagacctactttaggaattcagtcacagcagcacactaaaacgggaatgttaagctctgcatctctgaaggatcaggagatgcgtatgggacatttgaaaatgcaagacattatgtctatgcaggcagcaaatcaaggtcaaggatcatcctctaggaattcatctgagcgtgttgctcgtggtgacaagcaaatggagcaaggacaacaaatagcacctgatcagaagagtgaaggaaagcctttgacccagggaccaaccattggacatttaatttctggaaatatgataagacccatgcaagcaccagaaacacagcagggcatccaaaatgttgtaaacactcagattgcagcttctgctcaattgcaggctatgcaggcatgggcacgtgaacgtaatattgatttatcacatcctgcaaatgcacacttaatggcgcagctcattccactgatgcagtcaaggatggtctcacaatcaaaggtcaatgagagcagcattggtgctcagtcatcacctgtccctgtttcaaagcagcaggttacatctccagcagttgcaagtgagagctcagcacatgcaaattcgtccagtgacatgtctgggcagtcaggttcttcaaaagccaggcagacagctccacccagccatcttggctcaataacgaatgctggtatagctggtaactccagtgaaatggcaacacagcaattcaatgttcgtggcagagagtctcaagctcctccgaggcaaccagtagtagttggaaatggtatgccctctatgcattctcagcagtcttctgccaacacaaacttcagtgcagaccatcctctgaatgcaaaaacttcatcatctggtccagaacctcctcaaatgcagtacatgaggcagttaaaccaatctgctcctcaggctggaggtccaacaaatgaagggggttcaggaaatcacgccaaatctcaaggaccaccaactcaaatgcctcagcaccgaaccagttttacaaagcaacagctacatgttctgaaagcacagatactagcatttaggcggctgaagaaaggagaaggtactctgcctcaagaacttcttcgggctattgttccaccacctcttgagatgcaggtgcaacagccaaatcatgctgcaggaggacaaaaccaagacaaacctgctggaaatattgtggcagaactaataagcccaattgagtccagtgctaaggagccactgtctatacctagtattaatggtcagagttctttaaagcaggaatcctttgtcagagatgagaaatccattgtacccgcagttcatgttcaagctgttgcacctcctgtgtcaaaggaatctgctccaacattatctgctggaaaggaagagcagaaatcaattggatgctctgttaaatcaaaccaggatggtgaacgtgtaaataataatactgttagaaatgagttagcattagataggggaaaggctgttgcaccgcaggctcatgtatccgacacaatgcaaattaagaaacctgcacaaacgagctctgttccccagccaaaggatgtgggatcaaccagaaaataccatggacctctatttgattttcctttctttactaggaaacatgactcctttgggtcatcaatgatgctaaacaacaacaataacttgtcactagcatatgatgtcaaagatcttctttttgaggaaggcatggaagtacttaacaagaaaaggacagaaaatttaaagaagattgaaggtttattggcagtaaacttagagaggaaaagaattaggccagatcttgtgctgaggctccgaattgaagagaaaaagcttcgcctagtagatcttcaggcacgtttaagggatgagattgatcaacagcaacaagagataatggcaatgccagataggccatatcgcaagtttgttaggctgtgtgaacgtcagcgcatggaacttgctagacaagtgcaggcatctcagagagcagtaagggagaagcaactcaaatctatatttcagtggcgtaagaagcttcttgaggctcactgggccattcgtgatgcccgtactgcccgcaacaggggagtcgccaaatatcatgagaagatgttgcgggagttctcaaaacataaagatgatgacagaaacaaaaggctggaagccttaaaaaacaatgatgttgacagatatagggagatgttgctggagcagcagactagcatccctggtgatgctgcagagagatatgctgttctttcgactttcttaacccagactgaagagtatctacacaaattaggaagtaagataacgactgctaaaaatcaacaagaagtagaggaagcagcaaaagccgctgcagctgctgcacgattgcaggcatgcttcattaagtcgtctccccccttccccctcctcttctaccaatgttttgagaaaagtcttaatttttctcccctttttctatacaaattagtttggaggttgtactatttgaacttgggtctttctgaagaagaagtcagagcagctgcagcttgtgccggagaggaagtgatgattagaaatcgttttctggagatgaatgctcctagagacagctcatctgtcaacaagtattacaaccttgcccatgctgtgaatgaaacagtcataaggcaaccatcaatgttacgagctggaacattgagagactatcagcttgttggtttgcaatggatgctttctttgtataacaacaagttaaatggaattttggcggatgagatgggtcttggtaaaactgtacaggtcatggcattgattgcttacttgatggaatttaaaggaaactatggcccacatcttataatagtcccaaatgctgttttggtcaactggaagagtgagttttataattggttgccatctgtttcatgcattttttatgttggaagcaaggatcaccggtcaaaattattttcccaagaggtttgtgctatgaaatttaatgtccttgtgactacttatgagttcatcatgtatgaccggtcaaaactttcaaaaattgattggaagtatatcataattgatgaagcacagagaatgaaggatagagattcagttttagcacgcgatcttgatagatatcgttgtcaaagacgtcttcttttgacaggaacaccattacagtttggtgccatcaattgcaacaactctgttgcagaatcgttttttgtaaactcgggtaagctcggtcaggatcgctcaaattgtgagtctatggacggtcaggatcgctcaaacgatataattttttttatggaattattaatggaactctggtctctcttaaatttacttcttcctgaagtttttgataataagaaagccttcaatgattggttctcgaaaccatttcaaaaggaaggtcccactcaaaatgtagaggatgattggcttgagacagagaagaaagttattattatccatcgacttcatcagattcttgagcctttcatgctcaggcgtcgtgttgaagatgttgaaggctcacttcctccaaaggtcagcatagttctgaaatgtaaaatgtcagctgtccagagtgccatttatgactgggtcaaatcaactggcacccttcgtcttgatcctgaggatgagaaacgcaagcttcataggaatccagcataccagatgaagcaatataaaactttaaacaatagatgcatggagctgcgtaagacttgcaatcatccattgcttaattatccattcttcagtgacctatctaaggaattcattgtaaaatcatgtggaaaattgtggatcctggataggatcctcataaaacttcaaagaactggacatcgagttctacttttcagtaccatgacaaaacttctagacatcttagaagaatatctacagtggcgaagacttgtatacagaagaattgatgggacaactagtttggaagaccgtgaatcagcgatagtggacttcaacagccctgattcagattgtttcattttcctgctcagtattcgagctgctggacgaggcctcaaccttcagtctgctgacacggttgtcatttatgatcctgatccaaaccctaagaatgaggagcaggctgtggccagagctcatcgtattggacagacaagagaagtcaaagttatatacatggaagctgttgttgacaaaatcgctagtcatcagaaggaggatgaactgagaagtggaggcactgttgatatggaggatgaacttgcaggtaaggatcgctacatggggtccattgagagcctcataaggaacaatattcaacaatataagatagatatggctgacgaggttattaatgctggacggtttgatcaaagaacaacacatgaagagaggcgtttgactttggagacattattacatgatgaagaaaggtatcaagaaactgtccatgatgttccctcactgcaggaagtaaatcgcatgattgccaggagtaaagaggaaattgaactgtttgatcaaatggatgatgaacttgattggattgaggagatgacacgttatgatcatgtgcctaagtggcttcgagccaatacaagagaagtaaatgctgctattggtgctctatcaaaaaggccatcaaagaacactttattgggtggcagtattggcatggaatcaagtgaatttggttctgaaagaaaaaggggacgacccaagggaaaaaagcatcctaattataaagagttggatgatgaaattttggaatactctgaagtaagttctgatgaaagaaatgaatatgcacatgaaggagaaataggagaatttgatgatgatgggtatagcgtggctgatggagctcagaccattgataaagatcaactggaagatggtctgctttgtgatgctggatatgaatttcctcaatctttagaaagtgctagaaataatcagatggttgaagaagctggctcctcaggatcgtcctcggacagtcaaagagtgagacagatagtatcaccatcagtttcctctcagaaatttggttccctctctgcattagatgctcggccaagctccatttcaaaaaggatgacagatgagttagaggaaggggaaattgcggtatctggtgattctcacatggaccatcaattgtctggaagttggattcatgatcgtgatgaaggtgaggatgaacaagttttgcagaaaccgaagattaaacgtaaacgcagtcttcgtgttcgaccccgtcatgccactgaaagacctgaagaaaaatctggtagtgaaatggcatctcatttggcagtccaagcagaccacaaatatcaagcgcaactgaggactgacccagaatccaaattatttggtgactccaatgccagcaggcatgaacaaaactcaccatcgttaaaaaataagcgaaccttaccttcaaggagagtagctaatacatccaaattacatggatctccaaagtcaagccgtttgaattgcatgtctgtgccttcacaagatggtggtgaacactccagagaaagctgggaaggaaaacctatcaattctagcggatcttcagcacatggcactaagatgactgaaattatccagagaaggtcctcgttgaggcttatggcatgccctatcctaggaatggggaaacttccccttccccctaaaaacaaagttgctgagtgcaaaaatgtaattagcaagctccaaaggagaatagacaaggaaggccatgagattgttcctttgttaacggatttgtggaagaggattgaaaattctgggtctgtaaatagcctgttagatctgcgaaagattgatcagcggattgataaatttgagtataatggagcaacagagcttgtatttgatgtgcagttcatgttgaagagtgcaatgcatttttatggtttttcacatgaggtaagaactgaagcaaggaaggttcatgatctcttttttgatatcttgaaaattgcatttcctgatacggacttccgagatgcaagaagtgcactttctttctccagtcaagctactgccagtacagtaacatccccaaggcaagtggctgtcggccaaagcaagaggcacaagctgataaacgagatggaaactgagtcatatgccttgcagaggtcactgcaacggggatcagcttctagcagtgaaaacaacagaattaaagttcatttgccgcagagggaatcaagaactggaagtggtgggggaagcagcactagggagcaacagcaggatgattcttccctgctcgcgcatcctggtgaacttgttgtatgcaagaagagaagaaatgacagggagaaatctgtggtgaaacctaaaactggtcctgcctcaccatctagcatgagaactccagggccatcttcagtcaccaaggatgctagattatctcaacagggttcccatgcacaagggtgggctggccaaccatctcaacaaccaaatggatctggcgggccagttgcctgggcaaaccctgtaaagaggcttagaacagattctgggaagagaagaccaagccatacatag

SEQ ID NO: 109965 - DNA, 184 bp, Glycine max
  Peptide Sequence Number=SeqID_226743
ggagaggttggtagttgacagagtgaaagaagggtgtgtgcgcctttatgccaaaaacaagggatgtagggtcgagttccctgcggtcactgatttacggaaagtgtccattgagagtgcccttggctttttctctaaattaccagacaatccctctcttaacaaaattcattttataaaataa

SEQ ID NO: 109966 - DNA, 669 bp, Glycine max
  Peptide Sequence Number=SeqID_226744
gccaagttaatgaccgggctcaggcgctcaaaagtgaggctgtcaaagacaacccttttggctcgagataggccggtgatcagagaaggaaacctaagtctagaagagttagattgggctatagaagtcatctggccagaaatgagagctcctatgttcatgtccatgcgagagactagaccaaagattagcctagctctatccactatcaggtcagaggtgtgcgatgtggtggccaggcagcctgcagtatctggagtatgtgggcaaagtctcaccctctgccaacacccaggtgtctctaggaatgtgttgaggctgttagcatcgatcttcactagatggcctctgaccctggcttgctttgctgaaagaccctcagagctatatagggttgcgcttagcggtacaatgaaattcaaaaaattcactaagtatgggagcttagcgagccaggctcgcttagcccaatggatgccacaacgaaatgcgcttagctcaggaaggcccggcttagcgcgcagttttcaacaaaaaaatttgactaagttacctaggcttagcgaatcagccttgcttagccacaagtatcttaacaggatgatgagtgttcatcctcacaagatgaactcgcttagcgcagtaggcgtgcttagtgagttcgtctaa

SEQ ID NO: 109967 - DNA, 741 bp, Glycine max
  Peptide Sequence Number=SeqID_226745
atggccctcaccttcggaggactgcacatcctcgccatcagagggctgcatgccttcgcgattggaggactacacatccttgccatcagagggctgcacctcctcgcctttagaggactacatgtcctcgccttcagaggactacacgtcctcgccttcagagggccacacgccctcgccttcagaggactgcacgtcctcaccttcagagggctgcacgccctcgccttcagaggcctgcatgccctcgtcttcagaggactgcacgtcctcgtctttagattgctgctcgcccttgccttcagaggactacacgtcctcgccatcagaggaggactgcacgtcctcaccttcaaggggctacacaccctcacctttagagggttacacgcccttgccttcagaggactacacgtcctcgtctttagggggctgctcggcctcgctttcagaggactacatgtcctcgctatcagaggattgcacgtcctcacctttggaggacttcaagtcctcgccatcagaggactgcatgtcctcaccttcagagggctgcacgccctcgtcttcagaggactgcacgtcctcgtcttcagagggctgcacatcctcgccttcaaagggcgacacgtcctcaacttcagagggctgcacaccctcgccttcagaggtctacgcgtcctcactttcattgggttgcatatccgcaccttaagagaatttaaggttctctactcttaa

SEQ ID NO: 109968 - DNA, 826 bp, Glycine max
  Peptide Sequence Number=SeqID_226746
atggcgagagatgctgtgaccgacaatgaactgttgctcaaaaaaactgcccgcaggcggttggtaggagcgattaccctggtggtcctgatgttgattatcctgccttttgtgcttaaggacagagtggtcgaatccagtcatgataatgtcgaaattacagtcgttaatcgccaggccaaccgtgatcccatccttgaattgcctgatgatgaagtggtcatcgataacgaagtggcttcttctgcggggacaacgccctctagcgcagaagtaccagaagcgcgcattgaagaaccttcagctgtcgcgctaacgaaatcacctgagtcgcaaaaactcgttaaaaccgaagcatccaagcctgtagttgcaccagaagcaaccgctcaagctaaacctgtgcctgtggaaccaaaagtggaaccaaaagtggaaccaaaagtggaaccaaaagtggcgccggttcaggcagttgctaaagaagagccagccgtatccgataagaaaacaggaaagttttttgtacagtttggtgttttttctgatcccaaaaatctggaaaacttgcaaacaaagctgaaacaagccggctttgaaacggctagcgaaaatgtagatgctgcaggacaaaaattgcgtctacgtacgcgtacttatgctacgcggaatgaagccgcggccgcgctgaaaaaactacaggcagcagggctcatgcgtggggccatacatgagcttttttcagtactgggctgggtgttggctttttatctggctaaccgtttcaacagccaggtaatgcattacatgccagaacaaattcctg

SEQ ID NO: 109969 - DNA, 201 bp, Glycine max
  Peptide Sequence Number=SeqID_226747
atgctcgctcagcctggaggttcaagcggtgtgcttagtaaattgattctcgttgagcgcatcattgacaactcatctgcttccagaatcttctacgcgcttagccatgaactgctacactcagcagatggctcgctaagccatagaattggcttagcgggcagctcaaaatcagcacttccaccaaacttgcctaattag

SEQ ID NO: 109970 - DNA, 608 bp, Glycine max
  Peptide Sequence Number=SeqID_226748
atggcttccaggaagaggaaatccacagcctcccaacctcgggaactctatgataccacccggtttgttttcgaggttgcttgggagtgttattctcagaacattcactcctggaacatccttccagagaggaacattaacctcttcgtgactgagtacgatgagttcaggcgagagctcatccggcggaactggcataaggcgctgacacagcatatggatgggcacatcgatgtggccctagttaaagaattttacttgaacctgtatgatccagaagataaatcaccaaaacagattcgagtcagagggaagctaataaattttgaagctgcgttgttgaatgctttctgggaaacaccaccagtcattctgccaggggagcagtacccctcatattctattttctgtagggcgtggacacaccctcaggagcttgcctccaagctttgtattctaggacatggatttgttcttaatgttgaaggagcgccctggaggctcctgaggaaggacttgactaccttggccaagacatggagtgtgctctcatactccaacctcgcccccacctctcacacgtctgattttaatatggacagggcgag

SEQ ID NO: 109971 - DNA, 192 bp, Glycine max
  Peptide Sequence Number=SeqID_226749
atttatgtgtccagtattttcgggccagatgtcctggacatcgtatccgacatcgtggatcctgcagcttcacttcttcacttgacttttatcttgccttgtgccttgtgcagcaactccagtattttcgggcaggatgtcctggacattgtatccgacatcgtggatcctgcagcttcaattcttcattga

SEQ ID NO: 109972 - DNA, 663 bp, Glycine max
  Peptide Sequence Number=SeqID_226750
atggaggccatgaaagaccaaatggctgccatgttgagcatgaagaaaataatggaaagcaatgcggctgcagttgccactactagtgccccgattgaggaagacccaactcacccatcgggccttaataaagtaaatcctccagtctcggatatggtaggtcaggggagagaagcattgggaagtacaggtggtccccatgttgtgcagagcaagaattctttcccaccatacggcttgcctcccaactatacaccacccaatgttgcacacgctcccgatgagaatgttaataactccactcccatactcattgagagccgacaaccccaatttgatcatgcacatgtctctcaacccatggggaggcacatgaggcacccgaatctagtaaactttgagcctcacctcagatatgcctttgaggggcaagcattttacggcatacccctaccaaacactttggggggccctcagtatcacccacaaccacaacccttgcattttgtggtgggaagagtccctcctgctatggtggaaagggagaaattcaatcatatagaggaaacactgaaggccattgaagggggcgaaaattatgcctttgctgacatggtagagttgtgcctagttgatgtgccatcattttcttctattttctaa

SEQ ID NO: 109973 - DNA, 498 bp, Glycine max
  Peptide Sequence Number=SeqID_226751
atgcttgcaacatctttttccattgtcactctcaccactaccaatttctctgttgaaagcatttcctcgttgtcgcaccacgtcaaactccaatctacagtatccttcgccactgccagatggacggagaagcaacaacaacaacaacacaggcatgtttcggatttgatccttcaccatatggcttcatgcacgacgttgtatgagattttgggaattcgtgtcactgcgtccgacgaggaaataaaggcggcatatcgacgactggcgagggtctaccaccctgacgtggcaccagcggagcgaaaggaatcctttacgggtgagttcatgaagatacacactgcgtaccgtacactgtcagatcctgagaagcgtgccaactatgatagaagcttgatccgacgccaccagaaaccgctcacaatgtcatcatcatcgttgtgggggttttccggatacactagtcacaagtggaaaacagaccaatgttggtaa

SEQ ID NO: 109974 - DNA, 306 bp, Glycine max
  Peptide Sequence Number=SeqID_226752
atgaccacattggcctctgcttgtcaatcgaacttggggtctccgaatgatgaggtgcggataaccggaaggtgtttctgcttgctaccagactcttgggtcatgatagcaaaaggtggggtggtcgacaaaagcgatgcttttgctcctacgtatcctccatttgtgatgaggaactcagacctacataataaccgtaagctgtctccgcgtgccatcagactcttgggtcacaggataacaaaaaatgtgtgcgggttaccgtcgggtgtctccgcataccaccggactcttgggtcatggtaa

SEQ ID NO: 109975 - DNA, 1914 bp, Glycine max
  Peptide Sequence Number=SeqID_226753
atggagttgatctggctcactgtcaagaagcaaagaggtatgggcgaattcatcgtggggaagtctcctgccatttactgcagcggagaaacgccactgatgccgatttgtggccctgttggcatgcaccactcctttgcaaaccaaagtgatgtctgcgccgggaaggataacgttgaggttcttcccaaagcagtgaggcaaataacaggatggtcaccagtgccaaagaacttggggaagcattattggacgagtccgttgaaatcatcacgatcagaggcaagcttcctctcacatctgggtaaatttctcaacgcagggagagtgcacttgacaaataaaaattggattgcccacaccggaggaactgccgtcatcaggcctggaaggcatgtcatcctgcagtcagacaaggacacacctgcgtcagcggtgctggatcttgggacactggtagatgcgatccatgtggcatctggcgcacatctggagctgttgcggctgcacatccccaacagcggcaaccgccaagtcaagcggccctccgagcgcgtgcgcctgaacgttgccggcgctttcgcgctgtggccctccgtcactgtggcccgggactccaaggtgattggtcattcgcgcttcataccccctgtgctcctgcaaaatgtgccccccactgctgagagcttattaaaagaggcaatcagcgggcggcccatgcagaagccatctgtccgtctgccatccaaagatctccctctgcttcgttttcttgggccattgcatgctggggagcatgacagtgcaaaacctgaggagcaccccggagaaaaagctaaagctcagccggggcggggtgcgcgcgcagatgagctttcaggactgctttctgagccggggctcttgccagcagctgcagttatcagtggtagaatcagcttcggcagatcacccttcgagatgagcttccagtactgcgtgttctactactggtcggatgaggagtgggacagctgcgacaagtttcgcgaggtggccacgccaatcctgaacccggaggaggtccccgacaagctggagtggcgcgcatccgacacccaagtcttcatgaagggccgccagcaaacaacgcaccgcctcattaacatattgaaccgagcagccttcggtgacaacctcctcacagagctgccctttgacaacgagggaaccactggtctgaattcaatgggactcactggcatctgctcctttgcaacgacgagtcaagttaccattgcactcgtgacagcaatcacgagcgaggggagtgcatgctttcctcatatgcacaggaatattgcatttgggggcaatgtattgagcggaacctggggcttgcctgacgtaattgactctatgtgggatgcttgcagagggcaccatgcgcacggagcgaatcaatcacaccttggtgtgcgtgcccaacatcttccgccaagaggagaaaggtgcgctgctgcctgcactagcaacccacacaagcctccaaatggctctgaaaagccgcagcggttgctgtggggcctgctttccaccctcatgtcgaagcgtctgttccctggcaaacctgatgggtttttattgtgtcatcttgtcatcccctggaccctcggctgccagcttgacctgcttaacatgaatggaccttcaggggaagacatagcaaagccagggtgcaaattcctgatcatgccatgcagggcatgtgttgctggtcttgatgtccacgctgacgggcagcctgctgggcgccgttgccatagcgcagtactttgggacactccccattctggggtcagctcgtgggaggcgccttggggacagcagcgacacaagcgacggctccaaccgccgctccctcggctttggtga

SEQ ID NO: 109976 - DNA, 2061 bp, Glycine max
  Peptide Sequence Number=SeqID_226754
atggattcattcaatgatctggaccggtcattgaccaaactgtgcattcaccaaggccgtgatctattgtcacggcctcacaacctcggaccacgtactcgacatacacccgcacgagaaaacgcaaagatcgaatgtcaaaatgaaatcgtggcgttaaacacacctgcggtatttatgggatgtcatcgagacgctctgcagctgacttcagcagtcaagcaaaacattgctgaaggtttccctgtaacgtgcaagggctggctggctgggaatcctcactttctggtaccagcagaagattgtgtgtcacgcggtttcattgtcgaggcaatgatatcacgttttagcgtgcggtgctcctctcatcgaccgcccttagagtggcaattcaggtgccgaagtgctttgcgcgagaaccatcgacgtccattgccaaggtctggcaatcatgtaactctggcccagagctcggaggagctttcactcatgctgagcgacattgagcgagagtattaccgagaggtgagaaaggaccttgcggagtatctggacgtggcagcccctagtgatttcttccagctcctgaatctcgacttgggtgcaacaccattggacgtcaaggcctcttatcgtgcactgcagcgccttgtacatccagatctcattgcacacctcagaccatggaatatgtttccagctaggggtggcgaagacagagtcgcatgccttgcaggtgatgctgctaatgagctggctgtcatcttgaacattgcctactccaccctcatggacgacaacgcccgagacatctacctccaagacgctgagcggttcaggaaggaaggccatgcgtacgatgggcggcccgtgagcaagtggatggggcaggagcacgagcaccgcgctgtgtttgtggatgagaccacctgcgtgggatgccgccactgcacctactgcgcacccaacacctttggcatggcgcgcatcggctctctgcactttgcactgcaaaacggatggtcatttcaccctggcgcccgacgggctacactggacaccaaggctgacagagcactgatgcttggaaattgttgcactgcacaggaggagcactatgggcgggcgcgagtgcacacgcagtggggcgatgatgaggatgctgtcaaagaggctgtggacatgtgccccgttgattgcatcagctttggccgcatgtgggatatggcagaacatgaagtgcacaacgctgcaaatagggagaagcaactggtgctgctggagtttgtcttgaaggcctgcccccgcgaagacaccgccatcatggctcgcagggcggaagctcagtccacacgattcttgggtccaaggcttgggcacgtcaaattgaatgccgggaacatgggatccaagccgtccaagcaggaccccttcagcagggcggaggtgtggctgaggcagcgcaaggatgccaagatcgacgcgcatgactcctcagccagatcccttctggtgataatcttcccaccttgccctttctttcctgccatgcaaaacatcccaggcgctgtccctgtgcgcatgaggccatgctttacttctgccagccgcatcaccatggctttgctgcaagcctctgcaggacttgatacggaggagacagcagctgcaatggcgcgtgcatggctggctctgccgcatcacatccgtgagcagggctggcccggctttgtcgctgaaaacagcgaccagcagggccgggatccgagcgtgaaattcattggattactgatggatctgaacaattatgatgatttgctggagctgtacactggccacaggatgagagcggcagactttgctgatgttggtacccaagatcacaactttgtattagccgttgcatgcatagtaatcaacaaaggggattcagcaaaggggaccaccagggacggtccagatgtgatcagcatgagaaactataggactgcagcatgtcctgttcagatactgagtcaggttcattcgttgctgtgggccatcttgtacaacaagacttaa

SEQ ID NO: 109977 - DNA, 1416 bp, Glycine max
  Peptide Sequence Number=SeqID_226755
atgcatcactttattaagtctgcgtgtccaagaagcacaccgttctgtctggcagaagcagtcacttgggaagcagacacaaagattccggacgtgcacgacggcgcctacaacaacaaataccagcttcgctacaaggaaccagatgatacctcttcgatcaagccctggcattttcaattctgttgcctttgcagatgctttgcctgcgtgtcagctgtggcagctagggttattccaaaagtgcgatgtgggcttgaggccgacatcggtgagcaagacagatctggatggaatgcgcacatcacaggcaaagagaaacattctggctcgagttctctaccttctggcagtattattaagtcctttcctggttttaagtgtccatccgaggcacatcgcttccttacatatcaggcaaggctctccagtcaagaagcagactcatttgcaagacgcacttgctggctccagcagatcttgaacaccctgtctggaaggcagtcttctgaccggcgagaacgaatcatgccagcgctgctgaggcatgcatcaggtgtcacacaggtccaggcccttgatggcaggaagggagagctgcagaagttcagcatgacattgccgcagtcttgtggcaccacaacggaggcgcagctggctgttaccgcatcccatctgaaggttgcacatgtccatgattttcttatgcagtcattgtgtcatgcccagcattgctgtcagatgccagcactgctacatgggatcagggatggcttggcatgcatgctcagaaatatgtccacatgcacgcatggagtgcgcatgccagcaaatcttggacatgccattcatgaggcgtacagagcaaatgtggacatggctctcattgttgaggatgacatgaaggtgcttcggtggccttcacatggtctgctgtacactgcgccgcccgactgggacatcctgctcctctacatgatgggtgctcaggcagacagcatttacaggtcgccaccaagcctctgggttgaatggggaccttcaattttctcagccggtgcatacatcattcaccgaaaagccatgcagaggatcctcgacgcttatttgcctggagcctctcaatcagagcacttcagtgttgtggatctgacagcagtcagcacaaactgggagcatccattggcctgccagtctgagcgggttgtcttctcactggggaagacctttgtgtgcacagactttacaattgtggaaatatcgggtgagagcactcttgagaagagtcaccggccccagcacgatgccacagcaaggctggttgagcagctcatcgagcagcacgggccagcagtgtgctctcacactgtgctcgagggggtgtgccaagcatctgcctctgctgtgtaccactga

SEQ ID NO: 109978 - DNA, 1686 bp, Glycine max
  Peptide Sequence Number=SeqID_226756
atggttcaggatgttataccagaagccaatcgagcttgcagggagcgcaggctgaggggtttgagcgcgaagaaggatgtgataagggaatgccggctgtctcgctgtgcacatgtcgtgcctgtgacatccagaacacttcccggtcaggggcacaacagaccacggcacgcgaacggagccagtgcacaccagctgaagcagcggtgcgactcggctatcgtgccgaaggggcacctgcggtcgttcagcctggacatggctcgctggccgggattctcgcggcgcatgttctggaaccgctcctccgcgcctgaggggttgagagaggacgtggcggctgcgacagcgcccctgcctacaaactacggctcaggtgctcgccgtttcccttatcccggtgtgatgtgtgattttcatgaagcctccctgttttgctggtcattgagggactgtgccccggtcctagcatgtgctgggggcacgcctgttgtggtgttggactccgaggcagaagcggccacggcgctggcgcacgccaagagccccgagcaatctcctgccaagggcgctgatccagaggttggcgaccggttcgatttcatgcccccggacgatgacggggcggctccggttgatcaaagtgccgagcttctgcaggagggggcctggatggaggggccagatgagcagcccatgcagccaacaatacttcccctaagagttgtggctgagtggcaagcggcctttggtctgttacagccacatgaatctcagaacagctgtaaggtgccccaatcagttggaagatgcaagattggcattgctgcaacgcacgtcgcatcgctcgtgcatcggccgcggcgcggcggcggggcggcggccgccacggatgcgcgcatcgcagcggccgatgtctgctcctgggatccgccggcgcagattgcggctgcgctgcaggcatggcacgaggccgccggcactcgcagccctccccctgagcgcacctcccaaacccatgactctgcattcgagcgcgagcggcagagcattcttgctgcgggaaggccactgtgtgattgtgaaactgctgagcaatcagttacgagcatggcgcttactgctctgaggacatcaaacctcaacgcatgcaggggtgagttccgcggagccatcacccggtcgcatatggaaatgctggaaacgtggctcatactcgagtattgcgaccatggcagctttgacaatgccatccgctcagggacattcttgaacgacctggaaatttcaactgctcctgtaaaagtcaaagctgtgctaagttcagctgtaacatccggaatcctctgtctgatggacattgcagctggaatggagcacctgcactcccttggaatcctccatgcggacctgaaaggagcaaacgtgctgctcaagtccggagcaatatcaaattatgatcagaggggctacatgtgcaagctggccgactttgggctcagccgagtgatggagaacaactcaactcatgtctccacaaccacattcggtacagcagcgtacatgccagcagagatgctgatggagggcaggatgaccaaggctgcagatgtgtacagctttggaatgctcatgtgggagctgctcaccggcaggaagctgttcgaggggctgcgacagtcacag

SEQ ID NO: 109979 - DNA, 1287 bp, Glycine max
  Peptide Sequence Number=SeqID_226757
atgccagggcttgatcgaagaggtatcatctggttccttgtagcgaagctggtatttgttgttgtaggcgccgtcgtgcacgtccggaatctttgtgtctgcttcccaagtgactgcttctgccagacagaacggaacctgccttatgccttctcatcagcacttgtagcagcagctctgctgtgcctggctgcctcacaggattctgaagacatcagcatagatccagcaaccttcctgctgcaagtccctggccgcaattggatacctgcatgggccaagcttcctcccaaggcctcgccgacatttgactttgctgaagccctgcacaaggcgttcatctacctgcgcattcagcgttctggcaacatcactgcccctgaccaccacattgcctggcgttcggactcctgcttagcatgcaagggccctatgggagaggacttgagcggaggctactatgaggctggtggcagcttcctcaaagtgggactgccagaagcatttcctgtgacccagctggcctggaccattgtgcgacacaggactgccctgtacagagtgggattgcttgatgaggccctcagcgctctgaaatgggggtcagactacctgctgaactgccacaatgcgtctgccaacacatttgttgcgctcatgggcgatagtaaggcagacttcaagtattatgggcctccagagctctatgagcgctatgtaggctctgtcaggccagtcagctacacaggaccaacagcgccggccagtgaggtcagtgcagaagcagcagcagcgctcgcagctgcatcgctcgcattcaatgccacagaccctatgtatgcagccaacctggtgcagcatgcctctcagctgtttgacctggcatctctgtatcctggctccttcatgacgtccaaggaccctggtctgaaaacacatgccaagctgtacccttccactggattccatgatgagcttgcctgggcagctgtctggctgtttaaggccacacaggatggcacattcctgacagcggccatggctctgttcaatgagtcccagaccgacggcaactccgagtgctgtggctatgggaccttctcctgggacacaaagagccctggtgtggcccttctgatggcagagatcatgcccaatgagttgctgtattcggaggccatccaaaagttctgcaactggtacatcccgcctctgcgctctgtgcctcacacagccaacggcctcgcgtttccttacaaggtgacatgcaccggccccctgaaatga

SEQ ID NO: 109980 - DNA, 1209 bp, Glycine max
  Peptide Sequence Number=SeqID_226758
atgctggctcaggtgagggaaggggagcgtgagcgacagttgggagcagggatgcgcactggcagcggagatggagagagcgcgcgcgaggagggcgcggcagccgccggcagcttcatccaggttgttgtcggacccctgggcccagcggctggccaggcactcaatctcccgcttggcgcgcaccgtcctcaccttgaacgtggccacctgcgcgtacgtgcagtgcttgctctgatccttccgtgttctctgctggccctaacaaacaagctgcgggcaattgcaagggtgccacacctcgagaacgtgcctgacttacaaggcctgccacccacgctcaacttgacccatgatcaagcaactgaaccatttgaggaacttaagcgcaggtgcaaggaggccacagtccgacatgccagcgaggggcgtaccacattggggtgctggatggaggttgacagcgccgattcgcgcagagtctctgccaggctggcaatgctgcagtcatgcgccaccaccttcactgccaccagcgcgcccctccatctccctgcaatccaaaggggattaatcctcatgatgcgagctctggggcatgcagaagccgtcagcccagggagtgtcgatccagggatggccatgaacaatgcgcatggcatgctttcagctgttgcacccccctgctctcactggcatgcaaagacgctggccccacctagaggtcatcaagctgatgccttgcaacttactgatgtacaacatcacgattttcctgccaagaggcaagatccaagcaagaaccaaccaatcgtgggcacggtgcacagtattcataccgctccccgccaggcagggcttaaagcgaagtacatacagcagagcgcacctttgtacaccctgccaaaggagcctcggcccagcatctccccgagctccaggccatcaatcgtggcgcgttgcctctccctcaccaacatggtgatgtggtccacagacgtctgtggccctgtgatagcaaagttgcatttattaggaagcaccatccgccagcgagtctccgctgttgcattccatgcgcatcagtgcatacggataggacacgcacatggcaagctcggaggctcagtgcatgcggtgggacaaacacatggcaagctcacgtgcttgcgcgaggaagaggccacaggcgctcagatgcatgactaa

SEQ ID NO: 109981 - DNA, 416 bp, Glycine max
  Peptide Sequence Number=SeqID_226759
gccgggcgcgtacatcttggcgtggtgcgcgcccagccgcgtttgccgccggatctggcggtggcgcgactgcaggatcacccgctggcagcccgttcgcaggtgagcgaggcgcagctgggcgaattgcgtcagctgcggctcaatacctgggtggaaacccgccagccgctgccggccgggcgtacctggtcggccccaacttatctgttgttgctggagatggcggagcaggggtttggctggagcgtactgccgcgctggctggtgcagcagtttggtcatcaggtcttgcgcgagctgccggtgccgggctggccgcagcatattgcggtggatgtcatctggtcgcggcgcaatccgccgggcccggccggccgctggatgatcgaccagctgtgcgcgcagcagcctga

SEQ ID NO: 109982 - DNA, 318 bp, Glycine max
  Peptide Sequence Number=SeqID_226760
atgtcgtacaggatgtcacgacatcacgcttcagaacatgcagtttatgtgtgtctgtatgaacagattaaacaatattatcgggccggatgtcaggacatcgtgtccgacatcgtggatcctgcagcttcacttctgcacttgacttttatcttgcattgtacagcaactccagtattctcgggctggatgtcaggacatcgtgtccgacatcgtggatcctgcagcttcacttctgcacttgacttttatcttgcattgtacagcaactccagtattctcgggcaggatgtcaggacattgtatccgacatcgtga

SEQ ID NO: 109983 - DNA, 318 bp, Glycine max
  Peptide Sequence Number=SeqID_226761
atggcgatcaacctcaatgatgttgtctcagcacgcttcatactaatcatggtggcacctgctcaagtttataagtcttctcctgacttatatgcagtcatcttactcgttcgagatggtaaccaagtcaaaccttcgactcttatacgaattgatgttcaactaagggagagttcacatgctctggatacttgcatcgtcgctccacctatgggacctatttcttggcttgcatgcatggactcacccgccaagaagactttcggtacaagggatcttcatgtccatgaagccactactgccatcttagtcatttga

SEQ ID NO: 109984 - DNA, 438 bp, Glycine max
  Peptide Sequence Number=SeqID_226762
atgacccgcatagatcgcgagcacgctgtcccaggcatcaagcgaaggcgtgggcgccggcgtcaggatcatcaattccaggagttcttcgcggtccatacgcgcctccttcctcgtacacggcgacaggatggcatgagagtggttgcacggtcaaaacggaagggtaagcgttgcctaccacggatacagggaagtgcaatgcatcgcgacgaaatccaaaagctgggcgcccaagccgcccgcgacggactgaccctgtgggactgcccctactaccgtgccgcggccatgccgggacacacgggcgagtcgatcacggagtggcgcggcaaggtcgaggcctgggaggccggattcctggccgagacccgatcatggaatccgccccgcggcacccctccgccggcaggccaggcgcggccccctgtccactga

SEQ ID NO: 109985 - DNA, 609 bp, Glycine max
  Peptide Sequence Number=SeqID_226763
atggcgaagaaagcaggcaatcccgaacagattcacgaccttctgtaccaggcgctcgaaaccgaattgggcggtgaactcgtatacaccgccgcgctcgactgtacggtcgacgccgacctgcgcaaggaatggcagggttaccttgacgagacgaaaacgcaccagcgcgtgttgttgaccgtctttgaagagctgggcctggacccggatgcggcggtgcccagccgggccgttgtgaagcaccacggggaaagcttcgtggccgccatcaagctcgccaaatcgcaaggcgacccggacgcggcccaattggtggccgcggaatgcgtggtgctggccgaaaccaaggatcaccagaactgggaactgatcggcctggtggcgcagaagacgtcagggccgcaggccagcgtgctcaagcgcgcccacgacgccgtcgagaaggatgaggaccaccacctctatcacaccaagggctgggcgcgtgagttgtggatccaggcgctgggcttccccgccgtcctgcctcctccggaggaggccaggaatgtcgaaaccgctatcggcgcttcccgcgccgaacaggcgcgtgacaagatgctctga

SEQ ID NO: 109986 - DNA, 420 bp, Glycine max
  Peptide Sequence Number=SeqID_226764
atgaaaatccagagctcaaaccccgacctctctaatccctattacctccacccaaatgagaacccatcactagttttagtatcacctcctttggacgagaaagactaccattcatggaccataagcatgaaattatctctcatttcaaagaacaaactgaaatttgttgatggttctcttagccaaccaagtcttttggacccattctatggagcatgggagaggtgtaatactatggtcttaggatggttacaccactccatgacaaaaccaatcttaaagtccattttgtggatagaccaatcagttgctgtgtggaaggatttacatgataggttctcacagagagatctgttgtgcatctctgatctacaagaggatttctacaaactccaccaagttgtggagcagttagcatga

SEQ ID NO: 109987 - DNA, 213 bp, Glycine max
  Peptide Sequence Number=SeqID_226765
atgattgaaagttttcaacaacaacaagaaatgggtgttattgaattgtgcattgaagtagatattgccggtgcatttgcgttgaatgtgacaaattcgttattatcatgtgggaataatatagctggcaatgaatcaaaattggatgaggaggaagatatcgatgatatatctgacacagatgaagaaggtggaagtgagactgaattttga

SEQ ID NO: 109988 - DNA, 345 bp, Glycine max
  Peptide Sequence Number=SeqID_226766
atggtggaaaggggaaaattggatcatatagaggaaaggctgagggccattgaaggaggcagagattatgcttttgttggcatggaagagttgtgcctagtgcttgacgtcgtcatccctctgaagttcaaggtgccgaacttcgataagtacaaggggactacttgccccaagaatcacatgaagatgtactgcaggaaaatgggagcatatgcaaaagatgaaaatttattgatgtatttcttccaggaaagtcttactggggcaaccatcacctggtatactaatttggaacctttccaagtccattcttggaaggacctaatggttgccttcattgggtag

SEQ ID NO: 109989 - DNA, 560 bp, Glycine max
  Peptide Sequence Number=SeqID_226767
gttaccccttgaacatgtatcgaaacagcttcgcacactaagtgacaatgaagttgatggccatttccaactaggactcgtagagagggcatggtgcgagtatggaggcccaaactttgcactaggtattcttgaacaaagttgtgggtactacccccatcaaccaagatcactacctattgctctgcaatcaggcccaacaatcgcaatgtttcaagagcaaggtgaccctccaaatttaggtgacatgcccaatttagggttatctaaagagaaaccctcttcttcatctacaatcaacaacaatgttggacaagtggcgagaggtggagaaggttgcaacggaggtgacaacaaaagtgaaggggataaaggcaccactagcaatggaacttctcctcttgaagacacgttaatcctacggcttgaaccaaagtcagaggccaatggtgcggttggcaaggtcttcaaacttgaagaggtaagcattgatggtactacactaggtaaatttaaacaaggcgcttatgggatcctcgtactgcgacagagcaaaccag

SEQ ID NO: 109990 - DNA, 216 bp, Glycine max
  Peptide Sequence Number=SeqID_226768
gcgttcctcgttttaacatttgctcactttcgcagctcgaagaaaactaggaaaggaaagagtcccggaaagggtgggaatcgattttggaagtcacttgtggttggctttaagactcccagggaagccatcgaaggtgatttgttcgtcttctttagtcgctgtcaaggttcgttgttgcttgtgttctgtgtgctgctaagtgatcagtgctga

SEQ ID NO: 109991 - DNA, 2291 bp, Glycine max
  Peptide Sequence Number=SeqID_226769
gtgtagctgtggatcctaataaagtagaaagtgtggtgaagtggccaactcccaagaatgttaaaggggtgaggggattcttgggcctgacgggctactatagaaaattcataagaaactatgggaaggtagctagacccttgactacattgacaaagaaagatgcttttacatggaatgaagagactcacaaggcttttgaggctttgaaagagagtcttacaactgcccctgttcttgctttaccagatttcactaaagaattcaccattgaatgtgatgcttcaggtgtggggattggagctatattgatgcaagaaaaacgacctattacttactttagtaaggcattaggggtgagaaatgtggccaaatcagcctatgagaaggagttgatggctgtagggttggctatacaacattggaggccttatttgttagggaggcgttttacagtgtccacagatcagaagagtctcaaacaactgttgcagcagaaaattgtaacagtagagcagcaaaattgggctacaaagttgttggggtttgatttcaatattgtttacaaaccaggaaaattgaatggaggtgcagatgcactatctagagttcatgaaggaggtgaagtatgtgtgatgacttctagtttgcaatggaaggatgtagacattttgagagaagaatttgcccaagacccacatttacaaaagatagtaaatgatttacaacagaataaggactctaggccaggctttgaattcaagcaaggggtgttattgtatgacggacgactggtgatttcaagtaagtcagttttgattcctactttgttgaaggaattccatgaaacttcacaaggtggacattctggtttctacagaacatacaggcggttggctgttaatgtgtactgggtaggcatgaaaaatgttgttcaggagtttgtgagaagttgtgatgtttgccaacgccaaaaatatttagctagttcacctggaggactgctacaacctcttcctataccagacagaatttgggaagacatttctatggattttataactggactacccaaatctaaggggtttgaggctattttggtagtggtagatcgtttatcaaaatattgccatttcattgctttgaagcatccctatacagccagaacaatagcagaggtgtttgtgaaggaaattgttaggctccatggtgtacctttatcaattgtaagtgatagagatcccatatttatgagcaacttttggagggagatgttcaaactacaggggactaagctgaagatgagtagtgcttaccacccagaatcagatggccaaacagaagtggttaatagatgtttggaaacctatctaagatgcttcatagctgaccaaccgaaaatatgggtgcattgggttccatgggcagaatattggtttaacaccacttatcatgcttcaacaggcaagactccctttgaggtggtttatggaaggactcccccaactattacacgatggatccaaggagaagttagagtggaggcagtacaaaaggagcttttagacagagatgaagctatcaaacaattaaaagttcacttgttgagagcccaagataggatgaaacagtttgctgataagaagagatgtgacaggagcttttccataggagaatgggtgtttgtcaagctaagggcccatagacaaaagtcagtagtctcatgtatttatcctaaactagcagcaaaatactttggtccttatccagtggtctcacacataggggcagttgcttacaaattaaagctgcctgaagactcccgcgtgcatcctgtatttcacgtgtccttgttaaagaaagctgtggggtcctacaatggagaggagactttaccagatgacttagatggagagaaggacaatacttttgaaccggacacagtcttggcacagaggactgtacaagtacagggtgaagaggtaaggcaggtcctagtgcaatggaaaggacgaaatatagaggaggctacatgggaagaggcagtgatgatgacaagtcagtttccaaactttagccttgaggacaaggcagtaatttcagatggaggtgttgttaggaatgaagggaataatggtggacctagtggaacgatggaaccaaatgattccttactcaatcatgaggtgggccctagagaatggaagagaaggggggaatctagtgaattgatagaatggttaggcagcaatagctggcctataggagccactgctctgtgtcagatttag

SEQ ID NO: 109992 - DNA, 362 bp, Glycine max
  Peptide Sequence Number=SeqID_226770
atggaattaacaataggttctcatggcagggacgaggccgcggatcatgttggtgtcgccccagtggagaacctcgctgccgacgaggatgtaattaattttggcggcgatgtcgccgttgggggcggtcaccgtcacggagatgccgctgccggcgaaggcccgcaggatgtccgggttcacgtcgtagatcttcacgcggtcgatggtcgtcttcgtcttcaggaagttcgccaccgccgcgggcggtggaaggttgtcgccgagcgtgccgtagttgatgccgatgccgtgagcggcgatggcgaggtggagcagcaggaggaggggaaggaggaggaatgcggaggtggtggccatgg

SEQ ID NO: 109993 - DNA, 282 bp, Glycine max
  Peptide Sequence Number=SeqID_226771
atgacaccggctaaaggtaggagaaaggatagttactttattatgggtattttttcccgtctatttgggcaagcctacactccgtccatggtgcatcaagagtgcggcaaatttgatcagattgggggatttattttttcaaagcgttccgccatcattacgaatgaaacatcacgtggcaacatgacatgcgttttgccattggtgttggcgaaacatgctgtaacttttttccagcgtggcatggatcttgccactggtgctggcaaatttccgaagtaa

SEQ ID NO: 109994 - DNA, 270 bp, Glycine max
  Peptide Sequence Number=SeqID_226772
atgatgttagttctgcgcgtcaacgggctcatttgcccgtggttgacgaaaggtgcggataaccctaagcgaaaaaatgtttatacggataaacaattcggtatctccccctgccccttaacttcacgggttagtagtgacggaaatagtctatgcggagaattacttgtgtatctccgcatgtcacctgacttcacgggtcagtatgacagaaagcgcgaaagacgacgtaaatctccgcgtgtcaacgggctcgttggccgcgattga

SEQ ID NO: 109995 - DNA, 195 bp, Glycine max
  Peptide Sequence Number=SeqID_226773
atgacagatccttctggaaaggaggaaggacacttggcacgagaaatccaaggagagagaataaggatacaacacttgaaaagcatgtgttgcaaaggatttgcaaggaacaagatatgtgaaatacaagagttgacggtggaagcaatagcaaaagttaaactaggagatacacacgtggaagacaaaatgtag

SEQ ID NO: 109996 - DNA, 282 bp, Glycine max
  Peptide Sequence Number=SeqID_226774
atgagacatcttttaagggtcgtgggagatgaccacgttgataggctacagcggtggggctcacctgttcccattccgaacacagaagttaagcccaccagcgccgatggtactgcgacaagcgggagagactttgtattttattcctcttccaacaacaacaacaacaacaacaacaacaacaacaacaacaacaactactactactactactactactactactactactttaggctctttattcttttacaagctttcatcaatagaggtggtctttag

SEQ ID NO: 109997 - DNA, 210 bp, Glycine max
  Peptide Sequence Number=SeqID_226775
atgaacccagatttcaaccaaccacgaggcgggtgctcgcgggaggtcagcatacaccccgcgcagcaacattgttacatgtttgcgttggggaaacgatatttgagttccttggcgcacgaagcgccgggggtttgtgtttgtcgcgaggacgaggaggccgggcgcacggggcgccgtggtcatcccctccctcccgacggtagatga

SEQ ID NO: 109998 - DNA, 747 bp, Glycine max
  Peptide Sequence Number=SeqID_226776
atgaacagcagtgaaaaccagccccccggattcgatcggatccggatcggagagtgcactgtcactctgtcctcgcgagaagtcgaggtcgtcggtgcgcgtcgcccgcgtcggctgacgccgaaggcgctgggcgtgctgcgtgtactgctgcgccagcccgggcgtgttgtcacccgcgatgaactgttcgcggaagtctggccggacacgctgccgaccaatgatgtgcttacccaggccgtcacccagctgcgcaaggcgttcagcaacgacgacgacaacggccaggcctatatcgagaccatcgccaagaccggctatcgcctgctggtgccggtgcaggtactggacgatgtcgaggcggcaccgtcctcagaagccgatgacggaatcgcggacgtgcaaccggtgatgggcatcgccgaggagatgccggcacacgtgcaggcatcgcgccgccgctggcgccatgtccgccggcgcgtgctgctggtgctgggcgtgctgatgctggccacggtggtggtgctggccgcgctgctgctgcggcgggcaccggccagcagttcagcggtggatgcggccgtggagaacggcacgcgcgtgatcggcagcccgcagcgtccctatcggttgatcaccgcaaccagcggttttgaaacctatcccacgctttcacccgatggttcgttggtggcctatgaaggcgccaacgaagacgggcaagggggtggggcgatcaag

SEQ ID NO: 109999 - DNA, 327 bp, Glycine max
  Peptide Sequence Number=SeqID_226777
atggagaaacccagtctggtcactggcaaaatggagtccttgacattccaagcacacagagtaccacctatcctgtttcccctgttggggtcaatcattccagagtacttaatgcagtccagtgatgtgtttccttgtaaaaaacaggaagcaagaagagcagctgagaaagcctatgatgtggccaaggtagatgagagggttaatagagcagtagctgccgctaacagagcagccaatgcagctagagtagctgctgtcaaggccgtgcaaaaccaaatgcttcataatgttaacagcacgagcatcccaattcccattgtgtga

SEQ ID NO: 110000 - DNA, 2172 bp, Glycine max
  Peptide Sequence Number=SeqID_226778
atgtggggttggatggtcggggaagctggtagggcagcgtgcaactggaactgggtttcgctccgaaacatgggtggcggtcctcgcacctttcccggcggcgtgaacaagtggaagtggaagcgcatgcacgagaagctcgccagagacaaacagaacagactcatcgaacaagagaagcagctctaccaagctcgcattcgctcccacatccgctccaccctctcccccgaccaccaatccgccgccgccgccacccaccgccccctctcccctaacgaccacgtcaaagccctcgccgatcgcttcgtcaaagaaggcgccgaagacctctggaacaaccacgacggtcccctaactccgaacccaacaccgaacctcaattttggccccaaacacaccaggggttaccgttctgttcccgaggttgggaacagtcgtgttggggcccacaagtataggttttggcgaaagggtagtgatgattcttcttctagtgagagtgagagtgaagttgaattgagtgtgaagaagaggggtagtagtgcttctttgggggaatatgatgtcaagagagagaggagggttgtgcccaagacatctccagaggttgagtttattaggtatcagcttaataagaggaagttgagccagattgaggaacaacagagtcaagagcaacaacaaagcaatgaaagcattctaagcaacacaaggtttgacgagtgcggtatatcgccactgacggtcaaggcactttcttcagctggttatgttcaaatgacccgcatacaagaggctagcctacctatttgccttgaggggatggatgctttagtcaaagctaaaactggcactggaaaaagtgtagcttttttgcttcctgcaattgaaacagttctgaaagctatgagtagcaatacatctcaacgggtgcctccaatatatgttctaattctctgccctaccagagaacttgctagtcaaattgcagctgtagcaaaggttttgctgaaatatcatgagaccatcggggtgcagactcttgttggaggcatacgatttaaagttgaccaaaaacgccttgaatcagatccatgccagatacttgttgctacacctggtaggttgctggatcacattgagaataagtctggaatatctctgcgattaatgggcttgcggatgcttgtacttgatgaagctgaccatttactggacctaggattcagaaaggatgtagaaaaaattgttgattgtttgccccgtcagcggcaatctttgctgttttctgcaaccatgccaaaggaggtccgtcgtgtatctcagcttgttttgaaaagggaacacaaatatgttgatacagttggaatgggttgtgtagaaactcctgttaaggcaagttacagcaactattgtcattgccgtactctaaaaattgcaaaagtgaagcaatcttatcttattgctcctcatgagtcacattttcagttggtgcaccaaattctgaaggagcatatcttgcaaacacctgattataaggttattgtattctgtgttactgggatggtgacatcactcatgtataaccttcttcgggaaatgaaaatgaatgttagggagatacattctcgaaaacctcagctctatcgaactcgtatatcagatgagttcagggaatccaaacaattgattcttgtctcatctgatgtttcatcgcggggaatgaattatcctgatgttaccttagtcatacaggtgggaattccttctgaccgtgaacaatacatacaccgtcttggaagaacaggtcgggaagacaaagaaggggaaggtgtactgttgattgctccatgggaagagtattttttagatgaaatcaaggatctacctctacaaaatttccccttaccagatataaatccacatacaaagcttaagattgagaattcaatggcaaagattgataatgacatcaaagaagcagcttatcatgcttggctgggctattataactccatcagggaaattgggagggaaaagaccactatggctgagctggcaaaccgattttctgaatcaattggtttacagaggcctccggctctcttccgaaaaactgcaataaaaatgggtttgaaagacattcctggcattagaattcgtaaatag

SEQ ID NO: 110001 - DNA, 120 bp, Glycine max
  Peptide Sequence Number=SeqID_226779
atgactgcaagcggtacaagaattctcgagccatcaaatgctatgattgtgactcttgcaaagtattatatactttgtgggatgctgtgcgagacgaaatgctgccaggagccattctaa

SEQ ID NO: 110002 - DNA, 516 bp, Glycine max
  Peptide Sequence Number=SeqID_226780
atgcgcgataggggagctgctacgtgcacccagcaatattgctggggcacccagcaaacagtgaatgggcgaaaatgcccttccgcgaagactctttccagaaaaaaccttcttccggaatcatcccggaagacacttttttcggaaaatttccagaagaaccttattccggaagaagatgatgtgattccggaagaactccagaatacgttccggaagaacatgttccgaaatgtttccggaagaaggtacacattttcgttggttcatacgtatgaccagttagatgaggcttctaggaccaccacacgacagcttgcagggtacctgactctattacagtgttggatctatgagcacttccccagtgtgcaccaatgcgtgatagatgatacataccaggagacgtccccacgtgcttcccggtggttgacgtcgaaggcgcacatgaagggaatcacaggagcaccttatagggcacgttgtgatgctttgaccgtcacagatgtgtcctag

SEQ ID NO: 110003 - DNA, 253 bp, Glycine max
  Peptide Sequence Number=SeqID_226781
gttcatcgtgactaacaatggatcgggtcatagtgttactggcctgaggtataaggaataccaacttcaagattttagttctttgtttctcaaagagttaaacaattctcgtaactgggaaaggttgaaggtttgtcttgtcaaatctgaagactgcaataacctatccaaaaaatataagactcttaaacaatataaatcagctaaattatcaccaattgaagctggctgctgccgacctccttcccagtag

SEQ ID NO: 110004 - DNA, 273 bp, Glycine max
  Peptide Sequence Number=SeqID_226782
atgcctgatccattaatgaattccttagaggctatagttggggatcatgaccccttagatggaagactgaaagcagctcaaacagatgtagagttgtattattggtttgacatgactaatcatcaaattatgctcatttttggacagtggccagaagtggattcccttgtcgaagaattgcaaaagattgagggagtccagtctgtttcaaaaggccgttttttcagaagccctggattagctccaacttttcagccgctgccagtttactag

SEQ ID NO: 110005 - DNA, 222 bp, Glycine max
  Peptide Sequence Number=SeqID_226783
atggggatgggaactagcacctttgttactagatggatcaactttctcaccatggtgaaaacagaagataagaactgggacttgaggcttttggccattgttgtgataatatttggagtgtggatgagcactcatcatgatggctgccgaaagtctctcactgtgcctgtaataggcctcggagcagttattttcttaatgtcagccttgcattgtttatga

SEQ ID NO: 110006 - DNA, 1812 bp, Glycine max
  Peptide Sequence Number=SeqID_226784
atggggtctcttcctctcaccagtagtaaaccctggttttcaccagaaaaaacaacaagaagaagagccatttctctgaatcagagagtgaaggtcttcgcctcacgatcacgaaatgaaggagaaaaagaaccacctaaactcgacagccacgacctcatggaactcaaattcggtcggttactcggagaggaccccaagctcacccttgccaagataatgggaagaaaggtcaatcctgatgcttcttatcttgatattgagaaagccttttataagaacaagggtaaaattgtggaagtggaggaagttccatttgaaggctctaagggagggagctcatcaaggaaatttgatgacctgggtttggttcgtcctgttcctgctaaggggatgaaatttaaatccgataataacaaacctgcattggattttaagaaacccgttcgagcggataataaggaggtgggtgttaggaagagtagtgttccccatgttattctcaggaagccggccgcgcttaaagatgacagcgatggggacacgttgacgtcgaggttgagaatgaggccaaatctgtcgctgaaaatgcaggatgagcaagtcaaggcccggtttagtgacatgaccctgttgaggaagcctgaagcggcaatccaagagccttcttctagtgtggacgaccaagggaactatgacggtgagttgaagatgtggaacggagagttaagtgatgaaattggtggctttaccttgttggaacggccacacaaaccaagtggtgaaaaagaggagagtggtgaacgagaaatgttagaagtgaatgtcatgatcccaaatgatgtaggtgccaatctttgtgctagttgcaatgtagaatttagtaacggattggagcaacatgaggagagacagctggagttccatgaggagtcgactgatttaggtcagttgtcagatgattctagagtggagttgtccgtggaagctgcgctacaggcaaagccaaaaagactagatcaatatgtgaaacaagcctcaaaattggttggagaagagggtgcttcccttaatattggagctcgcacaaacaaggatgatttagggaaagttgttgatatgtcagatttccaggaaagcgaagatgctgattggaccagggcacaagatttgattaagactggagatagagaagatgtggaactagtaagctgcaataccaaagggttcattgtttcttttggttccttggtaggatttctgccataccgtaatctggcttccaagtggaaattcttagcttttgagtcatggttaaaacagaagggcttagatccatcaatatacaagcaaaactcaggcactattacaagttttgatgctgaaattaagaatctgtctcctgattctcctccatctctggagattgatggtaaagttgaagatagaatttcaccagatatgaaattggaagatcttctaaggatttatgaccaagagaaacttaagttcttatcttcatttgttgggcagaaaattaaaacaaatgtgttagtagcagacagaaaaatgagaaagctcatattctctctaagaccgaaagagaaggaagaattagttgagaagaagagaaatctcatggctaaacttcaagttggggatatagtaaaatgtcgtgtccagaaaattgcttactttgggatttttgttgaggttgaagaagtctctgcattaattcatcagtctgaattatcgtgggatgccactttgaacccagcatcatattttcagattggtcagatgatgtcatga

SEQ ID NO: 110007 - DNA, 538 bp, Glycine max
  Peptide Sequence Number=SeqID_226785
ggagtatcggggaaccaacgaggcaagggaagtggagaacacagacacttcaagcggtgttagacaagagtatgcattttctccactcaatctaagtttgttcgccaaatggaatcgatttcgtagtttcttagtaattttgtccaaaaaggtcaaaaagaaagatgctgtgcttgcaagggttgaatcagagaaaagactggctttaataagagcatgggaagaaagtgagaagacaaaagcagagaacagggcatataaaaggcacaatgctgtcgtattgtgggagaatagtaagaaagcatctgcggaggcacatcttaaaaggattgaggaaaaattggacagaaacaaggccaagtgtgttgaaaaaatgcaaaacaatgttgctgaaattcatagaacagcagaagagaaaagggcaatgatagaagccaacaggggagaagaattcctagaaatagaggagaaagctgctaagtttcgtacccgtggctattcacccaggaaatatcttccatgcttcggcagcagttaa

SEQ ID NO: 110008 - DNA, 510 bp, Glycine max
  Peptide Sequence Number=SeqID_226786
atggctaaatatgacccagaaatagtcatggaattctacgttgatgcatggctcatagaagaagaagtcagggataagcactcctggttcttagggcatccgtgggtcctggaagaggggcaatgttgcgagttcagtgaaaggaggagccaggcttcgggatttgataaggaggccataggccagctgctgtgcatttcgggacaagactttgcacgaagtgtgccgggaagacgggtgcagatcatgcgcactagcatgaccaccctaacacagatctggatgacactgcttctcaacaacattctccctagctatcgcaattccaatcttcccctgccgaaatgccagttggtctacgccattttgactcaggattgcacctccaaggcacccagtggacccaaaaaagtccaacagggcactggggttttcgaccttgatcatgggtctctgccagttttgtggggtgctggttatgcccacaaagctcatctggcctcccattaa

SEQ ID NO: 110009 - DNA, 231 bp, Glycine max
  Peptide Sequence Number=SeqID_226787
atggaactctatatgcagcatttggctaaccagcagcagcgccaggatcccaatccttactcgtggcctactcccgatcagttcggggccacaattgctgatgtaagctccattggagcttataggcctaggatcttcttcatcaatgtattcctttgcttcttggaagatgaatggcagcggaatggagaaggaagagagagaggagacgccccttcaagcagaagatga

SEQ ID NO: 110010 - DNA, 676 bp, Glycine max
  Peptide Sequence Number=SeqID_226788
atgctgcagctggagctggaagagcgcctggaagcgctgtcgcagaacgtcagcgaagccggcgaacgccgcatggagatgcgccaggagctggagcagatccagcagtgcatccgtgagctgacggcgcgcgcgccggtgtggctggcggcgcatgacgctctgagccagctcatgcgatcagagcggagagccgctgctggagcgctagctgtgaaaccaccgtcgagcgcgactaagtggcggcccgcaaacgtgaagtggaagcgcagatcgaacgtctcagacagccgggcggcgcggaagatcagcgcctggtcacgctggccgaacgtttcggcggcgtgttgctgtcggaaatctacgatgacgtcaccatcgacgacgctgccttacttctcggcgctgtacggcccttcgtgccacgccatcgtggtgccggatctgtcgctggtgcgcgagatgctggaagggctggaagattgcccggaggatctttgcctgatcgacggggatccgcagtcgttcgatgacagcgtattcgccgtcgaagagcaggaaaaagcggtggtggtgaaaatcgccgatcgccagtggcgttattcccggtacccggacgtgccgttgttcggccgggcggtgcgcgaaagtcgcctggaagttgtggatgccgagc

SEQ ID NO: 110011 - DNA, 174 bp, Glycine max
  Peptide Sequence Number=SeqID_226789
atgacaaaagacaaggttgatacctcaaagccctacactggggcaatgaggggcaccgtgcatgagcctcaagtgaacctaggggcagatcaaaaacgaagtccgcatttaccgcatttcaagacaaaggttgcatgcacatctggatccctaaaaatcatgttaactacatag

SEQ ID NO: 110012 - DNA, 291 bp, Glycine max
  Peptide Sequence Number=SeqID_226790
atggggtttgaaggtttaggggcacgttatttgatggagcggtggaaacatgaaggaatggatgtatttattccagaagagtatgttatcaagcgaaggcttgagaaaaaggcagcagcttcagcttcagcctctggaaaaatgtcaaaatcacattcgcataggaagaacaatgaatctactcacaacagggtttcctcgtcgaccactcatccacccaatgcttcctacctctctagtggctttggtcttgtcgccgacaacgttgtttttacttgtctctccgcttaa

SEQ ID NO: 110013 - DNA, 291 bp, Glycine max
  Peptide Sequence Number=SeqID_226791
atgagctacctgggtgacatggaagtggagtttgaaaacagctttgaccctgtgtctctcactcctccatctgaacatcttcgctcacaagtcacactactccaccgagtcaccgactcaattccacatgtcaatgatcccaaaacccagatggattttggacaccggaaaaccacgtcatcaaccggagctaccaaaacccgccgaaaaaggctactccggtggtcaacacagaaaaagatggttgagctcagtctcggtggttctgaacacagtggtggagtgaagtga

SEQ ID NO: 110014 - DNA, 495 bp, Glycine max
  Peptide Sequence Number=SeqID_226792
atggccacaccctgcgacctggaggactttgcgctggggttctcgctcagcgagggattgatcgctacgcctgcccaattgctagccatcgaggtacgaccgcaactggaaggcatcgagctgcagatgaccgtgaccgaggatgcacccggtgccgacctggatccggccaacgggcgcctgctgcccggccgcggtggctgcggcctgtgcggcacgcgccagctggaggaagtgctgcggccgctgcccgaggtgcgcgaacggcgaacctacccgccagcagccctgcaacgggcgctggccacactggtgcagcatcagccgatgaatgcggtgagcggttcgacccatgccgcggcctgggccgacgccagcggtcgcatcggctggccgcgccagctacgaaatggtcagcaaggccgtacgggccggcgtcagcgtactggctgcggtctcggcaccgaccgcgctggcgatcgaccttgcccgtag

SEQ ID NO: 110015 - DNA, 1125 bp, Glycine max
  Peptide Sequence Number=SeqID_226793
atggacgtctcctcggaaatgatccacagcctgctgccgctgtttatggcgacgacgctcggcgccagcgtcatcgtcatcgggctgatcgaagggctggcggaggcgacggcattgatcgtcaaggtgttctccggcgtgctgagcgattacctcggcaagcgcaaagggttggcgctgctgggctacgggctgggcgccatcagcaaaccgtttttcgccatcgcgtcgtcgtccggcatggtgatgagcgcgcgcctgctggatcgcgtgggcaaaggcatccgcggggcgccgcgcgatgccctagtggccgacgtgacgccgccggagattcgcggtgcggccttcgggctgcgccagtcgctggataccgtcggtgcctttttagggccgctgctggccgtcggcctgatgctgctgtggcacaacgattttcgcgccatcttttgggtggcggcgatcccggcggcgctggcgattgcgctgctgttttttggcctgaaagagccggccgccgcgataacccataagcgcaccaacccgatcacccgcgccaatctgcggctgctggggcgcggctattggtgggtagtgggtatcggtgccgtcttcacgctggcgcgcttcagcgaagcgttcctggtgctgaaggcgcagcagggcggcacgccgctggcgttgatcccgctggtgatggtcgccatgaatctggtctacgcctgctcggcctatccgttcggtaaactgtccgatcgcatgagccatgaaggattgctgaaagccgggctgctggtgctgatcgccgccgatgtggtgttggcgctgagcgatcattggggcggggtgctgtttggcgtggcgctgtggggcgtgcacatgggcatgacgcagggactgttggcggcgatggtggcgcataccgcgccggcgcacctgcgcggcaccgcgttcggcatgttcaatctgatcagcggcgtggcgctgctgctggcgagtctcggggccggaaccctgtgggagctgttcggttccgcctccaccttctacgccggggcgctcatctgcgtggtgacgctggttggcatgcaactggcgccgttcggcgaacggcggggcgcttaa

SEQ ID NO: 110016 - DNA, 767 bp, Glycine max
  Peptide Sequence Number=SeqID_226794
agagccgcttttttcaacggcaacttcgtggcgatcaactgtgcggcgctgcccgagccgctgatcgaatcccagctgttcggctatgcgccgggggcgtttaccggcgcctcccgaaaggctatatcggcaagatccgcgaggcggacggcggcgtgctgttcctcgatgaaatcggcgacatgccggcgagcctgcaaacgcgcctgctgcgggtgttacaggaaaaaacggtcacgccgctcggcagccgcagcgcttatccggtcgatttcgcgctggtctgcgccacgcaccacgatctgcatcggcaggttgaggcgggggcgtttcgcgaggatttgctgtaccgcatacaggaatacagcctgcgcattccgccgctccgagagcgggcgcagctggaggcctttattatgcagctgtggcgagagctgggcggtgagcggcgcgacattcgcctgctgccggaagcgctggcgatgctggcgcgctacccgtggcccggcaacgtgcggcagctgttgagtacgctcaaggtgctgctggcgctggcggacgatcatgcggtgctcactctggacgatctgccgcagtccatcgcggtgctggcgccgcgccaggagaacgccgataccggcctggaggcgctgcaggcggcgatcgacagggcgggcggcaacctcagccgggcggccaaggcgctcggcgtttcgcgcagcacgctgtaccgcaagctgggaaggcagaaagcggcggcggaatga

SEQ ID NO: 110017 - DNA, 900 bp, Glycine max
  Peptide Sequence Number=SeqID_226795
atgattgtgatggcggcgctgctgagcttttccgccgcggccgcgccaggggtggatctcgtcgccaacgaaacgccgatccacacggtgaagagcgccgaagccgtggccaaaatccccgccgatttcaagttcgtggaacccggcacgctgacggtggccatttccctgctgggcagcggcccgccgttcggcctgtacgcccgcgacaataaaacggtgatcggcagcgaggcggacatcgcgcgcctggtggccgacggcttgggattgaaactcaagctggtgcccacctcgtgggaagactggccgctgggggtggcctccggcaaatatgacgccgcggtttacaacatcaccgtaaccaacgaacgcaagaccaaattcgatttcgccacctatcgccaggatacgctggggttctacgtcaaatccgacagtaaaatcacccagatcaacaccgcgccggatatcgccggtaaaaagatcatcgtcgattccggcaccaatcaggaagcggtgctgctggcctgggacaaggagaaccgcgccaagggactggcaccgctgcagccggtgtacgtcaccgacaaggccgcctccacgctggccattcagtccggccgcgccgacgccaccttcggccccaacgtctccggcgcttatcaggcgcggctgaccggcaaaacccggctggtaggcatcgtgcccggcggctggccgaagaccgccaacatcgccgtcacgctgaagaaaggcaatggcctggtggatgcggtgcaggcatcgctcaacagcgccatcgccaacggcagctatctgcaggtgctggatcgctgggcggagagcgacgagaagatcgcccattcggagattaacccgccggggctgggggattga

SEQ ID NO: 110018 - DNA, 1989 bp, Glycine max
  Peptide Sequence Number=SeqID_226796
atgaagttatatacttcattgttgttacttggtttggtttccatgctctcttttgtggcttctgtcatgatcccttcaggtgaagtgttggcacttaaaactttcaaggaagctgtgtatgaagatccacatatggttttgtccaattggaatactttggattcagatctttgtgactggaatggtgtttcttgtactgcaactcgagatcatgtcatcaagcttaatctatctggggcttcattaaggggatttcttgctccagaatttgggaaaattacctacttacaagaactgatcttgcatggaaacagtctcattggagtaatacctaaagaattgggcatgttgaactctctcaaggtgttggatttgggaatgaatcagttaacaggaccaattcctccagagattggaaatttgacccaagttatgaaaataaaccttcagtccaatgggttgactggtaggctacctccagagctaggaaagttgaaataccttcaagagcttcggctggataggaataagcttcaaggatctcttcctggtggtggcagttcaaatttttcttcaaatatgcatgggatgtatgcctcgggtgtgaatatgactggcttctgtcgtttgtctcagttaaaagttgcagatttttcatataacttttttgttggtagcatacccaaatgcttggcatatcttccaagatcaagctttcaaggaaattgtctccatatcaaagacataaaacagcggatttcggtgcaatgtgctggtgcttcgcctgcccaaagcggaccagtagtgaacccaaggtacctacctgctactaaacatgtgaccaagcatcaagaagcatcaaaacctgcttggcttttggctctagaaatagtgacgggaaccatggttggttctctctttattattgctattctctctgcgattcagaggtgtaacaacaaaccatctatcatcattccttggaaaaaatctgcaagcggaaaagattatatggcagtacatatagactctgagatgttgaaggatgtgatgagttatagcagacaggaccttgaagtggcctgtgaagacttcagcaacataattgggtcctcaccggatagtgtggtctacaagggtaccatgaagggtgggcctgagattgctgtgatttccctctgcatcaaggaagataattggacaggataccttgagctctattttcagagagaggtggcagacttggcaaggttaaatcatgataacacaggaaagctgttaggatattgtagagagagcagtccatttacaaggatgctggtttttgaatatgcatcaaatggaacactttatgagcacctacattgttatgaagaagggtgccagttgtcttggacaaggcgtatgaaaattatcataggcattgcccgtggactcaagtatttgcacactgaaattgagccggcgttcactatctcagaattgaattccaatgccgtttacctcacagaagatttttcccctaagctggttgattttgaaagttggaagacaattcttgaaagatccgaaaaaaattctggtaatgttagtagccagggtgctgtttgtgttctaccaaactctcttgaagcgcgccgtctcgacaccaaaggaaacatctatgcttttgctgtacttctattggagataatcagtgggagacctccatactgcaaggacaaagggtacttggtggattgggctagggactatcttgaaatgccagaagtaatgtcatatgtggtggatcctgagttgaaacattttagatatgaagacctcaaagcaatatgtgaggtgataactctttgcatcaatcctgatcactctgtccgtccatcaatgcgtgaattatgcactatgttggagagcaaaatagacacaacaataaatttggagctaaaggcatcatcactggcttgggctgaactagcactttcgtcataa

SEQ ID NO: 110019 - DNA, 1254 bp, Glycine max
  Peptide Sequence Number=SeqID_226797
gacagcctgactggggccgctctgaagtggtatatgaatttggacagtgcgagcattcgtactttcaatgacctgggtgaagcgttcatccggcagtataagtacaatttggacatggccccagatcgtgatcagctccgtgcgatgacacaaaaagagaaggaaacgttcaaggagtatgcccagcgttggagggaagtggctgcccagattgtcccgccgttggaagaaagggaaatgaccaaaatatttctgaagaccctgagccagttttattacgagaaaatggttgcaagtgcaccaacagacttcactgaaatggtcaacatgggtgtgcgattagaggaaggtgtccgagagggacgtttggctgtggaaagtacccctgccgcaagtaatgccaagaagtttggaggccactttgcgaagaagaaagatcaagaggtgggaatggtagctcatggtaagcctcagcagaatttcaccccatatcgtcaggttgcgaatgtcgcatccactatcccaaacccatcatatcaccaacaaaggccacattacccctacccgtaccctccacaacaataccctccacaacaataccctccacaacaataccctccacaaccataccctccacaacaataccctccacagcaataccatcagccacataccctcaaaaacaacaaaatcgcccgcagaccccccaacaacccatatcattcacaaaaccgccaaaaaacaacctttgatccaatcccgatgaaatatgctgacttactccccgccctgctcgccaaaaaccttgtccagaatcccaatgttcaggcgaaccctctgccgaaccatgggcctgctgttaacatgatacaagattgtgatgaagacggtgtcatcctgaacgtccagcacattcgaactcccctggtcccaatacatatcaagatgtgcgaggcagctctgtttgaccatgatcatgcagcgtgtgaaatatgtccagtgaatgtaaaaggatgcccgaaggtacaaggggacatacaagggctgatagacagcagagaactaaccatcaagaggaaggacagagaagtgtgcgtcattacccccgagtttcagcggttggaaataagttgtaacagtggggaatcaactactactccactagtgattagtttgccaggacctatgccgtatgcttctctaaaagcggtcccttacaagtatagtgccacgatgttggaaggtgggcaggag

SEQ ID NO: 110020 - DNA, 189 bp, Glycine max
  Peptide Sequence Number=SeqID_226798
atggagtttgtaacggctccggcttcatgtggattcacacatcagtatatcctcaaggataccaatgacatattcaaaggtatgccagccacctctcatgggttgggcctctccacggaataccaagcaaaattatcaccttattctcaaggccttgaaaaacgaaaatcctttaggatttttcaataa

SEQ ID NO: 110021 - DNA, 192 bp, Glycine max
  Peptide Sequence Number=SeqID_226799
atggctaccttggggctggagattttggttgaatctgcctcaagtgttattttgaagatgatattatcatttgaccttgcttttgctttgattccgctcctaaagttcagtagcagcaaagtgactagcagcacaagcattgaagaggcaaaatacttcaacgacggtccttatcaaaacccgtctttatag

SEQ ID NO: 110022 - DNA, 132 bp, Glycine max
  Peptide Sequence Number=SeqID_226800
atggaagcttggggctgctgtcttcatagttctcgcgagcttggtgtttttaaagtgaggggggagagttttggggaagacataagcatggccctctatgggtcggcattcgcttactcgaacccactcaag

SEQ ID NO: 110023 - DNA, 679 bp, Glycine max
  Peptide Sequence Number=SeqID_226801
atggagcacataactacaagtgatgagaggttcaaatccttggaatccactatgtcaaacattgtcactcttatgtctcaaagaactcttgacacacttccttcccaaactaaagttaatcctcagaatgaggagataaatgttgttagcaccaggagtggaaagtctgtggtagaatcgaagaagaaagagaagaaactacctcctaagcttaaagacctagggagtttttcagtcccttgttccattggcaacttgtcctttgatagagcattgtctgacttagcttgcagacaagactttcacctactcatgagggatagtggaagacttactggtcaaggaacattgattgatctcagtgaagggaaattgacttggcggctaggtgatgaggaggaagaatttaagcctcacccaagtgtagggaagaaaaacccttccaagaataaggtcattccaaaagatcctggatggagtaagaaaaagggagatgacatcatcattcaagctcttgggtatggagtggatgattatactagagtattagtgaaaaaaaccatgttcaaggaccatggtcatttgaccatgacccatgcatttatcgtcagaatcgagtatggttgtggtaaaatgactatggcccaagtagttagcattagtgttaagcacggtcgtg

SEQ ID NO: 110024 - DNA, 249 bp, Glycine max
  Peptide Sequence Number=SeqID_226802
atggtgaagtgcaatgcagagccttccagtgagggtgttgctccaaaacccaaaaaacttattggcaagatgaaggagccacccctgtctactaccgaaagatccgcagtggaggttgggccaaatgcttcttccctaactaaaaaggaagaggaagaccttcaacatttgaagaatcttgaaataagttcttacagaatgtccatttcatggagtagactttacctattaaatgaatttttgcattaa

SEQ ID NO: 110025 - DNA, 486 bp, Glycine max
  Peptide Sequence Number=SeqID_226803
atgcattatttgtgcttttcttttaatcatttgcattccagatggatactcaagtgtcatgcctgttacactgttactggcgagattgggaggattttctgtcccaaatgtggaaatggtggcaccttaaggaaggtagctgtcactgttaatgaaaatggaatagtattagctgcccgtcgaccacgagttacattacgtggcacaaagttttcattgcctttaccccaaggtgggagggatgcagtctcaaagaacctcattctccgtgaagatcaacttcctcatagggtactttatcctaaaacgaagaaagccaacaagcaggttgtgtgtgatgatgacttctttacaccagacagtgtcttcagccaccacacagataagaaagctcctttccagcctcctgtaaggaaagcaatggcagttttcggtgggaggagaaatccaaatgacaatcactactcacgctctaagcataagtag

SEQ ID NO: 110026 - DNA, 1089 bp, Glycine max
  misc_feature (1085)..(1085): n is a, c, g, or t
  Peptide Sequence Number=SeqID_226804
atggaggaaactccgtcttcagttccagcgacggcatcatgctggagcaacgtggtcaagaagcagccaccacctccaccgcagcagcacaccgagcgagtgttggtggaaaccagcgattcccccaatgccatctccgtagccgtcgtggacgccaacgcagtcatcgaatccggcgaaaagctccacggcctcgccgacaagttcatctccatccccgaagtcatggaggaaatccgcgaccccgtttcccgccacaaactctctttcctccccttcaccatccaaaccatggaaccctcctccgaatccatcaacaaagttgttaaatttgctagggctaccggtgacctacaaactctttctgatgttgatatcaagctcatagctttgacttatactttggagggtcaaattcatgggacaaaacatatcagggatgcccctcctcctgtgcaaatggtcaatgtgaagaggttgcctgagaaggacttgcctggatggggttctaacgtgcccaatttggatgagtgggaggcgttggaacatgccgaggacgcgtccaattccaattccaggatccttcctttgcaggaccttagcttgaacattgtttctcaagatgagcattctgtggatggttccgtggagcctgtgagtgaagctgatttggggattcaggagggtggtcagaatggtttgacgaagccaaggagatatctgcctaagaaaaaagagataaagattgaggggaagacgatggtggctgatggaattgatgcgtcgcagggaggggttgatgacaatgctggtgattggatgccggctgtcagtcggagtactcataggagatatctaagaaggaaagctagacgcgagtatcacgagtcgttgtcaagtaatcaagatcagcaagagttggaagcaaatgttgttgatggtagtgttggtgaagatgctagtgctttaaatccgcctgttcatcagaggatgaagaacaacatattgaaaatgctgtgttggaggatggtaaggtggttaaagagaacaaagacaatgaaagtatctatgaaattatgcagcanatga

SEQ ID NO: 110027 - DNA, 723 bp, Glycine max
  Peptide Sequence Number=SeqID_226805
atgggagagaacaacaacgagtttcacgcggtggcaacactacctctcaagtacctggcgctgcaagatctggagtgggaaggcaccctcatttgccttcctcccaacttaacgtctctgtcaaataacttcacccctaaggttcttcccctatcgatgtttccaccatcggagaccaccaccactccggttcctcctatgttgccgtcggtggaggacaccacctacgttcaactgaacctccaagatcaattgtcagcgttacaaaacatcaatagcgggaacaacactcatgattaccctcagacacaatttcttaatagggcagcgaaaaaggttgctcccgtgtggccaggctcccaaagcaatcactcgttgtcagtgaaaggcagttcttcgaagtccaatgagtgcaggagatggagtgaagaagaacacagaaatatggaaaaggagattggaaaaaaatttcaagaatcatcaaaacaagaaacccaactcaagttgcttctcatgcccaaaaataatggtcctgtccctcaccgcatttaccagcagaatgaagtttcttttccaaatcttgatgtccctatcacgcaccacattgatcatcagaatggggttccttttcaaaatcatacaatgcaggagttatatgaaattcatctggcagtccctcactacattaatcaacaaaattgggttcttagaccaatgcgataa

SEQ ID NO: 110028 - DNA, 408 bp, Glycine max
  Peptide Sequence Number=SeqID_226806
atgaacaaagatgtctataatggagacttaatcttgattgatgacatttcggatgaggtgggatcaaatggtgggcagccaactacccctcttggtgaaacccaaatgaccaattcggctgaggaggatgtggacgatgtcccatatacgagccaaaatggcgtctcttgggttgcagattggggagtgcactgttgctttggcctggccatttgcttgagggtgttctatggacgtcgccatgttcttgatgttgaggcctactgtcgtaacctacccttcggcgggaggacaacgcgtgaatcgcgggtgcatcttccaagaaaggaatacgcgcggagtcgccaccaatgtttatttgaggaaaacgtcagaaaaaccggaaaagacatgatctacgaactttaa

SEQ ID NO: 110029 - DNA, 651 bp, Glycine max
  Peptide Sequence Number=SeqID_226807
atggaggatttcatcaagccgagacacttgaaggattttatccacaagcctcaatcttatcggcttcacaatagttataggcaagaccaagacaaaggaagagatagagattgcagtcaccagtctcagactatgagtgaaagaagtcgaagccggtctaaggagaacgctagacccattgctcagaggaagagaaagatgagggaagaaaggtgtcaggcagtgcaacaagaggtttccaaaatgatgacgtgcatagactatgctgacttgaatcgtgcttgtcaaaaggatgcatactcccctccccaagatcgatggcttagtagatgggatagcgggatatcgaatctggaagtatatgtggatgacatgttcctcaagtttgacgacttgtcagcacatatgaaggatctaaaggaggtgtttggacaacttcggaaacacaacatgaggctaaacctcaaaaaatgtgtgttcgggataagaagtcctaggaacatgaaggaagcacaaaggttggttgctagaatagcctccttgtctaggttcttgccaagaatcgtcgagaaggccaaatcgataatgaatcttcgtaaaaaggcaaagaacttccaatggaatgatgagtgtgaagaaacctttcgataa

SEQ ID NO: 110030 - DNA, 438 bp, Glycine max
  Peptide Sequence Number=SeqID_226808
atgagagtgagaaggaaccgcctggcagcgtcgcggacgggctgcttggcatcaccgaggcggtcgacgacggcagggactagcgcgttgaagtggagcttgaagtggtcaccggcgtgcacggcagcggagtcgagagcctggagcgcgccctgcgagaccttgaagctgttgtccttcaagagatccaagcagcaatcgacaagagaagtgacctcactggagctgaggctccttctggaagcttccagcaccttgtggaggcgctccacgcccgccattcgctccttcgcgtccttcgcgcgtgcgagctcgagcgcttcctccatcggatctggcacggcgggagatggtgaattttgcggaggcctcaagatgaggggagaagttgcggtaggagagagaaacagaagggaggatgacgcggaaatgaaatga

SEQ ID NO: 110031 - DNA, 255 bp, Glycine max
  Peptide Sequence Number=SeqID_226809
atggcagcaaggatagctgtacaaagtggtgcagctggaattatagtgtccaatcacggagctagacatttgtttatgtgttgggataatagtattgcctattggagaaaatttgtggctaaatattactctcctcgtgcaaagaaacggtggtgcttgtcattatatagcaatgttgggcatcatgcacttggtatttttcccactactaaaaaaatgagtttcaacatcaccctattaacatcggttatttga

SEQ ID NO: 110032 - DNA, 255 bp, Glycine max
  Peptide Sequence Number=SeqID_226810
atggagttttgcttggctagtccatgtaaaatccaagtttcatctcctacaataattgttgaaagagcagggttctttgcctggacaagcaaaagctggagagtcagagagaaatttgcacgaacagtcacatctgtaattggtctgttttcatctactgagcttccccttcaacgtgctattctttctcctattttgcagttgctgaatgatctgaatcctgctgttagggaagcaactattttgtgtattgag

SEQ ID NO: 110033 - DNA, 1756 bp, Glycine max
  Peptide Sequence Number=SeqID_226811
cctgcacattaagccgcttaacaccacgctgaaaaacctgaccggacgtttccgctacaacaacggaaacctggagagtgaagagctgcaggccaactggttcggtcagcccaccggcgtgcgtttcaccaccacggaaaatcccgatgattttggcgttaacgtcaaactgctgggcgactggcagccggcaaaactggccatgctgcccgccagcgtaagcagtaagctgggcggcagtctggcgtggcagggcaatgtcgacatcacgctgccgcatcagggtggggcgcgctacaaggttgatatcaacggtgacggcaagacagtgagcagtcacttacctccaccactggataaagaggccggtgaggcactgcccatcgccattaatgccagcggcgatttgcacagttttaacctcagcggcagcgtgcgtgagcaccatcgctttaacagccgctggctgccggagccgcagctgcgcgttgatcgcggtatctggctgaatgatgccaaaagcacgccggcgctaccggatcggcgtgggatggtgcttaatctgccggcgctggacggcgaagcctggctggggctgatgaccggcgcgacgggttcacgcaatgcgcagggcgagacggacatcggcggcgcactgctgccgggcgatgtgacgctgcgcactccggccctgacgctcggcggccagcagtggcacgatgttaatgccacggtgacccagggcgcgggcggcagtacgcagctgcagctggagagccgcgaagcgcgcggcagcctgcgaaccgcacaacacgcgccgtggcaaatcgacctgagctacctttattacaatccgcaatggagtgacgacgaagcgggcaaggcctcctcgccgttcagtggggacagcggcattgatttccgcagctggccagcgctgcagctcaactgcgctgagtgctggctgcgcgggcagaagttcggccacattcaggccaggctccagccgcagggagagacgttagcactcactaacggcagcgtcgataccggcagctcgaagctcaatgtcgcgggtgaatgggtgaacaaagcgggcgagcagcgcacctcgttaaaaggcagcctgagcggcaaaaatatcaatgatgccaccaactggtttggcatgaacacgccgctgcgcgatgcgccgtttaaaattgattatgacctgcactggcgctccgcaccgtggcagccttcagaaaagacgctgagcggcacgctgaaaacccacttcggcaaagggcagattgcggatgtgaacaccggtcgtgccggacagttgttgcggctggtgagcttcgatgccctgctgcgtaagctgcgcttcgattttagcgatacctttaatgaaggtttctggtttgattcgatcaacggcacggcgtggattgaaaacggcgtgatgcgcaccgataacctgctggtggatggcctcgaagcggatatcgccatgcagggcaaaatagatctggtgcagcggcaaatcgacatggaagcggtggtggcaccggagatcggcgcctcggttggcgtggccaccgcgtttgtaattaacccggtggtcggcgcggcggtatttgccgccagcaaggtgctggcaccattgtggaataagatttcgctgctgcgctatcacatcagcggaccgctggataagccggaaatcaatgaagtgctgcgcaaaccgcgcgaagccgataagaagtga

SEQ ID NO: 110034 - DNA, 357 bp, Glycine max
  Peptide Sequence Number=SeqID_226812
atggctccgaaaaagctttccgcgaagagatctaggagggacgtcgcggctgaagggaccagtgccgcccccgagtttgatagtcaccgtttccggagcgccgaggagatagctcgcagacattggatgtcgctggctactcccatgactaagtttgaccctgaggtagtcctggagttttacgctaatgcttggctcacagaggagggagtgcgggacatgcgttcatggttgaggggtcagtggattccctttgacgctgatgccctcagccagttcttgggtgacccgctagtgttagaggaaggccaggagtgcgagtttagtcaaaaggagggacagggccgatgggtttga

SEQ ID NO: 110035 - DNA, 225 bp, Glycine max
  Peptide Sequence Number=SeqID_226813
atgttggtcgaggctatgcaagaaatggattttgtgggggaggcctttgtggttgagggggcattctctgttggatgggcgtcggactggaaggaggtccgatattggctgagtaattgtactggggcagggaatattggtaagtggggtggtgaggggtttgttgggactttggccacgtgggagctgcagttacggcatggccatctccctcctttttcttag

SEQ ID NO: 110036 - DNA, 285 bp, Glycine max
  Peptide Sequence Number=SeqID_226814
atgaatgacgagtcatttcgaggtgatcgtcagcaccacaccaacttggatgataacactttctttgtcaaagcattagggcaggtactaacagatgctaggcccatgattagatcgatcaccacccagtgtccggctaaagacgttaaagaagcgcttctaggaggcagcctagcaatggctccaaagaagctcctcactaaaagggcaaggaaggacgccgcaggggagggatccagtgcagctccacaagcagaaattgagtttgacggactccatttctga

SEQ ID NO: 110037 - DNA, 375 bp, Glycine max
  Peptide Sequence Number=SeqID_226815
atgattccactcagattaaagcattcctcttcatgcagtggttcagttccaagcaatggtggctcgtggcggccaccaatggtcataggtgttggaggaggagatgttagggtttttgggcggaagtttaaagagagaaagggtgttacatgcactagaccggacctagcacaagcagtcattgttgtgagtagagacacatcttatgcgtttcctggttactcagattctaactatgttacagatttaaaagcaaggagatttgtgactaggtacgcattcatgattggtaactctctagttagttggaaggcaacacttcagcccatagttgctttatccactacagaggaagagtacatgactctagcataa

SEQ ID NO: 110038 - DNA, 708 bp, Glycine max
  Peptide Sequence Number=SeqID_226816
atggtgaccaagggcatgccttgggtttgtaggagtgcattccaaggacttatgcttcgaggctctccaagggcaaaccttgggtttgatgagcctttggagaagcaagactcactaagggtggatcttgggtttgacgagcctctggagaagacaaaccttgggtttgatgagcctttggaaacacaagactcaccaaggacggaccttgggtttgatgagcctttggagaagcgagactcaccaagggcaaaccttgggtttaacgagcctttggagaggcaagactcactaagagcaggcattggaaaggcatttcattggtcgttgtctggggtgaacaatgaggatgaatttgttgagtctaatgtgcaaggccctaaggatgaatttgttggctgcctctacatgaccattggtctggggatggaggccataccttcatatgaggtgttacgagcgactagtaaatatttgattgctcctagggcttttggctatagtcccattatgtccattccacacatggcaaagagccaaggggagcttaagctgtggagattgtcaggaaggggtgtccatcctgagtgtcggccaatagtagctggcacacaccactttggttacaaggaagctttctccggtataaagaccacagatcccatcatgaagctctctcatgacataatctgcctattggctgtttag

SEQ ID NO: 110039 - DNA, 744 bp, Glycine max
  Peptide Sequence Number=SeqID_226817
atgcactttcggggtcggcagaggcaagttcctcccaaagtcgttgaaaaggcgaagccattctacaagatgcccaagaaaactgagtcatccctatggggcaaggcctgtgaaaaagccttcttggccttcaagaagaccatcaccgcatcagcaaagcatcaacttcccatctacttcatcagctacatacttcatgatgttgagaagcactatcaaatgatagagaaggtggcactagcacttagtacctcgacccgacatctcgggccatactttcagagtcaccaagttgtagtcaagacgaactaccccatcaaacgggttttgcaaaagcctaaactggcaaggaggatgacaagcggggcaggagtcatcctcgaaggccctgacaatgttaccttagtgcaagccctcaagctcaacttcaaagcctcaaacaatcaagatgagtatgagacacttatagcagtgctaaaactagcaagagaagttggggccaagaagctacgatgctacattgacttgcagcttatccaggggaaattcaccaacatatatctaaccaaggaaacaatgctactcaagtactaccacatcgctaaaactatcatcaacaacttcaaatgctttaagatgtactacatacccaaggataacaatactagagcagacctactctccaagttagtcagcaccaaaaagaccgagcccctcaagactatcatccaggaaacgctctaa

SEQ ID NO: 110040 - DNA, 342 bp, Glycine max
  Peptide Sequence Number=SeqID_226818
atggctttgaagtctagtcctttctcggatagcctgtgcaagcaatcacctacaacactggacaagctgagagcaaggattgttgggttcatccatatggaagagatgaccaaattcaaagagaaagtgcatggaaaatcatcaaggaaaccaacaaaacgagaggctaagaccaagagcagtcataacaaaggaaagtcaagagtagatagaccacctcagtccaagtttagccaagattcattaaggataaggaaccttcatgagagcaagaaagggaatgcaatagagccgagagtgcaactagactcaagagacaacaaaatcattgtgctagagtga

SEQ ID NO: 110041 - DNA, 396 bp, Glycine max
  Peptide Sequence Number=SeqID_226819
atgcctgccacgagtgaccttgaaaatgggaactcggtgaatgtggcaaatctcttgtgtcaagagcctgataagcatacattgataatcaccctggaaagagagatgaaaatcctaaagcaaagtaatgctcaagagatggacaaactaaaaaaggagaacaccactctttgggaacaatacttgaaacttcaagaagaccaaagcgcgaattcggtctcaacaattgtaacccaccagactcatccaaccaagattgatgaggctaatacgacgtggcaagaaggaaagccctctatcacgcaattcagagagctacaaatgctgacacttggctatattccattgttgatgggattatggaggcatagctcttgcctggatagaagacattga

SEQ ID NO: 110042 - DNA, 957 bp, Glycine max
  Peptide Sequence Number=SeqID_226820
atgggagagaacaacaacaacgagtttcacgatttcggtggcaacactacctctcaaggtggttatgatggcttcgacgagccactgtattggaagtacccagcgctgcaagatctggagtgggaaggcaccctcatttgccttcctcccaagttaacgtctctgtcaaataactttgcccctaaggttcttcccctatcgatgtttccgccatcggagaccaccaccactccggttcctcctatgttgccgccgatggaggacaccacctacgttcaaccgaacctccaagatcaattgtcagcgttacagaacatcaatagtgggaacaacactcttgattaccgtcagacacagtttcttaatagggcaccgaaccaggttgctcccatgtgggcagttcttcgaagtccaatgagtgcaggagatggagtgaagaagaacacaggttgtttctgcttgggcttcagaaatatggaaagggagattggaaaaacatttcaagaatcatcaaaacaagaaacccaactcaagttgcttctcatggccaaaagtatttccttcgtcaggcctcaagtaataaaggcaaaagaagaagcattcatggcatggtcctaccagataatggtcctgtccctcacaacatttaccagcagaatggagtttcttttccaaatcttgacggccctatcactcaccacattgatcatcagaatggaattccttttcaaaatcttacaatgcaggaattatattaaattcatctggcagtccctcactacattaatcagcaaaattgggttcttagaccaatgcgataaatatatcaaaagtaccgcaagagatcacattgatgatcgttcattgacaacgttggaagcccgtcttagaaacttttttgtctttgaaggttgtatagcatgcttagtttactctaggaaattgtcaaattgttaa

SEQ ID NO: 110043 - DNA, 528 bp, Glycine max
  Peptide Sequence Number=SeqID_226821
atgaaatctacaactgtggaaatcaagaaggcagaaccaaagaagccaaatccaccagctccatcatccaagcgctataatgactcccggtcttcatatggtggcggatatggagatggttatgatgggtttggtggtaattttggtatgggtggctataggtcaggtggtgcctatggtggtaggggaagtgcaggtgcttatggtggctttggaagtgaatttggtgggtatggaggatatgccagtgccatggggccatatagaggtgatccttcacttgggtatgctggtcgatatggtggaggctatggcagaggctatgatcttggtgggtatggtggacctagtgacggttatggggcatatggtggtgttggtggtggttcctctggtagtgcctatggaagcagctatgatgccagcttaggcggtggatatggggggcctgctggaggctcattttatgggactagagggggatacgcaggtgcaggaactggtcgataccatccttatggaagatag

SEQ ID NO: 110044 - DNA, 540 bp, Glycine max
  Peptide Sequence Number=SeqID_226822
atggcgaaatcgagcaaagatccgatgacgtcgtatctggcgataaaggcaaagcaatacttacacaaccccattcactacgtgatggcgattcgcgaccacacaaagctttccaaaattatttcttcgcttccttacgtcgatatctccctccacaacgccgttggttggaacccgcttcaggaggcgctctgcctgcgcgcctctgacatcatgcaggtcctcgtccggctccaccactgtgccgcctgggccaagtggtgccgccgcctgccacgcctagtggtggctctccgtcgcatgcgtgatttctacatggagatctcgttccacttcgagagctccgtgattcccttcgtcggaaagatcgctccctccgtgattcaattttttaaagggtgttcattggtttcttctgtggttttcgggagaagctgttgcaagagagagaatagtgagagaatgaaggaggttttcaggagaagctgtcgtggaggtatcctacagcacaaaagaatttcaaattctttcataaaatga

SEQ ID NO: 110045 - DNA, 287 bp, Glycine max
  Peptide Sequence Number=SeqID_226823
gggagaagcttgccgcccagctcgcccaggcgagcaaggttgcttcctccagaagcaaaagccttctggaggaatcttctggagggcccaagtgggcctggggtcagtggatttcctttgacacaaatgccctcagccagatcctgggtgacccgctagttttggaggaaggccaccagtggttttgcccggaccgctgtaaggaggagggtgcggattatgtgcaccagcatgaccactttgacctagacgtggatgagactgctgctcagcaatgtcttgcctag

SEQ ID NO: 110046 - DNA, 120 bp, Glycine max
  Peptide Sequence Number=SeqID_226824
atggggagcagtgtccaaaggatttgtggcagccaagcagggaaagattgggagtacccaggctttgatggacgcttctctggggcacatcgggactgcgctacaaaggcaccccattag

SEQ ID NO: 110047 - DNA, 1166 bp, Glycine max
  Peptide Sequence Number=SeqID_226825
cctctccacgggcgatacccagaacacgcaccggcgcctccacgatgttgcgcagcacggtcatatgcggaaagagattgaagctctggaaaaccatgccgacgtggttgcggatctggcgcaggtgtttttccgaggccatgaaggggcccttgcctcccggctcatggtaagacatgtcagccagcgtcagttttccctcctggaagggttcgagtgtcatgagaatgcgcaggaccgtcgacttgccggagccggaagggccgatgagggtgactttttcacccttcgccacgctgaaattgaactggtcgagcaccgtcagaatgccgaagcgtttcgtgacatccgaaaattcgatcagtggctgattggtggtgttggtcatcgcaagggtattcctgcttttgggagcgccctttgcaggcggctgaggcctgccgagcagattatggtcagaaggaggaagatcaggccgacaagcgtcagcggcaccagatattcgaagatagttgcccatggctggaacgatgcgcggaatggcctggggaatgatgatatcgcgataggtttgcatgcgcgtcaggttaagcgcggtcgccgcttcccattggccatggtgtatcgcctctatgccgccgcgatagacctcggaagtataggccgcatattgcaggccgagcgccagcgcgccggtcagaaacgcgggcaagacaatgccgaaatccggaagcacgtaataaagaaagaacagctgcaccagaagcggcgtatcgcgcaggaattcgaccaccagcgcagtcggccaggaaatcatctttacccggctgcggcgcagcagcgcaaagacaagtcccagaaccagcgcaatggcaaaaccggcggcggctgccttcagcgtcacggtcaggccgatcagaatgatgggcaggatggaggtcgtgtaggtgagccaggtggtcgtgtcccattcgtaaccatacatcatgagaagatatccttacgaatggcgcgtgcgcgggaagacattgccgcgccgcacgaagcgttcgatcacccggatgacgaccatcaggatcagcgacatcgcgaaataacaaagcagcgtgaccgaatagatgctggcgctgtccagcgtcaggttgcggatcgactgcgcagcgaag

SEQ ID NO: 110048 - DNA, 402 bp, Glycine max
  Peptide Sequence Number=SeqID_226826
atgcatgtaagagatcaaaccattgcctacccttatggtctgcacatctcaaaggccaccgatgtcaagatagttgttgacaagaaccaggtcatgtggatggacactcataaagccttcacttttggttatgatggaaatgacaatgctaagcaccatgacgtccttcaagtgttacgaccagttaggaagtattacttcgatgatgcttgcatcttctttataaaggacgccgacaacggctcgttcattcaatgcctactccaacttcctaccattcaatatgagaggacttataatatgaagaaaatgattgaagaacaaatgatagctcatgtgactcaactccatgaagctcagaaaaagaaaaggttaaagaagaagaagttgttgttgttatga

SEQ ID NO: 110049 - DNA, 618 bp, Glycine max
  Peptide Sequence Number=SeqID_226827
atgaggctgcctagcgactatgggaacaagatagttgttatctacgcatgtcccagaacacatggtggtggtgctacgcactggtttccaaaggaacctggccaaggctcttgctctggccatggcataacctttagatcctcaagagaccccagacacaagttctgggaaattactaacaatgcttctctatgtttgtcctcaaagaggtccgttgataatgttctaagtactccctcacatgcacgttctatgatcaatggggagaagccttactccaaagagcaatgccatgatgataacaataagaagaaaaataattatgagagggagagtttctcctcaaagaggcacattgatgatgtgctaagtaatccctctcatacacattctatgaacactagggagaaacttaactctagagaacaatggcatcataataataagaagaagaactatgagagggaggattctttgggctggaaaccacttaataaagggaacaatacttttgaaaggttttattctcagagcacgggaaagggaagggacaagaacaaaaatatagtggaaacggttgtgaacaatgtgattgaagagacaagaggccaaggctga

SEQ ID NO: 110050 - DNA, 183 bp, Glycine max
  Peptide Sequence Number=SeqID_226828
atggctatggaagatgttggattacataagagtcaggttgatgagattgatcttgatggaagcatagggattccaaaggtacgacaactttcgaaggactactttgatggaaaggagccagacaagggtgacaaccctgatgaagagttgcctatggtgctgcaatgcaatgaagcattttga

SEQ ID NO: 110051 - DNA, 1155 bp, Glycine max
  Peptide Sequence Number=SeqID_226829
atgcgtaatttcctgcgcgagcaaggcaaaaagaaatttaatcctggcactgcagccggcatgatgttcctcaatgtcaaagacccggccacgatcaagttgttgcgcggcaccatgatacaaatgggctacaaagccattaatatcgccaacagcctggccaagaaatttggtttgctaaaagacaagaaagcaccgcctgcaactgtgggcagggcagaaatcaaggcgcaggtagttcatttcatcaaccgcccgatgccgaagaaaatgcaatccaaaacctcacgcgccatgatggggctggaagatgacaccatgatcccggtcatccgtaatccgcaaaaagtgaatgaggactcggaagccgtgttctatttcccgggttgtggttccgagcgtttattctcgaacgtagggttggcgacacaagcgatgctgtacgaagttggcgcggtcactgtgttgccaccaggctatttgtgctgcggttacccgcaaactgcggcaggtaatcacgacaaaggtcaggagatcactgccgataaccgtgtattgttccaccgcgtcgcaaatacgctgaactacctggatattaagacggtgattgtgtcttgcggtacctgtatggatcagttgcagaaatacgagtttgagaagatcttcccgggctgccgactgctggatatccacgaatacctgatggaaaaagacatgcgcctgcaaggcgtgaccggtacacgctatatgtaccatgatccatgccacacgccgatgaagacttacaagccattggaagtgactaataaactcatggggacagaggttgcgttgaatgaccgttgctgcggtgagtctggtacgtttgcggcagcacgtcctgacattgccacccaggtaaaattccgcaagcaggaagagctagaaaaaggcatggccaagatgggtctgactgtgggtgcgcctgagcagccagttaaaatcctgacctcttgcccaagctgcttgcaaggcttgtcacgttacggtgatgacacaggtattgaggccgactatattgtggtcgaaatggccaagcatgtgctcggtgaaaactggatggaaaattacatccagaaagccaacaatggcggcattgagaaagtgctgctttaa

SEQ ID NO: 110052 - DNA, 836 bp, Glycine max
  Peptide Sequence Number=SeqID_226830
gaagccatcgcccagctgttgtgcatactggggcaggatttcgcccagactgttgcagggaggctggtgcgaatcatgcgcaccagcatgaccactttgacccagacatggatgacattgctgctcagcaatgtcttgcctagcgatcacaactccgacctccctctacctaagtgccagttggtgtatgccatccagacacggatgagcgtccatgtggcccaggtgattgctgatgccatttatttgtttgcaggtatggtgcctactaggcaccctctggacacagataagtccaacagggccctggggtttccggtgctgatcacaggcctctgccagtcctacagagttcccgtcacccccagtaaggtaatccgaccgccgatcacccgagccttcatcgagaagtactgcacgcctaggcaggcgcatgctaggccactgggcgtagagcgttatctacagcatttggttcgccaacaggcagccaaccaccgtgggcaggggcagggtttcgccccttttgtatgccctacctcgaagcagtttggggctgaggttgcatggcctggagactggcccgatgcccaggtaggggaggagcctgcaggatcccccggtgaggcagatgaatcccatatggatgaagatatgactgacctgctaggtttcttggggcaaggatggacattctcaccctgggtcaaggtttatggtgagttgggattttggctcaaggctcattgtcgcaacctacccttcggcgggagggcgacgcgtgactcgcgggatgcgtgttccacgaaaggaatacgcgcggagtcgccaccaac

SEQ ID NO: 110053 - DNA, 372 bp, Glycine max
  Peptide Sequence Number=SeqID_226831
gagcaccctggaagctcttgaggaaggatctaatgacactggcccagacttggagtgtgttatcatactccaacctcgcccccacttctcatacgtccaatttggcatactggaaaaaagagaaaaattggaaggtgtagcagctggagtctcactaagcctggccaatgtgcttagcaagtatcatccactaagcgagacatcggctcgcttagcgagtaagagtaatcttgaagggaatctgccatgcaagcacgagcccagcgcgtcaccagctcgcccagtgagtcatttgtctcttctggcgcttagcacgcctggctcgctcagccaaagatcacttactcacgctaagcgcgaaaatggtgctaa

SEQ ID NO: 110054 - DNA, 240 bp, Glycine max
  Peptide Sequence Number=SeqID_226832
accattcctgctcctcctatcgattcatgggtgtcgtatgatgatatacatgacaggtggatgcactactcgggtcatatcgttccagcaagtgagacggatatcccccacgtgccggagctaggagcactgtcgacatctacgaggcacgctgtagatgagcctagacatgtagtggttggagcgccaggctcatcgacacatgaggtgatcgaagaatgcctcaggatgaccaagagg

SEQ ID NO: 110055 - DNA, 312 bp, Glycine max
  Peptide Sequence Number=SeqID_226833
atggtgactatcaaactcgggggtggcattggacccttccgctgcggcgtctcttctagacctctgtcataccctaatttcgtccggggacctttgcttggtggcatgcaactttcatttgaccattttgagaaaaagaatcaccaaaaaaaggtaggggtgtatttagtaaaagttggggtgcaaatagcaaccaggcccacttgggccctccagaagattcctccagaaggcggttgcttctggaggaagtcaccttgctcgcctgggggagctgggtggcaagcatctccccaattttcctataaatag

SEQ ID NO: 110056 - DNA, 426 bp, Glycine max
  Peptide Sequence Number=SeqID_226834
atgcataaggcattacggacgaatgcacctcttccgtatcctcagttagtcactctttttcttcgtcactttcaaattcctctcgatgatgaaccttttgttcaagtcaagagatcttttgccattggtgttggagcggtaacttcttttgggtaccgtaaggatattgatggatactggattaggaaacaagattcaccaccaccggttcctgatgagcgtactctgtctcctctgccacaaagagatgcttcctctactcttatgcatgaagtcctttctgaactacgtggccttcgagcattcgtaggtgactgtttggatgccatggatgctcattttaaaggcatggatacacggattactcagcttgaagatgacatgggtttcattcatcgttgcttcgatccacctgctgccccatag

SEQ ID NO: 110057 - DNA, 195 bp, Glycine max
  Peptide Sequence Number=SeqID_226835
atgcaaaaagatagccttgtctacaacaatataagctggtaccaagaggtgtcaaagctaaaggcaaagtatgattctcttcaaaggacccagaggcatttgcttggggaagatcttggaccattgaacataaaggagctgcagaatcttaagaaacagcttgaaagggctttaacacaagcaaggcaaaggaag

SEQ ID NO: 110058 - DNA, 501 bp, Glycine max
  Peptide Sequence Number=SeqID_226836
atgggtactcaggagaacaacaattctccattgcatgacctaagggaagtggccaattctcaagaggagtccacaatctttgaacaaacaccaaatggagacactggggagaaaccttccccggaaactagcgaagactcaaatgcaaagcgcagtaaccctaacaaaggtgaggggaatgaaaatgaccaagtgaaggtagaggaagagtccaaagaatgtaataatcgtaatgcaaatgatgagaaacagagcaagagtaactcaaaacctcctgagcctccaaaggattacattcatgttagagcaacaagaggtcaagccactgatagtcatagtcttgcagaaagatatacccttaatactaacttcttcaacaccaaagaacaaaaggcagagaacaccaaggagcataaagacctatcctcaacctggactaatggatttgcttattgcaataccatgtcaatggtttcaggttcgagacatggacaagattaa

SEQ ID NO: 110059 - DNA, 219 bp, Glycine max
  Peptide Sequence Number=SeqID_226837
atggcaattgcgtcccagtccttgaagccatggcagttcacggtgcatgctaccaacaactcctcccatgtgccccatgcttcgttatggtgttgctgttgttggtggtttttctctatggcattgggtagaagactccaagtagattggactagagatccaagggaaggccctagggttctcatgagccttagggtagatttcgagtccatgggctaa

SEQ ID NO: 110060 - DNA, 714 bp, Glycine max
  Peptide Sequence Number=SeqID_226838
atgttgacacttgatgttttacataggagattaaaatggacgaacactatcctgaaggaggaaaacactatcctgaaaagccaaaacagtggaatagctcaagcagacccaaaggaggaaaacactatcctgaaggacgaacaaaaaagtcaggatttctctagcgatcatagtaaaaatacttcaactgatgcaaaagaagaaccctcttcaccttctatgtcctctaagcaccaaacaatagaaagggaaggtaataatagtgagaaaaaagataataagaatatgcagcatgtttcacaccagacccactctaacaatttggcttttaatgcccctgccttcagtgtttctcaagcattggatgccttggcagggatggatgattccacccaagtggctgttaatagtgtttttggtgtgatagaaaatatgatatctcaacttgggcagagctcggagaatgaagaagttgaggatggaaaagatgttgaacaaaagatagaagaaaaacaaaaaactaatagccaaacaaaggattccaacacatctgttgatccttcagtagatgatcaccataatgatatgcacttgaataatggttcttgtcatacggaggaacaaccatctcaaagtcttagtgaaattaatgggaaccatatattcaatgctcaaagttgtaactctaatgatcacctagttgcaggggattag

SEQ ID NO: 110061 - DNA, 168 bp, Glycine max
  Peptide Sequence Number=SeqID_226839
atgtccattagtgtagattgtagaacaagaggtcaagcatactcattacctgcagatatacagtatcttgatgctagatgggaagttcctgttgtgcttcctctgcgtgattgttttgcccaagagatcaacatgctatgccgccttgatgggtttgtagtcctctag

SEQ ID NO: 110062 - DNA, 111 bp, Glycine max
  Peptide Sequence Number=SeqID_226840
atgaacgagagaggtctctgggcgaagcaaagagaaactgacgtagagctcacgatagtgaccttgttggatattcctggtggaggaaatagaatggttaaagagttttaa

SEQ ID NO: 110063 - DNA, 246 bp, Glycine max
  Peptide Sequence Number=SeqID_226841
atggacaacatccctatcaaactgtgttgcaacctaccctttcgtgggcgagcgaggcgaggctcatgggtgcgtcttccaaaggaggaaaatgcgcgaagttgccaccaacgtttatatgtggaaaatgtcagaaaaaccgaaggaaaaccggtcatgaagaatattccagattcgggagttgtatttacgtttgaggaaggtattagcacctctcacgtttgtcccaaaggacaacagccttaa

SEQ ID NO: 110064 - DNA, 277 bp, Glycine max
  Peptide Sequence Number=SeqID_226842
cgcgtttcctggtgaccctgtgctaaacgctccgagggggcctcagtatcaatcaccaccccgacccttgcattttgcgagaggagaagggccttccatagtacttgagaatgaaaggattgagcatatggaggagaggctatgtgccattgaaggaggaaaaagttatgtctttgctaacatggtggagagatctggcagctcaaatagtgcccttgatgatggagagggggatgataacaatgatagtggacacattgccggtgttttactataa

SEQ ID NO: 110065 - DNA, 539 bp, Glycine max
  Peptide Sequence Number=SeqID_226843
atgaaaaaggcccgcttgcgcgggcctttatctttatccaatggccgatcagaaaatatcggcgccgctgccccacgggccatgcggcttgtccacgccgtcggtgcgttcgaaaccatgcgcgccgaagaagtcgcgctgcgcctggatgagattggcgctgccgcggccgcgacgataggcgtcgaaatagccaagggcggaagccagcgccgaaaccggcaggcccgacagggcagcgtaagaaacgacgcggcgcagcggcgcatcggtttccttgacgacggcggagaaagccggcgtcacgatgaggttggccacatgcggatccttggtaaaggccgaggtgatctcatcgaggaactccgagcggatgatgcagccggcgcgccagatgcgggcaatcgtcggcatcggcaggttccagttgaactccttcgaagcggccgacatgatggcgaagccctgcgcataggcaccgaccttggcggccagaagcgcgctttccagatcggcgatgaaggccttcctgtcggccg

SEQ ID NO: 110066 - DNA, 464 bp, Glycine max
  Peptide Sequence Number=SeqID_226844
gattttataggcgctttatcaaggactttagcaaagtggcccttccactatccaatttgttgcaaaaggaggtggagtttgattttgatgaccggtgcaaagaggcttttgattgcctcaagcgtacgttgactaccacccctatcattcaggcacctgattggacaaccccatttgagctgatgtgcgatgcatccaattatgcgttgggggttgtccttgctcaaaacatcgacaagctgtctcgggtgatctactactgtcataccctaatttcgtccggggacctttgcttgatgacatgcgacctttctttggtccttgtgaggtgcttggcacccatcattaggcaatttgtgaaattccaggacatgccggaaaaccgaaaaaatattgatgcacaatccgtaagtttccgtgacacaccggaaatcaaatggaagcatcgttgcataattaagtga

SEQ ID NO: 110067 - DNA, 366 bp, Glycine max
  Peptide Sequence Number=SeqID_226845
atgagaattcaagggactaaccgcctaagaattctttgtcctaacacattggagggtacatcctttgtggcacaagtagaaggtacatctacttgggttgttatactgagaagaagagagggaatatctcttgtggatcagttcaagtggagggtacatccacttggttgttcaaagagaacaggggagggtacatcccttgtggatctttggcttgtaaaggattttacaaggttgaaagaaatctcaagaaccattagttgcttcgggactggatgtaggcacgggttatggccgaaccagtataaatcttgtgtttgtcttcttcttccctacactctttatctttatgttgtgtacttttaa

SEQ ID NO: 110068 - DNA, 736 bp, Glycine max
  Peptide Sequence Number=SeqID_226846
aggactatacatcgtcgccatcagagggctacacgtcctccccttcaggggacaacatgacctcccctttagaggactgcacgccctcgccttaacaggactgcatgttctcaccttcagaggactacacaacctcgccttccgagggctagacgccctcgccttcagaggagtacacatcctccccttgagagggctacacgccctcgccttcgtagggttacacacccttaccttcaaaggagtgcacatactcaacttcagaggactatacatcgtcgcaatcagagggctacacgtcctcgcctttagagggctacacgtcctccccttcagaggacaacatgacctcccctttagaggactgcacgccctcgccttaacaggactgcatgttctcatatttagaggactacacaacctcgccttccgagggctagacgccctcgcctttagaggagagtacacgtactcaacaccagaggactatacatcgtcgccatcagagggctacacgtcctcgccttcagagggttacacgtcctccacttcagaggactacatgcccataccttcaaaggataccttcataggactacacgcccttggcttcgtaaggcttcacgccctcaccttcagaggactacacatgctcgcctatagaagacaacacacctttgccttcgtagggctacaagccctcaccttcagaggactacacatcctcgttttctga

SEQ ID NO: 110069 - DNA, 2376 bp, Glycine max
  Peptide Sequence Number=SeqID_226847
atggaagatgctggtaactcgttctacctacatctgtcagataactcagggattttgcttgtttcgcaacctctaaatggtgataattacagttcttggagtagatcaatgcgcatggcattgattgccaaaaacaaaattggattcatcgatggttcgattccgatacttgaaattggagattctctttttcattcctggcaacacaacaataacattgttgcatcttggattatcaattctatttccaaggatcttgcttccagcgtcatttactcgacttctgcacatgatatttggaaagatttgcaagaacgctttcagcagagcaatgctcctcgcatcttcaagttgaagcgtgatctcattggattattacttgcacatggaatatgtgttatcatttcttatgggattgaagaaaagcaaagagaggtaggagcaccttctgtgtatgcttctcctacactagcttatgttgtgaatacaacttctgcttcatctggagatcagaagcataaaaatccaaagaaagataggccaacatgcactcactgtggtcttcttggacatgccaaagatcgatgctataagatcattggttatcctccacattacaataagaagaacaaaccagtggctaatgtacataatgttgtttctgcgaatgaagatactgcttctaattctgcacaaatgaatttcactcctcaacaatatcaacaactgattcggatgctacagactcagttaactcatgctcagactcctgccactgatcagactccagatgatcttggtacatcctttgtggtacaagtagagggtacatctacttgggttattgtaactaagaacaagagagggtacatctcttgtggatcagttcaagtggagggtacatccacttgggttattgtaactaagaacaagagagggtacatctcttgtggatcagttcaagtggagggttacaagggttacaagttatataacttgcaaacaagaaaatttttcttatcaagagatgtacatttttctgaggatgttttcccattccatgctactcatatctcattgactgatagatcaattgatccgttcttagaggtggtcttgcctatacctgcttcaaatattgttgatcatttacctcaacctgttcctgaggttactcctgctctagctcaaccaccagtcaatgatgtaaatgatgcattggttgtggttgatccacctttaaggagatcaacaagacagacacgactccctcagtatttacaagattatgctatgactgtgaattacctaattcagcagtatttgacttatgataggctttctcccttttataaagctttcataaatcaagtatctgaggagtatgaacctcagttctatcatcaagcaatgaagtttccacaatggaggaaagcaatgcaagaagaaattgaagctcttgaagctaacggtacatggtctgtggttgctttacctactaataagcaagccatagggttcacacaaagagcaaggatagactttctggacactttcagtctagtggcaaaactcacaacagtaaaagtccttttatccattgcttctgttcaaggttggtctcttttgcaactggatattaataatgcttttttaaatggagatttatttgaagaagtatatatgtcactatctctggcatatgctaagtcacagtctaatcatgtatgcaagttacacaagtccttgtatggcttaaggcaagcatcaaggaaatggttttgcaaattctctactgctttgaaaaccatgggttttcaacaatctactagtgactactctctattcagtaaagggacaggatcaacaatggtcattctacttgtatatgtagatgacataattctggcagggccaagtcacaagcatttacttgaggttcaagctcacttatctcaaacttttaagctcaaggtgcttggagatatgaagtatttcctgggtttagaaatagctaagtcttcaaagggcatattgctaacacaaagaaagtatactcttcaactgttagaagacacgggttacttagcttgcaagccacaatctcttcctgtggatcctaattgcaagctgaacttagttgatggtgaacctctatctgatgtgatcctttatcaaagattaattgataggctcatgtatttgacaatatctaggcttgatatcatggaacatgttacatcaggtttccttctgttgaatcatgtttcatcgagcaaacaattggctgattgccttaccaaactagttttagcttcaaggtttaaggaacatatgtccaagttgggaattctcaatgtttacctcccaacttga

SEQ ID NO: 110070 - DNA, 733 bp, Glycine max
  Peptide Sequence Number=SeqID_226848
ttttggcatcatcaaaacatcttggtgaatcatcatgttaactttgcttccacaaattggatgttgatgtgccttgattcggtgaagtataatatgcatgtgaataggcatggagtgggtctgaatgttcctcatagagggttaagacagggtgaccccttgtcaccttatctctttatccattattgtgaaggtctcacatctcttatccaaaaagcggaggcgagggggcatttgcacggaattaaaaacacccctcctccaaatattaaagatgaagtaacctcaattttggaagtgttagagtgtctaggtactggaagctatttgggcttaccgtctatgattggtagaaagaagaaggtcttggttaaagttgttgcgcaagctattttgacattttgtatgagctttcttatgcctacttctttatttaaggagattcaaagtatgcttaattcgttttggtggggtagtaatagaagtatgagaagaggaattaattggctgacttgggacaaattagcagtgagaaaagggtatggtgggatgggtttttgtcatttacttggttttaatctagtcatgctagcaaagcaggggtggaaacttgccacaatccaagtttcatttggtgtagcatccaagcttctcaagtggtggttagaggaggtatcaagtgaagggtcagaaacgggttggtgtgttgttgatcttattaatcctggttcag

SEQ ID NO: 110071 - DNA, 186 bp, Glycine max
  Peptide Sequence Number=SeqID_226849
atgaggaatgaagtttcaacatcaaaagggatgagcaacccaaggggtggtcaagttggtatccaaaaggccctggcagcaaggcctgtcagggattatgatgattctcagttggaactgttgaggtttgggaaactcgagagcagttccaaccatgcgggatttagtccaaaagcacaaacttga

SEQ ID NO: 110072 - DNA, 330 bp, Glycine max
  Peptide Sequence Number=SeqID_226850
atgttgtggtggaacaacaagcaaagcctaggtggaggtttacatgtttttaaggttttcccgagcgtaggaggaagagagattgaaccggagaaatatagaggcataagagatgttgagggtattagaaaatacagtgaagttagagagatcatgggtttgtggttggccaagaagaatgctttttggaggcaaagggcgaagactcacaggttcaaagatggtgatactaactctaaattcttccatgcagtggcatcaactcgtaagaagcataacaaaatttcaaagttggaagatgatggcagggagattgttgagactcaataa

SEQ ID NO: 110073 - DNA, 357 bp, Glycine max
  Peptide Sequence Number=SeqID_226851
atggcacaaagtggtggcgatggtggtggttacaacgacattgatagtgcttgtggtggtagtgacgaaggtgggggtgataatgacactgacattaatggtcgtgtgatggtagtaatgttggtgttgatgatgatgttggtggcgatgacagtagtagtgactatgttgatggtggttgtgatggtgacaacaagttatgacggtgacaatgatgatgatggtgacggtggtattggtggtggtagtgacataggtgctattagtggtggtcaccgtggcgatagtggtggagatggtaacaacaaaaaagtgtcattgttaaatgtgagaaatatttgtgtgcttttaaactaa

SEQ ID NO: 110074 - DNA, 387 bp, Glycine max
  Peptide Sequence Number=SeqID_226852
atggtgatgacgacaatggcgatggcgactggttactgcggtggcgatgatgatggtggtgtcgatacagttggtggtggtagtgacaatgtggtggtggtagcagagttggtggtgataaccaatggtggtaacgttggtggtagtggtggtattagtgatggtggtggtggcggcggtggtagtagtagtaatagcaatttcgatgacgatgatggtgataatgacgatggtggggtggtggtggtgatattgttggcggtggtggtggtgatggtgacaatgaagatgacaatgacattaatggtggtggtggtggtagtaatgtcgatggtgatggtgatggtgatgtcaatgacgacgatgttggtagtgcatgatctgtga

SEQ ID NO: 110075 - DNA, 147 bp, Glycine max
  Peptide Sequence Number=SeqID_226853
atgtggtttgttgatggaacgtcattagacatggaaacaattacaacggaaactgaagtcaagtggggaatggaactgggtggtccaaaatatcacatggcacttgctacaagagcaacaaaagataactacaatttaggtccttag

SEQ ID NO: 110076 - DNA, 291 bp, Glycine max
  Peptide Sequence Number=SeqID_226854
atggaagaagaacagggtagggtgttactgtcaaagaggttaaatggaaggtgtacggggcacttgaatgtcaaagaggctagggagagtgaatttgtagttgtcgcaacctacccttcggcgggagggcgacgcgagactcgcgggatgcgtgttccacgaaaggaatacgtgcggagtcgccaccaacgtttatttgaggaaaacgtcggaaaaaccggaaaagacgcgatctacgaactttttagtgaaaggttcgggagttgtatttacgcacggggaaggtattag

SEQ ID NO: 110077 - DNA, 372 bp, Glycine max
  Peptide Sequence Number=SeqID_226855
atgactctattgctttccattggtattagcttttggacactagaggctacaacatatcttccaaccattatatatgccatgtatataagttggatttatcttaaaaataggaagaggaaaccagaaactaaacatagagaacgatcattgaccctatcgcttcaatatttcattgaatgctctatggaagatatgatgcttctaatgatgatggatacagtctggaaagtgagcctttaccaggttcagactcaattgaggcatccaggaaaaggtgttgcggattcgaaatcatatattctcataagtcaacttcctcctaatgtatatgaaaaatatgttgtggatgttaatactgcgcatctatcttga

SEQ ID NO: 110078 - DNA, 321 bp, Glycine max
  Peptide Sequence Number=SeqID_226856
atgccttttttttccctcattttcgttttctctcttctcctctccaaaaccctttctttttcccgcagcccacaaaacctatctcagaaaaacaatgatcctggaattattcaccgttggaccgtcgcaaaatttgagtaccacgtttgcaacccaatttcgaacattctcaccgttgggaattccaaaatcatggagaaaaaggaatcgcatgaagaaagtacaagtggaggcttcaatttcttctccgtctctctaacgttcgagaattctatcggagcagtcagaggaaaagctggagaaatctcagggaatcgctag

SEQ ID NO: 110079 - DNA, 366 bp, Glycine max
  Peptide Sequence Number=SeqID_226857
atggtgatgacgacaatggcgatggcgacgtcaatagtagcgacaattataaagatattagtggttactgcggtggcgatgatgatggtggtgtcgatacagttggtggtggtggtattagtgatggtggtggtggcggcggtggtagtagtagtaatagcaatttcgatgacgatgatggtgataatgacgatggtggggtggtggtgcaatgttggtggtgattgtgatggtggtgatggaggtgatattgttggcggtggtggtggtgatggtgacaatgaagatgacaatgacattaatggtggtggtggtggtagtaatgtcgatggtgatgtcaatgacgacgatgttggtagtgcatga

SEQ ID NO: 110080 - DNA, 462 bp, Glycine max
  Peptide Sequence Number=SeqID_226858
atgacgtctaaggcagcaaaggaaatagctgacaggattgcgtcacagggatcgttcgttccccatggacgtcaagatatcctgattgctgccattgggcgaccagagcaccctggccgtgctcgtgctactggagccagtgtccccataaagcaatactttggatcggcttcacgaacgtcccgcagttcttcctccatgcctcctgaagacctacaacagttgacccaacaaatcagagaccaactaaaggagtcaatcacagaaaaaggacttgcactacctctagagccagaggttggtccctcaggtcctcgtgtcagcacaaaggagagttgtgttaatccctcaaggatcgatcttgggacgggtgactcagacaaatgcgggctatacattgaagaaaatccttcccgcctggttaaagatgcagaggctctcgttcctgtacccactgacgag

SEQ ID NO: 110081 - DNA, 359 bp, Glycine max
  Peptide Sequence Number=SeqID_226859
actccaaaatccaccctgtcttccatgtatctctattgaaacaacaccacggcccgcccccagtcacaggtgaccctctgccgccaactcaggttgacaaccaccccgtggtcgaacccttatcctttctcgattggaagtgggactccactatggatccaccctctcgcctagtcctggtccaatggcgcggcctcgccccagagaacacttcctgggagaactggaactccttacgcgatgcatacaacctcgaggacaaggttgacttcccaggggagggtattgttagaaatgagacaccagggggcaacaggcccaagagagttaccaagagaccaatccaataccaagactac

SEQ ID NO: 110082 - DNA, 208 bp, Glycine max
  Peptide Sequence Number=SeqID_226860
atggataaagggcttcaaggagttctcacttctggccacaccaaccctttcaactccgagatggatttctcaatcaacatcgagaagggcctcccaccccttgaggcaatcctccggattacagacttatccacaggcgagaatgctggtcctgaatccggttcaggatcggggaaagcactgactttgctactacctccactgggtg

SEQ ID NO: 110083 - DNA, 306 bp, Glycine max
  Peptide Sequence Number=SeqID_226861
gggcgctccccgctaaccgaagtcttggatttttctttcaaaggaaagacaagcagtggtttcccagttatcttcaattacttagtgagagcttatcgaattgatgtaaggcagggataccatgtaggaggcctgatcatacaccttaactcactagagcgtggacattaccttgaaggaacgtcggtgactaccctgtcggtagagtttctcctagagtgtatagctcattcgaagttcgacctcatgaaacatagagctgtaaaagtcctctccttccagtcgttcttacagtcaagtgactga

SEQ ID NO: 110084 - DNA, 632 bp, Glycine max
  Peptide Sequence Number=SeqID_226862
atggataggttgacgaccatgatgaatgcactcctgtcagcccagaactctcaagctgccgccgctgctgtagagcagcctttggtgagcacaaccccgctatctacagtgacttctccacccctctttctgcctccaggttgtacatggggaatgccacctccggtctgtggaagcccccaacccgccgtatctgaagttccacttcctttcgctcagcagtcagcaccggttccgcaacccggtacctctttccctcaagctgcaatgacctattcagcaccactgatccacactattcaacaagaggttgagccaattttccaagctgaaaatgttgtagccttcgacaagatggaagaactccaagaaagatttgatggtatgcaaagagaagtcgaagccctccgaggaagagatctgttcgggaaggacgcctgtgaattatgcttggtcccaaatgttactatccctcacaagttcaaggtgccagacttcgagaagtataaagggaactcctgtccccgcagccacttggtgatgtacgcgcggaaaatgtccatgtatactgacaatcataagctgcttattcatttctttcaggacagcctgactggggccgctctaaagtg

SEQ ID NO: 110085 - DNA, 588 bp, Glycine max
  Peptide Sequence Number=SeqID_226863
atgggcacttgtagagataaggacagtgtggatgacactgtttgcaaaaaatacgacattaacaaggagaaatgggctcagttttgtcagagtcacaaagacccctcgtgggaggatgtgcggaaaaaggcacaggtcgtcctgaagcaaaacactaccccccacgtgttgtctcgtgggggttatgaatatttagaacaagagctgatggttgagaagacaaagaaaaaactagaggaagttgctcaatctggaagcactgaggccatgattgaccctccatctcccatcagacggcacatgaagtggaagatggcctgcacgaagaaaactatccagatgacgtctgagtcaacaaaggaaattgctgagaagattgacttattggaggagcaggcgtcacaggctgccattgggcgaccagaacaccctggtcgtgtgcgtgccactggagccggtgtgaccatcaagcaatactttggatcggctccacggaccttcctcacttcttctttcatggctcccgaagaactagagcagctgactcaacaaattaggcaccaattggaggaatcgatcacaaaataa

SEQ ID NO: 110086 - DNA, 300 bp, Glycine max
  Peptide Sequence Number=SeqID_226864
atggaattgaaggaggatttaactgcaacttataatattcaaatcactacaagtcatacaaatccctaccacatatctccatcattgttgattactttcacaccagagtcgttcgagtacttcaccttctttctctctaagcgcaaaacctcgtactgtttttggcggttaaggatgtcggggaaaggagcgaaggggttgatcacaggcaaaacctccgccgccaacaaagacaaggacaagaagaaacccatctcgcgttcttctcgtgccggccttcagattttaccctctctttaa

SEQ ID NO: 110087 - DNA, 1488 bp, Glycine max
  Peptide Sequence Number=SeqID_226865
gactcgttagaagagcagacgacacagggtagttttgttccccatggtcgggatgacatcttgaatacggccattggcaaaccggaacatccaggtcgagttcgtgcagcgggatctggtatgacccttactcaattttatggtagggcaacacgtacatcgagtagttcctcagcaacactaatgcagcaacagtgggttgacattattggaaacataaaggaacaagtaaggaatgaatatgaagaacaacacaagaggagtctggaggaatttaagaaggagttgtccagtcagatcttcattcagttgagtcagatgggatcacaatactctccccttattgaggtggatttacaggcattggctgcacgtcttagcactaaaggaagtaatgtagaaactgctgatgttgacccatcaggcgacaaaaatgtgagcttaaaacccactatggggttatacgtgcaacgacaacatactacagtgttggtggccttggggaaaatatgtgaggggggatctgtcattcacaatgtcacttatgctaatgatgttgtaagggtgagtgttgacaaagttatagaaggtgacgccgaagtgcccttcccgacatcagagattcaatatgtcaggcaggctcttcaaacattcattgcatggccaacaaatcttgtgaaaaaagtgtcacatgaggagtccgatactagtccaaagaaacttcctgaaacaaatgaaagggggacgaatgattttgaccatgatctgttgcgtcaactgattaagagcctatatttcatgtacgacacacctgttgagttgaagtgggatgacagcaaatttgggctttcaaatgttgatgcttcattcttcttgacattctctaatgtaaatgaaatagtagctggatacaaatgtttgaacatatctatactacagttatggatcaagtttttggatgaatggagctcaactttgggtcatgcttccgtgtatggattccttgagccacaatcgatacacaatgcaaaggatcgacgtgctgaatgtgagcattacttacaagcatggctcaaggaatcgcaacgagaggtgtacctagaagcttacttaaatcagggccattggcaactggtagtattgtgtcctgcgaccaatgttgttgcatggttttgttcgttacatgttgatcatgctattattataagcagtgcaatgaagtcaacaaacacaactgcggatggtacaaataatccagcaactcctaagtggattgaagtcaagagccatgttcaaagcggagggtatgagtgtggctactacgtgatgcattggatgtggaacatcgtcagtgggggtttaaagaatgattggagcatgtggtttcttgatggaacgacgttagacaacgaaacaattacaacgattcgccagaaatgggcagcatatttccttaaagttcaaagcaatcaatgtacaaagtcttag

SEQ ID NO: 110088 - DNA, 489 bp, Glycine max
  Peptide Sequence Number=SeqID_226866
atgagtaggagggcgcggcggtcgctgcaaaacccagggcgcgagcccgggcggagcggtcgtcggtgcagatcttggtgcctgcccaccctggaaacggctcagccggaggtagggtccagcggctggaagagcaccgcacgtcgcgtggtgtccggtgcgcccccggcggcccttgaaaatccggaggaccgagtgcctcccacgcccggtcgtactcataaccgcatcaggtctccaaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcggggggacggattgggaacgggcccttcggggcctcttccccgggcgtcgaacagtcaactcagaactggtacggacaaggggaatccgactgtttaa

SEQ ID NO: 110089 - DNA, 123 bp, Glycine max
  Peptide Sequence Number=SeqID_226867
atggctcgcccagctataatgggagccatattagctatgaagatagctcataaaaagggttggagaagtctgtggcttgaatgtgactctactttggtggtgcaatcgttcaagatcgtctag

SEQ ID NO: 110090 - DNA, 1401 bp, Glycine max
  Peptide Sequence Number=SeqID_226868
gttgttaactttggtttccagtggttgaggtggctttgcgattataaagttatggcacgtgttgctaataaaattaagttgatagatggatcaagggaagctcttaagctttctataaggatcactgatctttggttcattgggattcccaaaaagtctgaacaagccgaaatgggagatgaaatccatgttgtttgcaaacaggatcagctgaagtctcgcaaggttggtttgaaggaaaatttgacttatgtgatgcataattttaaagttatgaagaatgacgggaaattcagagtttgtgatcatgaatataaattatgttttactagagttactgttgttaggcaatttgatatggaacacttaccttttaggaaattcaaatttgttgatttttctagtgtcattgctggtcattttcaaactggactcttggttgatgttattggcgtggttgatgaagtggtattccgatatgtgtcatcgaaaaatacgagggttgttttcaaattaaaggatttgagtggacaggtgctatcctgcacactttgggaaaattactgcttacagtttttgtcttatttgaatgaggttgaagatgaaaggccgattgttattcttttgacacatgccaggattaaggaagcgcagggatcatatccgccgtcggtcactaattctttcaaggcatctaaactcatgattaacaaccttgtgctggaaattcaagaatttagagagagccttttagatttagggatcgaggttagatcggttttgacgcctattggacaagcgagttcacaggttttagggtcatctcaattatcatcaaaagatgcatttctgtcaaaggctgaagtgaaaaatatctctcagattaatgccatttccgaggaaattgtttgtgtaactgtcgacaagattacaactatagtgatggacaactattcatggtgctatccggcttgcggtcaatgttataaaaaagctgacatagaaactgtgccgttcacatgtccgtgtggcaagagaacgatcaacctgtatagagttgaagtgatggttaatcacaagggtgaacagaccaaattttttatctgggatcgtgaatgtgcacagttaattggtcaatcagcggatgaagtcaacaggctcaaaatagaagatggcgatgttgatttaaatgcctctcctcaagcactagataggctattgggttgtttccttgcattcaaagtgaaggtgcaaccaaggttcaggaattctattgttcttaaatattcagatgaatcagacttggtcaatgctgtcctggatatgcttcccgatagtgagccatgttgcaagatcgagaattcaatacttgagtcgaccgatcctacagagcttgaatct

SEQ ID NO: 110091 - DNA, 207 bp, Glycine max
  Peptide Sequence Number=SeqID_226869
atggttggtgtgttagttatacgtgttcctctacactcacacccgatcaatgttccacgatctcaaaggtgtttcttgaagaagactgttttctccaaactgaaagagaacagatttcctggtgaaattgagttgagggaacttgttgggagaagattagctaatacaagatttgtcagtggtattgaaggtggtgttgggctctag

SEQ ID NO: 110092 - DNA, 273 bp, Glycine max
  Peptide Sequence Number=SeqID_226870
atggcgatcaactcttccaagaatccagatggttctgtccaaaatgcaatgccttcgtatttttattctccaccactagatgtttctgctgcatttccacaagcaacaccagcatcaacgtttcctccttgtgcttcagattattttcaattggacaacttattgacaacagaggagcaagccattaggaagaaatactgggagaaggccaagtttccatttcatgttattccaaagcttggtgcgttgcgcattgctggtggcacaatcaag

SEQ ID NO: 110093 - DNA, 486 bp, Glycine max
  Peptide Sequence Number=SeqID_226871
atgccttttggtcaaaatgaaagtttaagatttattattaaaaaggatgctcctggtttaacagtcacaaaaatagagaataaaattggactcaggattgtacaaaatggagacattgttatgaggaaagtttttgtccctgacgaggacagaattgcaggagtaaactcttttcaggacacaaacaaggtacttgctgtttcacgcgtaatggttgcttggcaacccattggtatatcgatgggcatctacgatatgtgtcacaggtacctaatggagaggaaacaatttggagcaccattagcagctttccaaatcagccagcagaaacttgttcagatgcttggtaatattcaagctatgatacttgttggttggcgcctctgcaaattgtatgagagtggtaaaatgactccaggtcaagctagcttgggaaaggtagtttctaacttatgtcatagttgtaaccccggctttctttcttaa

SEQ ID NO: 110094 - DNA, 261 bp, Glycine max
  Peptide Sequence Number=SeqID_226872
atggcattccaacaagccttgttacatacactggtggcatacaaaaattacacttgttccggttggtgtgtattcattgttggtggtcctggtcctattgcaaactgcagacccctacgctgcccggtttgtagaacaaaagcaacttgggttgccgctagtgctgccgcttcctgtttcaccgtaacatcaagcttatcgataccgtcgacctcgagggggggcccggtaccagcttttgttccctttagtgagggttaa

SEQ ID NO: 110095 - DNA, 414 bp, Glycine max
  Peptide Sequence Number=SeqID_226873
atgaaaacggtatcgtttcgaagggacaacacagggacagcttggaaagggactgcagagaagccaagtcgcttgagatacctgacctgttttccatactctaaacttagaatcctttggtattataaggcatctgcttacctattctctgaagtcaaagacctcaagctctacgtgtgtcatggacttgccgacatcgaaatggaagagttcacgaagaactgcaagggaatgaataagctctcatgtagatcatgcacgttcagatccaacggcatgaacctagtgctcaacaatcacactacgctaaagaagctctctatctctagaggtgggtatgcagacctattcgacctatttaaggcgagtctagaagtccacattttataccaaccgattaaacccgctagataa

SEQ ID NO: 110096 - DNA, 186 bp, Glycine max
  Peptide Sequence Number=SeqID_226874
atgaagcaaggtcggcgcgaagatgagcaatacaaagaggggttgaaggtgaggcgacaattccggtcgcgcagggaggttgagatggagatgagagcagggacgagcagtagtattcttgggtcgacggtgagaggtagagtggcaaaaggagaagatgtccttacccattgtgattgtgaataa

SEQ ID NO: 110097 - DNA, 444 bp, Glycine max
  Peptide Sequence Number=SeqID_226875
atgactattgcgcaattcatcaagcacttagaaatcgtggagaagacagttctggtttggcatttggagaggaaggaaccacaggcatattggtttaaggtggagtttcttctgcagtggcaacacatgaagggaatttcctggctttggaaacttccattagctggaaatcgaaaatgcaagagtattttaagatttaccgcatcaaactttaggacaaagaaaatgtttccaggccttgaaggttttcccaatcatactgaaaatgctactgatgtacaggatgggatggataggctatcaaaattacttgacggcataagttttgtgcacaacgaagcggttcctatatctataaactatagactgcttgatgatcaaagaggaagtgaggttttgacatggttttctcaacaacgatcatggaggcatacttggagatga

SEQ ID NO: 110098 - DNA, 321 bp, Glycine max
  Peptide Sequence Number=SeqID_226876
atggaaatgattacccgtattaacgagtatttaacatgtgaacagacaaacacatttggtcattatgctttatataatatactagtctgtaaccgatgcacatgcacggattgtttgcataatcagatatcaccaactgaaactcggcaagaatcagagaatggcaaggtggtggaatcttgggatgtgtgtaaatcaaaggggagggagaagaagaagaagaagaagggggatgaaggggatgcgcctaaggctgggtgttgggtcaggttgaggttcattggaagctacatttcttcaagatccaaggttgatacctga

SEQ ID NO: 110099 - DNA, 477 bp, Glycine max
  Peptide Sequence Number=SeqID_226877
acttcatacatgctgcctgcagacctaagccagatgtggatgcctaatgttcctaatatgaatgaagtgaacttgagtcttcccaacaacatgggatcaatggtttcaaatgtgtatgaaaccaacttgagtcatcccaactacatgggatcaatggtttcaaatgtgtatgaaaccaacttgagtcatcccaactacataggaccaatgactccaaacatggatggaatgaacttgaatcttcctaactacacaggatcaatggctccttcagatatgaatgcaatgcaatttagtcttcccaacaacatgggacaaatggttccaatcatggatgaaacaaacttgaatcttcccaatttcatgggatcaatggctccagaaatgaatgaaatgaactttagtcttcccagcaacataggatcaatggcaccaaatcctccaagtggaactttcccaaatccgaaccttgattag

SEQ ID NO: 110100 - DNA, 288 bp, Glycine max
  Peptide Sequence Number=SeqID_226878
atgggagttgccaatgggagttgcaacttgcactcaaatcgcaagttgcagctgcaactcccctttaggcctgtagctgggcaactcgccactacgagtggcgttttccgtgccacgtggcgttttcccagcaaactcgccactaggagtggcggtttgctatattatccatgcaaaggacgtagaaaagagccccctcatgggcggggaaaggtttctaacacgggtgtactacaaccttgctcctttcacacatgggtggagttaacacagtcaagcttctactaa

SEQ ID NO: 110101 - DNA, 444 bp, Glycine max
  Peptide Sequence Number=SeqID_226879
atggttgcctctaaaccccccttgatccccattttgtcatttcaaagtttgcaaaagactttctatagggatgctcctggaactagtaactctactcctcaaaatgaaaataacaggttagagaatcctgcagatataaatccagctcttgttgcttccgagtctactccaaaactaatagtggatcaaactcaggcaaaaagccctgatgccgatcttaaaaaattacggagaatggagtctaatcggctttcatcccgaagatcgtggatgaagaagttgatatatttgaccaatttggaaaatcaagatcaattagctcaacttcgaccacaaattgcttcccatgaatcccagaaacaattcttaatgctagaaaaacagacactgctccagagaatggaaattcttgagaaagagataaacttcagagagtgtaattaa

SEQ ID NO: 110102 - DNA, 432 bp, Glycine max
  Peptide Sequence Number=SeqID_226880
atggaggccatgatagagcaaatgaccacaatgatggaagtcatgatgagtatgagaaaaatgatggaggtcaacacgactacagtcattgtcataagtaccaccactgaggtggacctgactcacccatttggcctcaatcatagcaagcattccttcccaccatatggcttgcctcccaactatacaccacctaatgttgcacatgctcccgatgagaatgtcgacaactctgctcccatacccattgagtgccaacattcccaatctagccatgcacaggtccctcaacccatgggggagacacatgaagtaccccaagacaacactctagccgacttcaagcctcaccttgaatatgctactgaagggcaagcatttggtggtgtacccccgccaaacacttcggggggccctcagtatcacccataa

SEQ ID NO: 110103 - DNA, 516 bp, Glycine max
  Peptide Sequence Number=SeqID_226881
atggacatgcagtctgacaacaacctgatgagtgcttctcaagatacctcaaccactctggacgaccagtttggtctagccccgcaatcgcagggtttatatgacagacgccacgagaaagatagctgtggcgtgggctttgttgcccatattaaaggccagaaaagccatgacattgttgccaaaggcctgcaactactggacaacctgacgcaccgtggtgcgaccggttacgaccctaaactgggtgacggcgctggcctgctgatgcaaatgcctgacactttcatgcgcgaagaggcggccaagctgggcatgaccctgcccgcagcgggccaatatgcagtaggccaggccttcttgccacaaaacgcagacaaccgtgcaaaatgcgaagccatttttgcgcaaatcatcgctgaagaaaatcaaaccctgctgggctggcgcgatgtgcctgtcgacaacagcaacattgctgatgccgcacgtgccgttgaaccggtcatgcgccag

SEQ ID NO: 110104 - DNA, 501 bp, Glycine max
  Peptide Sequence Number=SeqID_226882
atgacaactctgggtaaagtcatcggcggcggattaccagtcggtgcctttggtggccgcaaggacattatgagcgtactggctccgctaggtccggtttaccaggcgggtacattgtcgggtaacccggtggcagtcactgcaggcctcacgaccttgaaattggttcaagcaccaggcttctatgaaaaactaacagcgcaaacaacaaaactcatggatggtttcaagcaggcagcacaagctgccggtgtcgcgttcagtgcacaaagtgtaggcgggatgttcggcctgtacttcagcgcccaatgcccaagtagttacgcggaaatgatgctggcagacaaaaatgccttcaatacatttttccatagcatgctggatagcggcatttaccttggcccatccgcgttcgaagcaggctttgtctcggcagcgcatactgatgcggacattgcacaaaccgtgcaagccgctactaaagcatttgctgcactttaa

SEQ ID NO: 110105 - DNA, 560 bp, Glycine max
  Peptide Sequence Number=SeqID_226883
gcattccatcgcgcgcatccgggggcgtccatcgagctgaaggtgggcgtgacggcggacctgctgcgccagcaggcgcgcggcaagctcgacgtggtcttcggcaagcagtgctcgcgcgtgcgcgacgagggcgaactgctgtgggaagaggaactggtgtgggcctggggcgaagacaaggcctggctgcccggcgaacgcgtgccgctggcggtgttccccgaaccctgtgtctaccgcgaagccgcgatcgcggcgctgggcaaggcgcggcgggcgtggtcgccggcgttcgaaagcggcagcatggccggctgcctggcggccgcgcaggccggtttcgcggtggccccggtggcgcgcagccagctgcggccagggctgcgggcgctgtcgcgcgaagaaggcatgccggcgctgccgaatgcgcgcttctatgccttcgcgcgttcggccgagccggtggcgcgggcgctggtggcggcggtgcggcagaccggccagcggcgccgcttcgccggctgagccacggccttgcgttccctcaatcgccctga

SEQ ID NO: 110106 - DNA, 306 bp, Glycine max
  Peptide Sequence Number=SeqID_226884
atgggtcattggggtgataagggtattttcatgggtttaccttggtatcgtgttcatactgttgtattaaatgatccaggccgtttgctttctgttcatataatgcacacagctctggttgctggttgggccggttcgatggctctatatgaattagcagtttttgatccctctgaccctgttcttgacccaatgtggagacagggtatgttcgttatacctttcatgactcgtttaggaataaccaattcgtggggcggttggaatatcacaggagggactataacgaatccgggtatttggtag

SEQ ID NO: 110107 - DNA, 363 bp, Glycine max
  Peptide Sequence Number=SeqID_226885
atgcccatcgctagcaaaaccagaaatatgcttgaaggtctgataaaagaaggatcattgaaatggttgcttggcaagaagagttactttggtgaagaatttgaagagatggaaaattctccttctgctgggaagaactttatacgagagctctctcctgttgcaaacctagttgttcgtagatgctcaaaaatccttaggacctcttcaagtgatcttctggagagcttcaatcaagaggcttctgattctatgaagcatccatcacgatatgcgaggaactttttggaatattgttgtttcaaaacccggttaggacttatcttcgaagaccatggaagcaatattcaagaacaattttaa

SEQ ID NO: 110108 - DNA, 276 bp, Glycine max
  Peptide Sequence Number=SeqID_226886
gtatcagtaacaactcatgtgattgcaaatattttagattctttgttttcaaaaggttttggaatatctcctgaaaaccaaaaagaagatggaaccctcaatacatctagagatgcaagtgggacaggcatgggagagggtgtcggattaaagggtgtaagtgatcagattgctaatgaaggtcagctgctgggaacacaagaacaacaaaaagaaaagcaagattactccaatgaagtgccaagtagcaataatacagggattgagatggaatag

SEQ ID NO: 110109 - DNA, 387 bp, Glycine max
  Peptide Sequence Number=SeqID_226887
atgcccaccaccttgcccccgagttcctcctctagcatgcctcccttgtcgcctccttctcccatcaatttgtttacaaaatcacaaaacatactaatcatgccactaccatctttaagcttgttgcctaaagtagatgacgaagcaattcttaagacagacatggatggattaacggggacatttgctatcacagtgggtgtggttggtgatgtatgtagaggcttcgaggagaaaagtggtgcagaactcgctgcagatatatatgctgctgatgacaatatgacagaatacactaattgtttgacaaatggaattctagaggcatactcagggatcttagaaggatttaaaggttccccaaagacccaatttctaatgtcttaa

SEQ ID NO: 110110 - DNA, 604 bp, Glycine max
  Peptide Sequence Number=SeqID_226888
cttctcctcctccaccgtcacccaccctcccaccccacaagagcttcagtacatcacagcaatccttgcacgtaccactgccctaaactcacagggtacccccactacagtttccttaaaccagcccctcgacccatcaatcttccaccacctcgaacaccccgccggcgacaaagatcgcaactttgccccgaaagaccaactgggtcaccgttggaatcggagattactgttcgatttggttgacgaggttctgagggagattctggagtctcaagagggagagagagaaaagaggcccgggaggagcgttgaagggttggtgaagagggtgtggaagagggttgaggagttcccacgtgccaagtgtgaggtgttggaggacattgatgagttgattgacctgcagagagagaaagatggtgagagaatggaagaagaaggggaagaactggttgcagagattgaagggaacatatgggacacgttagtccatgaaacggttatagttatggattgttgggaaaatgctaaaaaagaaaaattattactatatgatgattccaaaatatcatcacatgtttgcagtctcagtcaattttaa

SEQ ID NO: 110111 - DNA, 456 bp, Glycine max
  Peptide Sequence Number=SeqID_226889
gtgaggacatgtagtcctcggaaggtgagggcgtgtagccctacgaaggcgagggtgtgtagccctctaaaggcgagggtgtgtagccctctaaaggcgagggcttgtagccctctgaaggcgaggacgagcagccctctaaagacgagggtactagtacccaagattgactgtccttttgaaagaggtgataattcatgcagtcttatcctatcttttgcaaatctctccgggaactccctcagagtggaaccaattgggtgggaacttctaatctgccccctaggtttacttgaggctcatgcacgatgccccttactgccccagtataaggctttgagttggtggattaagtcaaatgactcctatgtagaagcaagatgttttgatgttttgatgatgccaaaggatcaagtgcttctaagttttattcaagacaagaatccaagaaaataa

SEQ ID NO: 110112 - DNA, 561 bp, Glycine max
  Peptide Sequence Number=SeqID_226890
gggtccagaagaccaagggcaaggccagctaagactccttctacatcggcagctcctcatccagcttctacatcagcagctcctcctccagctcgtattgcagcaactccttctaccccacctcctggagagtttcaacatttcaaagccatgcttcgaagcatacatcaagggcagattattttgctgcaaacctggccagggactcagcctcctcttcacagggacgacgaggatcccgccgctcaggtaccacatcagccattagatgagtcatcagagtcttccacccctaagcccttgatcaggaagaggagggtagttgtaactcaggaagccgcagccactcctgaaaagtcccctgaggccactccagagcctccagtaccaatggcaaataccacttctccacagcaagcagcagatccttcaacgcctgaagttcaaaccaccccagtcctgtctccgaacacctctcttgtagctactcctgtactgcatttgactaacgaggaggaggttcagacacaggacacccaggaccaatcacaggatctttaa

SEQ ID NO: 110113 - DNA, 354 bp, Glycine max
  Peptide Sequence Number=SeqID_226891
atggcacatcaggttccttttgcaggtgtagctgatttagatgatgaggggtctgcagatttaaggacaaatcctcttcaagaaggaggggatgatgcaatccttccaaggaggggacccatcaccagagtcatggctaggagactccaggaagattgggccaaggatgcaggagatgaccctaggattctcatgagccataggctaaggctccatagtgtagggagggtaaaaaagaggctaagtcatgaagtgcaaaaagtgacagttgagcttagctcaacaattgggctaagcgtgcatccaccgctaagttcagcttcaacgcacttagcgcgaaggagaatccggtag

SEQ ID NO: 110114 - DNA, 453 bp, Glycine max
  Peptide Sequence Number=SeqID_226892
atggaactccaacgaattaatcaaaatgaagaaaccgacaaaaagaaaagaagtatagcacttaaagcctcttcatcaatgcaagaagaagaaaatgaagaagaagaatcagaagatgaagaagacttctcactctttgtgaagaagtttaaaaaatttgtcaagaagagaagaatcgagaggcgtcaaaacttcaacaatggaagaagatttcaagaagactctcaaattcttagatgctacaaatgcaaccaacttggtcacataaaagcgaattgtccctcaaatgaggaatggcctgagaaaagtgataagaaaaggtatgaagaaagaagaaccaagaaggcctacattgcattggatgacaatgacttatctgatggttcagagaaggagatcaaccttctaaccaaggactatgagagtgatgagaacatctctcaagaagattaa

SEQ ID NO: 110115 - DNA, 423 bp, Glycine max
  Peptide Sequence Number=SeqID_226893
atgtcgacacggagggagaacaccaccctcaaaatgactgggatactcaacaccaacgaccaccatgatcgcagaacacagtctcccaacgcggaggaagaagatgacgctcacgacgggaacgcggcacggaggatcgaggtgaccgaaatcacttcacgcctgcaaaaagaagaaaaaatggtgaggggcttatgggctatcctcgcgggtcttgctggttcagtcgctgttgctatcctctcctcgagggtctctgctactatcaataccccctcctccagaaaccaccttgtcctcaaggtggtgacgtggaagtatcaagtttggagtccaggatgcaaagtggtcgtgggaccgggcattggctcacaacttgaagaggccatggtgtcgaaacggacggtggtggaccgtgatgag

SEQ ID NO: 110116 - DNA, 280 bp, Glycine max
  Peptide Sequence Number=SeqID_226894
atgaaggctgagtgtcctcagttgaagaagaaaagatattttggtgacaagaaaaagaaaagtatgatggtaacctgggatgactcaaacggtaacaagagtagcagtttagacgatgaacaagccaacatctatctgatggtagatacaaacgaaaagattgaggtaaaaacttgttttgaatctgatacttcttctagcacttcattagatgatgaagaagatatgccttatgatgttcttcttcagaattgtcatatgatttctcttcaatgcaaac

SEQ ID NO: 110117 - DNA, 1332 bp, Glycine max
  Peptide Sequence Number=SeqID_226895
atgacaaacccgtggctaagcgagtgctgtctcgctaagcccaggtaccttagacagggtcgcccctgtgggctaagcgctattcgttgcggcatgcataaggctaagccagcgctgctcgctaagccattatacactgacaacattctcagccagaatatccttccggagagaaatgtgaagctttatcatattgagttcgacgagttcaaggtggagttggagaggcataatttgcacaaatgcctcgccaatgtccaggatggaagcatagacgtggctttagttaaggaattttatgctaatttatacaccacagaggaccaagctccaaagcaagctagagtaagaggacacctgatcaaaatagatgtagacaggctgaatgaattccttcaaactccagtggtgttagaggagggggaatctttacccaactactctagattttgcagattaaggactaaccaccaagagattgaagccaggctttgtattccccgcaagggagctaggttggtctatggcttggtaaccaacatggacatgaacattggagcccttatctcaggtcagatttcttctatttctcagagtaactcctctaggctcagatctctagccttgatcactgccctaagcagagctagaggagttacctctgacaatctgacctatgagagcctgagcccggccattaacttggcctacattaagaaaaattgttggaatatggatgatctaacagttaacttcaaaggggcaaagaaggaaaaggttcgaccagctgaggttcctttttcttctactctaccagctccttccacttctgctactcttacaccagctccttcagactcatctactcaagactctcagtgctttgagtccatgcttcagagtcttcataaaggacagattttgttaatgcaaagcttgcaggttgtagctcctccaggatccattctgacagtggagcagtttttagagaaggtatcccggccaggaaccctgccttctcttgagagagaaggtgggggtcccagtgctcaagaggttgctactacagagagatcaccacagatttcaccagatccaccctctccagtggtggatcaatcttctcttcaacagccagcagaccctcctacactagtgcatgagattccagcagacccgtctacactattacttgatcttccagaggacccttctacaccagtcctgggattgactaccactcctccggccactcctatgctatgtcttacaaatgaggaggacactcaggatgaggatactcagtcacaggacctgtcacaggaattttaa

SEQ ID NO: 110118 - DNA, 597 bp, Glycine max
  Peptide Sequence Number=SeqID_226896
caataacattgatcaattcattgctaagggaacatccctcacgaagccactaggcttcataggaaacgactatctgtactggaaagacaaaagggagatgtacatcaagtccattcaatacatactctcgttgattattacaaatggagacatactcattcctaaaccagaagcagaagggacatacattgatcttgctataatagagcttaacacaaaagctcgttatactttgacatgtgctttatcaaaaaatgagtacaataagatttgtagattggagacaaccaaagagatatgggactcagaaggagaatatgtggatgacatgtttagaagacttcaagtacttctatacatacttgaagctctgggatacacctttactaaagctcagataaatttaaagatcctagacaacttttccaagttcatattcaaaattgagatcatttgccaaaaagattttgctgccctcaagtctggtgagactagatccagacgagaagaaaagaagagctcttctaaagctcttaaagtgttgatggctaagtttgatggttcaaacaatagttctggagattcccagatgatgaa

SEQ ID NO: 110119 - DNA, 288 bp, Glycine max
  Peptide Sequence Number=SeqID_226897
atgttcctcgacctaaagcccactgaaggaggagcagttgcctttggaggcatgggtaaaggaaagattatgggtataggtttctgtatttcttatatcaaaagtgatcatggaactaagtttgagaatgctgagttcagatcattctgtgaaaagaatggcagtttccacaacttctcctcatcgagaattccccaacaaaatggggtagttgaaaggaaaaatataactctacaagaaatgactgggaccatgctctgtgagaacttacttcctaagcacttctag

SEQ ID NO: 110120 - DNA, 329 bp, Glycine max
  Peptide Sequence Number=SeqID_226898
gttcctacactttgggaaagctatctaagatcttcagattaattcaagctttagtaaaggtttgtcctagagcttcaagtccatttagaagaacttgtaatcccccaaacatattgtcgcaacgtgcccttcgcgggcgagcaaaggcgaggctcacgggtgcgctttccaaaggaggaaagatgcgcggagttgccaccaacgaaggtattagcacctcttacgtcgacaaaagcggggcttttgctcctacgtaccctcctttggagaggaaatcagacctacgtagttctttcttatgcatgaatcaagcaattctttttacttga

SEQ ID NO: 110121 - DNA, 519 bp, Glycine max
  Peptide Sequence Number=SeqID_226899
atgaaacgacatgagtttctgtgggagccttacatagcaatggttatgtcagcgttgcctccaatttgtctggttggaagtgtagcgtggtgcgtggtggtgccactcatttgtttccaagttgttgagtggcaccaacccgatagagttttgagacaatttggaatgcaacaacctattccagggtgtccttcgcaaccccagaatattcatggcggcctattgagttttaactccgactacatgatcgagtataggcaaaaaacgaagatgttcgttgatcctaaggatgcaaacacagctacattgagaatcactaagcctgtgtcacatggtccaccaccagagcatgaatttgcaccacaagagtttcatattctttcgtcaagtgttgaaactcaaggcataggcagacgaagggaggctatagaagtggaaccatatttctacccacagatggaaaaccatggccatggaatgtattacacaccaccaacattttctcagtatccgacatag

SEQ ID NO: 110122 - DNA, 549 bp, Glycine max
  Peptide Sequence Number=SeqID_226900
atggcggatttaggggagaaaggaaagagggaggtggaggaggacgatgaggactcgtccgagttacatgacttagtggctcacttgggtgagggagggacaagggagagaagcaaggtgcagagcttagtgagcttgatgcggaagaggaagatgcgacggaggaagaaggtttcaggcggcagcggcagtggcagcgactcctcgtctccgctggggaaggataagcttatatttatggttcataatgcatcatcacctgcccgcaatgatgaagtgtttctcggtgtccttagcctctttatgggttctccttgctctcttttctctgaggaatggagccaccatgttcactgggaatttgatcgagcaaggaccaatcattacgtgccacgtggtcaacaagtgctgaaggttggagcccaagagcgaagggagcttgtgtttgtgcaagtgcaacatcgttcttggacaaaggctctgctcccatttttctacttctcactcttttcttgtctaataatgtgtgttgatgctattgatatgtga

SEQ ID NO: 110123 - DNA, 249 bp, Glycine max
  Peptide Sequence Number=SeqID_226901
atgagatttcggatgttagcgttcattcctaaacgaccatttagaggaaacactgggcccgacagaatagaagaatatcactcgaagtgtaccaatctcacacagggcagggtttgtggtaagttgggattttggctcaaggcttgtagaacggctggacatgatatatgtcaggatgttggtttggccagcggctcagggaaaaaggagaagtcccacattatttccatgatacacatgcaacactga

SEQ ID NO: 110124 - DNA, 216 bp, Glycine max
  Peptide Sequence Number=SeqID_226902
atgaccacattggcctctgcttgtcaatcgaacttggggtctccgaatgacgaggtgcggataaccgaaaggtgtctccgcatgctaccagactcttgggtcatgatagcaaaaggtggggtggtcgacaaaagcgaggcttttgctcctacgtatcctccatttgtgatgaacaactcagacctacgtagttctttcttttgtgagactaaatag

SEQ ID NO: 110125 - DNA, 1128 bp, Glycine max
  Peptide Sequence Number=SeqID_226903
atgagcaccattttgattgttctcgctgctatgctggccggcgcattggttgcaggatggatctacaggcgtcgcgtacagcgccgttaccgtctgccctttttgaatgcttttgcgggtgcgagcacgcgtaagcttacacaagacgagcgcgatgcggttgaaaactatcttgaaatactgaaccgttctcagctgacccctgggccgacgggagccactgctgcgcccgttgcgctaaagcttaatgcgcaaagcgataccgtactttgcgtgacgcgctccattacgcggtatggcatcaccaccgacgatcccaacaaatggcgctattaccttgattctgtcgaagtgcatctgcccccgtcctgggagcaatacattaatgacgaaaacagcgttgagctgatccataccgattcattgcccctggttatctcactgaacggccacacgctgaatgagtaccttcaggaagccccgcgttttgcgcttgagcgcgcaagttcgacgcaggcctccatccgtggcgaagagactgagcagatcgagctgctgaacattcgccaggagacgcatgaagagtatgccctgagccgcccggacggcattcgtgaagccgttctgatcgtcgccgccttcctgctcttttttgtctgcctgctgacgccggatgtgtttgtcccctggctggccggtggtgcggtgctgctgctggctgccgggctgtggggactgttcgccccgcctgccaaaacctcgctgcgagagatccactgtctgcgcggtacgcccaagcgctggggtctgtttggtgaaaacgatcaggaacatctcaacaatatctcgctcggtattattgaccttatctacccgcgtcactggcaaccgtggattgcgcaggacttaggtcagaaaaccgatattgatatctaccttgaccgccacgttgtgcgccagggacgcttcttatccctgcatgatgaacgcggtcattgccggcggcgctgcgctggtctttatcatgttgctgcttttcgtgccgctggatatgcccatcaaattcaccctgtcgtggataaaaggggcgcaaaccatcgaagcgaccagcgtcaatcaactggatga

SEQ ID NO: 110126 - DNA, 291 bp, Glycine max
  Peptide Sequence Number=SeqID_226904
atgtcagatttaggaggactaggcaaagtagtggcacctcctagtgttaccctagttggtttcaaccaagtttttcaaaataacccattttcttcaaaaagtttgtacatgccaccaaaagttgaagcagtgaaggccaagcttgctgcattggaagggtccaacaatctattgttaaagatgactagacgagtaaaattctgcataagaataatgcgatgggtggtagtggttcttcctattcttctagttcagacaaagacaacctggaggagtgtcagatgctgttag

SEQ ID NO: 110127 - DNA, 338 bp, Glycine max
  Peptide Sequence Number=SeqID_226905
cacaacaacttagtcccgtactatcaaggactttagaatcagaccagttcccactgttgaatgaccctaacaaagcatgcatctacgtgatcaaggatctcacaatcactcacaaactcatctcaatctctcaaaacggcttccgcttcgaactcgtgtctctgcagatcttcacacaacaaaatctctcaaaactctctggaactaagacctttctctctctagaacttcctaaacatgcaaaagcttcaagccaaggtcagactctcatgcatgcagaggcttcttcaagagcaatgccaaactccttttgcaaatctgatttcaggcttaaatag

SEQ ID NO: 110128 - DNA, 585 bp, Glycine max
  Peptide Sequence Number=SeqID_226906
atgaacttaatcattgttaccgaaagaaaagaacacactttacggcgcccttaccgaacttgtgctagagctagagtaatgagtgaagtagaggaggtgcaagaacagatcaaggctgacatggaggccatgaaagagaaaatggccacaatgatggcggccaatatgagcatgaaggagataatggaggtcaatgcggctgcattgctgagggacgacccccatgatgtgcaaattcaaaacaaacacgccttcccgccatatggcctgcctcccaactgtacaccacccaatgtggcgtacactcccagtgagaatacacatgaaattccccaccacaatctagccgacttcgagccttgcctcggatatgccactggagggcaagcagttggtggtatacccatgccaaacactttggatggccctcagtttcgcccacaaccacaacccttgcattttgtggagggaagagcccctcctgctatggctgaaaagggaaagctggatcacatagaggaaaggctcaaggacattgaaggaggagaagattgtgccttcgctaacctagaagagttgttcctg

SEQ ID NO: 110129 - DNA, 533 bp, Glycine max
  Peptide Sequence Number=SeqID_226907
cgttaggtgtggcaaagccttcagtagctagttaccttagccaggagatactggcagagcaagaagttgatagagtgcatggattacctgcgcagcctccggtgaagttcaagaatatggtggttatatcactgtcaatgaaactcaaggaagagcactgttctattggtttttcgaggccactcacaaaccagaacaaaaacccgttctcttatggctcaatggaggctgatagtagttatttcacaagctcccttccttcttcctccctctcccccccaagctcctttcctccttcgcctccgcctcctccgctccctttcccttcaaacgaatgtttcttcatgtcggactcagccaacaagttgcgagctgatctggaaaatgtgagattttccacttcgaattcgaagtatcctgacgagggatcttcaaatggctattctagtaattatatggaatctttggtattatcacattttatggctattccagctgaagcattatattctgaaacatggtgcgaatgtcat

SEQ ID NO: 110130 - DNA, 372 bp, Glycine max
  Peptide Sequence Number=SeqID_226908
atgttccgtgtccctagaaaaattagctcgcaacaagcacgcgcactgacaacaatgtgtgacgtcatggaggttatgcccagagcattgtgtcccaacgtccttcagcacaaggttcctttaagcacttcacctagccatctgctcccccgaacacaaggttcaagatcatcacaagatccaaacacaaacaacaaaccgggagtgaggtcactttcactaagtaagatcatagggagaccagtcagggtcacgatgttttgcgagaatgctccaaccatatgggatcagcataggcttaaagaagcactcaaacctgatgacccccaaggcctacactccgaagagtctatcagggcctctccctcctga

SEQ ID NO: 110131 - DNA, 888 bp, Glycine max
  Peptide Sequence Number=SeqID_226909
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcggaaggctcatacgcaggtttcacgtgaaacggccgggattccgtatgtcccgacactctgtccttccggtgcgataccagcaccgatcgttctggcgggatatcgaggcaggtccgagtgacgccaatccctaccccgttccgagagcagcctgcctcgacgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 110132 - DNA, 699 bp, Glycine max
  Peptide Sequence Number=SeqID_226910
atgccacaatctccctatatttcctatttttttccttcttcaggtggttttgatggtggagaggttgagaagattcctgggttcgatttcgtagactggttaaagaacacggtttcggagaatgatttcgttgtgatgaagatggatgtggagggtactgagtttgatttgattccaagattgtttgaaactagggctatctgtttggtggatgagatttttcttgagtgccattacaataggtggcagaggtgttgccctggacagaggagtcccaagtatgagaaaacttatgatcagtgcttgcagctcttcacttctctcagacaaagtggagttcttgttcatcaatggacccaaaccgccagaaccagtggcgagtttggtgtccttgagcaaatcgccagcaccaatggcgatacgtgcatgcagagacgaaaccgccagtccaaatggcgatacggtttgcgctttgggaaccgccagtcaaactggcgagttccatggcctgaggctgcagggctacgtccctgccatggcagtgtagtgcagatgcaggtgcaggcaaaaccgctattaccattggcggtttgccttgcacagggattgccaagaaaacgctattaccattggcgggttgcattccgtttgaattttttttgcccctcttccattataaaagcagaagaagcttcgtga

SEQ ID NO: 110133 - DNA, 228 bp, Glycine max
  Peptide Sequence Number=SeqID_226911
atggatatatataggtggaacacttctgaaaggtttatctcaatatgtacagtgcacagaatgggaaagaactggaagaaaggaaatattacattcaaagcttttgatgcaaaacataagagtggaggtggtggtttcatcattgtggaaggtttccataatgttctcagaagtttgagcaccttagcggtacaagcttcattgtatggaatgagttctggcaagtga

SEQ ID NO: 110134 - DNA, 667 bp, Glycine max
  Peptide Sequence Number=SeqID_226912
acaatttaagtctgatttgacgtcgaaatgggtacttgcagccgacaaggaaagtgtcgatgacactgtatgtgaaaagtacgacattagcaaggagaagtggacccaattttgtcagacccgcagagacccttcgtgggaggccatccaaaagcaaaacactttccctcacgtgttgtctcgtgggggttatgcatatttagaaaacaagttgatgaatgagaagagaaagaaaaaactagaggaagttgctcaatccagaagcactgacaccgtgattgatcctccatctcccatcagaagacacgtgaaatggaagatggcccacaccaagaaaactgggcaaatgacgtctgaggcagcaaaggaaattgttgacaagattgatgtactgactgctgccattgggcaaccaaaacaccctggtcatgtgcatgctgttggagtcggtgtcacgatcaagcaatactttagactggctccaaggacctcccgcacatcttcctccatggctcccgaagacctggagcaccagatgcagtcccagtttcagtctcagatgcaatcacaaggacttgaactgcctcctgagcccgaggttggtccttcagctgctcgtgtcagcacaaaggagacttgtgttgatccatcagggaacgatccttag

SEQ ID NO: 110135 - DNA, 144 bp, Glycine max
  Peptide Sequence Number=SeqID_226913
atgccaagaccagacaaacccaattggcctacgatgcattcgcgctcagcgccacacctcgcgcttagcgcgttcagatcgcgcgctgggcgcgccatgcacgctgagcctgtgcttctgttggatcgggcgctgggcgcctag

SEQ ID NO: 110136 - DNA, 186 bp, Glycine max
  Peptide Sequence Number=SeqID_226914
atgttggtggcgtcgagctcttcgaatctgggaagccatggggaagcggtggatgcagaaaaatcgtgtggagaaacgagccagttggaggacaagctgtgggaatgggaatttgagagtggaaaaggccatgcttatgcttcaacttcgagcttaagggtatacatgatgttgaggataaactaa

SEQ ID NO: 110137 - DNA, 807 bp, Glycine max
  Peptide Sequence Number=SeqID_226915
atgtttggcttgttaatgtgggttcattctgaactgtgggatgccccaatatatcaaaataaagaagaagaaaataagcactatgaaaagggaatgcaattgcaaagagtgagacagtatctgatggtggatgatatgactgcagattttatcattagtcagcttttgtttttggatgctgaagactccaagaaagacattaagttatttataaattcacctggtggttctgtaactgctggaatgggaatttacgatgccatgaagttgtgcaaggcagatgtgtcaactgtttgccttgggcttgctgcatccatgggtgcatttattcttgcttctggtacaaaaggcaagaggtattgtatgccgaattcaagagttatgatccatcagccacttggaactgctggtggaaaagctacagaaatgagcattcgaataagagaaatggcatatcacaagattaagataaacaagatactatcaagaattacagggaaacctgaagagcagattgaattggacactgatcgtgataattttatgaatccttgggaagctaaggaatatggtttagttgatggtgttattgatgatggaaaaccaggattggttgcaccaattggagatgcatctccgccaccaaaaactcgggtatgggatcagtggaaaattgaaggaagccggaaagcgaagaaaaatttaccctcagagcacaagtttttgcagaatgcatccaaaggaagccagggaagtgatggtgataagggcactgtacaagaaggcgaaacacccgttgctgtataa

SEQ ID NO: 110138 - DNA, 237 bp, Glycine max
  Peptide Sequence Number=SeqID_226916
atggaaatgaggtggtgcagtttggtgcaattaatagacaatttcaccaacaagaaaggaatgaccagccactgctataggattgcatataggtctatggaacgttcactcactgatgaggaaataaacgatctgcagttaccaacacttgttttaccccttgtcaatgcagtggaaagtaagagaacaggtgcagagcaaattgaatgttgtcttaagatgagctataaatgttga

SEQ ID NO: 110139 - DNA, 450 bp, Glycine max
  Peptide Sequence Number=SeqID_226917
atggaagctacaaatctgggatgctgcaagctttcatgggggtcagtgatttccaagaacgttaacctaacaagccagaagcgtatggttagaaggaggtgcgaaagtggggatggttgggggagattggttgatgagggcatgatagtgctgcgttggcgtataaaggagatgaagaggatggaggaggcgaatcaagaggttccttctcattggatggagtgggagaagcagtactatgctcattattatgaccaacatgtttttcatgccatggagttattgcagtcttatttgatgagcctcaggctcagacccattgtagcattaggggtgttagtccttgtatctttgagtgtgctcatgtgttccggggtgggcttctttcatgccctagaggtagcaaatagcctcgtatcttacttttactcatcaagggaattaatataa

SEQ ID NO: 110140 - DNA, 216 bp, Glycine max
  Peptide Sequence Number=SeqID_226918
atgacccaagggctggtagcccgcggagacaccttacggttatccgcacctcatcattcagtgaccccaagtgtgattgatgagcagaggccaatgtggtcgtctgcgccctttccggagatgtctgagttcctcattggaggatacgtagagcaagagccttgcttttgtcagccgccccacaatctctgtcatactgaccttgaggtcatgtga

SEQ ID NO: 110141 - DNA, 396 bp, Glycine max
  Peptide Sequence Number=SeqID_226919
atggctgctgcttctctcccttctttcttctccgtacaagcaagaggaccatatctcaaattcaaaagaagcaatatacgtcgagggccgcaaataataaaagttcaaaactatcaagatgaagggagatccaccaacatagatgcgaatttaaatgttctaaagaagaggatagagatggtgagggtgaaggagagattggaaaggtgttgcaaatctcaacatggttggaattatgtcccagtttctgaccacagaataaccaaaggatcaaacaaagaggagttcagcttaattgagttcacaggtctagtttgtgggactcttggtcttacttgttttggtggaacactcttcatttaccttgtttccctggttgttcatctgcaattatga

SEQ ID NO: 110142 - DNA, 600 bp, Glycine max
  Peptide Sequence Number=SeqID_226920
atggatgagcaaattatgtcatctcctaatatattggtacagtgtcgaatatgccacgatgaggatgaagagtccaacatggacacaccttgttcttgttgtggcacattgaagcaactcaagcccggctatactgcacctccattgcctcctctattacattatggtggttctccaataaattttggatggaactgggagatttcaagaagggattttcaaaaccaccagttcatagcgatgtttaatgctaatcgtgaattcctagaccttgactttgcatattcatcagcaccttctacaagaagcttgatatttttccgcattattgccattatttttattgttcttcttcttttacgccttacacttccaatcatatttatactcagtggagcaagagcatattcattggctgtgtttatgctagtagtgttgagaatcattggaatgattgtaccagtatatataatggttaaagctattattgcaatgcaacagtttcaatatcagacactcgatattcagcattcccctatgcaagcacacgaggaaaatgaaataggacaatctcagttgcgtgtcattcatattcagtga

SEQ ID NO: 110143 - DNA, 384 bp, Glycine max
  Peptide Sequence Number=SeqID_226921
atggagaggagggtcgcgaggctgcggaggggagggggagggggaggtagtgtgaagtggaagggatggggagggaggaaggagaaggtggaggccaggagaagaagaaagctcaggaaacaagaaggagaaggacaagaaagaaaaagaaaaacgaagtgcaccttggcagaagagaaaaaaaaagcaaatagggtacaccatttgaggaaaactacccatgtgagttacagacaaaagggaatagagcctagcaacataaggccatgccattattggaagctattgatttggaggttgatgttccagaaggaaaacaacagttcaagagttggaggggccatattgtggaagttgcattgtgggatgaataatttctattaa

SEQ ID NO: 110144 - DNA, 528 bp, Glycine max
  Peptide Sequence Number=SeqID_226922
atggccctcgaaaacctagagcagctgacgcaacaaatcagggaccagctggaggagtcgatcacagaaaaagtaactcaacagctaatgttttccttcagccacatgcaatcccagtttcagtcacagatacaatcacaaggactcgcactgcctcctgagcctgaggttggtcctttagctgctcgtgtcagcataaatgagagttatgttgattcctcagggaacgatcgacacacgggtgactcaaacaaatgcgggttgtacatcaaagacaatcctccctgcctggtttccctaggaagactttatgagggatccacaaccgttcacaacattcatttgttgcatgatcaaatcaaggttggtgttgagggggttagagatgcagatgttctcattcctgtacccactaaagagggagttgtgggacccgtgaaacctgcagataggccggatcatgatgtcgatgatcctttatatctgatgacattgaccatcccacagctttttctgaagtcgttgcag

SEQ ID NO: 110145 - DNA, 225 bp, Glycine max
  Peptide Sequence Number=SeqID_226923
gtaataccagcttttgaagaggctgtttcgggcatggctcttgggggcattagaaggataattgttcccccggaacttggatatcctgagaatgatttcaataagagtggcccaagaccaacaacattctcggtctacttatttacagaggatgagaggatacatgcaaacaactgtcctgtagaaattttgttaatattgatattagatgcttgtgtcaaatga

SEQ ID NO: 110146 - DNA, 740 bp, Glycine max
  Peptide Sequence Number=SeqID_226924
gttgtccagtgtctgaggagattgtcccgtgtcatgggacattgtttgatgttggaggtgtgagaattgcaggtttgtcaagcttttcaagccctccatcttggaaaagtgttgtccgggttgcttttgtcaagttgtctagggtgaacatgcttttggttttgaaagagaggtatgatgtgccagcatgtacgacgcatgcgcaacactcgtgcatacgtgttattcatggaatgggcacatactggagatgtgatgtgtggcgaatcctcttcctcggagaggttgagagtttcgcgtcgtataggtggaggcacttcttgcctccgtgggagggggcggcctttcactgcttcccgaccaaggagcttgtcccggccacggtgattctccctatttttgttactggggagcaaggagaagcagtgaggatgttagggcatccctcccacatgcaatgtagtcatagctttgggtcgccattatccccacctgtcgttgttggctatgagtgggtgagggacgatgttctgaagtataattcctcctttacctctgcgatgagtgtcactgctctgcaatgccacattgagcagtttatggaagtaatgccttccaaggttattttgatgatgccaaagaatcaagagttaagcaaagtttcaagcaaagattcaagaatcaagtttcaagattcaagattcaagaatcaagtttcaagaatcaagaatcaagaataa

SEQ ID NO: 110147 - DNA, 429 bp, Glycine max
  Peptide Sequence Number=SeqID_226925
atgattttgatttctcccaggaccccaagaaaatctctgattcttcttcctcctctggcagcaggagtcaaagttgttgttgcgcgccatcgttccaacgaagaaagatgcttctatcttccgccgccatcgttgccggaaccttgtgcagcaattcagtcagcggagtcagtttggcagctgaattcgccgatatttgtgaatacagtgccagcgcttagagggaaggattatggcaagacaaaaatgcgatacccagactacactgaaactgaatcaggactccaatataaggacttgcgacctgggaatggccccaaacccaagatgggtgagacagtagtggtaatgcacataattgtttctacattttctttatttaattcttttgttacggttgactggttggaaattcgaagtctgatatag

SEQ ID NO: 110148 - DNA, 1092 bp, Glycine max
  Peptide Sequence Number=SeqID_226926
atgtggcattttcacattaatcacaatagtgcagttaatcatgatcaagcatgttattgggttttcctctccgccttagacgaaaatctgaaggatttgttctatgatgagaaacctgggtattttgaatatgcaaaagaaacaactgttgaagcagatgatgcttgcttaacctgtgaagccacattaactaagataaatgctttcctggaagatgctcttcgctcttcatgtgaaggaattatggtgaaaacattggatgttgatgctgggtattctccatcaaagcgttctgacaaatggctaaaagttagtaattgtgctacaggactttggtcactttgtttaagactaaaaaatcaggtcaagcgagattatgtggaaggattaaatgatactcttgatttagtaccgattggtgcttggcatggaaatggaaggaaagctggatgcaattccatgtcctacaaggtttatcaatctcatatagtggtggcattctgggctttgaccaaatgtgcgactgacccaacaaaccagcagtgtgactggacaataaattttcattggagattaggtggtggtggaggcaaaggggctgggcaaatagaaacccctaaattcagtaggggtaatgatgtcatttcatgttcagatgctcagtatagtccatttcttatggcatgtttcaatcctgaaacagaggagtatcaaagtgtatgtcgtgtgatgtctggattctcagattcattttacatagaggaaattgatattgcggtgcagatgaaacaattcttctctggggacaaagtcttgtccaaaaaaccaccatattatcaaacaagagaggcaccagacatgtggttttgtccacaagttgtttgggaaataagaggagcagattttactgtatccccagttcatcatgctgccattggtttagttcatccatctcgaggcatctcaatcagatttccaagatttattagttgtgtctcagacagaagcccagaagaatgtagcacagctgccgatataggtgaaatgtttcattctcagactcggaagatggatatcacaactggagactga

SEQ ID NO: 110149 - DNA, 1344 bp, Glycine max
  Peptide Sequence Number=SeqID_226927
atgtttccaatgagggtatgggtagctgtggtattcattatgttagtaactactgtggcggccaagcctcgtcgaattcttttggatacggatgttgatcttgatgatgtatttgctcttctctaccttttgaagctcaacagatcagagtttcaattggagggagtcacaatcaatgcaaatgcttggactaatgtcggacatgctgtgaatcaagtttatgacatactttacatgatggggagagatgacatagcagttggaatgggaggtgagggtggaatactcccagacggtaccattctcccaaatgtgggtggatatctttcaattatagaacaaggaatgacaacgacaggaggctgcagatacagacaggccattccaataggccatagagggatcttggatattgatactatttatggcatccgaaaagctttccttccacaggggataaggaaatatactcccttaggacaaccaactgctcaacaagtgttgattgacaaaatatctgcaggtcctataactttgattgtgataggagtgcaaacaaatatagctatttttctcatgaacaatccacacttgaagaaaaatgtacaacatatttacataatgggcggtgctgtgaggtcaacagacccaactagttgttgccccaaaaatgcatccttttcttgcattcctgggcagtgtggtgaccgtggcaatgtattcacaaattatgaagcgaacccttatgcagagttcaatatatttggtgacccttttgcagcataccaggtgattcattctggtatacctgttacccttgttcctcttgatgcaacaaacacaatccccatcaatgaagaattctttaatgaatttgaaaaaagtcaagacacatatgaagcacaatattgtttcaagtccttgaaaatggctaaaatggctcgtgataagcttgacaaccaattctatacgagttattttatgtgggactctttcgcatctggtgtagcggtctcaagcatgagaaactccaataaaaaaaataaaagggaaaacgaatttgctcatatggagtacatgaacataactgtaattacttcgaacaaaccttatgggatatctgatggctccaacccattttttgatggcctcaaagttcctaaattcaatctaaagaaaggcggggtgcatagtggtcatgttcaacaagggcttagagataaattttgttttgtgaagaatgggaaagggagatgtcaggacggttatacagctgaggtggatggtcctgactcggtgaaggtacttgtcgccactaaagcaaagcctaacaggacgttagga

SEQ ID NO: 110150 - DNA, 786 bp, Glycine max
  Peptide Sequence Number=SeqID_226928
atgaagtttgagacttctcagaatactgatcaccttgaactcagacaaccactggctatggaaatttgggagtctataatgcaaacactggaaccagaatctaaaattacagtattaaccaatggacccttaactactttggcaaaggttgtatcaatgaaaaacataagctcaagaattgaggaggtttatgtaatggggggacacatcagcaggaatgtctgtgacaaaggaaatatattttctgttccttccaaccaatatgcagaatttaatatgttcctggatcctttagcagccaagacagtgtttcaatcagaagttaacatcacactcattccactcagtgtccaacagaaagcaagttcattttcacatatgttatgctggttgcgtaggatagaacaaacacctgaaactgtgttttccaagcgtgtgctattaaggctacaacgtctgaagcaaatccaccacagatatcaccatatggacacattcttaggggaaattctaggtgccattgtcctagctgacggcccttcatctctaaaagaaaaatttgagatcaagggcattaaagtgttggccgaaggagacgagtccatcgatggagaaatggtggtggatgaggaacatgggaaattggtgagaattttaagccatgtgaatgccaaggcttatcatgaaaagtattcaaagaggctcggtgactggaaccaatcggctaaggtaggaagctttgaagatcaaataaggaaatggagtcatccacattctttattataa

SEQ ID NO: 110151 - DNA, 237 bp, Glycine max
  Peptide Sequence Number=SeqID_226929
atggcatcacttgttgacgatctggagggcgcttgcagggacaatgcagaggttagagccaacgctgacggaggaatcggcagaggcgttgatcttggtgcaggggaggaaggcgacagcgtactggaggtcaagcatctcgccgtggagcttgttggtgtcgacaaggacgaggtcaacgatgagaagaagattaaatttgttgttgttgcaaatgtagaagagaagggaagatga

SEQ ID NO: 110152 - DNA, 228 bp, Glycine max
  Peptide Sequence Number=SeqID_226930
atgcaatgttgttaccataaaaactatggtcacaccatcaaggagtatgttgcccttaaaggtagaattgaagaattaatacaagaagaaaccctcaataactatatctacaaccctaacaacaacagaggtggttatagaggtcgagggaagggtcaaggaggcaacaaaggcggtcagggacaaaacgatcaagagaaggacatgaacaaggagaagtcaaactag

SEQ ID NO: 110153 - DNA, 381 bp, Glycine max
  Peptide Sequence Number=SeqID_226931
atgtgtgaaaaattgactgcactgaatctgcttctccttgtttttctcccctttcccttgttgtcagctacaatggtgtttgttagacagttgtcttatgttaaagatcagaatggtgttgacttcaaaaaagttgatgctcatgtgcaccagttaaagggtagcagttcaagcataggcgcgcaaagggtgaaaaatgcctgcattgctttccgcaacttctgtgaggagcagaacacagatgcgtgcctcagatgtctgcaacaagtgaaacaagagtactgcatagtcaagaataagcttgaaacaatgttcaggcttgagcaacagattgtggcagctggtggatcaatccctacggaactgagtttcattgggtga

SEQ ID NO: 110154 - DNA, 561 bp, Glycine max
  Peptide Sequence Number=SeqID_226932
atgtctggcattactgaatatgttgaaagggacatatatgaatacattgagaagcataaagacatagaatttgttaattttgttgatctagtaggaagtgagtgtgcttctcaagcaatgacagcaggcataagattgagagaaggtagccacataaatcacagtttactgagccttgaaactctaattcggaaactaagtatacctctgaggtcatataatgtggggtactgcatggtgtgtgaagctaatctgaaaatattggaaggggtaactgacattgacttggtggtcaatctgaagctccaagaagaagcactgcttgcaaaatgccttggtagaagaatttgtaatcaatgtggaggaaattttaatattgcctccattagcatcaagggtgagaatgggcgtcctggaatggtcatggctccacttcttcctcctgcacactgtatgtcaaagctcattactcggtcagatgatactaaagcagtagtcaaagaaaggcttcgtatatacaatgaaaaggaacagatgatttctgtgagaattgctgattga

SEQ ID NO: 110155 - DNA, 216 bp, Glycine max
  Peptide Sequence Number=SeqID_226933
atggcatacggttctgtgtgcctctgtcgccgacgggtgacaggggaaagagagaacggagaggagaataaggaaaggagcttgggtcaagacacgatgagaggtacagtgatgccacggcgggagcttgggtcaacagagggcgcgaggttcaatcggggttatgagctcgagaggtccaaaggtcctattttaattattaaacctaaaaattaa

SEQ ID NO: 110156 - DNA, 240 bp, Glycine max
  Peptide Sequence Number=SeqID_226934
atggcctccaagttagaccattcacctatcttactgcttgatgcaaattctaggagatttttccgttggaacaacgttattgaaggagatgttattcacagattggaatcatgttcaaagcatatgcaggcttggaatagtcaggttcgtgccacttactgtaaaagaagatggaaaaattatatgaggcttttgatgaagattcaacttctcgttatttttccattagtgagaaattga

SEQ ID NO: 110157 - DNA, 1122 bp, Glycine max
  Peptide Sequence Number=SeqID_226935
atgataattgaacatgattccaatgagctatgcgcaagtcatccagttaggcagttacttgataagcattttgatgataaccaaccactaggtcatacttttgaaggctctgcttcaactctgtacaacaatgcttttaatagctcagatatgacacagttggattatcatccattcagtttaaatcaagatatggatcacaaaccagaaggtttgattggtcagttggatttatatcaggacctcaggcacaacacagaaatgaaaaactcagaatcaactcaatttagtttagaaggttttgattgtagccaattctttgaagctgatgacaatgtgcagcatggagagaatattatacctaacattcttccaaatatctgccctccaccttctgctttcttagccccgaaatgtgccttatgggactgtttcagacctgctcaaggggtagaatggtgccagaactactgtagtagttgtcatgagctgttggcaaataatgagggtcttccaggcatgaccccaattttgcgacctgggggaattggtgtaaaagatggtcctttgtttgatgctgttcttgctaagacgcagggaaaggaagtgggcatccctagttgtgaaggtgctgcttcaactaaatccccttggaatgctccagagttctttgatctttcttttcttgagggtgaaactgtcagggagtggctcttctttgacaagcctagaagggcatttgaaagtggaaataggaaacagagatcacttccggattacagtgggcgtggttggcatgaatcaaggaagcaggtgatgaaggaacatggggggcaaaagaggtcctattacatggacccccagccacttagttatctcgagtggcatttgtacgagtacgagatcaacaaccaggatggttgtgcattatacagactagaattaaagcttgtggataaaaagaaaagtcctaaaggaaaagtgaccaaggaatctcttactgatttacagaacaagatgggacagcttactgctgctgttccgtcaactgatgatggttatggacaaccagtcaagggaaaaacaaagaccaagtctgagaatgatgaatctcccaaataa

SEQ ID NO: 110158 - DNA, 449 bp, Glycine max
  Peptide Sequence Number=SeqID_226936
gtgctaaaggattacccactgacaaggttctaacatgggcagtggaatttgaacccacgttcgaaggtatgatgagagaaagttccaagggcgtgggtggatcttcttctcttcaatccatgaaggaaaaggaaaaacacctggtggaaaagattcaagggattttcaacagtcttcagtgtgcaagaaaggagggcaggggtaatgacatggtgatctttgaggagcagatgcatcagttgctccgagagtggaaggcggaactggaatctccggccaactccttagctgatggaagctttggttcatttcccagcgaactagcccaaatgttgctagggagtgaggataaagatgatgctactagtccattaacaaaacctgtgccattgaagaatgagatccatacaaataacattagtgacggcaattttcagttttttcaggag

SEQ ID NO: 110159 - DNA, 483 bp, Glycine max
  Peptide Sequence Number=SeqID_226937
atgctaatgccacaaaatggtggcagtcgtggtgatgtccatgttgaggataaccaaaacatgtcctttccgtggtgggagggaacctttatgaggtgcttcactgcaataaatgaaaagcttgctaagaacattgacactgatggatttcatggcggtagcacttctgtatctgtactcaaacagggtgaccaagtaataattggcaatgtgagggattctcgtgcagttctttgcagaagagcacctgacaatcgccttattcctgttcaacttactgttgacttgactccagatattccaacttttcttcctcaatgtcactcaggagaagctatgagaatttttgctgtagaagaagatcctactgtaaacagagtatggatgcctaaaagggactgccctggactggctatggcaagagcctttagaaatttttgcctaaaagactatggtgtcgcctcagtccctgatgtgtcttaa

SEQ ID NO: 110160 - DNA, 1119 bp, Glycine max
  Peptide Sequence Number=SeqID_226938
atgatgttatccactgccaaaggtgcacagtcttacagtgacattagaacagtcaacggtctggtatatcctacatttagggaagcatgttttgcaaaaggctttctaggtagtgatcaagaatttattagtgctttacaggaagctaataattggggtactgcacactacctaagaaaattatttgtcaagcttttatttttgaacaccatggacagaccaaaatatgtttggcaacagacatggcaatggatgacagatgatatcatattcaatcatagaaaacaaggtattcgccttactaaaaaggaaacaattcatttatgcttaactaagattgagaatatgctacaagcgaacagaaggagcttgcgagattttccatccatgccatacccaataggatatgcacgaaaccaacatcataataatcttatccataatgaaatggcatatgacaaagaaatgttagcagaacaatacaacacgacataccaattgctcacagatgagcaaaaaactattgtcgataccattatgtctgtggttaacactcaatcagttgcagtttactttctctatggatatggtggaactggcaaaacatttgtttggacaaccttatcatctggtatacgctccaatggtggaattgtttgtacagttgcttcgagtggaattgcttcattactattgcctggtggtcagaccgcacattccaaatttgctataccagtccctgcaacagaaaattcaacatgcaatattcatcaaggcagtgagttagctgaattattaaaagttacaaaactaatagtctgggatgaagctccaatgtgtcacaaatttgcatttgaggcactagataaaagtcttaaagacatcatgcaaaacaatctgccttttggagggaaaattatcgtttttggtggagatttccgacagatcttgccaattgttccaaaagaaatcactattccatatgagtttcttataaaaaattatgatgatcctatccatgctattgttgaagccacctatcccagcttgatagataactacagtgacacagattacttgcaaaaaagagttgttcttgcctctaaaagagattgttga

SEQ ID NO: 110161 - DNA, 222 bp, Glycine max
  Peptide Sequence Number=SeqID_226939
atggctctgggttccacctatggggagatcaatctacagagaaaccccacaaagaagggtaataataataatgacaagagtcacccacttctaagcttcttggctcttcgtaggaaaaagaaaacaacagcaaggcctgaatttgcaaggtatcttgagtatctcaaggaaggaggcatgtggaatttgaattccaataaacccgtcaagtattacaaatga

SEQ ID NO: 110162 - DNA, 387 bp, Glycine max
  Peptide Sequence Number=SeqID_226940
atggttgagcttgaatcttgctgtgtgaaagacaaggttttgattgatttacttagtgtaagtaaagaggtgagagcaaaaggggggtctctttttgcatggaagccaccattggctttggcagtaaagcatgacccgccagtggcaatggcgatacaggcgttgacgtggaggatcccaccattggcactaacgatacgcgctgacgtggagaggtgccgctggtcccattggcgagacacgccacgtgaagaggttcccgctatcagcaatggtgatactgacgtggaggaagctctcacctctcccattggcgatactgatgtggaacatttcaaccatgcagtgtttgcagtgttatgcaggctagggttgcagtctttctga

SEQ ID NO: 110163 - DNA, 2923 bp, Glycine max
  Peptide Sequence Number=SeqID_226941
ggaacgcgcctgcagacacccagtggactcggagaagtccaacagggtccaggggtttccagctttgattatgaacctccgtcagttctacggagtgcctgtcacccccagcagggtcatcaggcccctattaacaaggctttcattgagaagtattgtgcccccaggtaggcgtagggcgaggcatcacagtagcgggcaacagatgcactgccaccacctcagctcatctacaaaagctggagtgttgcctacgacatgtggccgaccagtaggcgaccaagtccaaagacaaagagacggcaagtccaatgacatgcggagataccttatggttatccacactttttgtcagctagaggcaagtgagtccgttgacacgaagagactaacgtcattatcaccacctttcttggagatgtcagcgtcttatggccgacactgcgaaaatgtcttctttgctatccatcagactcaaggagacggcaagtccgatgacatgcggaaataccttatggttatccgcaccttttgtcagctagaggcaagcgagcccgttgacatgcggagactaacatcgtcatctgcacctttcccagagatgtcagcgtcttctggccgagattgcgaaaaagtctcattggctatccatcagactcaaggagatagcaagtccgatgacatgtggagataccttattgttatccccaccatttgtcagctagaggcaagcgagcccgttgacacgcagagactaacatcgtcatttgcatcgatcccagagatgtcagcatcttcctgcccagactgtgaaagagtctcgtttgctatccgtcagactcaaggagatagcaagtccaatgacatgcggggataccttatggttatccataccttttttcagctagaggcaagcgagcccgttgatacgcagagactaacgtcgtcatctgcacatttcccggagatgtcaacatcttccggccgagactgcgaaaaagtctcgttggctatccatcaaactcaagggtccggttgcatgcagacactaacgtcgtcatctgcacctttgtcatccagagatggcaagtccgatgacatgcggagataccttatggttatctgcaccttctgtcagctagaggcaagcgagcctattgacacacagagactaacattcgagctcgttgacacgcagagaccaacatcgtcatctgcacctttcctggagatgtcagcgtcttccggccaagactgcaaaaaagtcacattggctatccgtcagaatcaaggagacaacaagtccgatgacatgcggagataccttatggctatccgcaccctttttcagctagaggcaagcgagtccgttgacatgcagagaccaacgtcgtcatctgcatctttcccggagatgtcaacatcttccgaccgagactacaaaaaagtcttgtatgctatccgtcaaactcaaggaaaagtctcatttgctatccgtcagactcaaggagacggcaagtccgatgacatgtggagataccttatggttatccgcaccttttttcagctagaggcaagcgagccccttgacatgcagagactaacatcgtcatctgcacctttctcagagatgtccgatgacatgtggagataccttatggttatccgcaccttttttcaactagaggcaagcgagccccttgacatgcagagactaacatcgttatctggacatttcccgaagatgtcagcatcttctaaccgagactgcgaaaaagtcttgttgaatatccatcagactcaaggagacggcaagtccgatgacatgcggagataccttatggctatccgcaccctttttcagctagaggcaagcgagtccgttgacacgcagagactaacgtcgtcatctgcatctttcccagagatgttagcatcttccatgcgagactgcaaaaaagtcttgtttgctatctgtcagactcaagggtccggtagcatgctgcgactaacatcgtcatctgcacctttgtcatccagagacggcaagtccgatgacatcgagtttattgacacgcagagactaacgtcgtcatctgcacatttcccgaagatgtcagcgtcttctgaccgagactgcgaaaaagtcttgttgactatccgtcaaactcaaggagatggaaagtccgatgacatgcggggatatcttatggttatccgcaccttttgtcagctagaggcaagtgagcccggtgacatgcagagactaacgtcgtcatctgcatctttcccagatggcaagcgtgatgacatgcagagataccttatggttatatgcaccttttgtcagctagaggcaagcaagctcgttgacacgcagagactaacgttgtcatctgcacctttccctaagatgtcagcgtcttccaaccgatactgcaaaaaagtctcatttgctatccgtcagaatcaaggcaagtccgatgacatgcagagataccttctggttatccgaaccttttttcagctagaggcaagcgagccccttgacacgcagagactaacatcgtcatctgcacctttctcggagatagacaacattttcgatgacatgcggagatatcttatggttatctgcaccttttgtcatctagagggaagcgagtccattgacacgcagagactaacatcatcatctgcacctttctcggtgatatgtcagcgtcttccagctgagattgtgaaaaattctctgttgctatccgtcagactcaagagtccgactcaagggtccggtagcatgcggatatactttagggttatccgcatgttttgtcagctagaggcaagcgagcccgttgacacgcagagaccaatgtggttatttgcttccgtctcggagatgtcaacgtcttccgactga

SEQ ID NO: 110164 - DNA, 168 bp, Glycine max
  Peptide Sequence Number=SeqID_226942
atgtcagtaaagaacctcattgggcacctaagagtacatgacaagacaaaccacacattgatggctccgaaaaaactttctgctaagagagctaggaaggacactccaggggaaggatccagtgcagccccacaagcggaaattgagtttgatgggcactgcttctaa

SEQ ID NO: 110165 - DNA, 2211 bp, Glycine max
  Peptide Sequence Number=SeqID_226943
atgaaggaggttatggctgagagaggggggtcatactccaaggttgtcggctttgttccgaccggatggacctatgaagtgaagcggaataggtttgcggtcaagtccaaggatttgttcaagattcatcttgtgccgtatagtgagcactcaaactatgatgagctcagggagtatgtgaagtttttgaagccaaagcgggttgttccgaccgtgggtttggatgttgagaagagtgacagtaaacatgctgacaaaatgaggaagtactttgctaggttggttgatgagactgccaacaagcaggattttttaaggggttttcttcgtgaccctggtgagaagggtgaagcgggtttcaaggctgagaaggttgttagtgatgctcttggaccagggcaagacatggaggaagaagaaatcaatgcattgaagaagacagaaggtgatatgggtattggtccagttgtggctgtgggtttgtcttcttttatggaagaaacttatgcacaagatcctactttgctgaatgatgaagaaaaggagaaaataattcaagaactgactttttgtttgcccacatgggtcacccgaaaccagttgttggatctgatcagcatctcagggagcaatgtcattgaagctgtttctaatttctatgaacgtgaaactgaatttcatgagcaagtgatatcttgtcaaactcctgtttcaacatccaagtgctgctcattaaatggtatggattcacttgcaaaaccatgcctcaatacaaacaacactggcaaaaatattgacatttttccaagtcaagactctaaattaactaacctgaggcatacagtgcctagtcccatttctcctgccaaaaggaagagaagtactgacagtaagcaaaacaaaaaagccaaagtcaaagcaaaatctgaaccaagtggttcaaagcaggccacaattacaagattcttcagtaaagtaatacctgagatgcctggtggtactcaatctgataattctgaaccaaagcttgaccaaagctctaaagttgaagacttgttgccaactgatgatggacaaatgtacaaggatgaaattgatcaatttatgcaaataataaatgggactgagtcattaaaaaaatatgccatcactataattgagaagacaaaaggtgatatcaataaggcattggacatatattacggtaattctgaaaatcttggtgaaaagcaaatatcagttcaagtggagagcaaaattgatagacctgtagtgaagaagcatgcatcagaggaattgagaattgtacctgatatttttgaccagaaagtcttgaaagataatgtagatgctactcacttatctctaccacctgagaaatacaaccctaaagagcatgcgtgttggaaagatggacagcctgcaccatatttacatattgcaagaaccttcaacctgcttgagggtgagaaaggaaggattaaagctacatcattgctatgcaatatgttcagaagtttgttggccttatctccagcagatgtgcttcctgctgtgtatctatgcactaacaaaattgctgcagaccatgaaaataaggaactgaatattggtggaagtttagtcactgcagcacttgaagaggcatgtggaacaaatcgattgaaaataagggagatgtttaacaaatttggtgatcttggtgatgttgcacaagagtgtcgtcaaacacagagattgcttgcaccacctacaccacttctaattaaggatgttttctctgcactacaaaagataagtgtacaaacaggcagtcgaagcacatctcggaagaaaggcatcattgttcatctcatgcgttcctgccgtgagaaggagatgaagtttcttgttcggaccttggtcaggaacctaaggattggggcaatgcttagaactgttttgcctgcattggctcatgctgttgctatgaattcttgccctactttgcaccaagaaggaactgcagaaaatataaaggagaaactacaggttctttctatggcagttgttgaagcatataacatactgccaaatttagatctcatagttccatctctcatgaacaaaggcattgatttttcagtttcaagtttatcaatggttccaggaatccctattaagcctatgctagcaaagtatatactgttccatatattggccatttcttga

SEQ ID NO: 110166 - DNA, 720 bp, Glycine max
  Peptide Sequence Number=SeqID_226944
atgataaagaggaggttctacaagctcgatcacggtgatagagaggccttggatccgtcttcttcttcttcttcggactccgagattgaagccgaagccgaagtcgatgcctctgaagaagaatcagaggaagatgtaacagcagaagtgaaaccgaatgatgatgaagctggttcaacttcttctgggtatgcaagtgaggatggttctgccagtgatgttgatgtcaactcagcaggtctgttatttagtgaagatgatgctggagctataaatgaaagacaagtgcttattaacagggagttgctgattaaatgtgatactgaaaagtctaatgtcttggctgaaaagaaatccttaccgacagatacgccatcctgtgtcttaaaatgcaaatcagtatttaagtgcaagatatgtccccgaattatctgtttgtctgaggagactttgcgggatcatctgcaatcaaagagacatgctcgatctgaaaaactacttagtgaaggtagactgaaggctatgctcaacagtgatggtgaaattgataatcaagagatctcagagatccaaactaaagatactgaggataatgctgagaagaatcacaaaagaaaaaatcagcataaaaagagattgagaaagaagaaaagtgacaaagcaaacacaaggaaaatactgtcaacaaaaggagcagccaagagagggcgaaacaaatga

SEQ ID NO: 110167 - DNA, 533 bp, Glycine max
  Peptide Sequence Number=SeqID_226945
gtggtgtcgagaaacaccgcatcggcaccgacgaagggggcgagggcgggttcggaaaccatggaattacaaaagcgaaaatcgccggtgtggacgtacctgagggcggcggcatcggcggtggcacgggggacggagaagaggaactggacggcgccggggcagtggttggcgtcgaggagggtgacatgggcgccgtcgatgcggagaggctgccggagggggagggggacgatgaatgcggcggggatgtgaagaatgcggcggaggagggcggcggtggtgtgggagcagaagatgacgccgcgggaccaggatggggagaggccggagtagtggtcggaatggaagtgggagaggaagtaggagtgggagtgggggccggcgtggcggaaggcgtcgacgaggaagcgggtgtgggggatgagtttggagtgagggatggaagaggggagtggggggagggagggtgtgggaggggcttcggattggagggttttgagggcggtgaggtagagtttggtggagtctag

SEQ ID NO: 110168 - DNA, 1170 bp, Glycine max
  Peptide Sequence Number=SeqID_226946
atggaagaaggttcagagacaggaaagtggggatggatgaaaaggaggagagcaatgagggaagagctgaagaaggtgggtactatagcagctccaatggtggttgcaagtgtgttgcaatatcttttgcaagtggtgtcattggtaatggttggccatcttaaccagctctctctttcaagtgttgctattgcaatctctctcaccaatgtttctgggtttagtgttttgtcagggatggctggtggtttggaaactttatgtggccaagctttcggggcagggcaatatgaaaaatttggacaatatacttacactgccttgggacatgttggtgctgcaatctccttcagcctttgtgtttggtttaatgtgatgttgcttttgtcctttgtgaggtattcctctgcttgtgagaaaacacgcatccctttctccaagaatgctttggttggtgttggagtcttctttcgctttgctgtcccagcagcagtcatggtttgtcttaaatggtgggcctgcgagatacttgttttgctagctggactttttccaaacccaaagttggagacatcagtcctatctatatgcttgacaatctctacattacatttcaccataccttatgggtttggggctgctgctagcactagagtttcgaatgaattaggagctgggaatccacaagcagttcgtgtggctgtttcagcaacgatgttccttgcagtcacagagggtctaattgtaagtgcaacactattcggctgcagacatctcttgggttatgcctatagcgatgatcgtatggttgttcattacgtggctgttatgacccctctgctttgtctctctatttttactgacagcttacaaggagttctttcaggggttgctagaggaagtgggtggcaacatctaggagcctatgtcaatctgggagcattttatctggtaggaattcctgtaggtatcgtacttggctttgttgcacatttaagagcaaagggcctctggattggaatagtcactggctccattgtccaatcgattctcctttcccttgttactgctcttaccaactggaagaaacaggcaatgatggcaagggagagaatatttgatgctaaaccaccagacgaaaatgaatcgaatcacatgacgagtgcttaa

SEQ ID NO: 110169 - DNA, 789 bp, Glycine max
  Peptide Sequence Number=SeqID_226947
atggcaggtgctttggaaactcaatgtgcccaatcatttggaaccgagcagtttcataagcttggaaactatgtcttctgtgcaatactctttctcattttaagcagtgccccaaaatctatcctatggattttcatggataaactgcttgttcttttggggcaagatcatgctatttcactagtagctggaaactactgcatttggctcattcctgcactctttggttatgctgttcttcaagctttgttgagtggtggtcggtcattagagctactagtaatacttgctggtcttttaccaaatcccaaacttgaaacttcagttctatcaatctgccttaaaatttgcaacttgcactatttcattccatatgggaccggtgctgcagtaagtagtcgggtttcaaacgaattaggggcaggaagaccacaggcagctcgagaggctgtttttgctgtaattgttctaacattcacggatgcaattgtctttagctctgttctattttgcttccgtcatgtgctgggatttgcatttagcaatgagatggaagttgtacattctgttgcaaagatagttccagtgctttgtctctctttcagtgtggatggctttctaggagttttgtgtgctctcagttgtgtgttcaatgaatcaagaattgtaagaggaagtagattgcagaagatgggggcaattagcaatcttgtagcatattatgctgtgggaatccctgtgtctctcgtgtttggttttggtcttaatttctatgggaaaggcctttag

SEQ ID NO: 110170 - DNA, 1153 bp, Glycine max
  Peptide Sequence Number=SeqID_226948
gcagaaataccccgtggttatccgtacaaagacaacatctgctcatcctgaccaatgcgtcaggtggcaggcggatatacccaagcgtcaggtggtaggcagatatactgatgtgattatccgtagcaagacaacatctgctgatcctgacccatgcggatatacccatgtgattatccgtaccaagacaacatctgctaatcctgacccaagcgtcagatatacccaagtgattatccgtacaaagacaacatctgctaatgctgacctatgcgtcaggtggcaggtggaaatatcgcaagtggttatccatacaaagacaacatctgctgatcctgacccatgcgtcaggtggcaggcggaaatacccctagtggttatccatacaaagataacatctactgatcctgacccacgtgtcaggtggaaggcagaaataccccgagttgttatccgtacaaagacaacatgtgctcatcctgacccatgcgtcagatatatccaattgattatccgtacaaagacaacatctgttgatcctgacccatgcgacaagtggcaggcagatatacccatatatactcgagtgattatccatacaaagacaacatctgttgatcctaacccatgcgtcagatatacccaagtgattatccgtacaaagacaacatctgctgatcttgacccaagggtcaggcggatatacctaggggtaatccatacaagcacaacatttactaatcctgaccaatgcgtcaggtggcaggcggaaataccccaagtggtcatccatacaaagacaacatctactgatcctgacccatgcgtcaggcaaatatactcagcggtagtccgtacaagcacaacatttgctgatccctacccatgcgtcaggtggcaggcggatatacccaagtcattatccgtacaaagacaacatctactgatcttgacccatgcgtcaggtcaatcaaagaatgagttcaagatgttcaagatagaatcaagaacacttcaagattcaagaggaaagttgaattcaagagtcaagaatcaagatttaagagatcaaggttcaagactcaagattcaagaatcaagaaaaggctattcaagaatcaagaaaaagcttaatcaagataagtatgaaaag

SEQ ID NO: 110171 - DNA, 132 bp, Glycine max
  Peptide Sequence Number=SeqID_226949
aatgtgactagtaatgaaacttgcaatgctgttcatgagaatatcaatattgcatctgatcattttgaagcaaatccaactgatcgagctgcagaatcagaagttgagtacagaacccgatgccaagtttaa

SEQ ID NO: 110172 - DNA, 1350 bp, Glycine max
  Peptide Sequence Number=SeqID_226950
atgaataccatattagacttggaagctttagagattgaagagggctctcctaggagtcaagggtctgaaaccccaagttcaagggccagcacttctgattcggagagtcagggatcttttgctggggcacctaataccaataaccaatggcggggtttctttaaactactcaagaaaggatcacaaatgcctttccaaccttttcacccacttaaaaatgttccaaaactgacaagaagaaaaagcaagaggatcagggaggacctcattccttctctgaattctccagctcttcatgcatcttttgacgctgagtttggctgcttcaaatcttcctggaaaaacttcactctcgccgagatccaagctgcaaccaatgactttagccatgaaaatttgattggggagggaggctatgctgaggtttacttgggcaaattggaggatggaaactttgttgccattaaaaggttgacaagagggtgccaagaagaaatgactgcagatttcttgtctgagcttggcattatagtgcacgtggaccacccaaacatagctagattgattggatatggtgttgaaggaggaatgtttcttgttcttcaattgtctccacatggtagcctgtcatccatactttatggacccagagagaaactgaattggaacctcagatataagattgctttggggactgctgagggccttcgctatctgcatgaggagtgtcaaagaaggatcattcacaaagacatcaaagcttctaatattcttctctcagaggattttgagcctcaggtgcctcatatgcctcacaaatctgattatggaacttcttctgttctaaatcagtttacaatctttattgtttcatctaaatatctgattttgggcttgcaaagtggttgcccgaccaatggactcatcacaccgtctccaaagtggaaggcacattcggtagatgaaaagactgatgtctatgcttatggtgtgctattattggagctcattactggtcgacaagctttggatagctcacagaaaagtctggtgatgtgggcaaaacctttgctaactgcaaataacatcaaagagcttgtggatccagttttggctgatgcttatgatgaagagcagatgaaacttgtatttgatatactaagaggggaagaagagagcttaagaatcatggaagaacgatcgaagtcaaaacttcagaggacatactctgaagaactctttgatgcagaagagtacaactcaacaaagtttttgagtgagagggatcgacacatggagactattctaggctgcagtagctctgttacagacgatgaagagaaaatctag

SEQ ID NO: 110173 - DNA, 207 bp, Glycine max
  Peptide Sequence Number=SeqID_226951
atggaggttgaggaaccttggtggttatggctatcattgcattatcaagtagatatgggagcaagtggtctttgtcattggaataatgacattgttgggtttggtgggaaacttggccgtataggaatgacagtcacagcatgggtttctccctctttctcaccctcttcatttgccccagttttctcagtcgtcctagtaggatga

SEQ ID NO: 110174 - DNA, 675 bp, Glycine max
  Peptide Sequence Number=SeqID_226952
atggtacgtggagacaaatcatggtcatccgctttcctttaccatccagagacaatcaagtccgatggtatgcgaagacaaattatggtcatccgctttcctttgccatccagagacaatcaagttcgatggcgtgcaaagacaaattatggtcattttccccctattgttgaagactacatgtcttttgaccaagactattgcagtctcctttgccatccagagacaagcgagtccattggcatgcagagacaaattatggtcatctgcctccttttgtcgaagactccatgtctttcgactgagactattgcagtctcctttgccatccagagacaagtgagttcattggcatgcagagacaaattatggtcatctgcccccttttgtcgaagactccatgtctttcgattgggactattacaatctccattgccatccagacacaagcgagtctattggcacatagagacaaaaatgttcattttcccctcttgtcgaagactcaatgtctttcgaccgagactattgaagttccctttgtcatctagagacaatcaagtccgatggcatgcagagacaaatattgtcatctgccctcttgtcgaagactcaatgtttttcgaccgagactattgcagtctccctttgtcatccagaggcaatcgagtctga

SEQ ID NO: 110175 - DNA, 455 bp, Glycine max
  Peptide Sequence Number=SeqID_226953
atgccgatctccccctgcgaaagtatcggttggtctatgctgttccgacatagacacccagtggacccggagaagtccaatagggccctggggttttcagctctggttacgggtctctgtcagtcctataggggtcgcgtccacaagacacccagtggacccggagttgtccaacagggccctagggttgctagctctggttatgggtctctatcagtcctacagggtgcatgtccctcccagcaagggatcgcgcccgcaagacacccagtggacccggagaagtccagcagggtcttagggtttccagctctgattacgggcctctgtcagttctacagagtgcctgtcacccccaacaagggcgagacaccacagcagcctgaggatggccggcagtgggcaacagacgcactgccgccacctcaagagcacctcagctcattcacaaaaag

SEQ ID NO: 110176 - DNA, 237 bp, Glycine max
  Peptide Sequence Number=SeqID_226954
atggcgaaatattttgaagaggagttcaagaggaagaatgaagcagacatcagtgataaccgaaaagttctaggaagggcattcctttgtgctaagattgagaaaatcaatatggagctctctaaggaatgtatgaaaacagtgaccaggtgtctcgcagatgcgaagatagacaagagaagcaagctcttctatggttctcgtgaagatgcttgtgtgagaaagcaacatcattaa

SEQ ID NO: 110177 - DNA, 462 bp, Glycine max
  Peptide Sequence Number=SeqID_226955
atgaaatttgctgtaggaatcgatcttgacaatcagaggttgattggtggtgccgcaaagaatcaggctgtctccaacccagaaagcactgtatttgatgcaaagaggttaattggtagaaaatatagtgatcctgttattcaaaaagagaaaatgctgtggccattcaaagttgttgccagtattaatgacaaaccaatgattgttgtcaagtacaaagggcaggagaagcacctttgtgctgaggaagtcttcacaaagatgtgggagattgcagaggcatatttggaaacacctgtaaagaatgctgttgtaacagtgcctgcttatttcaatgattctcagcgaaaagctactgctgctgctattgcatatgaccttgacaagaggactaatttcgttggagagcaaaacattttcatctttgaccttggtggtggtacttctcacgatcaaggataa

SEQ ID NO: 110178 - DNA, 201 bp, Glycine max
  Peptide Sequence Number=SeqID_226956
atggtacacaggatgacgcctcctgatactaatacatttaggattgagtatcgtgtaagaatttcacatgtgtcaacattgcaacgtgatactataaccatgatagagcttcatgaaaaaggacaaatgttacaacacaaaacattagtcagaattacatttcctgaatctgacgtgacaaaaacaactcttgcacaataa

SEQ ID NO: 110179 - DNA, 870 bp, Glycine max
  Peptide Sequence Number=SeqID_226957
atgacgatggtggtgtacgagatgccgaggaagccggccatgataaacgccgccgcgcccatgatggggggcatgatcatgccgccggtggaggcggtggcttccacggcgccggcgaagcgggacgacagcccgatgcttttcatcagtggaatggtgaagtgccgacgagatcaccgccacctgggccgggccgccgcggcggcgtccggcggcggccagcgccagatcgttgaacagcgcggttgcgccgctgacgctgagaaaggcgccgaacagaataaacaccacgatggcggtggaggcggtggacagggtgatgccgaaaatcccctcgctggtcatgaacagccgatacagcaggcgttccaccgagaagcccccgtggccgaaaatgcccatgaagtactgcccgaacagcgcatagaggatggcgaaagtcgccaggccggggatgaaatagccggtggtgcgccgcgcggcttcgaacagcacgccgataccgatcgccgccatcacatagtcggtggcgttggggatgctcttgcgcaccacgtgcagatcgacgtagttaacgtagaaatagccgtagctgaccagcgtcaggatgatgaacagatagtcccagcggttgaaactgcgggtggcgtgccgggccgagaaagggaacaggataaagcccaggatcagaatgccgctcaggaacgtggtgttgcggtagaactcctgcgtgttggacagcgcgttggcgtagatggcataggcggaaatggcgatcgccaggacggttgccagctgccaatagatgccgctcagcggccggttgccggcgccggcttccttgtccagatcgacggcgggctgcggtga

SEQ ID NO: 110180 - DNA, 243 bp, Glycine max
  Peptide Sequence Number=SeqID_226958
atggagcagttaccggcgaaccggagcgaagcaaaaccgttggcggcgccgccgcaagtccttcatcagagcgacgtggacgacgatgacgagaacgtgaatcagctcgatgaatgctcttctctctatcgcttgatgcaggattgcgttgttcgaacaaacaggaattggaaagaatgccaaccagaggtatacgctttgagggaatgttttgaaaagagaaagaacaagcaaggaaagtag

SEQ ID NO: 110181 - DNA, 231 bp, Glycine max
  Peptide Sequence Number=SeqID_226959
atggagaaaaagggagcaaccgtagtggtggaagctctcagacggaggttctatggagggcaatcttgggatagtctaaaaaaagaggtgcaagaagtaattctcaagcctcttcactatggacttcgtaacccattgtccagaggctcttcactatgggaaggtatagggaggaaggattgtacgcagccttacccttgcatatgcaaagaggctgttaatactcaataa

SEQ ID NO: 110182 - DNA, 726 bp, Glycine max
  Peptide Sequence Number=SeqID_226960
atggctgctatgcagtcaacaatgtctgcaaatcacgggatgcatatggaggcttccactccactggacattcgtcccaagtctaaagttgttatcaaaaggtttagaaaattgaactttaagggtcaccacagagcagaattgcgtaaaaacaaatctacaagtgactcaaatggcctcttagttgagtctcaatctggaaggcctattaggattgctacattcaatgttgcaatgttttcacttgcacctgctgtttcagaatttgatgaatgggttgtctccaatcatgagcatgtatcaaacaagaagaatcttcttgcaaagggtgattttccaaagagtatactaaagcaatctccattgcatgcctctttggacaaggctcagaatctttctgcctccaatattctaccacgttcgaatttgaaggtttctatcaatctccctgacaatgagatttcgttggcaaatagtagattgcttgcttcgatggagagaaaagagggtacttcagatacaatcacgggaaatgtttctggcaggcatcaagttccagcaaggtctcctgtgtgctttcctttcgttatgaattactgtgaggacactgagaggttcacatgcagcagaagcatcatggaagttctgagggagattgatgctgatgtgctggccctgcaggatgtgaaggcagaggaagagaaagaacatgaagcctctttctga

SEQ ID NO: 110183 - DNA, 483 bp, Glycine max
  Peptide Sequence Number=SeqID_226961
atgaggggttgtatcaattataatcctgtccttgccataagacaacttggctaccccatgagaggagcatcatcgaaggaaagtatcacgcctttcatcgcacggggtttcagtgaccccaatgcgaggatacttcaaggagtccgcaaagcatggggtgcaatgcaaaggaatgataaagagcttaggggaagcaacaatgggatcatcggcggctatcatagcgaggaagaggctgaaacccctgaggagggtgaggaggtgcaagccttaaaagagaaacttgaaaaggcacaattagtcaaggaaaagttcaaaataatggccatcaaggtcaagaaaaagtgcgataaactgagggacatcaatatagccacgaccaaagctttagaacgggaaacaaagagggcccgaaaggaagaacacggccgaaacaagtttcgaggggctttatggggtagaaacaacgaccttaagctttga

SEQ ID NO: 110184 - DNA, 243 bp, Glycine max
  Peptide Sequence Number=SeqID_226962
atgaattgggagggagactatagcggaggtaaccaggcgactgttgcggagcgacaccaggtgctaggtggtctgcaagtcggagggggactaaattctgaaaattgtttgagttacattgagaaaggagcaagccatgtcattgtcacatcttatgtattcaataatggacaaatggatattggaaggccaaaagatcttgttgaaattgttggaaaagagaggcatgtgttggatcaataa

SEQ ID NO: 110185 - DNA, 1869 bp, Glycine max
  Peptide Sequence Number=SeqID_226963
atgtatgacacaaataccccggtttttaacgcactcttccaaccttcatttagtggtttccatcttctcccatcgagagacctagcacctggtgtcgctccgcaacagtcgcctggttacctccgctatagtctccctcccaattcatgcgatgttgtgtatgtagtgtgtggtttcaattgttggctggtggggggatatgcttcgattgcggctcctttaaccaagctattggcgaaggaccaattccagtggacctctacagctcaacaggcgtttgatgctcttaagcacacccttgccctcgcaatgctcttcagtaaggcgttttcccccaaactgctccgatcttccacatatgtgagagaacttgccgcaatcaccgccggcgtcaagaaatggcgtcaatatctgttaggacattcctttgtcatcttaacagatcatcgaagccttaaagagttaatgtcccaagccatccagacgccggagcagcaaatatacttagctcgtctcctcagtatccttgacaatcccgctgctcaccctcagtatagcaccattgtggacttcatttcgcagaaacaccgaatttggttgcctaagggattcagcttcatccctctgctacttgaggaatttcattccacacctactggtgggcatatgggcattactaagactttggcgagggtaactcagaattttatgtggcaaggtatcaaggatgatgtgcgtagtttcatcctttattgcctgcactgtcagcagaccaaatacaatcaccgcaaaagccccgatctactgtgcccattaccagttctggcacgaccgtgggaagacctgtcattaaacttcattggtggcttgccatcctttcgtgggttctctattattctggttgtagtggatcgtttctcgaagggagtccacttgggaatgctccactcaaaccatacggcttccacagtggctcatctctttttggatattgttgttaaaatccatggcatgcctcacagcttagtcttcgatcgggatcctttgttcctaagcaaattctggcaggagcttttcaaacttttcggcaccaagcttcgaatgagctcagcttatcatccgcaatcggatggtcaaacagaggtcttgaatagggtcaatgaacagtatctgcgatccttcgttcatcaacgaccctcttcgtggggcaaattcctcctttgggctgaatggtcatacaattcctccattcacactactacggagatggcgccgtatgaagttacttttgggaaaccgcctccgcccattcctcattatcttttcggcacttcaaatattgacgccgttgatgatttttttacaagttgtgaagcagtctttgcattagcccggaagaagctccttaaggcccaacagactatgaaacactttgcggatactaagaggcgagaggtccagttcaaggtcggggatatggtgttggttaaactccgtccatggcgtcagaccactgttatcggcacatctcccaaaccattcagtggacatgagcccattatcacccctttggtcttattggctaccaagtgggcttcctccaaagatgggcccgaattacaagtcttggtgcaatggcacggtttgcttcctgaagatacctcttgggaatcttggaccaagctgaaagaggaatatcaccttgaggacaaggtgcttccagatgcggtaggggatgttatgaatcagcaacagagcaaagatgcagcagacaaggagcagaccaacacttacctcagggctaaaaggaaattgcacaaacctcaccatctggaggatttcgtaacctcctttgggaccaaacgctga

SEQ ID NO: 110186 - DNA, 291 bp, Glycine max
  Peptide Sequence Number=SeqID_226964
atgactactcagagagggaatgaaagcttaggtaaagaatctgccaccactgcacttttgcaagagggattcaagaggagcacaagtttacctttgtggggatccaattcttcaagaaaaatggctctgggttccacctatggggacatcaatctacagagaaaccccacaaagaagggaaaaacaaaaaaaccaacagcaaggcctgaatttgcaaggtatcttgagtatctcaagcaaggaggcatgcggaatttgaattccaatgaacccgtcaagtattacaaatga

SEQ ID NO: 110187 - DNA, 1230 bp, Glycine max
  Peptide Sequence Number=SeqID_226965
atgtatgattttgatacagctatgccgacatttactgcaatagcatttgatagattgatagagcctggagcttcaaaacctgcttataaatctgctccggtgccaatgcctgtcccaaagaagattgagaggcgaactagtgaaccaaccataaggaagaagccccgtcctcgtcctcaattaaagccagcactctatgccactcctgaggtgacaccgcttccggatgcaccctcttcgttccctccttctccgtacatcatcaatcacaaacgccgtggcccacgcctgctgaagagttattctgaggccaatgtgcaggccaagcaggagaaccttgacaatgaaaatgctaatgttaagagcaatgatggtgtgattaccagtttagatggtgatctccaagtcactttcaccagcattgaacctgttaaggaggagcaggtgaatggcgtgcatgataccgaccttagtagcagtagcaacaataaaggtgaccttggggaggcacatagggaaagtgaaagtagtggcattcttaatggatcacacttggataaagtagtggctttgaatttggaaagagagggtgagagtgaagacttttttgatccacatgattcaatgagtttaaaaagttgcacagatggtgaggataatactggcacagaccaagcattgaaattcagtgctgctggtggggaattttttgatgcttgggaagagctctcttctgacggtgggactcaaaattcacatcgtgatattgaagctgagttgcgtgaaataaggttgagtctattgatggagatagagaagcggaagcaagttgaagaaacccttgacagcatgcaaagccactgggagagacttgggcaacggttatctcatattggaattgttttgccttcagatcttactgctgagggtgggcagctgagttctgatcctatggaagatgtatgtcagcaactttacattactaggttcatatcaaacactattgggagaggaattgccagggcagaagcagagattgagatggaagctcaattacaatcaaagaactttgagattgctcgactattggaacgtcttcactgttatgagaccatgaatagggagatgtctcagaggaaccaggaagctgtagtacctgctttatggtcattgactgggaatatgaatgacagcggtatatctttaaggctatgtttggattgggggtag

SEQ ID NO: 110188 - DNA, 321 bp, Glycine max
  Peptide Sequence Number=SeqID_226966
atgccagctcaaggagaagataagtcaagaacaagctcaccaccaaaggaagccatggataagagcttgaaggtaggagaagatgagtggagggagagggagagaaggaggacaaaattttatgcttcaaatgagcattgggctaaggtgaagaaagagttaatggattgtgggggtaggttcttgtgccatgtcaatgccagccctttgagggagatgggaaagaccttgtgcatgatggttgttagactattggcaagcataccaattgtcgttataggttacacatttataaaagagttcgtctccacagagacttga

SEQ ID NO: 110189 - DNA, 279 bp, Glycine max
  Peptide Sequence Number=SeqID_226967
atgaagagacaaggatctcaaatggtgatttcctgcttagtatgggtgtggctaggaaatttgttagataaatcaccgtctgaaatgcaaatgatcgatgttgtgggggtagagttaagggatgctcacttttattttgtgagtggatgtcataggttcagaattggtgtcctaggacatggtgcaaggaagggtggggggatgatgttgaaagtagtgcttttagatgcaatggtggttgcaaaaattggtagaggttatctctatgttgtcctttga

SEQ ID NO: 110190 - DNA, 501 bp, Glycine max
  Peptide Sequence Number=SeqID_226968
atggagaagctcgcttcttcttctactgcaactgttgttcccactcaacacttcctttttcaatttcaccaacattctcttttcttcttccccaaaactgcgttttccaccttccaccggaaccgcaccgaaccgctctcactgccatgttgcaaaagcagacaccgtcgcctagaagcattatccagcaaacaggatcaactctgggtcagcgaagaagaattggagctagaattggaagaaggagaagattcgtatttggacggtgatgatgacgacgacgactcgtcgtttttgtcgctcagcgacaagcccgacaggaacatggccatgctcgacgattacgagggcgaggagctcgactttgattacggtcccgaccaccgaagcggttcgtgtttcgccttaggggtatgtggcgttacttgggaagccaaatgttgggaagagtacactggcgaaccaaatgctagggcaaaagttgtcaatagttacagataa

SEQ ID NO: 110191 - DNA, 438 bp, Glycine max
  Peptide Sequence Number=SeqID_226969
atggtgaagaatggaagacttgaagctcaaaaactcaagaaagcatgtgaccaaaaggggattttgagtgttaatcaagtcaaggacaagccaaagcttaagggatttaagaacccattggtccctaagcttcgccatgttacaaaggtgttacaaacatgtggcagcaaggtggtggtgcaaggggaacgtgacaacacggtgttggctggtccaaggatgttacacagagccttagaggttgaggtcacacatgcatgtacctgggtgggagtggacgcgaggcattgtgaagttgcgacaatggtcggtggtggtggtggtggttgtgttgtttggttgcaagctttggaggagagaggtgatgactatggtgttttggttcttgaggataaaggagatggggactattggtgtttggagaaggagaaaggttaa

SEQ ID NO: 110192 - DNA, 324 bp, Glycine max
  Peptide Sequence Number=SeqID_226970
atgaatagggtggtgtatcgtgctcaagaattcctacacaaatggaggaaagccagactgtgtgaatctccacgaatgtctctcagatatgattctggccaagttgtcattgcgactgcaacaaactataagttctttccacatttgaatgaagttgaagccattgctcttagggatgtgattgcatggctccgtgacttggagattaaggatgctataattgatatggattgccaacatatgatgaacaatgtctgtagcaatcatcttgataattcaaaatttaatattttagttttaacggatcaactgtcaactcgataa

SEQ ID NO: 110193 - DNA, 258 bp, Glycine max
  Peptide Sequence Number=SeqID_226971
atggctacagctgaccttcatggggtacaggaaagtatcttggtgttctatcttggtagaagcaaaaaagcaatttttggatgtgagtgggataagtttgaagagggacaacaaagaaggcataaagtggttgagatgggacaagatggcaataaggaaggaacttggctggggtggtctattatgaatgctggtatgaggtttagaaatactaaattttttaatatggctcttcttgaacctcacgaatgctggtga

SEQ ID NO: 110194 - DNA, 573 bp, Glycine max
  Peptide Sequence Number=SeqID_226972
atgccataccattgtaccacctataggcatagagtgacatgcagttctaggctggtaatgagtgacatagtaatggtatggagaaggcttgctagtgcttgctggcaaccagtgtgtagataccaccccatcaatattgttccagtactgcaaatagtgtgtggccgtgtgctattgcctcttgctctatatagatttctcaatgatattgtcagtgagcatccagagagattttttgtagctgaaattgttagagaaaagatttttatgcagtatcgaaatgaaattccatatgcatgtcaggtaaatgttgtaaactataaagctcggccaaatgcaaaagaatacatacaagtagagattttggttgagaaaaacactcagaagattatccttattggaagagaaggaaaggctttgaaactgcttgcaacagctgcccgccttgatgttgaagattttttacagaagaaagtttatcttgagattgaagtgaaggttagagcaaattggcgacaagatgaagggcttcttaatcactatggttatgggggccaaatacgtgttatataa

SEQ ID NO: 110195 - DNA, 690 bp, Glycine max
  Peptide Sequence Number=SeqID_226973
atggacgagtttctcttgaaagctgagaaggccaacgccattcgaagacacaacaacgacattttcgccgtcttttccaaagcccttcgcattctcgaactttgtctcgtccttgttctcctctcgtggatcctcacgcgcctccccttcgcgctcgcactctccgccgagttcctccgccgcctcatcgccttcgccgccagccccctcgtcgtcttcgccgtctccaacgccatcatcgccgccctcctagcccagtcccgccgcctctccgccccccactccgccgactcactctaccgcgagttcctccacacacgcactgccgtcaccgaacctcacgcgcctccgtcaccgccgccgtcaccgccaccgccagagcccgagtttcacgacaagcaggtcatcgtcgagacagtgcatgacgcgccttccgccggagcggccgcgaagtaccgcaggagtcagtcggagaagataaaggtggacgccgccgggaagctgccgcgccggaagcagctgcggcggtcggagaccgagaagaggggcgagtgcttgccggaaattttgtacccgcaggatgagctcagcaatgaggagtttcaacgcgccatagaagcgttcatcgcgaagcaattgaggtttctgcgagaagagtcttccgccattgttgttcagaatccctcgtag

SEQ ID NO: 110196 - DNA, 498 bp, Glycine max
  Peptide Sequence Number=SeqID_226974
gaagatgcacccgcgagtctcatgccgccctcccaccgaagggaagaggtcagaaagcaatttgacgctggcttcttggcagtcgcccgatatccagaatgggtcgctaacattgtgccaatccctaagaaagatgggaagataaagatggcaccggaggacatggaaaaaaagacgtttgtcaccctgtggggaacattctgttacaaggtgatgtcttttgggctcaagaacgtcggggcaacctatcaacgggctatggtagctttattccatgatatgatgaacaaagaaattgaagtctacgtcgttgatatgatcgccaattctaaaactgaggaggagcatctctctggaaaactgctcggctttatcgtaagccagaaaggaatagaggtggaacccgacaaggatcaagcgatgccttatgaatcctctggtgcttgtgccacccgtgcccagaagacccttcattctatacatgattgtgttggatga

SEQ ID NO: 110197 - DNA, 816 bp, Glycine max
  Peptide Sequence Number=SeqID_226975
atgggagagaaagagaagagaaacaagaacaagaagcaaaagcaccaacaccccaatgaccaaagcacaaagcagaactctgatttctccttcaagccaagctcagaggtaaagggtatcaaatttggaggccagttcatagtgaagtccttcacaatcagaagagcaagacccttggagcttctcaaggttctttctttcccaccaaccaacaacaccaacaaaccaaaggacaagctccctttcccttccaccacagcattcttgcccacaaacttcaccatcttggcacaccatgcttggcacaccctcacccttggccttggcaccaagaagtccaaggtgctcctctttgtgtttgaaactgaggccatgaaggcctcagtggacagaatttggccaccagagatagcacttggtgatgtcaacaagaggctcataaggggcctcaatggatgtgagatggcaaggttcaagttcagaaaagggtgcataactttctatgtctatgctgttaggcaagtaggaagctttggcttttcctgtgctgaggatctaagaaccattcttcagtctgttgtggagcttaaggatttcttggatcacactgttatgctttccatgccaaaccaaagaagcatcagttactcacagtcacagtcacaacctcagaggctcttcgctatgcgaaggtatgagagaggaatattcagccttacccttggcatatgcaaagaggctgttttcggattcaaacccatgaccaacaagtcaccaaggcacaactttaccactgcaccaggactcgccctctaa

SEQ ID NO: 110198 - DNA, 342 bp, Glycine max
  Peptide Sequence Number=SeqID_226976
atgaagaagatgaagatggtttggaagaattaccagattgagctgaacgaagagagagaacgctcaacgtcgtcgatcaagacttcgaagttcaacccgacccaaacgcaccgttttagtcgctcggttctctttcccggacctgagtgcccttcaccctgccctctcttgtgtcacgtcccacgtagccaaagtgtgtttcttctctccttgttcttgttcttggtcaaccctaatttgagtttgagtttagggggaaaaggaaacatggaagataagcaaaggcaatcagagatggagagggtgacggtgaatttgtcttcttcctctagtaatgtataa

SEQ ID NO: 110199 - DNA, 174 bp, Glycine max
  Peptide Sequence Number=SeqID_226977
atggcaccgccaagaaaatgcataagagtttgcgagccaggagaagtgaatcagcctatggaccaggtgctggacacaagtcctaggaaacccattgtatggaaagagttaggagttggtagtgaggtggcagttaatcactgtgggagtagcaggagtatagacagagtatga

SEQ ID NO: 110200 - DNA, 747 bp, Glycine max
  Peptide Sequence Number=SeqID_226978
atgagcatatttgaatctctttgctcaacttactttgttccaaatgcatttgtaactttctgtggatacacttctacattctcttcacaatggacacttgagcaggttgtaattattgatgatggaagtgctgatgagacaaaaagagtagcttttgaatttgtgaggaaatacacagtagacaaggtaagggtcatccttctaggaagaaatcatggcaaaggagaagcaatcagaaaaggaatgatgcattcacgtggtgaactacttcttatgcttgatgctgatggagcaactaaagtcactgacctagaaaagcttgaaaatcagattcaagctgttgccaaaagggaatatcaccatggagattcaagtgatagtgatcctagatttagaatatctgatgtcccagctgctgtgtttggctcaagagctcatctagaggagaaagctttagctacaattatgacgaaagcttcaccagacatgtgtggtttcaagatgtttactagggcagcagccaggaagcttttttcaaatgtacgcttaaaaaggtggtgctttgatgttgagttagtctttctatgcaagtggtttagaatcccagtttcagaaatttctgtgaattggtctgaaattccaggatccaaggtgaatcttctgagtatacctaacatgctttgggagcttgtgctcatgtctgtggggtacaggactggtatgtggagaatttctaattctacctga

SEQ ID NO: 110201 - DNA, 477 bp, Glycine max
  Peptide Sequence Number=SeqID_226979
atggcaagaatagcaaaagcgatccagatctcggaacaagagctaaaccgagtgaagcaaaataggaatggggtgatagggataccaagaaagcacttggaggagaaggcagaagctttggcaaataaaagggagtggacctcattcattgacatattagcactattggtgtttggaactatactatttctgaatgtagacgggctagtggacctagcagcgatcgacacctatcttgcttatcaccatagcaagcaaagcctggtcatcaccattttggcagatacatatgatacactcgacttgaggtgcgagaagagcagtgcaagaattatctattgtacgcctactctttatgtgtggttggtctcccatgttttcgtcatgaaggagcgtccattagccggctcccccgatggaaagaaggaggggcaagagtgttatgctcgtgtgaaggattcccaaatgtccccttga

SEQ ID NO: 110202 - DNA, 165 bp, Glycine max
  Peptide Sequence Number=SeqID_226980
atggttcgttgcggcgatggccaacagcagcattggtggaagatgatccctttctcttcttcgacgattctgccatttgatgaagttttagtgaatttcaattggtggaatcgaaagaggagtgaaaatgaggaaaattgggctttacgggacgtgttttggtga

SEQ ID NO: 110203 - DNA, 346 bp, Glycine max
  Peptide Sequence Number=SeqID_226981
atggctgcaccaacaccgattcagaaaactgaagaggagtggaagggtacaggagaatataacaagttttatgaagaaggaatttacaactgtgctggctgtgggactcctctttacaagtcttcaaccaagtttgattctggttgtggttggcctgctttctttgagggttttcccggtgccatcgatcgatcccctgacccagatgggaggaggactgagataacttgtgcagcatgtggtgggcacttgggtcatgttttcaaaggagagggattcaagaccccaactgatgaacgccattgtgtcaatagtatttctgtcaaatttgttccaggaaatgcta

SEQ ID NO: 110204 - DNA, 1407 bp, Glycine max
  Peptide Sequence Number=SeqID_226982
atgggttgtgtccatggcaagtgctgtacccgttacccttcaccctcagtgagtggctctagagacttcagagaacttggaccttactgtgcccaaaggaagcacattctcactcagagtttattgcaatttgttcctgtcccttcccataacttcactttggaatactctgtgctcactcagagagggtactatcctgattcacctgataaagaaaaccaagatagttttagcattaggacacagtttcaaggcaaccccagtgtccatttctttggtgtctacgatggacatggcgaatttggtggccagtgttcaaattttgttaaggataggttggtggaaaatttgtctagtgacattgcattgttggaggaccctgttaaggcctacacctctgcattcctgaccacgaatgatgacttgcataagaatgagattgatgattctttgagtggcaccacggcaattacggtgctggttattgggaacaccctttatgttgctaatgttggtgattctagagcagtgctggctgttaaggacgggaaccgggttgttgcggaggacttgtcttctgatcagacaccatttaggagagatgagtatgagagagtgaagctttgtggggcaagggtgttgagtgttgatcaggtggaagggcataaggatccggatattcagacttggggtgatgaagagagtcagggtgatgatcctcctaggttgtgggttcagaatgggatggttcctggagctgcttttacaaggagtgttggggataagttggctgagactattggtgttattgctgttcctgaggtgtcaacggttcagcttacacctaaccatcttttctttgttgttgcaagtgatggtgtatttgagttcctatccagccaaactgttgttgatatggcagcaagttattcagatcctcgtgatgcatgtgctgccattgctggagagtcttataaactatggttagaacatgagggtcgaacagatgatataacaattatcatagttcagatcaaaggcctgtctaataaatggcttattctgtggatggtcgtagagaagttagctcaggctgttcctattcaggtgtcagttacatctggacatggagcaagtgagatcaatgtcagtactgtaacaaggacaaagagcaagagggtaaagggagcatctgaaatatctgccactactggggcgagccctggtgcagcggtaaagttgtgccttggtgacttgttggtcatgggttcgaatccggaaacagcctctttgcatatgcaagggctttatggaagcttcaccatgtctcctcatactttctccaaggtggttgctggtttaaggtgcattatcttggcagctgaagggacccttttcagaatgtag

SEQ ID NO: 110205 - DNA, 411 bp, Glycine max
  Peptide Sequence Number=SeqID_226983
atgagggcaaagatattagagaatatcataatcatgtctagactcttacgatctttttctcgtatctcttttcactcaaactcctccttatcatcttcttcaagaaactccaatctattaaatgatcaagacaaccagacccaagaggtcgccccaaaacacaatctcttcgatgaggaagtccgattcgaagatatcaatcaaaatatggatgactggaacattccagaaatccctcaggatcaactatacgttcctgagacaataaaagacaaacacaactttgattacataatcaaaacagtagaaaacaatattcctctaggacaagaagtaggggaagaatttcatttactttcaaaaaattcaatttatgaacatagccgtaagtataaatgtgggatcctctag

SEQ ID NO: 110206 - DNA, 995 bp, Glycine max
  Peptide Sequence Number=SeqID_226984
atggcattcgcattctcaggtttcgaaggcttcgagaagaggctggagctccatttctttggcgacgacccaactatcctccaactaggcctcagaaaactctccttcgagtgcatacaacaaaccctagaagcagtccaatgcactgtcgtttcagccgttggaaactcctactttgacgcttatgtgttatcagaatcaagcctctttgtgtacccaacaaagatcatcatcaaaacgtgtggaaccacgcagcttctcaaatccataactcccttaatcttctacgcacagacccatctcggtctcactctctctttatgtcgctacacccgcggaagcttcatctttcctctgtcacaacccttccctcacacgagcttcgaacacgaagttacttacttggaaacaacccttccttcggacctgtgtttcagaaaagcctccatcatgccctcgaaatcctcctcacacgcgtggcacgtgttcaccgccacgaatattcctcatcatcactctcgcgctctttacagcgaaaggcacgcttacaccatggaaatctgcatgaccgacctagaccccgtcctcgcaagaaagtttttccgccgcgccggcgacggaaaaaccggcgactccgccgggaaggagatgacggagatcaccggagttgacgagattaacccgcaggcgcttgtgtgcgatttcgcgttcgacccgtgcgggtactccatgaatggcatagatggggagtggtactccacgattcacgtgacgccggaagacggtggtgcagatattccgaccggggacgatgtcggtctctacgacgtcgttggggagcgagatgtggagagaggtatcgggtgcggtggagcccatgggaatgaagttgaggagctgcgcgatggaccagttcccggattctgggagcgttgtctttcaaacgtttacgccgcttcgccggaaaagtgcacactaggtaggaattggatgag

SEQ ID NO: 110207 - DNA, 396 bp, Glycine max
  Peptide Sequence Number=SeqID_226985
attcaaaggactaaccgcctaagaatcctttgtcctaacacattggagggtacatcctttgtggcacaagtagagggtacatctacttgggttgttatactgagaacaagagagggtacatctcttgtggatcagttcaagtggagggctgaggtagtcagcacaacatgctatcttgtgaatcgctcactatccactgccatagatttaaagactcctattaagttgaaggtgtttggatgtccaacatacttgcacgtaagtgaaggtaagttggagcttagagccaataagggtgtctttatgggctatggaaatggagatttgggtagggctgaggatgtcactaagaaggtggagtttgagaagcccacaattagaaactttagtgattag

SEQ ID NO: 110208 - DNA, 1800 bp, Glycine max
  Peptide Sequence Number=SeqID_226986
atgcgaggccacgattggatcaacacgctgctccccgacgagttactcattgagatcttccgccgcctggactctaagtccaaccgcgacgccagctccctcgtctgcacgcggtggctccgcctcgagcgcctcacacgcgccgccatccgcatcggcgcctccggctcccccgacctcttgatccacctcctcgccgcgcgattctccaacatcaccaccgttcacatcgatgagcgcctctctgtttcaatccccgctcacctcgggagaagacgctcgagcggcaattcctcggtgaagctgcacgacgtgaatgataagcacggctctgcctctgatcagagcgatttggattcactctgtttatctgattctggtttggcttctctcgccgaaggctttcccaagctcgagaagctgaggttaatttggtgttctaacgtcactagcgaggggttgtcatccctagctaggaaatgcacttctttgaaatccttggacttgcagggttgctatgttggagatcaaggtctagctgctattggacagtgttgcaaacaacttgaagatttgaatctgcgtttctgtgaaggtttgactgataatggtttggttgaattagcattgggtgtgggaaatgcgttaaaatctcttggagtagcagcttgtgccaaaataactgacgtttcaatggaagttgtgggatcacagtgcagatcccttgagaccttgtcattggactctgagttcatccataataaaggggtgcttgctgtgattaaaggatgtccacatttgaaagttctaaagctgcaatgtattaatcttacagatgatactctaaatgttgcaggcactagctgcttgtctttggagttattggctttatatagttttcagagatttactgataagggtttgtgtgctattgggaatggatgtaagaagttaaagaacttgactttaagtgattgctatttcctcagtgacaagggtttggaagtaattgctactggctgcaaggaacttactcatcttgaagtgaatggatgccacaatattggaactttggggctagaatctgttggaaaatcctgccaacatctctctgagttagcattgctttactgccaaagaattggtgatgctggtcttgtccaggttggacagggatgcaaattcttgcaagcacttcaattggtagattgttcaagcattggagatgaagccatgtgtggcatagctagtggctgtaggaatctaaagaaacttcatattcgtcgctgttatgaggggatcattgctgttggtgagaagtgtaagttgctaacagatcttagcattcgattttgtgatagagctcttattgctatagctgagggttgttcccttcattatctgaatgttagtggttgccatctaattggagatgctggagtgatagccattgcaagggggtgccctcaactatgttatttggatgtgagtgtattgcagaagttaggtgatatagctatggctgaattgggagaacactgtccattgttgaaagaaatagtactctcacactgtcgacaaataacagatgttgggttagcacatcttgtaaaaggttgctgcacagtgcttgagtcatgccacatggtttattgctctggtgtaacttcagttggagtagcaactgtggtttctagttgtcccaacataaaaaaggttcttgttgaaaagtggaaggttagccaacgtactcagcgtcgagtaggctcagtcatctcctacttgtgcatggacctctag
